United States Patent 7,018,794 (METHODS FOR MONITORING MULTIPLE GENE EXPRESSION) - sequence listing, part 2

SEQ ID NO: 2673 - DNA, 1200 bp, Bacillus licheniformis
atctgtcccggaacagtcatgtcgaatacagtgccgatgaacgggagcttttgattttatgcgcgatgcttgaaacgggagagccgatcaagccttatacaattgcccatgacttgcagtggacggcggccacgatcagcacgattcttgacgagctggagaagtggatcgctccattcggcctctcgctgatcagaaaaagaggctacggtatagagctgagggggccggaggacgccaagcggaaaatcgtcggaaacttgatggccgacaagctcgatgttcagcagtttctggaaacgatcgaaatgaatattaaaggcaagaacgaagcgccggagaaaatattcggtgtcgtcagccgggggaaattgctgaaagcggaaaaagtgctgtttcagatgaaagaaaagtatggactttctctttccgacagtgcatacatcgctctggtcgtccacttgacgtttgcgatcgagcggatacagctcggtgaaatgatcaatatgaatgaagaagaattgacggatctgaagcgtacgaaagagtttgaactggcgcttgcgcttgcaaaggcgcttgaagatgcgtttcacgtgaagatacccgaagctgaggcggggtatattacgatgcatttaagaagcgccaacaaaagcttcaaaatcgactacagagcggaagatatcgagctggatactgcgctcagaacgaaaaagctgatcgatttcatctcgcaaaaaacgggcatgaatttaaccggcaatcattcgctttatgaaggattaatcgcccaccttgaaccggcgatcatccggatcaaagaaaagatgtcggtgcataatccgttaacagagcaggtcaaaaaagattattttctcctatatatggccatagaggaaggcgtcgaaatatttttcccggaaatccggtttccagatgaagaaattgcttttatcgtccttcactttggatcggcgcttgagatgagcaaacaaaaagtagacatcaacgcgctcgtgatttgttcgagcggaatcggttcatcaaagatgctggcctcgcgggtgaaaaaagagcttcctgaaatcgcttcctttgagatatcctctctgatggaactgaagacgaaaaacactgatgcctttgacatcatggtttcaaccgggccggtcccatatgaaaacattgactgggtta

SEQ ID NO: 2674 - DNA, 980 bp, Bacillus licheniformis
atggatactggcacacatgttgtcatgggcgttgcactcggaggcatcgcgacgcttgatccagttgtcggaatggacccatcaatggctcaagccgtgatgattgcgacaatcgccggatctcaggctccggatatcgataccgttttgaaattgaaaaacaacgctgtttatattaggcaccacaggggattcacccactccatccccgctgttctcgcctggtcgctgatgattccgggcattctcatgctgttttatcccgaagccaatctgcttcacctgtggctttggacccttgccgcggtcgcgcttcatgtgttcgtggatatttttaacgcatacgggacacaggcggtcagaccgttttcaaggaaatgggtagcgctcggcttgattaatacatttgatccgtttattttcgtcagccatctcatagccatcgccttttggctggcaggcgcgcatcaaggctatacatttttggctctttacatcgtcttggccggttattatctggtgaggtatttcatgcagaggaaaatcaagcatgagctccgtgaaaaaatcgatgatattgaagaaatcattatttcgcctacgatgaaattcaggcaatggcgaatcgccgtcaaagcaaaatcggctttttacgtcggacggagcatggatggaaacgtcgtgatcgtcgacacattcaacagggtgcctttaccggatacggatgtgatgaaagcggcgaaacaggataagaacatttcggcgtttctttcgttctcaccggtttacaaatgggagatcgatacgtataaggatcattacgaagtccgctttatcgatctgcgataccgcagcaaaggacactaccctttcgtggcgatcgcacacatcgacagggacacgctcgaattaatcacctcctataccggatggattttcagcgaggaaaaacttcaaaaaaaattaaagcttggctctgt

SEQ ID NO: 2675 - DNA, 1019 bp, Bacillus licheniformis
atggtaatttcttataaatgtccgggctgcggggatgacatggcctttgacgctgaatcgggcacgctcgcctgccgcagctgcgggagacaggacaagattgaaaacattccggaagaattgaaaactgcgagatttactgaagatgaagcaacagaatatcattgccaaaactgcggcgctattttgatcactgagaaagaaacgacggctacatcctgcagcttttgcggaggagcggcagtgatcgccgaccgcctgtccggaagccttgctccggcaaaggtcattccttttacgatcagcaaagaggaggcggcggacgcgtttcgcaagtggtgcagaaaagggctgctcacaccaaagggctttatgtcggctgaccggattaaaagcattacaggcatgtacgtccctttctggatgtacgatttaaacagcaaagtgcaggtcagcgcccgctgcacaaaggtacataggtatatacagggcgactatatctacacggagaccgaacattatgatgcgtttcgcgatatcaatctcgactacatcaaagtcccggtggatgcctcagaaaagatgaacgatcaattgatggacaaattggagccatatccatatgatcagctgaaagattttaaaacggcctatttggcaggctacatcgctgaaaaatataattacgatgatgaagagctttttccgcgggcgaaaagcaaaatcagcggctacatcgagtcatatatcgattccaccctgtccgggtacagctcagtcgatgtgaaaacgaaacacgtcgatacacaaaaagtgaaaagcttgtatgtgcttttgcccgtctggatggtcaattacaactacaaacaaaaggattacatctttgccatgaacggacaaacgggaaaagtcgtcggcaagccgccgatcagctcatttaaagaaaaaatgtggttcagcgggctggccgtctccatatttgcactctggaaaatcattgctgctgtaatgggaggcgg

SEQ ID NO: 2676 - DNA, 1622 bp, Bacillus licheniformis
atgaaagcccgccgtttttttgtaagcgttctttgctacgcggtttttttcatcggcaaagcgccggatatcccggcggcagaggcgcttcttttattatcaatgctgttttttgttccggctgcgctcgatctcattcagcatgaaaatgggatgtttcggctgatcagcgtctgttttccttatgcggcttgttcggcatcgctatcactgctgttccattccccgcttttttcattggtttggctatgctatacggggatgatcgccttatacggggcacttcgcctctgggagagagaaggaaggagccttgaagaggcatcgattgacagcggcctgctttaccttccttttggaggggggtggctttttgcttatacgctgaatctccaggtcatggatttcagcccgctgattgtgctgctgacagcggtacattttcattattctgcatttctcattccgatttttaatggaatgctcggaaggaagctgaaaaagaaaggcctcctttatgcggcggtgacatggctcatcatgctgtctccgctgttcattgccatcggcatatcgttttcgaaaaccattgatgtcatcgctgttgcgctgtatttgtcggccctatacggaagcggctttctcgcctcgattacggccttcaaaaacagcgcggctcgccgctttgttatcttttcgtcttttacattaatgatcaccattgctttttcactcatttactcttacggcgtttttcgcggccggacgacttttacaatccaggaaatgatttggattcacgggcttgtcaacgcctttggcgtcatcattccagcgctgaccggctggcgccttgaatcccctgggccgggctgtgaaaggaggcaaggcgaaacgatgagcaacatttacggcacttggaagatcggagccgattttttacacagacaccgattacaaaccgattcgtcttaccaaggtcttgccgatgatatgagcgcatttcagagcaaaggatttcagcctgagaaggtttctcctcttattctcgatttctatgagcatactgccgattattcgttaacagcggagatctcctggcgtccatggtttaaaccgctcgcgcacatgtaccagctgatttcaagaaagacaggacaaattcatttggggactaagaccggacggcaaacgatggacggagagattatcggtgttgattcagccagagacggaaggaagaatgtgcgcgcctggatcagaacgaacgaggtaggcgagactgtgtttgtggcgctttattctgctcatacccacgatcacatcacatatatgaatatcgcgctgccattgccgttttccaatatgacaggcattttaaagccgaaagcagaggacggctgcctgattttgacgagcagtgataaacgatctgaccgtggggatgaaggcatcttcctttcgaccggaacaggaacgtttaaactgccgctcgccgaacgctttatcattaaagagcagggacgaaagaggctctgcgcccatcaccgcatgtggctgttcggcatacggtttctcgacattcaatatcatattgaaaaaaaggattctgccgtgaaaag

SEQ ID NO: 2677 - DNA, 862 bp, Bacillus licheniformis
atgtcccataaagacaatggccattttattatttctcaggaagactggtccctccaccgaaaagggtatgatgaccaacagcgtcaccagaaaaaggtgcaggacgcgatcaaaaacaatctgcctgacctgattacagaagaaagcatcattatgtccaacggcaaagatattgtcaaaattccgattcgctcgttggatgagtataaaatccgctataactatgataaaaataaacatgccggccagggagacggcgacagccaagtaggagatatcgtcgcaagggacggctctgataagcggggcgccggcaaaggccagggagcgggcgatcaggccggtgaagattattatgaagcggaagtttcgttaatcgatttggaagaggcgctcttcagcgaaatggagctgccgaatttagaacagaaagagcgcgatgatatcgttgtcgaagatattgaattcaacgatatccgcaaaacgggtttgacgggcaacatcgataagaaaagaacgatgctcagcgcatttaagcgaaacgcaatgactggaaaaccgtcgttttatccgatctatcccgaagacttaaaatttaaaacgtggaatgactctgtaaagcctgaatcaaaagccgttgtgctcgccatgatggatacgagcggatcgatgggcgtttgggaaaaatatatggcgcgaagttttttcttttggatgacacgttttttacggacaaagtatgaaacggtcgatatcgagtttatcgcccatcatacagaggccaaagtggtatcagaagaagatttcttttcgaaaggggaaagcgggggaacaatttgttcatctgtataccgcaaatccc

SEQ ID NO: 2678 - DNA, 1081 bp, Bacillus licheniformis
gtgaggtatatatggattggtatgatcctgtgctttttatccgtcagtctggccgtcggctgcatcaaagctgaagatcagtcagatgatgagaaaaatgatgaagcgcttcagcctgccgaacacttcgtttaccgtcatttaatgagcgatcaggggctgatcaaaaccggcttttccgaccagcctgtttacttgtcggaatcgcttggcttgtggatggagtttttgatcagcaaaaaagacggcgagcatttccatgagcaatatcagcacctgaacgaatccttccttatgaacaacaacctggtgtcatggcaaatccaaaacggccaggcaagcggggtgaacgccctgatcgatgatctcagaatcatggtgagcctcgatcaagcggcagctctatggggaaacagcgagtataaacaaaccgctcggaacatcggtgccgcattaagaaaatacaacatgaacaacgggatattgacggacttttacgactccgcctctcaatccgcggcaaaagatatcacgctttcctatatcatgccggatgcgctatccatcttgaaaaagaatggagtgataaataaagaactcgaaagtcggaatgccagcattctttatctcgcccctttgaaaaacggttttctcccaaaagcatacagtacagaaacgaaagcatacacctatgaccatgaagtcaatctcattgatcagctttacgcagcttggcatttacctccgaaggatcaaaaagccgctgtattagcggattggctcaaacagacgtttcaaaccggcggaaaactgtatggccggtattcgctcgatacaaaaaagccggcggtccaatacgagtctccatccgtctacgcgttggcgattttattcttcatcaaccaaaacgaagataaaaccgtcattaaagcgctgtatgatcgaatgaatgattttgaaattcttgattcgtccgagacgtattatgggggatatatgagcggaaatgatacgcattcttttgataatctgctgcccctattagccgaaaggaagcttttaaatgaaaatctcattcaat

SEQ ID NO: 2679 - DNA, 936 bp, Bacillus licheniformis
atgagaaatcaagagattattcgtaaagccgagatgtcgcttgcgactttgaaaagcggaggattaatgaatccggcgcaggcttctgcatttattcgcatggtgcaaaacacgccgacaattttcagcgaatcgcgcgtgattcaaatggaaaacgactcgcaaaaatttgaaaagatcggctttggccagcggattttacgagcggctgatgaaggtaaggcattggcgaaagatcaattaaccgcaccggtgaccagcacggtcgaactgaacgcgaaagaagtcattgccgaagtcaacatcacttatgacacgctcgaaaataacattgaaaaagacggccttcaacagacgctgatgcaaatgctggcggagcgggctgccgttgatattgaagaactgatcgtcaatggtgatgtcgcatcctcagatccataccttgcccagctcgacgggatccggaagcagtccgtctcccatatcgtcgatgcgggcggggagcaaatcagccggcagcttttcaaacaggggctgaaagctgttccggcaaaatatatgcgcgttcctcaggaattcagattcttcacatcgctcggccaggagattgaatggaaagaccgcgtcgcagaacgtcaaacgactctcggggatgcggcggtacagggcggactttctaccgcttttggcgtgcctgttaaaggggtctcaaatattcagccgtatgcatacggagaaggagatgcggccgccgaagcatcagacattattttgacgcacccgaaaaatatcattctcggtttctcgcgcaatatcagaattgaagtcgataaagacattcgcgcgcgcaaattcatcattgtcctgacggcaaaactggacagcaaattcgaggaagaagacgcggttgcaaaaatcatcaatgtaaaagagtaa

SEQ ID NO: 2680 - DNA, 1044 bp, Bacillus licheniformis
ttgaaaaatatattaagagcggtcgtgatccttctcatcgttgcggcttcatacacgctgtttattcaatacggctcaacgcctgagaaaattgcgaaggaagacaagccgcaagtctcaaacgaagatgcaaaaaaagagaagcccttgaacattcccgattccggcctgctttcctttatcggggaatcggccgagacgatcgaaaagaaactggggaaaccggacagagtcgatccttcagcgtatgattatgaatggtgggtctataaccaagggaaaaaacagtacgttcaaatcggcttgctgggcggcaaggctgtgacattgtttgcgacaggcgacggggtgaacaccgctccgtttaaaatcggacggccgtcaagggaagttttcaaaacgacccagatcgccccgtatgtcaatgttcaatataaaggcagttcataccgttttgagttttccgaggaagatatgaatacaaggccgacggttaaagtcggagacatctatgttcagctgtacatggataaattcgaggggacgctttcaagcatcagggcatttgatgcgccgactttaatcaagcaaaggccgtatgaagttgtctacagaggcaccctgatcgagcctaaagcattgacagaatcggattggaagaaaatcgagaaagcaaatgagaagcagatttttgatataacaaacgttatccgcgcaaggcacggcctgtctgagctcacttgggatgaaggcgtatcaaaagtggcttacggccacagcagcgacatgaaagagcaccattacttctcccatgtgtcagaaacggaaggcaccctcaaagacaggcttgaaaaaggaaaagtcaattttgagcaggcgggggaaaatatcgcgctcaactatgtcgacgggcctgcggcggttgaaggctggttaaacagcgaagggcacagaaaagcgctcttaaatgccgactatacccatctcggcgtcggggtggatgagaaatattatacgcaaaactttattaaagaatggcaatag

SEQ ID NO: 2681 - DNA, 1083 bp, Bacillus licheniformis
gacacgaatattctttgtgcgcagaattataaaaacccgatctttgggtgaaaaaacgacgatgggaagcgtcacaaaaaccgatgtggcgatcatgtatatcaatggaatatgcgacccgaaagcggtgaaagaagtcaaaaaaaggatggaaagcattgagatcgacagcatccttgaatcgggctacattgaacagtttattgaagacaccgtatttacgacctttccgacggtatatcatactgaaaggccggatatggtcgcagggaatctgcttgaaggaagaatcgccatctttgttgacggtacaccgtttgtcctgcttgtccctgccgtttttattcaattttttcaatctgttgaggattactattcacgctttgacattgcgacattcatccgctttttgcgcgtattgatcttctttatttcgctgattgcgcctgccgtctacgtcggtgcgacgacttttcacaaggaaatgatcccgacggagcttttggtcgtaattgccgcgcagcgtgaaatcgtgccgttcccggctgtggtcgaagccatgatcatggaaatttcgtttgaaattttgcgggaggcgggcatccggcttccgaaagcgataggttcagccgtttcgattgtgggagccattgtcattgggcaggcggcggttcaggccgggattgtgtcgccggcgatggtcatcatcgtagcgatcacagcgatttcaagttttgctacaccttctttctccatggcgatttccgcccggctcgtccggtttttcttcatattagccgcggcgacgacgggtttttacggcattattcttggactgatcatcatgtttgtccatttatgcagcctgcgttccttcggtgttccatatatgactccttttgcgccgtttattttgaaaaactggggcgacgccatcgttcgtctgccttggtggacacatgagaagcggcctgaactgatcggcaatgacaataaggtgcgccaaggagaataccagaaacccgagcccccggattcaggcgatatgaagacaaaacaagaagatggtgatccaaatgaaac

SEQ ID NO: 2682 - DNA, 1122 bp, Bacillus licheniformis
atgaatcaatctctcatcacaaaatcgcctctttacattgctgaagaagcggccaaaacaataatgaaagcgtatacaccgaaagagctgccaccggccgggcgctggcactaccatcagggcgtatttctgtgcggcctgattcgcctttgggaagaaacggggaaagaagcatacttcaaatatgtaaaagaatatgccgatgatctcatcgatgactgcggcaatttttatttcaggagggatgagctggacgctatacaagccggacttctcctttatcctttgtacgaggagacgggcgatgaacgctaccgcaaagctgcaaaaaagctgaggggcctttttgaaacgctgaatcaaacagaagaaggcggtttttggcataaagataaatacccttaccaaatgtggcttgacgggttgtacatgggagggcctttcgcactcaagtatgcaagggcgttcaatgagcctgaactttacgataaggtcatcctcgaggaaaaactaatgagaaagcatacgaaagactgcaggacgggattatattatcacgcgtgggatgaaaagaggcagatgccttgggccgaccccgtctcaggctgttctccagaattttggggaaggtcaatcggctggtacgcgcttgcactgagcgacatgatcgaactgctcccgcaggggcatagcacaagacaggagtggacccggacgcttcaagagatggtcaaaagcattgctgattttcaagatgaaagcacagggctatggcaccaggttgtcgataaaggcggacttccggacaattggctcgaaagctcctgctcgtgtttgtatatgtacgcgatggccaaaggggctcgcatgggctatattgattcatcatatattgatagagcgacaaaggctttcaaaggactcgtcgaagaaaaaatcgagatgagcgcaaaagaaggcttgcttttaaaagatatctgcgtcggaacttctgcagggacatacgattattatgtcggacgggaaaaaagcaccaacgatcttcacggtgtcggcgccttggttatggcttttgtagaacttgaaaagaccggccgtttttcctgcggggaagcgaagtga

SEQ ID NO: 2683 - DNA, 1767 bp, Bacillus licheniformis
atgagttcatttaaagaaatagcagaaaacgccacgattcaaagctttttaaattgctatttgcgtgaaaccggcatcgaaacccgtgagatcgcggacggctctcaaaaaacgctgattgtcccgctagagcgccagcagatcgagctgatcgttccgatcaagtactggtcgaagacgggaaggcaccttttctcatttccgctttattatcaaacagcccaaaacggaaagccgcttccactcgactatgtgacgctcgtctccctcgcttcaaaggaattgcttcttcagcaaagccgcgggggtgccgaggatgaattcatgctcagagtcattttgagctgccgaaatatcagccgttatgttgaggaacgagccgatgatcaaagtgagcttagccgtgctgattttacgtttatcgaagcggagcagtcgctcttgctcggccatctgatgcatccgacgccaaaaagcaggcaggggatgaagcctgaagaggaaagcatctattcgcctgaacttaaaggggagtttcagcttcattactttaaggcacacgcctccctcgttctgcacgactcaagtacaggaacaaaagcgccgctagtcattcaagaggaattgagaaacgacccgatgattgacaatgcgtggctggatgagcaaacggccgatccggattttgcgcttcttcccgcacatccgctccaggcgagagccttgttggaggagccgtatgtgcaaaaattgatcgctcaaggtctccttacatatctcggcgcaaaaggccggaagtatacggcgacatcctccgtccgcacggtctacagcaagcactcgcgctatatgtacaaattttcggtaccgatcaaaatcacgaattcgctgcgtgtgaacaagcagaaagaattggacagaggtgttgaaatggcccggctgcttcagacagagctcggccaaaggttgaaacaggagtttccgggctttcgcgtcatcacagatcctgcttacatttccattcgaggagagaacggggagtccggctttgaagtcgtgatcagggagaatccgttttatgaagacgaccgttcggcatgtctgatcgccgggctttgccaagatcacgcctacgggaaagagtcgcggctgtgctctgtcatccgcgggctggctttagaagaagggcggacgacggaagaagtgagcatcgattggtttgacaaatacttatcgatttcgcttgagccagttttatggctgtttgaaacatacgggctggcgattgaagcgcaccagcaaaacgccgtcatccgcttaaaaaacggctatccggagacattttactacagggacaaccaaggctattattacagcgaatcaaaagccgggattctttccaagctgatcgaaggcttgagcgaaaggagcgagacgatctgctcggacagcgtggctgtagagagactgcgctattatttcttcttcaaccatttgtttgggcttgtaaacgggtttggctgcgaagggctgatcggggaagaaacgctcctgtccatgatcagagagcggcttgaaaaagcggagcaaatttacggtatcacagagctgacggacagcctccttcgttttgcggagcttccgtgcaaggccaatctgctgacgagattttacgacatggatgagctgacaggctcgcttgaaacccagtctcgctatacgtctgtcaacaatccgcttttaaaggaggcggcggctgtccaatga

SEQ ID NO: 2684 - DNA, 1034 bp, Bacillus licheniformis
atgaccgtaacaaaaaccgcagcatacgaaactttgactgaaagctccgcggccgcgcttgccgtccgtctcgggctttttccaagcaaaagcaccctgacatgccgagagatcggggacggaaacctgaatctggtcttccgcgtttatgacaaagagcagcaaagaggattggtcatcaagcaggcggtgccttatgcaaaagtcgtcggcgaaagctggccgctgacgcttgacagggcaagaatcgaaagcagtgcgctgatccgccaggctgagcacgttccgcaccttgttccgaaagtgtactattctgacaccgagcttgccgtcaccgtattggaagacctttctcacttggaaatcgccagaaacggactgattgacgggaaggattacccgcatctgtcggaagatatcggagaattccttggaaaaacgcatttttactcatcagaatatgcgcttgacccaacggttaaagagcggcttgtgaagcagtttacgaatccggatctgtgcgatattacagaaagccttgtgttcacagaccctttctttgaccatgagacgaacgatttcgaagaagagcttcgcgatgaagcagaagttctttggggcaatgaagcgctaaaaattgaagcggcaaaactgaagcagcgctttttatcagcggaggaaacgctgatccacggagacctgcatacaggcagcattttcgccggtgaagatggcgaaacgaaaatcatcgaccctgagtttgcgtttttcggcccgatcgggtttgacatcggacagtttatcgccaacctgctgttaaacgcgctttctcgcgaagaaaacaggcgggctcctttataccgccatgttgagaccgtctggaatacgttcagccggacattcagcgaagcatgggaaaacgatgctgttgagacttgcaaacatgagaatgggcgccttgagtcagtcctgagacaggcgtttgaagacgcagcaggcttcgccggctgcgaaatgatccgccggacgatcgg

SEQ ID NO: 2685 - DNA, 882 bp, Bacillus licheniformis
gaaaaaagaaaaggcaattgtcggctttatcgggccgagtggatccggaaagactgccggcgccctgctagttgcttacggaatgatgcgggaagcatacccggatgcaagtgataaggaagtctggtcaaagattggtgttgtggatactgagcaccgtcgcgccaaactgtatgcaaacttgcaatttgatgatgtacggattggcagcttcaagcacatcgattttacaccgccttataccacagaacggtatcaaatggctcttgaagcaattaaggaagccggtgcagaagttgtcataattgactcgctttcccacaattgggcgggggaaggtggcatcgttgaaaaacatggggaaatgcaaggtaactcatttcaaaactggggtaaacttgcgcccgaaactacgaaattaataaaaacgttaacgcaaaatgacgttcacattctggcgacgcttcggaccaaaactgagtacgttgttgagccgaacagtgaggggaaaatggcgccgcgtaaggtcgggaccaagcctgtgcaaaaagacgaaatggagtatgaattcatgctcaatttcaatattggtattgatcatttggcggaaacatcaaaagataatacccgcatgtttgaaggatcttcttttaagctcaatccagaagtcggccgcaagctttaccaatggcttgagctcggtattgacgtgaaagcagaggaagaagccgaacggattcgattgattgatgaaattaaaacaatcgtcgccggcaacgaaacagccgcccagatgattgaagaatttcagatcaaagcaaataaaaaacttgatcaatggactattaagttggcatctgccgcacttgatagattacaagc

SEQ ID NO: 2686 - DNA, 1152 bp, Bacillus licheniformis
gttacacaaaactggcgcacagcttgaatttgatgatttgctttccgatccttttggacaaggagaagcgcctgtttccggcgtggaggaaaaactccgcgggcagcaagtgaatctggttgatacgttatctgaagaaaaacgccggcaggcatttcaactggccgaacagattgacccgaaaaaccataacagcattactctgtatggaacgcaagctcaatccaaactcttgaacttctcacatgagatgctcgagcacgtccaaaagaaagatgtcggtgaaattgggcaggttttaagcgacctcatgaaaaagcttgaacaggtcagccccgatgaattgaaaactgaaaaaaggaacttcttttcccgtttgtttggaagagtatcccattctgttcaagaagtgttatcaaggtatcaaaaaaccggcgctcaaatagatagaatcagcgtaaaacttgagcattccaaaagcgcgctgatcaatgataataagatgctcgaacgcctttatgaaaaaaataaagaatattatgaggcactgaatgtctatattgcagccggtcagctgaagcttgaagaattaaatcataaaaccattcccgaattaaaagagaaatcgaaaactgaacatcaccatatggcggttcaggaagtaaacgatatgattcagtttgccgaccggctggaaaagcgggtttacgatttaacgttgagcaggcaaattacgctgcagagcgccccgcaaatccgtttgattcagcacacaaatcaagtgctggcggaaaagattcaatcttcgattatgacagcaatccctctttggaaaaaccaggttgctattgcgctcaccctgttgaggcagcgccgagcagtagaggctcaaaaacaggtgtcggccacaacaaacgaactgctcttgaaaaatgccgagatgctgaaggccaatacgatcgaaacggcaaaggaaaatgaacgaggctttattgatattgaaacattgaaacaagtgcaggacaatctgatcggtacacttgaggagacgcttaaaattcaagaggaaggccgttcaaagcggctgcaggcagaagaagaaataagggcaatggaagatggtctcaaggctaagctgctggacatgaaaga

SEQ ID NO: 2687 - DNA, 1014 bp, Bacillus licheniformis
aatcgtgtggagagccgggatgaagtggatgcttcttattttaggaagcttaataggtgcgggatatgcatccggccaggaaatatggcagttttttggtgatgaaagcggactggctatcctgttgtttacgatcatgttcagcctgtcaacctatattgtgatgaagatcagctatgaacaaaaatcagagcattttctgcctgtgctcgaaacattaatcggtccgatgctggctaaagtatacgatgtgctgatcatcctgtatttgtttacgacgacgattgtgatgattgcaggaggcggggtaacgctgcaaatctttcatatcccgttttggactggcgtcatcttgttttgtttatgcacagggttgttgtttttgtgggggctcaatggcatattgtccgttaatagctacttaatcccgattttggtggcggggctgctgtatgcgctgatttcttttcaaacagctcatcatcagccgtggctgctcaacttgactcatcaatacaactggcctgccggcatcgcattcacttccctgaacatattatctgttgtcgctgtattatctgcggtcggcaaagagatgaagggggtcggagaagcaaagattgccagcatattaagcggcctggtgtttggggctatttcatacatgtacaatgagacccttgtagagcttgccggtgaactggcccattatgaaattcctttattcgcggttttggagggcgcgccttttccgatttttatttttatgacggctgtactttgcgtcgcaatctatacgacgacgatctcgagcattctcggtctgtccagccgttttctgtcctttgtgaactggccgagatgggtgatcgtcatcctgcttctctcgatcatggctccttttacgtcaatcggattttcaaatttaatcgcttttttatatccaatttacggattattgaatttatatttattggtaaatattttactatatccgattttgagtaaatggaa

SEQ ID NO: 2688 - DNA, 903 bp, Bacillus licheniformis
ttcggtactgctcagaggattgaagcagcagccggtagacatcacggcgattgtgacagtcgcagatgacggcggaagctcggggaggctgcgcgacgagctgaaaattcccccgccgggggacgtcagaaatgtcctcgctgcactgtctgatgtcgaaccgcttgttgaagacctgttccagcaccgcttctctaaaggcggcgatttaatcggccattcattgggaaatttgattttggcggcgatgacgaatataaccggtgatttctttcacgccgtcactgaaatgagcaaagtcttaaatgtgagaggaagggttctgcccgcggccaataccagcgttgtccttcatgcggaaatggatgacggacagatcatatcaggggaatcgacgattccgtcttacgggaagcggattaaacgggtgtttttaacccctgaaaaaatcgaacccgttccggaaacgattgacgtgatccgcggcgccgacctgattattctcggccccggaagcctgtatacgagcatcttgccgaaccttctcgttccgaagataagggaagagatattaaacgccccggcaaaaaaagtttatatttgcaatgtaatgacccagccgggagaaacgctgtactacagtgcggcagaccatgtaaaagcgcttaaccagcatatgggcggtccgtttatcgatacgatcctcgtcaacaatgaggaaatcccggacgacattcgggaacgctatgcgaaggagcaggcacagcccgtccagtttaatattgatgatctgtctgcgatggggcttgaggtcatcaaagatcagattgtgacatacgagaatggcgtgatccgtcatgatacacataaagtcgcttcgctacttgttgatttgttaaaaga

SEQ ID NO: 2689 - DNA, 828 bp, Bacillus licheniformis
atgggcacagaaaaaagattaacgaagagagagattttcagtatgtttatccgctcaaactttttgctcggatcttttaactttgagcgtgtacaggcgctcggctactgctacgtcatgattccggcgatcaaaaaactgtacggtccgggagcaaaacggagcgaagcgctccagcgccatttggaatggtttaatacacatccgtggctgacagcgccgatatttggcgtaaccgctgcgatggaagaagaaatggccaacaataaaaagattgatgccaaagcaattaatggaatgaaaatcggcttaatgggcccgttggcaggcgtgggcgacccgattttctgggggacgttgcgcccggttttggcggccttgggagcgtcgcttgctttaagcggaaacatcgccggcccgcttttgtttttctttttaatcaacgccgtcagattaagcactaaatactacggattaaagtacggctatgtgaaaggcatggaaatattgcaggacttggtggggaaccgcattcaaaaactgacggaaggcgcttcaatactcgggctgtttgtgatgggagctctcgtttccaagtggaccacaatcaatatcccgatcgtcgtgtcgagaattaaggatgatgcaggcaaagtcgatgtacagaccgtgcaaaacattttagacagcatcatgcctggtgtgctgcctttaggattgacattgctcgctgcctggatgcttcgcaaaggggtgaatcctctgctcatgattttcggtatttttatcatcgggattgtcggctattgggcaggttttttggcataa

SEQ ID NO: 2690 - DNA, 1224 bp, Bacillus licheniformis
atgaatagcattctggggatttggaagacaagaattgaggagtatgtcaaagaaacaagatcatatttgaaatacatgctgaatgaccaccttgtcatcgtcatgatttttttcctcgctggagctgcgagctggtacagcaaatggctgaaagagatgcccgaaggttttccagcctattgggtgatggccgtcatcttttcgctcattttgacaggctcgtacgtccgcacgctgattaaagaagctgaccttgtctttttgctgccgcttgaagcaaagatggggccgtattttcagcaggctttccggtttagttttttgacgcagctgtttcctctggccgccgcggccctcgctttggcgccgctgtattttgaagcaagcggcaaggggttttccgcgtacctcgtcttgctgattcaactgctcgtcttaaaaggatggaacacggctatgcaatggcggatgacgtttttcggcgaaaaaaacatgagggttaccgaccggtttgtcagactgcttctcaacacgatcgggatctatttcgctttagagtcttcatacgcatttgccgcagctgtctacctgatcatggccgcactgtatgtgtattttaaggtgatcgataagaaaaaatcgtttaaatgggaactgcatattgaagacgaaatcagaagaaagcagcggttctacagaattgcgaacttattcacggacgttccccaccttagaaaacaggcgaaaagaagagcatatctcgattggatgctccggtttattccgtatgaacagagccggacatttacatatatgtacggaagggcatttatcagatcaaacgactatttcggcatcgtcgtcaggctgaccgtgatttttggcatcatcatcgcttatttttcggcatatgagtgggtatcggccgcgctcatcgtcttcaccgtattcattacaggaattcagctgacgccgctgtttgatcatttttcacacctgccactgcaggagctttatcccgtcaaagcagaagaaaaacggaagagctttttcggcctgcttcacatcgttctgagcgtccaggcgcttgttttgtctgccgctgccggagccatgatgcagtggaccgggatgctcgccggactggccggatccgcgctgcttatatttgtgattttgaagccttatttcagcagcagattgaagaaaagtgccaagagatag

SEQ ID NO: 2691 - DNA, 2463 bp, Bacillus licheniformis
aagttctcagggtgctcgagattcatgaagaaattattgggagatttttaagcgaccgcagcctgattgcgaaaaaatttaatatcgcttcccccgaattggttggatttgaaggggatttgggagattcccacaaaaacgggcagagtgtcaaagtgctggtgttaaacaacggaaagctcgtgtataaaccgcggtccttgtcaattgacgaacattacagggagctgctgaactggctgaacggacggggaatgaagtacagcctccgtgctgcggaagtgcttgacaggggaaattacggctggcaggaatttgtaaagcatgaaggctgttcttcagaagaagaactggaaagattttatttccggcagggcggacatttggcgatattgtacggattgcgctccgtcgattttcataatgaaaatatcatcgcctcaggcgaacaccccatcctgattgatctggagactctttttgacaaccatgtcagcattttcgctcaaaatcaaaacctccatgtcaccgcattggagctgaagcattccgtgctgtcttcgatgatgcttccggtcaaattcaaacatgatgaagtgctcgattttgatttaagcgggatcggcggcaaaggcggccagcagtcaaagaaagcgaagggctacgccgtcctgaattacggtgaggacaggatgtctttaaaagaaacatcgctgaccaccgaggaaaaattgaatgcgcccaaactaaatggacgtccggtgtccgccgttttctatacggactttatcgtggaaggatttaaaaatgcttatgccattatgatgaaacataaagaagaactggcaggaccctcggggtttttgaatctgtttaagcacgacgaagtccgccacgtcttccggccgacacatgtgtacggcaagtttctcgaagcgagcacccaccctgactacttgaccgccggagataaacgagagcaattatttgattatatgtggatgctcgccaaacagtcggaaaaggcaaacgtgtttattccggacgaaattgtcgatctgctgcttcatgatattccctactttactttttatgctgggggcacttccctgctcaattcaagaggggaagaatcggaaggtttttatgaaacatcaagtattgatttggcaaagaaaaaaattcaatctttctcggaaaaggatttgaatcatcagctccgctatatttctttatcaatggcgacgttgattgaaaatgtctgggaccatgcagaaagcgggcttggacagaaggaaacggtcgctgatctcggaaaagaggtcaagcatatagctgatgatttgctgcagaaggcgatctattcagagcgcggtgaaggtcctttctggatcagcaataatgccggagacgaaaaaatggtgtttttgtcgccgcttcctatggggctttacgacggaatggcagggctggcaatattttttgcacaagcaggcaaggtactgaacgagcaggtatatacggatacggcaagatcaatgatagaagaaattcaaaaggaagaaagttattgggttcaaaatgggaattcccattctgcttttttcggcacaggctcattcatttacctgtattcctatcttggcagtctatgggaagacgattccttattggaaagggcgttgaacctcattccccgagttttggatcagccgaatcaaacacaaaacccggattttatcgcaggggattcaggattgctgacagtgcttgttaatctgtacgaaatcaagcagcacccagcagtattggactctataagacaggtactgagcagattgaatgatcgaattggccgcttacttgattcaatcgagcaggatgccgtttcgttgacgggattttcacacggcttgacggggatcgcattttctatcgcaaaggcggcgaaggtgatacacgatgacagctgcaaagagcttgtcctaaagcttgtcgaagaagaggaccgctattttcaaaaggatcatctaaactggctagatttacgaaatgattcgcatacgctgtccccaagctactggtgtcatggagctcccgggattttgctggggagagcgcacattcaggcttttattcctgaattgactacccggactttaaagcttcaagaagcgcttcaaagttctttaaatctagcagactgtcaaaatcattcgctgtgccacggtttaattgggaatttgaacattctgctggatatcaaaaggctgaaccgggaacttcatgtccctgatgatatattttgcatttataaaacgaaaaaccggggatggaaaacgggtttgcattccgatgtggaatcgcttggcatgtttgtcgggacggcaggaatagcctacgggcttttgcggctcctcgatgaatctgttccatccgtattaactctcgatattccgacgg

SEQ ID NO: 2692 - DNA, 1248 bp, Bacillus licheniformis
gtacaaaacaataaatgaagcgaacgaagctgttatccggaagatcatagcagctgaaccattcttgaccgatgttgtacctgccaagtctgtgattcctgaattagaagattatgtgttattacatgctgggcctccaattaaatatgaaaatatgacagatcctatgcaaggctcttgtgttggagcgattctttttgaaggatgggcagaagatgaagagggagcgcgtggtctgcttgaaaacaataagattacatttattccatgtcatcatgtgaatgcagttggaccaatgggaggcattacatcacctaatatgccggttcttgttgttatgaacaaagagagtggcaatgaggcgtactgtcaaatgatccaaggcatcggtgcagtattacgcttcggtgcttatcatgagcaggtaatcaatcgcctgcactggatgaaagatgtgttgggtccagtgttaagtaaggccttaagaaaaattgatggaggcataaacgttaatgttttgatggctaaagctattgcaatgggggatgaatttcaccagcgcaatattgcagcatcattggtgtttttaaaagaagttgctccagtaattgtggcattagatgatgttgaaaacgaacaaagtgcagaagttatccaatttttagctgatacagaccaatttttcttaaacattgccatggcgactggaaaagcaataatggatgcagcgcgtacaatcaaacatggtacagtcgttactgcaatgtgccgaaacggtgaaaactttggcattcgtattgctggtatgggagatgagtggtttacagcacctgttaatacaccacaagggttatattttaccggctactcagcggaagatgcaaacacagatatcggtgattcagcgattacagaaacaatcggtgttggcggcgtagcaatgattgctgcccctgcagtaacgcgttttgttggaacaggcggatttaatgatgcgcttgaaacaagcaatcaaatggctgaaatctgtgttggagaaaatccgaactttgttattccgacgtgggacttcaaaggtgcgtgtttaggtattgatgcacgtaaagttgttgaaacaggcataacaccggtaatcaacacaggtattgcacataaaattgctggatatgggcaaattggtgctggtacagttcatcctccaatcgaatgttttgagaaagcaatcacagcatatgctgaaaaactagg

SEQ ID NO: 2693 - DNA, 981 bp, Bacillus licheniformis
atgatcgaattatttgtcataaaagaaagcgaatggtatgaacttgtcaccgaaagcgtcacattggaaggagaaaggtaccaggcgcctcgttcgatcgaagcgtcgattgtgatcaagcagggaagccacaaatattacagcgtgcaggaaggcgataccgttttatttaaatggaaaggaaaagaactgtttcgcggaattgtgttcagcagggtgccgaaagaatatacgcttacgtttaaagcgtacgacatgcttcagtacttggtgaaaaaccaggatgtctatgtattctcgaacaaaacggccgctgacattgtcaaacgaattgcgaacgactttcaaattcccaaaggttcgattgcaaacaccggacatacgattaaatcgctcgtctttaaagacaatacgagcctgtatgacattattttaaaagcgctgcgggagacaaaaaagcaaaccggaaaaaactatcagctgtatgccgaaaaaggaaagctgtgtttacgagcgtggcccgaaccggaggatatctgggttttggaaacgggtgtgaacattacggattacgcttacagcacgtcaatcgatgaaacggcaacccgggtgaaactgagaaagcagaaagataacaaaacctataccgcatccgcaagcgatgaagccggtatgaaaagattcggcgttctccagtacacagaaacggtttcggatgatattaacgaggcgcagctccgcgaccgggcgaagaagatacaggctgaaaagaaaggcgtcaaaaaagagctgaaaagcatacaggcaatcggcataccggaagttcaaagcggactgccggtttatatatcgattccggaagcgggcattaaagaaacctattgggttgataaggataaacacgattttacaggaacaaaacatgtgatgacgattgatgtcgtcgctaaaaacaccatacctgaaggagcgtcttcatga

SEQ ID NO: 2694 - DNA, 819 bp, Bacillus licheniformis
  misc_feature (1)...(819): n = A,T,C or G
tagctgtgtgatcgtgtgggggatcggcatttatgaaaaaaggcgccaccagcaaaatatcgatgcgctgcctgtccgagtgaacatcaacggtatacgcggaaagtccacggtgacaagattaacaacagggatattaatcgaagcaggctacaaaacagtaggaanaacaaccgggacagacgcaaggatgatttattgggacacaccggaagagaagccgatcaaaagaaagccgcaagggccgaatatcggagagcagaaggaggttatgaaagaaacggtggaaagaggggccaatgcgattgtcagtgagtgcatggccgttaatcctgattaccaaatcatctttcaggaagaattgcttcaggctaatatcggcgtgatcgtgaacgtgctggaggatcacatggatgtgatgggaccgactttggatgaaatcgcagaagcattcacagcaaccattccttataatggacatttggttattactgatagtgagtataccgatttctttaagcaaattgcaaaagaaaggaacacaaaagtcatcgtcgcagacaattctaaaataacagatgaatacctcagacagtttgagtacatggtattccctgataatgcgtctcttgcgctcggtgtagctcaagcgttgggcattgacgaagaaaccgcctttaaaggcatgctgaatgcgccgcctgatccgggagccatgagaattctgccgctgatgaacgccaagaatcccggacatttcgtcaacggttttgcggccaatgacgcagcttccactttaaacatttggaaggcgtgtaa

SEQ ID NO: 2695 - DNA, 1392 bp, Bacillus licheniformis
tgggatgtctgcccgggctcgggccgatcaccgcgattgccattatgatcccattaagctatggaatggatccggcctccgcgttaattttgatggcgggtgtctattacggagcggtctttggcggttcaacatcatcgattctgttaaatgcccccggagtggcaggcactgtcgcgacatcgtttgacggctatccgatggcaaagcaggggaaagcggggaaagcccttgccatcgctgcaatttgctcctttgcaggcggaacgatcaccgtagttgcgctgatgctcgtcgcgccgacaatggcaaacattgcggtgacatttgggccgacagaatattttgcattgatgatgctcggcttggtggcaatttcgagcctttccgaaggatcgacggtcaaagcgctgatctctgcgacattgggctttatgacggctaccatcgggattgatccgcagacggggaccgaacggtttacattcggtgcggcaagccttctggaaggaatcgattttctgatcgtggcgctcggtttgtttgcacttgctgaagttgcgtttttaatcaagacgcggaacaagccgatgacagagggagcgtctcaggtcggcagcctgaaggtgacgaaaagcgaaatgaaagagatttcgggaccgatcgcaaggcattcggtcatcggatttctgctcggcatcctgcctggtgcaggagcgacgattgcatcatttatttcttatattacggagaaaagaatctcaaaacatcccgaaacgtttggcaagggaaatattaaaggagtcgcagctcctgagacttcgaacaatgcggcaacgagcggcgcattcgtacctctcctgacactcgggattcccggatcagggacaacggccgtcctgctcggcgcacttttggtcgtcggcgttcagccggggccgctcatgcttacggatcatcccgacgtgttctggggcgtgatcgcaagcatgtatatcggcaatttatttctgctgattttaaatttgccgttaattcctttcttgtcaaaaattcttctgattccgaagcagcttttgatttcgctcatatttgttttctgcctgatcggcgtctacgctgtgacatttaatgtcgtacacctttatattctcgtgttcttcggaattctcggatattttatgagagtgctgtcttttccagcggctccgtttattttggcttttattctcggaagtttgatggaagagtcgttcagacaagcgatgacactgtcatcaggaagcctgtccgtgttttttgaaagtcccgtcacaatcggtttattgattacggctctattgtctctcatcgtgccgccgatttcccgggcaatgaagaacagaaataaaa

SEQ ID NO: 2696 - DNA, 951 bp, Bacillus licheniformis
tgaaaaacaagtggagcttttagaattcggtaaggagcccgctcttgaaatatccaagttctctgaccgcattctttccatgatgagaacgaacagtgtgacagattcaggcgcgatgttgacgcagctcggaaaaatcatggaccgctttgacaagaatgactttgaagaacaaaaaggcttgctctctaaattatttaagcgcggcaacagcatgatcgagaaaatatttaaaaaatatcaaacgctcggcggtgaaatcgaaaaaatcaatgtcgaaatttcaaaatataaagatgaaatgacaaaatcgaccgtgacgcttgatgaaatgtatgaaagcaaccttaaatactatgtggagctggaaaaatacgtcgtagccggccagatgaaaatagaagaattgcagcggctcatccccgaatatgaagcgaaagcggccagcggaaaccagatggcgcagatggagcttgatacgcttcgaaacggcattcaagcgctggaagaacgggtgtatgatctcgatatggcgcggatggtcgcaattcaaacggcgccgcaaatccgcctgctccagcgcggcaacacaaagctgatcggaaaaatcaactcggcattcatcattacgattccgattttcaaaaacggcatcatccaggccgttaccgccaagcgccaaaaacttgtcgccgattcaatgagcgaactcgaccgccgcaccaacgaaatgctgaagcgcaacgcgggaaaatatttcaagccagtccgtcgaaatcgccagaatgtccggaagaccgagcatcgatatgaaacgatcgaacaatcttggaatacgattgtcaaaggcatgcaggagacgaagcagattgaagatgagaacaaacgcctgcgcgaagaaggggcaaaacgcatattggaacttcaggacaatatgaaaaaagccgcttt

SEQ ID NO: 2697 - DNA, 1677 bp, Bacillus licheniformis
gaacgatgtacataacagcttaagaaaacaatttgaacaagcggattctctccagcggatcagcggaacggagacggatcagaaaaggctgatgctcggcaaagtgctccgctttatcagcgagcagttcgccgaaatacaaatcggcaatacgaaatggcaggggaagcttgaggcacccctgaaagcgggcgctcattactggttttcgtatgaaaagaagccggatgaagcgacaggccgccttcaggtcgttgaagcgtttgacaaaaacccgaagaccgtgcaggatgccgcctttaagctgttgaacgggctttctctgaagcggacgaaggaagccgtctttctggtcggagcgttgctgaaggagcagcagccgatcagggaaaacgatttaagagccgccatcaagtggcttgaaaatctgccgaagtccgatgcccaaaaaggcgccgatgccgtcatgttcgctcttaaacgcgaacttcccgtccaccccggcgtgctcgattcgattatggccgtcaaaagccccgttccgctcaatgagcagattgcgagaacgcttgatatgatcgcgaacgccgctcagccatccccaggcatggaaaagctgaaacaggcgcttttgccagttttacaagcggagactgaggtgcatgccgaaaggctgattcaaaagcttgcggaacacatcagatcgctggaaaaaggagaactgcaggccgttctgccattaaagccgcaggttcagtcagaaggcggaaaacctccgcaaaaagcagacgctggcggcgcatacggacaggaagcaaaagcagcccagcacaatccgcaaatcgcagcagctaaagacgtgttcgctaaattggcggcacaagccgaaacgaacgggacgcatattgcaagagaagcggcaggcgtcatcaaagcgcttgaatcgcgcggagctctcggacaagctccggccgttctggaaggattcacgccaaaagagacggaacttttgcagcatatcatgaaagaaacagcgcctgcattgacgaataaagccgatgtattatccgttctcctcaagatcaaagatgttttaggcgtcagagatgagctctcattgttgagagcgatggaaaacggcgccgttctcaaagagcagggcctgcaatctttaaagctcgtgctgaatgaaatgaggcatgcttccgatcttccggctcctgtaaaacaggaagcggaccaaatctttcaccgtttaaacggacagctgtttttgcagaatgatcagcctgcccagagccagctttttctgtcgtaccctctgttttcaaagaacggcgtccaggatttgaacgttttcttaaaagggcagaaaaaagacgacggaaaaatcgacccttcccagtgccgcctcatgttttaccttcagttggaagcccttgaagagacggtgatcgattgtttgatccagcaaaacgtcatgacggttacaattgaaacaaagttcgatttggagtctttgattgaaccgctggtcccggctttaaaggaaaacctgaaagagctgggctacagcttgtcaggcgtctcagcaaaaaaacgggaaaacatgaagctcgctccgtttttggagtcccgttttgaacaaattacagagagcgcagtggatgtgaaaat

SEQ ID NO: 2698 - DNA, 816 bp, Bacillus licheniformis
atgagtcatttgttgcgcaagccgcaggcgaatgagctgtcacaaggcgtgaagcttgtacacgaagtgaaaaaatcgaattccgatctaagttatgtcgagtttaaagtccttgatcttgcaccgggatccagctatgaagaatcgctgagcaaacaagaatgctgcatcgtcgcgcttaccggaaagattaccgcaaccgatcatgaacagacatttgaaaatatcggcacgagagaaagcgttttcgaaagaaagccgaccgacagcgtatatgtgtcaaatgaccgcaagttcggcattaccgccgttacagaggcaagagttgccctgtgctattcaccttctgaaaaccagcttccgacgaaactgatcaaagctgaagacaacggtattgagaaccggggaaaattcagcaataaacgaaccgtccataacatacttccggattcagatccttcagcgaacagtcttttagtcgtcgaagtctacactgaaagcggaaactggtccagctatccgccgcacaagcatgaccaagacaacctgcctgaagagtcctttttagaagaaacatactaccatgaacttgatccgcagcaaggcttcgtatttcagcgcgtatacacggatgaccgttccatcgacgagacgatgactgttgaaaatggaaacgttgtcatcgtgccggccggataccatcctgtcggggtgcctgacggatacacatcctattatttaaacgtgatggcagggccgacgcgtaaatggaagtttcataacgaccctgaccatgaatggattttggaacgctaa

SEQ ID NO: 2699 - DNA, 1158 bp, Bacillus licheniformis
cgttcccgccggtcttttgggggatgtgcaggtcgcgcttttgatcggcagcctgctgtttttattgacctttgtgatgtcggggtttgccgccggtccgtttttcgccaataaaatctatattacgagcacgatccaagccatccaaatgctgattcgcgttctgagcgtattgttgattttcgcgtggtttgcaccgaagatctggcacattcagctcgccgctctcatcgcaaccgcttcggcgtgcatcctgtcgatctttttctttaagagattgattccatggtttacgttccgggtgagggatatgtcgtttgcaaagtgcaaaaaactgcttcaggcgggaggatggagctccgtcagccaagtcggcatcctgctgtttctgcaaatcgatttaatggtggcgaatgtgatgctgggggtttccgaatccggcatgtacgcggcgatcattcagtttccgctgttgttgcggacgctttcgggaacgctagcggccgtattttcacctacgattacactctattattcaaaaggcgacaaagaagggctcgtccgttatgccaatcaggccgtcaggtttaacggcatcctgctcgctttgccggcggcgcttctgggggggcttgccggcccgtttctgtcgctttggctcggcccttcattcgaacatttgaaatggctcttactgatacatgcgggctatttggttgtttcattaagcccggcgccgctgttttacatctttaccgcctataacaagctgagaacaccggcgctgaccacggttgccttcggcgttgtcaatttgctgcttgccatcgtgctgagcggcccggcgggactcggcctttacggaattgcgctggccggtgcggcagctttaacgctgaaaaacgtcgtcttcactccgatttatgcatcaaagattacgggtgaaagaaaaagggtcttttataaaggcatatacgggccggttgccggcgcttcatttactttggctgtctgttacgctcttcaatacttattttcgatcgtcagcctgctgtctttgtttgtcacggcactggctgcgacgttggcttacggcctgtttgcctatttcgtcatgttgacgaaagcggaacggcgcattgtcacaacgaagctgca

SEQ ID NO: 2700 - DNA, 1078 bp, Bacillus licheniformis
atgatggtaggtcagcaggacaaaattaccgtttcacaaacgagcatcgtcatcacgaattttctgctgggaaccggcatcttgacgctgccgcggacatctggggaagcggttaaagcgccggatgtctggctttctgttgcattcggagggctggttgccatattagccggtttcatcatggtgaaattaagcatggagtaccccgacaaaacgctatatcaatatagccgggatctcattggcaagtggccgggaggacttttcaccctgcttttgatttgttattttctcgcaacatcaggtttccaagtccgatctgtcacagaggttatgggattttacttactggaagaaacgccgatttgggcgacagcgatggtttttttatggagcggaatctatttattaaccggcggtattaacccgctcgcccgactttatgaaatcatctttccaattactgttctcatttttctgatcgtcatttttatgagcgcaagcatattcgacatcgacaatttgcgcccggttctcgggaaagggatcaagccggtgctggaaggagtcaaaacaacgtcttttgcttatacaggcatagaaatcatactgatcatcgttccttttatgagaaagcccgagcaagccttaaaagctactttgatggggatttctttcccgattgtcttttatatgatcaccgtcattatggtcatcggtgcattggcaatcgagggagtgacatcacggacatggccgacgattgatttgatgcgaagttttgaaatacctgggctgatttttgaacgttttgagtccttgctgctagtcatctggatcatgcaaatgttctccagttttacgatcagctattttgctgctgctttaggtttgtcgcaactcttgaagaaaaggatggaaccgatattattcagcttgcttccggtcatttatctcattgcgatggcgcctaaaaatatcaatcagctttttcaaatgggagatctaatcggcaacagcgccatctatttggtcggtctcatcccgctaatgcttctggtcatatcgaaagtgagga

SEQ ID NO: 2701 - DNA, 811 bp, Bacillus licheniformis
atgagtaatcggacgatttatgttgtatcagactctgtcggcgagaccgctgagctcgtagtcaaagcggctatcagccagtttaacggttcatccgagcagacaaatatcaggcggattccttatgtcgaagaccgcggaacaataaaagaagtgatctcgctggcagaagcggacggcggcatcatctgttttacgcttgttgtcccggagattcgtgaatttttaatcgccgaagccgaaaaggcgaatgtcgtgtattacgatatcatcggcccgctgattgagaaaatggagtcggtctacggcttcagtgcgaaatatgagccgggcagagtccgacagctggacgaagattattttaagaaggtagaggccatcgaatttgcggttaaatatgacgacggcagagatccaaggggcatcttaaaagcggatatcgtgctgatcggcgtgtcgagaacgtccaaaactccgttatcccaatacttggcgcataaacggttaaaagtggcaaacgttccgatcgttcccgaggtggaccctcccgaagagctctttaccgttgatccggctaaatgcatcgggttaaaaatcagcccggataaactgaaccatatccgcaaggagcgcctgaaatcgctcggcctcaacgacaaagccatttacgctaatatcaaccgcatcaaagaagagcttgaattctttgaaaagatcgtcggccgcattggctgcaatgtcgtagacgtatcaaataaagcggtggaggaaacggccaacattattcacaacatgatgacaaaaagggtct

SEQ ID NO: 2702 - DNA, 930 bp, Bacillus licheniformis
agctgacgagccgcattcaagagctgaccgcaaaactgaacaaggacaatatctcacggacaaatgcctacaaacgctactttgaccgccatcctgaaatcaagtggtcgcttttggcttcatttgtttcccggaatgccggctggtcgatgaccgatttaaaagggcgcttattctatctcggacttacggcttttcagcagaaatggctgtttttagcgtatgagagagcgaactggctgatcttttcagacgcctatccgcagctcctgctataccattggtccaagcagcttggccagccgctgtttcatttgctctcctcatttggcgtgtcttcatttatgaaaacggagtgggagcggttctggcatgagcgcgatcaaaagcggctcatgtacgctctcattataaatgaacaaaacactatccaaactcctattatacaaaatcctttgtttaaaaagaatgtttttcagacgattccttttcagctgtgtgaatggtttcacttcaacacggtcattttcccgacggttgaaggcgttttttacggtgtgtctgtcaaacgcttcaccagtttaaaggaaaggatcaagctcggcaagcaattaagcgagctgctgttttcgcctgagcttttccccggtttttttcattttacatcatgtgttccgcataccgggtcgcgctttgatatggagcgctgggcaggggttaaaatcagaacctcgccgtttttgagaacgtgttatcccgttgttgcccattcattagacggattaaaatgcgattggtttcgcggaggaaagagggaggcgatgttcaaagatgaaaaactgccgaaaacgatcgaaatcaccgattggtattttcaaaaaagaaggcagctgcaggcattgttttcgctggagcattggctgaataaga

SEQ ID NO: 2703 - DNA, 1078 bp, Bacillus licheniformis
atgacctttcaggaactgaagatcaatcttgcagaatggcttttgctcaaggtgaaatatccttctgaatatgtgatgggaacgccgggtttaaggcgctttgaacaatataaaggcaagaaaaaaatcattctgactttaattccgtcccatgataatttgggagatcatgcgattgccctggcaagccgcacattcatagaaaacgagtttcccgattttgagttaattgaaatcggcattaacgatatttacaaacatgcaaaagcgctcatgcgcatccgccaccccgaggatatggtattcatcatcggcggaggaaacatgggggatttgtaccgcaatgaggaatggacgaggcgcttcattatcaaaacattcaagcattataaaatcgtccagctcccggcaactgcgcacttttccgagacgctccgcggcaaaaaagagctgaaaagggcgaaaaaaatctacaactcccatcgccggctgttcatgatggcgcgcgatgatacaacctatcaatttatgaaacagcacttctcaaaccaaacgattgtaaagcagcctgatatggtgctttatttaaagaaagaacagcagtctgaaagagaaggtgtgttggtttgtttaagggaggataaagaaagctttctcaggccggaagagcgtaaaaagctgctgaaggctgtcggcgacgagtatggcggtgcaaaaacttttacaacgacgatcggcaggagggtcagccgcgtgtcccgcgagaaggagctgaaccggctttgggatcagctgagaggcgcggaggtcgtcgtgacagacaggctgcacggcatgattttttgtgcgataacaggaacgccgtgcgtcgtgatccgctcttttgatcataaggtgcttgaaggctttcgctggctgaaagacgttccttcgatgaagcttgtggaaaatcccgatgcggcagaggttctcggcgcaatcgaagagctggtcaagaccggtgactcgcatcgtgagaccccggcaagggatcattatttcgcagatttaagacggaaaattatgggtgatgtccaat

SEQ ID NO: 2704 - DNA, 753 bp, Bacillus licheniformis
atgttgtttcttcatgatgtgtgggtgaattggtttgagggagaagaaaatggctacaacgtctgccactttcatgaatggcggaaggaagacagtgttgaattgcttgaccaggtgcctttgttaagggtgtcgtccgttttgtttcactacatagaaaatgatttgtcagagcttccggccgaattattgaacgaggttcatcaaaaagcgtatattcgtaaaaatcatgagcggacacagcttgatcattgtttcgtcgtaacggacggcattggtattctcgcggtcgatacggccggttacacaataccggtaagaaaaagccgcctcattccgagacaggagcagctcgtttatgaaatggtgaaggacgttgaagcggaaacttacgagtttgcaccagagaagctgcaatcttccaaagaataccacattttatctttatcaccggagcatgtcagaggattaacgagaaaagaacgccagctcaaacagctgctgttcatggcgctcgatcagctcaaagggctccaaaatcgggccgagatcgcttattggtacaccgaatggaatccgtatatgtatgaacagatcaagcgcatgacatttgaagaaatctgggacatgcttttcaatgagacgatcgacggatggtcagacaaacacagggacttttgtgaaaatttgattaaaggacagccgttttttgaaaagctttgggaaattgagaatgagtctaaagtcaactaa

SEQ ID NO: 2705 - DNA, 1054 bp, Bacillus licheniformis
atgaaaaagcgttttttattcgggccaatcatcttggcatttttactttttttcaccgcgatcttgatcccaaatgcatggctgacaaagctggttcctaaagatcgcgtcgaaacttcagctacagaattaaacccgatgatgttccaggggatgtatcttcaaggcaaagcgcttgaagacccgaaatatctgccgattttcggatcatcggaattgtcccggttagatgcattccatccgtctaactattttaaagtaaacaatcaagggttcacgccttacctggtcggaaaaggcggctcacagtccttgattcacgcgatcaacttgggggcgcagtctgatcaattaaagggcaagaaaatcgttttcattatctctccgcagtggtttcaaaaacacggctcggacgaagcccactttgcgccgaacttctcggctttgcaggcatacgatcttgtgttcaatcaaaatgtcgattccgggctgaagaaaaaaatcatcaaacgcatgcttaaatttcatgcagtgaaaaatgacgctctgctttcagccctttttaaagccgagctcgaccaggacaaggtggcactgtctcttctgacgccgccggcaaaagcttaccaaagcattctggagaaaaaggacatctattattccatggttgaaggagacggaccgaagcggaccatttcccaagatgtaaaaaacaaatcgtgggatgaattaaaacagatggccgaaaaggtcggcgccaaagaatcccggaacaatgagtttaaaatctcaaacggcgtttataagaaattgaagccgaagctgaaaaagcttaaaggccataataaaaagatgaactatgccgagtccgtcgagttccacgatttccatctcatgatggatgttttgaaagaatccggcgcagaaccgctgttcatctcggttccggtccacggcaaattttacgactataccggcttccctaaaaaaggccggacggatttctataaaaagatcaaaaaagaaatcgaacaagagggctttcaagttgcta

SEQ ID NO: 2706 - DNA, 804 bp, Bacillus licheniformis
atgtcaacgattcaaatcattttgctgcttgtcatcgctgctataacaggtatcggtagtgtattggacgaagggcagacacatcgcccgctgattgcctgcactttggtcggccttgtcctcggggatctgaaaacaggcatcattctcggcggaacgctggagctgatggcgcttggctggatgaatgtcggtcttgcaatggcccccgatacggccatcgcttccgtgatttcgactatcttagtgattaccgccgatcagggaatcggcgaagggatcgccgtcgcggtggctttggcagctgcgggtcaggcgctgacgattttcgtccggacgatcaccgtatttttaattcaccgcgccgacaaatacgcaaaggatggcaattttaaaggaattgaaattatgcatataactgccatggcgtttcaggcgctgcgcgttatgattccgacattgatcgtggctctgatcagtgtcagcgctgttcaggcgtttttgggaaatattccggaagtcatcacaaaaggcttgcaaataggcggaggcattatcgttgttgtcgggtatgcgatggtcatcaacatgatgaacattccgtatttgaagccgtttttctatatcggttttttgctggccgcgttcaccgatttcaatttagtcggcttcggcgccctcgggctctgtctggcatttttatatcagcaagtgatgcaaaaaaatcatgctcaaggggcggttgctgccgccagtgacggcagcatggccgcttatgatgatgacgatgatctggatgcttaa

SEQ ID NO: 2707 - DNA, 1044 bp, Bacillus licheniformis
atgtttgaagaccagacatttgaagagatcatggaacgcatgcttgagcgggtttcagatgagattgacaaacgtgaaaacagcgtcatttggaatgcgcttgccccggcagccgccgagctggcgctttcttatatttggcttgatcaagtgctgaatttggtttatgcggatacggctgaaggcgaatatttggacagaagggcggctgaggccggtcttgagcgctatcgggcgtcaaaagccatatggtctgcggcatttacggatggagtatcggttccccccggaacccgtttctttctggaagatttatattttaccatgctcgaagacggcaagctggaatgtgaaacagccgggacaaaaggaaacgccaatttttcggggcggcctttgcttccgctcgataccattcccgggcttgaaaaagcggttatgggaagccttgaaattcccggccgcgacgaggagacggatgaatccctgtatgaaaggtatttaatccgcgtccgtagggaagcggtcagcgcgaatcagctgcattacaaacaatgggccgaagaagtggacggcgtaggcaaagcgaaggtctttccgctgtggaatggcgagggaaccgtaaaggttgtcattacaaacgcgaaaatggagccagccacagacgcattaatcgaaagagtcaagcagtatatcgatcccgatccgggcaaaggggaaggtatggcgccgatcggagcttataccgcggttgaaagcgcggtatggaaagacgtgagcatatctgcaaaaatcatacctgaatcaggccggacgatcggtgaggccaaacaggaaattgcagaaaaaatcactgaattatttaaagaaatggcttttaaagaaagcgtcatccgtctctcgcagatcaacaacatgatctatgaatcgtcctctgtcagcgactattcggaagtcttcatcaacggggaagcgaaaaatctgcagttgacagaaacggaaattccaaagctggggcaggtgaccatcattgagcaagattga

SEQ ID NO: 2708 - DNA, 1483 bp, Bacillus licheniformis
gtgtcaacatgattgaacaagacatagccggactcattcaaaaagcgcttgaagcagggtttatcgaaccggctgacgtgaactacgcgcgcaaccaagtgatgaatctgctgggcttggaatcgtttcctgaggaagccactgctgcttccggcgactccatcccagaccttttggaaaaactcgcagcctatgcagtcgaacacggcgtgataaccgacgatctagacgcgaaagacatgctggcggcaaatgtgatgaactgctttgttgcaagaccttctgtcatcaatgcagtgttccagcagaaatacgaacaatcgccgctggcagccaccgaatatttttatcagctcagcaaaaacagcaactatatccagacgaagcgaattgaaaaaaatatttcgtatcagatggatacgccttacggcacaatggatattacgatcaatttgtcaaagccggaaaaagaccctgaacaaatcaaacgggagcgcgccgctgcaaaacaatcgcgcagctatccgatgtgcctgctgtgcaaagaaaacgaggggtatgcgggacgaatcgggtatcctgcccgggcaaaccacaggattattaaagtcccgctcgccggagaaaactggtattttcaatattctccatatgcttactataacgaacacagcattttattttctgagcagcatcggccgatgaaaattgataagcttgcctttcacaggctgcttgcttttactgagctgtttccgcattattttatcggatcgaatgccgatttgccgatcgtcggcgggtctattttaagccatgaccattatcaggccggacgatatgagtttgcgatgacgcgcgcggaaggcgcgttctcctttcaaatcaaacagcatccggccatcgaagcttccgttttaaaatggccgatgtccgtcatccgcttgaaaggaactgcgatcaacagccttgttgaagcggcggaccatatttttcagacttggaaaaactactcggatcaacaagcggatatctcggcttttacagatggcacgccacataacacgattacgcctatcgcaagaaacgtgagcggcgtttatgaaatcgaccttgtgctcagaaacaaccggacatctgccgagcacccatacggcatattccatccgcatgctgacgttcaccatattaagaaagagaatatcggcttaatcgaagtgatgggcctggccgtccttcctccccgcttaaagaccgaattggcggcagtgaaagaattcctgctcggtcagtcagatgccgttgaagcgcatcaccgggaatgggccgaacagctcaaaaccgaatacggagagctgtccgaaccggagcaggctgaatcaattgtacgaaaagaacttggcaagaaatttgtcaaagcccttgaggacgccggagtattcaaagaccgcgaagctttcatgcgctttatccgcacagtcaa

SEQ ID NO: 2709 - DNA, 891 bp, Bacillus licheniformis
atggtgatggaaaatcttctccgtccgatttaccaagaaagagcaagccgccctgacacactcgctgtcatgctgattgagaggagaaatcaaacttcatctgcaacagataattttgatgcggcattgttgattatcgttaataaggctgaagaccctgtattcgtgaagcattatgagttcgacggaaaaacggcttctcttcatattatttctgttgaacagcttcaggaatggattctgcttggaacaaacaggagaatcatagactgggttctcaatggaaaggtgcttttcgaccgaaacgaatttatcgccaagctgattgagcagctcaatacatttccgttttcagaaagaaaactaaaaatcggacttgaatacgggaaattaatcagaagatatatagaaggaaaatcgttttttgaggacggtcaatttttggatgcctacaattccatcgtacacgccctccaccatttggccagaatcgaagtgatcgataaggggtttcaccctgaagttacggtatggaaccaagtccgccacatggaacctcaggtttataaattgtataaggaattaattgaaagcaatgaaagcttgcaaaaacggctggagttattattcctcgcaagcgattttctcattcattcaaaagccgaaataggggctgcctatattctcaatgtcatggatgaaaaatcggtttggcaatttgccgaacttcttaaacatccggatctcaagtatttcacgacagacctgggagttatactggagttcttggctgaaaaggatttagtcggagtaaagccgatagagacaaagggccaaaagatttttcaccgaggatattttattaaaaaaagtgttgacactaatttataa

SEQ ID NO: 2710 - DNA, 1005 bp, Bacillus licheniformis
acataagaaaagcggcaggcgccactgagtccccgcctgtaaaacgatgaaaccaaattttttggcggggcaggctgcttccaacagtgagcggcccttggttgagcctgcaaatggcggcgcgcagccttgtcccccctgcagccggccaagcattcagaaatgcgcggaaaacatggctgaagaagcctcagacaaagctctcgcttgatcgcacggaaacatctgaagccggcattccggtcggatttacggaagaagaaaaagccgcctatgccagacaggcattaaagatgatggggatcacagaccggttcgctccgctggttgtcatttgcgggcacggcagcagaagcacgaataacccttatgcatcggcactggactgcggcgcctgcggaggcgcatctggcgctttcaacgcacgcgtcctagccgctttatgcaatcttccaagcgtcagagagaggcttcgctccgacggcatttttattccggatgatacggtattcgctgccgcagagcacattacaactttggatgaactgcactggctctatgtacctgagctgccggctaaagctcaacaagcgtttgaccgcatcaactctgtgcttcccgatgtgagccgtactgtcggagccgaacgcttagaagagctgccgcagctcggctatcaaaatccgcggaatgaagttgagcgcttcgccgaagattggagcgaaatccgtcccgaatgggggctggcccgaaatgcctcattcatcatcggcacacgccggcttacacggggggccgaccttgagggaagggcttttctgcacagctatgactggcggaatgacgaggacggctccatccttagcggcatcatttcagggcctggaacagtggcccaatggatcaatctgcagtattacgcgtcaaccgttgcaccgcattattatggaagcggaaataaagcaactcaaaccgtcactgccggtctcggcgttatgcaaggaa

SEQ ID NO: 2711 - DNA, 1159 bp, Bacillus licheniformis
atgaccggtcaaccgctgacggtcggcatccaccagacgagtgaaaacacgatgctcctgcccgcttctttcaaacaggacggtctgttattcgccgctttcggtacgagtgttgaacggtgccatgtctcatttgacagccatttgaagcgcaccgttttattatccgaaaatctgtacaaaaacctgcggattccgtaccgcggcaaagcctccctgctttttcgcgacaataccgtctatatcgggcctttaatcgggattttcaccgccggtttcacaaaatcgcagctggatcctgtcagaggaaggtctttatttttttcgaagcttttgacgatggatctcccggcaggaggctacagctatctgttcggggcgcaccagattaattgggaagaaggcacggtgcaggctctcattttcagggaaaacggctgggaggaggccatagtcccgctgcctaatgttgtatacgacagactgccgaaccgcaaagccgaagaatcctccgccttgcgggaaacaaaaaaacggcttatggatgaataccgcattccgtggttcaatccgggcttctttaataaatgggagatctatgaatgtctgcagcaagacgagaggacagcggaattgcttccattttcggcattggagcccgatgccgataaaatcgaagacatgatcgaccaatacggcttcatttatgtaaagcccgccggcggcagtttcggcaaaggcatattccagctttcaaaacgggaagaaaacggtattcttgccagacatgccgaaggcgtcacatctttttcgtccgctgctgaatgtttaaaagaatggcagatgcttcacaaacatacttcttatcttgcccagcaaggcatcgaacggatcgaagtggatcatcacccggcagatttcagggttcatacaaacaaaaacggaaaaggtcaatggaccgtcacagccatcgcggccaaaatcgctggaaaggacggaattacaacccatatgtcgagcggcggcgccgtgaaaacacttgcagagatttatgatgatcctcaggaaaggcttcacactctgcaaaagctgacaaaagcggcggtccttctcagccgggtccttgaccgaaagcttgacggtttcatcggaaaaatcg

SEQ ID NO: 2712 - DNA, 867 bp, Bacillus licheniformis
aaaacagcataaaaaagaatcagcggtcaaaaaagcgtttaggatcgtcatgattcttatcggggctgcctgtgctgccgccagcatcgaattatttctagtgccgaataacatcatcgacgggggcattatcggcatttcattaatattggactacctctttaaagataacccgtatatcaacttcgctctgctcgtcgtcgttctcaacatcccgtttatgttttcaggctacaaacacatcggaaaaacgttcttaatttcaccactaatcggaatcgtcagcttgtcaattattgaaacactgttgcatcatgagaaggggttacgactcagccccgtctgggcagccgtattcggcggtcttctgctcggattcggcgtagggcttgttattcgtaacggcggttctatggatggaactgagatactcggcattttgcttacgaaaaagctgccgttttctgtcggcgaatttgtcatgttcgtcaatgtctttatttttgcatgggcgagctttgtgtttggccttgagcaggctatgttttcggttatgacatattatattgcgatgaagacgattgatgccgtcattcaagggcttgaagagacgaaagcggtcatcatcgtttcagatcaatacgaggagatttccgattcgctgctgcatcgcctcggccggggaacgaccaagctcaaagggaaaggcggctattccgacgaggacacagaagtgatttatgccgttgtgaccaggcttgaagtgacgaagctgaaatcgattgtcttcgatattgatcacaatgcttttataacgattatggacacgcacgaaacgcgcggaggaaagtttaaaaacgccatcca

SEQ ID NO: 2713 - DNA, 906 bp, Bacillus licheniformis
gaagccctcgatcggttcaaaactgttcgaatggattgataccgctgtaaaaaaagtaaaagaagcagacttggatttgaatttcgggcactcgtacgatgtccagcatatattccagtttaaagacactgatttttcgactctggatattcagcttgccaacggcagcgtcaaccttgtaccatggagcgattccgacatcagagtcgaatgccaggcaaaagtgtaccgggctgaaaatcaggatgaagcaaggcaggcttttctccagcatatcgactgcggtgtggaaggcgataagttcatgatccgtaccgagaaaaaaacgatgaagaccaaccttaccgtctatataccggacaaagagtacggcaaaatccgctttaaactgtttaacggcccggtcagaggggaacatttaaacgtaaaagagctgtccgccaaaacgacgaacggcgtgctgtcgttctctgctctcacggcaggaaaagcttcattggaaactgcaaatggacaaatcaaactagccgaccatacttgcggagagattgaagcggaaaccatcaatggattgatcgaccttaaaggttcatgcgaggcgcttgacctgcagagctttaacggcaatatcgcggcaacagtcaaaaatccgcactgccggacggcatatgtgaaaacaacgactggaagcgtagagttgaatgttccccgggactgcgctgttacagcggagctgaaaagcaatctcggttctctgtctcatgatctttcagatgcagaaattttaaaggaaaaaaacgagacaatccagaaggaaatgtacctaaaagcaaatcaaaatcatgatcatagcatgaccgtgtttttggaatcgaagacaggatcgatccatttaaaccatacaca

SEQ ID NO: 2714 - DNA, 1908 bp, Bacillus licheniformis
tgatcgaactatttagtgattatgtgctccattttgaacgttattttgttttaagcagacagagcatgcttgtcattcagtggtgtgtgacaggccttgtccttttgtatgccgtgtcatttcatccaaaagtgtgcaggcggcgcctctttttttatgcaggcatcgttctcaggctgatactggttggcgccctttcgtttgaattggctcaccaaatgaaagccgctgagttttcaaacctgtacatagacgaacaagatgcgcttctgccttttatgcagtttttgctgttcggctatattttgcttgtctcttttcattatatgatgacactcgcggaaaaagggggcaaggggctgttttttgcatttgacattgcggtgatggcgatgccgcttttccaatcgctgttcagctttgccgcctatttgaaggaatttggagcggaggagcttgaagaattgccgctcgttctgttgttgattgtcggaataccgggactgatgatctgcttgttttttcagctttattggaaaagaaaccgttacgttctccttttgattttttatattgtgacgatcggcggtttcttcatcaaaaagcttggatacgaattttttccgctgaacgtatttctgacaatgatcggttttcttatgacatatcacttgctgaatgactcgagaaagcctttgttgatggtgaagcgtgttttagccgcgggcaccgccgtatttttcacgcttcacctcaatcctttttacaatttggcggatgccgcttttacaatctcacacccggaggtttcagacgtggttgatgccaattttcggcctgtttcggttaaagaagcgaagcagactgtcagctcgttttttccgacagagagctttatctatttgtcagctaccaaccaggattttcataacgtttatcatttcaaaacgaaagattacgatgcggacgttgacggctggacgggaatgatcaccaattatcacaatcaaaaaaagcctagcgggaatatcctgtccggtcaggcatatatcaagcggtcgaagcaatttctaagggaacacggccgcgaacttgacaaacaaatcaaggcaaaggtcagccgtgatgacggcgaagctactgttgaattttaccgtgaaggcgaggatcctgaattaagcacaatgtggtttacttggcggaaggagactctgatgggattccatgaggacgcgtctgtttacagcttagaaagcgtgaaccaagcccgcgtttctggtgaggatatcgagcggggagttgaagccgtctatcgtaagctgggcatacccgtctcatcttatcggctgacagatattgatttattattcccattcagcctcaactcggcatccatcaacataaagacaagtgacggaatggggatggagttccaccctgtaacaggtgcattaacggctatttcgatcaaatctgaaagcgccttgccttatcgcggacaagagcttgaaaaacgcttgctttcattatttgatcaagacatttccaatctgaaaagggtggagttagaaaaggatctgatagaatttcagaaaaaagaaagcgatgctgtgttaaatacggtctggaccatgacgaaacatgaagagggagcttatctgacggtgagaaaaaactttcaaaaagcagatgaaaaacccccctacacgtatgcagacggggaaaaagcttttcagaaagtgtctgaacgctatcaaaaagggctggtctatcataaacggacgaagcttgtaatcgtttcagacggggatcaaaagagccgttatgcgtggcttgtcatcatccagccgttcggctcaaatgaacatgacgcatacttggttgatgccgagacagatgaggtgaaac

SEQ ID NO: 2715 - DNA, 1083 bp, Bacillus licheniformis
atgatcacgcttggatttatgtcgctgtcgcacggacatgaaaaagcctatgccgaagaactggccaaagtggcttcggactacggaatccgatttatccggttcacccccctggatatttcccccggttccctgcttgtgaaagggctctcctttcacccgaagtcaggacagtggaatgaaattgaaagagaaatcccggaattgatctatgaccgctgcttttacggcagagatcagcaatcgaaaaaagcaaaaccgattgtcgaatggctcaaaaagtatcctaaaacgacatttttaggacttggacttcctgacaaatggacggtttacaaagcattgaaagccgatcccgtcatcaagtcctaccttcctgcaacaacgattgcagaaaatgcccaggatatcctgcgcaagcttgcaaaagaaaaatcatgcatcttgaagcctgcatccggatcaggaggccgcggcatcattcatcttgagcttacgggaaaaacggtaaaggccgcctaccaaaccggaaaacacaaacagctgaaatcattttcgaaacaggcctcatttgaaacgtggtgccaaaaagttcttcagcaccgctatctgctgcaatcgttcctcgatattcaagacaaggacggttttccttgtgatatcagattgctgctacagaaaaacggctatggcgaatgggaaacagccggtaaaacggtaaggcggagctatcagcatggactgcttgcaaacctggccggtggctctgaggcggtgagctttgacagctggcttttatccgtgccgaaaaagcgccaggccgtccttctcgatgatttagagacaatggcgcaggccgttcccctggcgcttgaatcaaatcacgggccattattcgagctcggccttgatatctgcctgacaaaagacggaaaagtctggctgctggatgtcaactcaaagcccggaaaacacgcttttatcaagcactctcctgaaaaaagggagcttttgtataaaggtcctttggagtactgctcattcttaacggcttcagccggcgcgaaaggggctgagaaaaga

SEQ ID NO: 2716 - DNA, 1287 bp, Bacillus licheniformis
agaaaataaaagaagagattgtaaagaagctgaaggttccggtatttccgaatcgctcatttgatgtcacatcgtttggggctgacgaaaacggaaaaaacgattcgaccgaagcgatacagaaggcgattgatcaagcccaccaagccggcggcggaagagtaacggttcctgaaggcgtgtttctttccggtgcgctcagattgaaaagcaatgtggatcttcatattgcaaagggagcggtgatcaaattcagtcagaaccctgaagattatctccctgttgtgctgacgaggtttgaaggagtcgagctctataattattcaccgctcatctacgcttacgaagccgataatattgcgataaccggaaagggcacgcttgacggtcaaggagatgacgagcattggtggccgtggaaaagaggaacgaacggccagccttcacaggaaaaagatcggaacgctttgtttgaaatggctgagcgcggtatcccggtcactgagcggcagtttggaaaagggcattatttgcggccgaatttcattcagccgtatcgctgcaaacatatattgattcaaggcgtcactgtgctgaattcgccgatgtggcaagttcatcccgtgctttgcgagaatgtgacagtggacggcatcaaagtcatcggacacggccccaataccgacggagtcaacccggaatcgtgtaaaaacgtggtgatcaagggctgccattttgataatggagacgactgcatcgccgtcaaatcgggaagaaatgcggacggccgaaggatcaacattccgtcggaaaacatcgtcattgaacataacgaaatgaaagacgggcatggaggggtcacgatcggaagcgaaatttccggcggcgtgaagaacgtcatcgcagagggcaatcttatggacagcccgaacttggacagagccctccgcattaaaacgaattcggtgcgtggcggcgttcttgaaaacatctactttcacaaaaatacggtcaaaagcttgaagcgcgaagtgatcgccatcgatatggaatatgaagaaggagatgccggagatttcaaacctgtcgtccgcacggttgatgttaagcagctgaaaagcatgggcggacaatacgggatcagggtgctggcatacgaccactctccggtcaccgggctgaaagtggctgattccgagatcgacggcgtcgatgttccgatggaactgaaacatgtgaaagaccccgttttttcgaatctgtatattaacggaaaacgctatgact

SEQ ID NO: 2717 - DNA, 928 bp, Bacillus licheniformis
gtggaaatctatttagatgcgatatggctgttaaacttttgttttgacttgctgcttttaatgatgaccgcatttattttaaagcgaagggttaaaaagcggaggctgatcctaggggcatttgtcgcgtcaagcatcgttctgtttatgtttacacctttttcaccgtacgtccttcatcctgccggcaaactgtcgttttcggttgtgatcgttcttgtggcatttggttttaagcggttccggttttttttgcagaatttgttttctttttattttgccacttttttaatgggaggagggattatcggagcgcattctttgcttgaaacggattcgatcatggaaaacggcgtctttatgacgaattggtccggttttggagaccccgtcagctggctgtttgtctgtgtgggttttgcggctgtatggctgttttcaaaaaagcgttttgaagatgctgaagcgaagaaaattcaatacgaagaacgcgtccgcctagaggcctgcattggtgaacatacgcttcatttcaccggattgattgactccggaaaccagctctacgatccaatcacaaaaacgcccgtcatgatcgtcaatattgaaaaattgaaagttgtattgggagaagaggcaagtgtgaccatcaaggaaatgagcccgcttgatgccgtcgggaaactggatgaagcactgccgtatatcgggcggatccgcctgattccgtaccgcggggtcggccatcagcatcagtttctgctctgcttaaagccggatcatgtgctcgtttgtacggaaagagaagtgattgaagcgccgaaatgcctgattggcatcagcacatcaccgctttccgctgacggcgaatttgacgccatcgtccatccgaaaatgctggccggaaacccggtcaaacacgtttctt

SEQ ID NO: 2718 - DNA, 831 bp, Bacillus licheniformis
atgaacatttgggatattattgtcgctatcatacttggaattgttgaaggattaaccgaatatgcccctgtatcgtcaacagggcatatgattattgttgacgatgtctggctgaaatcgaaagaactgcttacgccggaggcggcgaatacctttaaagtcgtgattcagctcggctccatccttgccgtcgccttcgtatttaaagaccggattctcaatcttttaggcatgaagaaaaacattacggaagagcagaaatcgggaaaccgcctttccatcgcccaaatcgctgtaggccttgttcccgccgctgtgcttggatttttatttgaagactatattgatcaatacttgttttccgtccgcaccgttgcggtcggtctcatcgccggtgcggtgctgatgctcgcagccgactggatcaatcggcgcaaggatacgacagattcggttgataggatgacgtataagcaggcgcttggcatggggctgtttcaatgtctggcgctttggccgggcttctcgcgctcgggttcgacgatttcaggcggggttattctcggcttgagccacagagcggccgctgatttcaccttcatcatggcgattccgatcatgatgggtgcaagcctgctctctttaatcaaaaactgggcatatttgagtgcagacctgttgcctttctttatcgcagggtttatcagcgcttttattgtcgctctttttgtcgtccgttttttcctccggctgatcaacaagatcaagctggttccgtttgccatctatcgaatcgttttagggctgcttctgttcattttgtttctgtaa

SEQ ID NO: 2719 - DNA, 1096 bp, Bacillus licheniformis
atggatccaaaaaatcagcacgatcggattagcacgtatgaagccgcttcgatcataaccagcacaatgctcggcgcaggcctgctgacgctgcccagggcgctgacgcaaaaaacgctgtcgccggacggatggatcgtattaatctttgaggggcttgtcttttttctcattatctacatcaatgcaaaaatcgttaaaaaacacaacgtcctgtctttttttgattacacaagagaaggctgcggctttataatcgggaatattctcaacctgttaatcgttttatacttcatgggcgtggccagctttgaagccagggcgatggctgaaatggcaaagtttttccttcttcagttcacgccgatgagcgtgacgattttcgcttttatcgtctgtgcaatttatttggttgtcgggggtatcagcgatatgtcaaagatattcccgttcttcctgtccgttaccattgtcattcttctgatcgtctgcggactgagcctgaatatgtttcagctgaaccatttgcggccggttctcggccttggtttggagccggtcagcagagctttgacggtcgtttccatttcatttttaggggtggagctgatgatgtttctgccgaaatacgtcaaaaacaaagaaaagctttttaaggcatcggcgattggatttgggataccgctcttcttatatatcctcacctttgcggtcgttgtcggggcgctgaccgcgactgaggtcatgacgttgacatggccgacgatctcgttgtttcagtcttttgagataagagggattttcatcgaaaggttcgaatcgtttttgctcgtcatttggacgatccagtttttcacaacgtttgtcgtctatacgtactttgccgcttcaggacttgaaaacgtattcggatggcctgtgaaaaaaaacgtcctcttcatcggcgttgtcatctatctagcatcccttgtcccgcgggacgccaaccaggtcagcgccttcagcgactaccttggatatatctttatcgttgtcttctgtgcacttccgcttatgatctttttgctcgtgtccatcaaaaggaggtttacttctt

SEQ ID NO: 2720 - DNA, 1161 bp, Bacillus licheniformis
cctttctgaagcaaaggaaaaattgaaagcgcttaaaatcgagacgccttcatggggatacggggactcgggcacgcgcttcaaagtgtttcagcaagagggtgtgccaagagatccgtttgaaaaaatggaagatgcatcagtcgttcacaaattaaccggaatttgtccttccgtcgccatccatattccttgggatcgagttgatgattacggaaagctgaaagcgcacgccgagcagcttggccttgctatcggcgccgtgaatccgaacttgttccaggacgatgactacaaattcggcagcgtcacaaacgtgaaagcggccattcgccaaaaagcgactgagcaattgctcgaatgcgtcgatattgcaaaacaaacaggctccaaggaaatcagcctctggcttgccgacggaaccaactatcccggtcagggcgacatcagaaaacggaaaaactggatgtatgagtgtctggctgaagtttacgaagctcttgacgatgatatgcggctcttgattgaatacaaattttttgagccggctttttatcataccgatctggcggattggggcatggcttacaatttggcgcaaaagctcggcccgaaggctgaggtgctcgtcgacaccggccaccatgcccaggggacgaacatcgagcacattgtcgcttatttgcttgacgaaaaacgtctcggaggctttcatttcaacagccgcaaatacgctgatgacgatttgatcgcgggcgctcacaacccgtacgaactgtttctcattttttctcaaattttggacgcctgccgtgattctgacccgaacgtccggaagacggccgaacatatttcgtatatgcttgatcaatgccataatcttgaaccgaaaatacccgctgtgctgcgctcggtcatgaatgtgcagactcaatttgcaaaagcgcttttgatcaacttcgatgaagtgaagaaagcgcaggaagatcatgacgtgcttgccgcagaggctgcgatccgcgaggcatttgaaatcgacgtcaagccgctcctctgcgccgtgcgggaggaaatgaacgttccgcctgatccgctcaaggcttatgcggaaagcggatatgcggaaaaaatcctggcacgcgggaaaggcggtgcaagctg

SEQ ID NO: 2721 - DNA, 915 bp, Bacillus licheniformis
aaaaaatggatcgtattctcgcgttttattacatatggcttgtcatgaccgtatttttaatggtcatcgggttttacaatcactttacgttaaaccacctgccgagctcgaccctttataacgggccgcactataaacagcactatccgacatccgtttttttcaaccagaatgactttgcgacatttctgtccatcagctttttcttttatttatcttttttcaaaaacattaaaaacagctacttaaaaatagcggggctgctccttgcgttctgttcggcatacttgattttcctgactggatcaagagccagcatcctgggggtcatagccggccttgccgtttatgtgttcattttgctgccgaaggtgcttaaaaaatgggcgctcatcgccgcagctgcaggatgtatcgcttttgtcacactgtttgcaggaaagattaccggagctttttatacatactttttggctccgcaaaccgcacacgatttcagcgagccgctgccatccaatgtcgccagggcgaatttgttgaaaaacgccgggcattatgtgctggatacttacggatttggcgtcggcgccggcaatgtgccatattatttggagcatcatgcactgttcgatacggaccgggtcgtggaggttcataactggctcgttgagatcatgacgaattttggagtggtgatgatgctcggttatttaacgatgtacatttatttaataaccgtgctttacagatattataaaagatcgcttggaagacggccaaagcttcttattgaaggtttgacagccgcgctcgtcgccttccttgtgtcaagcatcagtccgagttccgtctcgaatttatatttccattgggtgttcctcgcgcttgtgattgcgacggttaatacctttagag

SEQ ID NO: 2722 - DNA, 1071 bp, Bacillus licheniformis
  misc_feature (1)...(1071): n = A,T,C or G
atgaatgaagattttaaaaaacgttgggaaaaatataaaaacggcgaactttccgaatcggaaatgctccgggtcgaagaagagcttgaacagcttgaagaataccaggacatgctggaacaggaaatgaaagacgaagactgggatttggcgatcagtcctgaaaagcaaaaagcgattttaagatacggaaaaaataaatcatatatgcggatctccacccttgctgttatttctacgcttattattctgccgatctgcacactcggcagctatctatactacgggttgggcgggcatgaaagcaaagggaatgaactggtgcaaaccgcttcaatgacagttgccgtcacaaacccgaatattcaagtcgatactgaagcccttgtcaacaaagtaaaactctttggaatcgaaacacagttcccgttaaagaagcaaatcggaaacgtcacaaaagtagttggaaatgaagaagtggaaatgttcttcgatcagctgaagtctccgcagattcatcaatacaatcaggagctttcaaaagaagaacgtcattttgtctaccctgacggcatcaaagaaaaatcagtgtccaaagccgagtcgattttaaaacagctgcctgacggaaccgtaaccgaagctttcctttcctttgaaaaaacatacccgacaaaggagctgtatgaaaaattaaaacgctatgatgttcgcgttctgtggaatgcgattgaaacagaaggcgatttanaagatcatccatacgcaaagccgatcggatttcccggaaaagattcaaaccggatttttgaaattcagcaacctgccgaaaacgatgacgaacagtttaaagcggcgctttcctacatgatcaagaacaagaaatgggctgaaaccatttcaggcaggaaagacctgaagctttccaaacggcttgactatgtggaacagaatggtgtgaacgtgtatggagccgtcattaccggaccgtcaaaagaggttgaacggctgatcaaaaaagggcctgtcaaagcagctaaagtaggtgaggtggaattatggaactggtaa

SEQ ID NO: 2723 - DNA, 830 bp, Bacillus licheniformis
atgaaagtaaaaaaaatcttaaacaacaatgcgctcgtcgtaaaggatcgcggcgaggaaaagatcgtattagggtccggaatcgcatttcaaaaaaagaagaatgatattgtcgacagatctaaaattgaaaaaatattcgtgatgaaagattcatcagaataccgccaattcgaggagatcttaaaaacattgccggaagatcatattcaggtggcggaggatattatttcttatgcggaaaaagagctcgggatcaaaatcaatgagcgaatccatgtcgccttttcagatcatttatccttcgcgatagaacggttaagcaagggaatggtcattaaaaatccgctgcttcaagaagtcaaagtcctctacacgaaagaatttcaaatcggccgctgggcaaaggctctcattaaagaaaagctgaagatcgatatccccgaggatgaagtcgccaatattgcgctgcatatccacacagccaaaacaaacgcgggagatatgacaaaaacgctcgatctcacaacgatgatcaaggatattatcgagatcatcgaaaacaaactcaacattaaaataaaggatgagacgatttcgtatgagaggcttgtcaaccatctccgtttcgccattcagcatatcgagtcgggagagacattttacgaaatggatggtgagatgatcagcctcattaaaaagaagtttggacaagcgtttatgtgcgcagaagaaatcggggcatttgtgaagcgggagtatggctttgaatttccggaaaaagagctgtgctacattaccatgcatattcagagattttatcagcggtc

SEQ ID NO: 2724 - DNA, 844 bp, Bacillus licheniformis
atgttaaccggattgacgattgcaatcatcggcggcgatgcaaggcagatcgagatcatccgcaagctgacggaacacgatgcaaaggtctttttaatcgggtttgatcagcttgatcacgggtttaccggagctacaaaactaaagctgaacgaacttgattttggcacaatagacagcattattctgcctgtatcgggcacatcgatggaaggaacggttgcgactgttttttccaatgaaaaagtggtgttaaaacaggaacatttagaaaaaaccaagccgcactgcgcgatttattcagggatttcaaaccaatatttagacggcatggccaaaggggcgaaccgtcgtcttatcaagctctttgaaagagacgatattgcgatttacaactcgatacctacagtcgaaggtgccattatgatggccatacagcatacagactttacgattcacggctcgaatgtaatggttctcgggctggggcggacgggaatgagcatcagccggacgttctcggcgctcggcgcacgcgtaaaagtcggagctcgcgactccgcccacctcgccagaatcatggagatgggcctcactcctttccacacaaacgaacttgcagagcatgttgaaaatatcgacatatgcatcaataccattccaagcctgattctcgataaacatgtcctctcacgaatgacacccagaacattaattctcgatttagcaacccgtcccggaggcacagattttgattttgccgaaaagcaaggcattaaagcgctgcttgctccaggacttcccgggatcgtcgcgcctaaaacggcgggacagatcattgcca

SEQ ID NO: 2725 - DNA, 914 bp, Bacillus licheniformis
atgaaacaatctgcagagaggcatcaataaaagaaaaggagttgaaccgaaccgatgcatacgatgtggaaaggctctatcagctttggccttgtcaatatccccattaaactgtttgcagcgacagaggataaggatattaaattaaggtcgcttcataaagaatgccgcgccccgattcagtatgaaaaaaagtgcacaaactgccatcaggaaatcgcgcccgacgacatcgtcaagggctacgaatatgttaaaggcaaatacgtcgtcttatcggacgatgagctgaagcagctcaaagaagagcaggaagacatggccgtcgaaattgttgattttgtgcagctaaaggaaatcgatcccatctatttcaaccgttcatatttcgtcggaccgggagataacggtgtaaaagcgtactcacttttgcgcgaagcgctcagaaaaacagaaaagatcgggatcgcccatatgaccatccgctcaaaaaaacagctcgccattcttcgcgtctacgaaaactgcattttaatggagtccatccactaccctgatgaggtccgaaacgcagcccacgtacccggtgttccggaagaaaccgcagtcaacgaaaaagagctgcaaaccgcgatttcattaatagacgagctgacaacgacatttgcgcctgaacaatatgaagatacgtacagaatcgcgctgatggataaaatcaaagagaaaatcgaccataatgaaggtgtcacgccaaatgccggggccgccgctccgcgcgaggatgtaatcgatctcgtgagcgctctccaagccagcatcgaacggacaaaagggcctgaccgggaagcggcgaaagcgcctgcagcaaaaggaacagctgagaaaaagaaaaaaacgtcgcgcaaaaaagcttc

SEQ ID NO: 2726 - DNA, 818 bp, Bacillus licheniformis
atgtcaaatcaaacaaaacagcccgcatacggagggcaggctgtcgtcgaaggcgtcatgttcggcggcaggcgccattatgtaaccgcgatccgcagaaaagacggaagcattgaatttttcaagctgcctcggaaaaccaatccgacgcttgaaaaattaaagaaaattccttttctcagagggattatcgcgattgttgaagcgagcgctaacggcaccaagcacttgaatttttcgagcgaacgctatgacctcgacccttctttagacgatcaattgaaagaagagaagccgtccaatctgacaatgatttttggtctcgccgcagtcggcgtcctgtcttttttgttcggcaagtttatttttacgctcgtgcccgtttttttagcggagctcacccgtccggtctttcagtcggacgtcgcgcagattatgatcgaaagcttctttaagctgctccttctcctaagctatatttacgctatatcatgcactccttttattaaaagagtttttcaatatcacggagcagaacacaaggtcataaactgttacgagcaaaatctgccggtcacggttgaaaacgttcagcggcagtcaagactgcactaccgttgcggaagcagctttattctattcaccgtcatcgtgggcatgtttgtttacttgcttgttcctactgaccctctctgggttcgtattttgaatagactcgcactgatacccgtcgttctcggcatttcatttgaagtcctgcagctgacaaacaaactgagagacatccctgtattgaaggcgctcggctaccccgggct

SEQ ID NO: 2727 - DNA, 768 bp, Bacillus licheniformis
gagcattaaaccacttcgttcgttttggtgggagcagtccctgtcatgtgtatttcctgtcgtattttgccttctttggctgttacacagaatcatacctcttcccttcctgccgcggtatgacttgctgctcatcatctgtgttctcatgcaatggtggatggtgcgttccggtcttgaacacggggatgaattaaaagtaatcacattgttccacattattggacttgctcttgagcttttcaaggtgcaaatgggctcctggtcttatccggaggaaggttactccaaaatctttggggtgcctttgtatagcggctttatgtacgcaagtgtagccagttatctttgccaggcttggaggaggctcaaggttgaactggttaagtggccgccgttttacgtcgttgtaccgctggccgctgcgatttatttaaattttttcctccatcatttttggattgacgtccgcttttggttatctggacttgtgataattgtcttttggaaatcatgggtcatatacgaggttaatgggattcgttaccgtatgccgctcgcactttcttttgtgctcatcggattttttatatggatagccgaaaatatcgcaacgttttttggggcctggacatatccaaaccaaaccagtacgtggagtctcgttcatgtagggaaagtgagttcatggctcttattagtgattgtcagctttctaatcgtagccacgttaaaacaggtgaaggggaaagattccactagagtgga

SEQ ID NO: 2728 - DNA, 1118 bp, Bacillus licheniformis
atgtatgtatttgggatttttgccgttatgattgcagtcggtgcacttatcggcgctgtaacgaatcattttgcgattaaaatgctttttcgcccctataaagcgatctacatatttggaaagcgggtaccttttacgcccggattaattccgaaaaggcgcgatgaattggcgagacagatgggacagatggtcacaggccatctgctgacaacagaagggctcaaaaaaaggcttgcatccgatgcggtcaaaagccaggcggtgcaggttggagagaggcttttggcccgcctctcgcaatcaacggccaccgttgaagaagcattggaaagcatcgggatttcaaaccccgcccaaaaagcggatcgagcggtatccagattggcggatgagaagctgaccgcatttttagaggcgtatgagaatgaaccgctgaaaaagcttttccctcttgaggctcaagaaaagctgaaagaaaaaattccgatggtgtccagctatattttaagccgggctgtcagctactttgaaagcgatgaaggcaaggaacgcctcggacatatgattgacgattttttgaaagaacggggcatgctcggcagcatggtgcagatgtttttaggcaacagcagtctggttgaccgggttcagccggagattgtgaagtttttaaagaacggcgagaccgcggggcttttacaggatctgcttgaaaacgaatgggacaagctgaaagaatatacgttcaaggaagcagatgacaaatggaacctcaaacctctcattttcgatttgaaggaaaagcttttgaaacgattctcgcttcagccgtttttcgaaaagacgataggctcctctatttccagttttgagcaggatatcgctttgcgcctttcgcagatgcccgaccgccttttggaagaagcggcccgccgcccttgatcaagcgctcaaacagttggaactcgagcaaatcgtcaaggaacaggtggacaacttcccccgttgaaacgtttgaaaaaaatggtgctgtccattttcaagcgggagtttaagaagataccctatttaggcggcctgtttggcggaattattggagcggtgcaagccatttt

SEQ ID NO: 2729 - DNA, 1134 bp, Bacillus licheniformis
ggtcctcgatcctgacaggtggagagaagtcaatcggcgattgctggcgaagatgctttctgaatatatgtatgaggatatcattaagcccgatttcattgaaactgaagacggcatcaaccgctatgagctgagaacggccgaggataaggtgtaccggtttgccgccaaaccacgcatgtttgacagttttgacgcggtgccggagacgattgaagtcttcaagggcggacaatggacaaaacatgtgagcgcgattgaatttctcctggatattcagccgcatatcccgatgagtccggagacagcgggtcatttgatcaaggagttcaaccatacgatgctggctgatgcccaccttttggcaaaggatgcgcttacggctgacgagctgaccgaagccgattatgccgtaattgaaggcgagatgaccggccatccgtggatcgtctacaacaaaggaagaatcggttttggctatgatgactacctccggtttgccccggaaaatcagagagccaaacggctgctgtggatcgctgtacacaaagataccgcgtcatttcactcggttgaagggctcgattatgagacgctgattcataaagagcttgatgagctgactttaaggcaattcgctaaagtcatagaaaagcagggcgcagccagtgaagactattattatatgcccgtccacgaatggcagtggacaaatacgatcattcagcagtttcctgaagaaattgcttcaaaagcgatcattcctttaggggaaggcggagacgagtacctgccgcagcaatcgattaggacctttacaaacatcacaaacaaacacaagcatcatattaaactgccgatgagcattttaaatacgcttgtatacagaggcctgccgtcggaacgtacggttatcgcgccgaaaatcactgagcatatcaaagggatcgccgaaaacgacgcatttctaaaagacgaatgccgggtgatcctgccaggcgaaaatgccagtctgaacgttgaccaccaatactatcactctcttgaaaaagccccgtatcaatatttggaaatgctcggcgctattttcagagaaagcatttatacgtatttggaagaaggagaacggcctgt

SEQ ID NO: 2730 - DNA, 820 bp, Bacillus licheniformis
ttgaaaatctataaagtattgaacaacaatgcagcaatcataaaggaggatggtcaagaaaaaattgtcatgggacctggtatcgcttttcaaaaaggcaaaaacgataccattccaagaaacaaggtagaaaaaatttttaccattcatgaagaaaatgaaaagtttaaacaaatcctcgaaacacttccggaagaacatattgaagctgccgaagagatcatcagctatgcggaagggcagctgtccgcaccgttgagcgatcatatccacatcgcccttgtggatcatttgtcatttgcgatcgagcgagtccgcaaaggattcgtcattcaaaataaattgttaaatgaaatcaaagcgctttataaaaaagaatatgagatcggactctgggcaatcgatttggtcaaagaaaaactgaaagtcgaattgcctgatgatgaagcgggttatattgcgctgcatattcataccgcaaaaatggatgcggaaaacatgcagaagactctaaaatacacgaacatcatcaaagaattgatagaaaaaatcgaatgctgtttcaatcagaagattgacgaaaacagcatctcatatcagcgtcttgtcacgcatctcaggtatgccatcaaccggctggaatcaaatgaagcgtttcatgtcatggacgatgacatgctttatttcatccggcaaaagtatcctgaaagctaccgatgtgcggcagggctggcggattacgtaaaaactgaatatgatcttcatcttccggaatcagaagtcggatatattacgctgcatgtccagcgtttaaatgatt

SEQ ID NO: 2731 - DNA, 777 bp, Bacillus licheniformis
taaaaagcgaagtgaagatcgtctataaacccggaagcggcggtgacaaaggctggaagtatataaatagcagcgatacgtacaccatcggcatgacatccagcttaatgctgagcaattacattctcggacagagcaaactgaaaacagacgatttcaccccgctggcgattcttgcaaaagaatggcagacgatcgctcttccaaaaggatcggaaataaagagcggaaaggatttgctgaatgagatcaaaaagaaccccggcaaggtaaaaatcggtttttcccccggacttggcaatgatgaccagctgtcattcgtcagggcggccgatatgtacggagttgacccttttaacattcaatatttacagtatgaaagcagcgaagagctcattcaggcgcttatcagacatgaaattgacgccgcatcgatgactctatcagaagctaaaacatatgaaagaagcggcagcatcacacttggggctgttacttcagacaaaaggcttcccgcatatccgcatgtaccgacgtggagagagcagggcatcccgtttgtattttcccattggagaggtgtattaggcccgaaaaatatgaccaaagaagaaatttcctactgggatcaagtgtttaaaaagatcacatcctcaccggaatggaagcagaaaataaatgaacaggaatgggaaagctattatttaaacagcaaggagacgcaacgattccttgaggagcaatcagcattttatcaaaacatcatggctggggatt

SEQ ID NO: 2732 - DNA, 1094 bp, Bacillus licheniformis
atggagaaagcaaaaatcagtgctgcacagctgttcgtgcttattgttctgtttgaactcagcagctctctgctgatttttccaggacaatctgccgaacaggacgcctggatcgcgatcttgttcggaacagtcggagggctggctttgtttatgatgcatcactttttctaccaggtgaatcccgacgcctctccctatgaaacgctgatgaatatttttggaaaaccggttggctggagcatgacatttatctacattgtttattattgttacattgcggcaagggttttgcgcgattttggagaaatgctgctgacatcggcttatccgaacacgccgattatcttcgctaatggattgttgattgcagtttgtatttttactgtgaggaagggaatcgaggtccttgcccgttcaggcgagctgttgtttggcatcatgttttggcttgctgtcacaggcctaatcctgatagtttcgtcaggcttgatcaaaccgaaagagcttttgcccattcttggaaacggacccggtccgatgtttcatgccgtgttcacgcaaacgctgtattttccgtttggagaaattatcgcctttacattgatcctgccgtatttaaaggaaaagaaactagcgaaaaaagccgggttgttgggaattgccatcagcggcctcatcctggcttttaatgtcgcattgaacatcagcgtgcttggcgtcgatctcaatatgcggtcgcgcttcccattgctgagtacgatccagacgattcaagtcgccgaattcttggacaggcttgatgtatttttcatgctcgtgctggtgattggcggtttttttaagatgagcattttcatgtatgccgtaaccgaaggcgtgaccgttttattcaagcttaaaaacccctccaaagttgttcatgtcatcggcattattattttgattttgtccgtctccattgccagcaatatttcagagcatgttaaagaaggaatcgagtttgttccattatatgtccatttgccgatgcaggtgatccttcccgcttttatttgcatagtcacttatgtgaaaatgaaaaaaaataaaaa

SEQ ID NO: 2733 - DNA, 709 bp, Bacillus licheniformis
atggaatttgaaattcgctacatctccttttacgtcatccaggtcgacggcaaggatgagcaggccaacaagcaatataaacattttcagacgctggatacagaggaatttgaaaacagcgagctgaaggatttcttagacggggaattgaaaaaaatcgtcaagcggaaagccgaacgccatccgaaatcggagcaggtgccgacgaaaatcggccgcttcatcacagagccggggcatgagcttgattctaatccgaactacaatctgtttcacaaaacaaaactggcggagacaaaggaagaattcaatgaactgagcgaacagttcgtccgcacatacctcgacacgagcgccgtcaggggaggcgtgtttttagtggcgacagccgtaccgcgcaaatacttcgatgatacatttgtctttgtcatgaagtgcgactttgaaccgaaggtcgctacgatcgccgatgaatcgtcgctgattcgcaaggtcgaaatggcgattacgacgaaaaacatgaaatcgattcagtacccgcacatgcctgaagagggcatgacagaggaaagcgaagtgaaaatccaccaggcttcgcacgcccgctactttgaagacttcttaaaattcgtcgagtacggcgagtcgatgccggaaatcatgaagtcacaagtgatgaacatggtgcaggagcacgtgtacgagagca

SEQ ID NO: 2734 - DNA, 756 bp, Bacillus licheniformis
aaaaaggggttgaaaaaaggtgagaaaaagctttgttttgcttttaacggggctgcttgtaatccttatgctttctgcctgcggccaaaaatcgcaagaagatgttgtgacggggctcgacaagaaggcaaaagaatacacgtcctataaggcaaaagcgaaaatgaccattgaaacgggaaatgaaccgcaggagtacaacgtggaaatctggcataaaaaaccttctctttaccgggtctatttggaaaacccgaaaaaagaccagagccaggtgatcttgcgcaatgaaaacggcgtgtttgttttgactccgtcgctgaataaaagcttccgctttcacagcgactggcccaataacagcagccaggtatacttattcgaatcgctcgtaaaggatgtcaaaaatgatggggaagcttctttttccgcaaaggattcaaaatacatttttgaaacgaaaacgaattatcagcataatcagatgctgccgactcaggaaatcgttttccataaaaagaccatggctccttcatcggttaaagtgatggataccgaccgcaaaccgatggtaaaggttgagtttacaagctttgaattcgataagccgctcgataaagactcttttgatgaaaagaaaaatatgacgctgtctcaaattgacgtagcgacaagcgctgacgtgtcagactctttcgctgtcaaaacgccgctcgatgtgcctcagggcgtgaaaaagcttgaagagaaagagat

SEQ ID NO: 2735 - DNA, 921 bp, Bacillus licheniformis
aaaaaagcggcagacttttgatgatgttttgcatcagcgcgctgggcactgcggccggaagcgtcattgctttttttctgtttaaggatcagattccgcaccttgataaaatcggcggcatgatcagcgcctcttatatcgggggaggcgtgaattttgcagcgatggccgccaagttctcaactcccggtgagtatgtatcatcgacggtggttgcggataattttatgatggcttttctttttttcattttaatggggataccggcgctaacatggtttcaaaaacgcttcggcgttcaggaagtggcgggcggccgcgaaaatcaggcggaagcctattggaagagaaaagacatctccttgcaggacatcgctttaaacatcggaaccgcctttgcgatcgttgctgtgtctgtaaaagcagcggcttttttcaaggaacgtttttcttctgacggcggatttcagtttcttgcctttattctgggcgaccagttcctgctgctgacgacgctgacaattttgctgacggtagtgtttccccgctattttgaacggctgcgcggctcacaggagatcgggacttatttgatttacttattctttgtcgtgattggcattccggcggatttgcggatcatcctcatgaacgccccgctcctcctggcatttgtctttgtgattgccatgtccaacctgctcgtatcgctcttctgcggaaagctgtttcgttttcggctcgatgaaattctcttggcttgcaacgcatctgtcggcggaccgacgacagcggcggcgatggcgattgccaaaggctggcggggcctcgttgctcccgtaatgctggtcgggacgttcggatatctgatcggcaattatgtcggcaccttcttgggcacatggttttccaccctgttat

SEQ ID NO: 2736 - DNA, 762 bp, Bacillus licheniformis
ttaatatgtttttgcttcccaaccggattgcagccggcggagtcagcggcatcagcaccattttgcaatcgttcggctttgaagccgcctatgtgcaatgggcatttaatattcctttatttattgccggggttctggtactcggaggaaaattcggcatcaagacgcttgtcgggtctgtttttctcccgtttgtcgtatacgtgacgcgggacattgctccggcgacagagaatccgctcttggccgccattttcggcggtgtcggcatcggagtcgggatcgggatggtctttctcggaaggggctcgacaggcggcactgcgctggccgcgcaaatcattcataagtacaccgggctgtcgcaaggcaaatgtttggcgctgattgacggaacgatcgtcctgtccgcgatgtttgtttttaacatcgaacagggactttatgctatgcttggcgtttatatatcaagcaaaaccatcgatgtcatccaggtcggattgaaccgttccaaaatggcgatgatcattacgaaccgggaagaggaagttcgacatgcggtactgaataaaatcgacagggggattacgaaaatatcagcggtcggaggctatacagatgatgagcggcctattttgatgtgcgtggtcggccagaccgagttcacaaagctgaaacaactcgtaaaacacattgatgagtctgcatttgtcattgcgatggatgcttcagaggtgcttggcgagggttttaaacgcgcat

SEQ ID NO: 2737 - DNA, 991 bp, Bacillus licheniformis
atgactcaatcggaattcaaggaacacatccatgaaaatctcgcaatgctccttccccatctcgagcataacgatgatctgattcaaaataaaaaaatgctgaaaaacggaatcattttttactttttgtactttaaagatttgaatgatgacaagaaaatccagaaggctgcgaaattgcttgtctccgatgacagctcctattcattggaggatgtccggctccgcttaaacaagctgaatgcggaacccgttacagcaaaaaaggacgcgattaacgcaatcttcaaaggaaaatgtctgctgttgatcaacggtttgaatactgtatttgcactgccgacagctgagaaaaagaaaagaagccttggagaagtgaatacagaaaacgtcgtcagaggcccgaaagtcggttttatcgaggatgtcgatacaaatgtggctctagtcaggcagcgtgtcccggataaagaactgaccgtggaaaaaatcccgctcggcaagagcaagtttaaagacgcgaccattctctatatccagggcaaagcggacgattcgatcatcaaagatcttaaaaagcgcctgaaaaaagttcagctggatgatattcaagataccggcgttcttgaagaattaatcgaagataataagtactcgccgtttccgcagatccagaataccgaaagacctgacaaggtttcttcagcgctgtttaatggacggatcgcaatttttgttgattactcgccatttgccctgatcgtgccggcttctttcggaatggtgatgcagtccccggacgatttttacgaaagatggatcgccacgaccttgatcagatttcttcggttcagttcgattttcatcaccctgttcctatcggcgtctgatatttcgctcgtatcttctcatcaaggcatgctgccgacggctctcgctgttaccattgcgagcacgcgcgaaaatgtgccgtccccgccgttcctcgaag

SEQ ID NO: 2738 - DNA, 858 bp, Bacillus licheniformis
cccgattcatgtgcttgcctttatgccgtcgatctccgcaatgaagcagttttccggctggctctcagaaagggtgacgaatatccacctgagctcccagcgcatctatgagacgggcatcggtcttcagcggaaggtgaaagagctcggcggcctgttcattcccgcgcacatttttacgccgcacaagagcctgtacggaaaaggagtcgaattttcgctgaaagaagtgtttgacccgaggatgattgatgcggttgaactcgggctgagcagcgacaccgatatggcttcacacgtatccgaactgaatccttatgcatttttgaccaattcggacgcccattctcttggaaaaatcggcagggagtataataagctgcacatcaaacatgccagctttcaagagttttcgcttgctttaaaaggacaagaggggcgtagcattgccgcgaattacgggatgaatccgcagctgggcaaatattttcaaaccgcttgtgaaacatgcggccgtctgcaggaggcagatgaaacgttgtgcaaagcgtgcggcagccgaaagtttacaaaaggcgtcagcacgcgtctaatggagctttatgatcaggatgaaagcccggtcaagcgcccgccgtacgttcaccaggttccgctgcagctgatccccggcatcggcccgaaaacgattcagaagctgaaagaggctttcggcactgaaatgaatatacttcaccgtgtaaaagaaggcgatctaaaagaaaccattcgtccgcagacggcagagctcgtgatcaaagcaaggaacggggatttagagctgaaagccggaggcggcggaacctatggaaaagtgca

SEQ ID NO: 2739 - DNA, 1173 bp, Bacillus licheniformis
aaactaacaccatccgttatttaacgagtgttttactattgtttctattaaccggatgctggagcagccacgaaattgaagagctcggcttaacatttgcaatggggattgacaaaggcgaggaaaccgaacttgaaaaaaagtttgacaaagttgggggcgattatccgaaaaaagaccggatcacgatgatctatcaatacgtgaacgaacaagcagccggttcaaaatcgattggaggaagcactgatcaaaaaacgtatatcaacgtttatgaaactggagactcgcttcagcaaattaacgctgaagtagcattaagacaagacaggcctgtattcagtcctcatttaaaagtgattgtcatcgccgctgacctcctccgcacctattcgctgtcggaactgctagatcagcctctccgcgataatgaaatcaggccgagcagtatggtgctggtcacaagagggcgtgcgagagacacgcttgagctgaaggaaaccggcgaaatgccggcgtttcgtctgcttaaaatcgttgaaaatgagtataaagcgaaaaaaattctccctcctgtaacgcttgccaaattgacaggcaaaatgagatcaggaacaagctatctgcttcaaaatgtcatcggtaccgatggagaaataaaatatgcgggagcagccgcaattaacgggaaaaccaataagctgatcggctatttggatgaacacgatttagaaggcgtgatgtggatcatcggaaaggggattgggggcatggttaaaagctatgatccgacagaaaagaaggtgaccgcatttggcgttgaatcgattaaaagcaacatcaaacccatcgtcaaaggaaaccgcctgtcttttgaagtgaacgtaaagtcagaggggtatcttgcggaaaactggaacacgaaagaaaaagcttttgatgacaaatttttagaaaaagtcgaaaaaacaaccgcgaaaacggtgaaaaaatcgatggaggacattacaaaaaaaatgaaaaccgaatacaaagcagatcttgccggattcggtaacgagctgaggatcaagcatccgaggctttgggaaaaactaaagaaaaattgggatgagacctttaccgatataccgattacatttcatgttcaaatcgcgattaaagaatacggaa

SEQ ID NO: 2740 - DNA, 752 bp, Bacillus licheniformis
atggaatatcaggtgaaaatcgaggcgtttgaagggcccctggatctgctgctgcacttaatcaaccgccttgaaatagacatttatgacatacctgttgcgaagataaccgagcagtatttattatatgtgcacacgatgcgcgaacttgagctcgacgtggccagcgagtatttggtgatggctgcgacccttctcagcatcaaaagccgaatgcttcttccaaagcaggaagaagagctgtttgacgaagagtttctcgaggaggaagaggatccgagagaagaattgattgaaaaattaatagagtacagaaaatacaaaagtgccgcgcaaaatttaaaggagcgcgaggaagagcggcaaaaagcattcgcaaagccgccgagcgatttaagcgactacgccaaggaaatcaaactcagcgagcaaaagctgtccgtcaccgtttacgacatgctcggggcgtttcaaaaagtgctgaaccgcaaaaaaatcaaccggccgtctgaaacaagaatttcaagacaggaaataccgatagaagagcgaatgacgcaaatcgtcgactgtttgaaatcgtcccgcaaaaggatgcattttatggaactgttcccgtatgaacagaaagagcatctcgttgtgacgtttttggcgattttggagctgatgaaaaaccagctgatcatcattgaacaggaacacaacttttcagatatttacataacagggagtgaagcgattcatgacgc

SEQ ID NO: 2741 - DNA, 792 bp, Bacillus licheniformis
atgaaaaagcttttgtgttttacgctgactgcgtttttatcctttagttttttcgctgtacaggaagctgacgcagccaagccgatcaagattccaagctctgtcacgaatatttccaaagagaacacataccctaacgcctctcaggatcagccgaggctgcagccgagcgaattagccgaagagctgctgaaaacaaccgatattgcgattgaaaatccgcatctgattaaaatgctgaatgagtcaagcatttccggcacaccgctggcaatcggctatcgggcgacgatttatttgggcagatgggcgctaggttacacctcgaatgaaaccgttgcgaactgggaataccgcaaaatcaacacaaaccgctttgacaaccggggcgggaaagcacctgcagaactcacgtattcccaggaacagacgagcaaaatcaaaggcggcttaacagcgaaagttccaaaggcggaagatgtcaaaaatatgatgatgctcaaagccatggaaaaaacaaagctgccgctcgcctttgaaacagtggtcggctccggtacaaaacgcgatcagatttataaagtgcagccgaaaaaactgggaaatttacacgcctatgcacctgccgtcaatgaaaaaggaaaagtcacctacggcgaagtgtacatcgtattaaaaggcaacaaaagaaagctagtcgtcaaaaatatcacctcgcaaggaatcggcgcttggattcctgtacaggatcacctgacattcggctttcagctcagccatcagccgaaataa

SEQ ID NO: 2742 - DNA, 854 bp, Bacillus licheniformis
gtgaagaataaatggctttcttttttttcaggaaagatccagcttaagataacgggaaaagggatcgaacggttattaaatgaatgcaccaggcgcaacatcccgatgtttaatgtaaagaaaaagaaagacgccgtctttctttatattccgctttctgatgtacatgccttccggaaggtcatcagaggcttcgactgcaagtgcaggttcatcaaacgaaaagggtttcctttcctcgtgcagaagtctaaacggaatagcggcttcacttttggagttgctgcattttttatcatcatgttcctattgtccaacatgctttggaaaattgatattacaggagccaatccagagacagaacatcaaatcagacagcaattggatcaaatcggcgtcaaaaaaggccgctttcagttttcaatgctgaccccggaaaaaattcagcaggcgctcacaaagcgggtcgaaaacatcacttgggtgggcattgagttaaacggtaccgcccttcacatgaaagtcgttgaaaagaatgaacctgacaaagaaaaatatatcggtccgaggcacatcgtcgccaaaaaaggggcgaccatctcgaaaatgttcgtggaaaaaggcgagccgctcgtcacggtgaaccagcacgttgaaaaagggcaaatgctcgtttccgggctgatcggaagcgaagaggaaaagcaaaaagtcggagcaaaagggaaaatctatggtgaaacctggtacaagtcaacagtaacggttcctcttgagacatcatttgacgtttttacgggtaaagtaaggacaagtcacaagctatccccggaaatttgcgttccgcatctagg

SEQ ID NO: 2743 - DNA, 832 bp, Bacillus licheniformis
atgaaaacagcagtagtaacagacagtacggcatatatacctaaagacctgcgtgaccgctacaatattcatatgatacctctcaatgtgatctttggagagacttcatacagggaagagatcgatatgagctggaaggactattacaaagaagtaaaagcccacgaaaatctcccgacgacttcccagcccgcctacggcgagttgatttctctctatgaaaaactcggtgaaacatatgacgcggtcatcagcatccacctttccagcggcatcagcggaacattcaacagcgctgtatcagcaagcggtatgcttgaaggaattaaagtgtatccgtttgattcggaaatcagctgcatggctcagggtttttatgcgatcgaggcggctgagatggcggaaaaaggagcggctcctgaggaaatcatccgccacttggatcatatgaaaacctcgatgagggcttattttatggttgacgacctttcacatttgcaaaggggaggacgtctgagcggcgcccaggcttttgtcggaagccttttaaaagtaaagccgatcttgcattttgagaacaagctgatcgttccctacgagaaaatccggacgagaaaaaaagcgatgaaccgtttatttgagctttttggcgaagatgccgagaaaggaaagccgctgagagcggttgtgattcatgccaaccgtgaagaagaagccgatcaaataatcgaagaattgtcgaagcaatatgcacatgtcgaattttataaaagctatttcgggcctgtgatcggcactcaccttggtgaaggagcgatgggtatcgcctggt

SEQ ID NO: 2744 - DNA, 786 bp, Bacillus licheniformis
gcttgaactgacagcgggcacaaagctgtcaggcggggagaacggaacggcaagcgttgccgattacaccgcatttttagatgctgccgaaacggaatacttcaatacgatcgcactcccggtcgcagacaatgaacagctgaaagccacttttgccgctttcatcaaacgccttcgcgacaagcagggccagaaagtccaaggcgttgtcgccgattatgccggagactatgaaggcattattaatgtaacgggaggcgtcgtgctggaagacggcactgaaatcactcctgaaaaagcgacggcatgggttgccggagcgagcgcaggcgcgacttttaaccagtcgctgacatttgtcgaatacgaaggtgctgttgatgtcctgaaccgtctggatgaagaccaggtcatcgaacgtctgaaaaaaggcgagtttttatttacatttgatgcacgcgatcaatcggtcagcgttgaaaaagacatcaactctttaacgagtttcactgccgacaagaacaaaaaattctcgaaaaacaaaatcatccgcgttctcgacggagtcaacaatgacctgacccgcgagttaaaggctttaatcaaagcacgaaaagcaagcggcagcgacatccctgcatcagacgatggtttgcaatacgtcaaaacgctgatcattcagtatatgacggcgcttcaggaagccggcggcattaccggctttgattctgaaagcgatattgccattacactgaatgaagaccgcgacgggtttttaatcgattt

SEQ ID NO: 2745 - DNA, 795 bp, Bacillus licheniformis
gccggcgatggggattttcgggttgtcaggggaagcggcgataccgcttgtgctcggcaacatgctgaacttgtatgccggaattgcgggaattttaacgcttgatttgaccgttaaagaagtgtttattttagcggttatgctgtcgttttgccacaacttgattatcgagtcgactgttgcttcaagggtcggaatcaaaatatggctgattttgctcgtgcgcatcggtctcgctgttttttcggccattatcatcaaccttgtctggcatggcgggcaggatgcggccaaatacggcttaatctcagcgaaaagcgccgctccttccggctggtttgacattgcgctagaagccgtgaccaaggcgggtcttggtgtccttcagcttgcagccatcgtaataccgctgatgatcatcattcaatatatgagagacctcggctggctgaatgctttttcaaagtggtttgcaccgataacgagaatgcttggaatgaaagagaacacctcaatgacaatggttgccgggctgacgatcggccttgcatacggggccggcgttatgatcaaagcggtcgaagaagacggcgtcagcaaaagggatgtcacgcttgcttttatttttctcgtcgcctgccacgcggttgttgaagatacattggtatttatcccgctcggcattccggtctggcctcttttgttgatcaggcttgcgaccgcggttctgctgacgatcgcgatttcgcgcttctggagaaagccgggttattccgttcgcagaaaggaagcttt

SEQ ID NO: 2746 - DNA, 810 bp, Bacillus licheniformis
atggactttttaacatccaaggtgctattgattttttgttttctgttgttgatccattccatcgaaacgctcgcttacgctgcccggctgtcaggcgcgagagtcggatttatcgcatcggctctgtcattatttaatgtgatggtcatcgtctcgagaatgtcaaacatggttcagcagcctgtgacgggaaagcttgttgatgtcgcgggggcggatgcgctttccctcgtcggtagccaatttcggtttttgatctttggttcaaccgtcggcacaattttcggaatgctgcttctgccgacattcgtcgccgtattttcgagagcgattgttcatttggcaggagaaaatggctccgttttgcaagtgtttcgcaaggcgttttcaaaaaatagcttcaagcatgcaaagcattatgcaaaaagaccgagcctggaatatgtgaaagactttcggttccgctatataccgaaacggctgtttgtcttgaacatggtcattacggcgatttatacaatcggcgttcttgccgctctttatgcgggcgtccttgtgcccgaaaggcatacgaccgcggtgatggcctccggccttgtcaacggggttgcgacgatgctgctcgcgctgtttgtcgatccaaaggtgtcggtacttgcagatgacgtagcaaaagggaagcggagctatacgtatttgaaatgggcttcgatcacaatggcagcatcgagggtggccgggacgatttttgcccaagtactatttattcccgcttcttactatatcgcatggatgacgaagtggatgtag

SEQ ID NO: 2747 - DNA, 774 bp, Bacillus licheniformis
tgcccaaaaaaatcgacagggtttttatactcaggtttggcgtttcgtttttagctgtattttatttaactgtgctgttggcgggggaaaatgcgggatcacggctggtgctgctcgaaagtgtgctcggaattggctacggattttattggcttgcgtttaatgtcctgacatttgaaatcactgagccggacacgagagatttttttaacgggttcctcggcattttaaattccggcgcgggaatgatcggtccgattgttgccggctatgtcatttcaaggcttgccgacaacacgggatacacggtgattttcagcctgtccttggctttattttcagtggccgtcattacgagcttttttttaaaaaggcgtgaatcgcgcggccgctacattttgaaaaaaatctggacggaacgaaattcagacccgaattggcgcagcattacaaatgctcatttttttcaggggctgagagaagggattttcgtttttttaatcaatgtctttgtctttatcacgacaaagagcgagttggcattggggaagttcggcttgattaattcagctgtttctttttttgcatactatttcgcaacgcggcttattaaaaagggagcgcgcaaaaaggcgattttaatgggcggtctcgtcctgttcggcgctctctttctgattttgtttcatatgacgtatgtgacgcttttgctgtatgctgttgcgattgcgatcggctatccgattttgctcgtaccgtataaatcgctcacat

SEQ ID NO: 2748 - DNA, 882 bp, Bacillus licheniformis
gcagtcaacttttcaaactgctcggcgatttgccggggaaaaaaagcattgatgcgagcactcttaaaatcgaagaaaagtcatcttttattctcgaaacgcttttgcttgatttaaacggaattgaagcggtgccggcctattttgcaaaaccgaaacagatgaacggcaagcggccggccgtgctttactgtcattcacacggagggcgctacgaaaggggaaaggaggagctggttgaaggagcggagtacttgcaagcgccgccgttcgccgaggaattgacggctttgggattctccgtgcttgcgattgatcattgggctttcggagacaggcggggcaaaacggagagtgagatatttaaagaaatgctttggacagggcgggtgatgtggggaatgatggttttcgacagcatcagagccatcgattatctgaaaatgagggaggacatagacgaaagccgcatcgcttcactcggcatgtcgatgggaggtctgatggcctggtggaccgctgcattggatgagcgggtcagcgtatgcgttgatatatgcgctcaggtggacagcgaaacattaatcaagacgcagaatttggaccgccacaatctctattcttatgttccagggctggtcaaacacttttcaaccgctcaaatcgaaagcttgatcgctccaaggcctcatttaagcctggtcggaaccgcagataaactgacgccggttcaagggattgacattattgaagaaaagctgtccgatgtgtatatagaaaaaggcgcaggtgaacgctatgaagtgtttcgttctcattcagggcacctcgagacagccggaatgaggcataaagcggtcggtttcttaaaaacatggctgt

SEQ ID NO: 2749 - DNA, 1095 bp, Bacillus licheniformis
tacgatccgaaaaggtcgggaatatgttgaatcaatggtatgcaacaattaagttacagcaagttcataaagcaactcaaatgaagaaagaaattcagaaggctattgataatatggagaagaatcaagatgttttgctttatttcaatatgatagattctcggtataaattattgatcgaaaaatataacgaatccggaagcatcttaaaaagtcttaagtatagagctgaagaaaagaagacggacgacatgcttcagtattacttttactttttcagcgggctgtatcagttttacataaagaactttacgaaagccattaatttttatcgcattgctgaaaattggataaataaaataccagacgaagcagaacgagcagaattcaattatcaaattgctattgcatattatgaaattcaccaaaattttttctcgttaacacacgcagaaaaagcgctcgaaagctttttagcccttggaaattatgaaaatagggcagcaaccactcaaatgataattgcggcaaacagactggatctacatcaatacgaattaactgagtccgtatataaaaaagcaataaaaatggctgctgatacccgacaaaattacgttgagggactcggacatcacaatctcggtcttgcttacgaacgacaagaaaaactcgatttagcgcgtgaatccttcgaaatagctctcgacatttttgaaaatctacattccaaaatcgcaatcatcagaacttcttatatgctggcaagggttttattcaagaaaggtttattcgaagaagggacacattggtatcaaaaagccctcaatctcgcaaaagaaataaacgaaaaaacgtacgaagccaagttattagtcatacactcaatatataaagagttggataagaccttattagataaaggattgaatatgctaagagacaaaaagctttggtcagacgtagcagatttagctatcattgcagcaagacacttcaaaaagaaggaatatcatgaattagcggcgaaatacttcgatgaaggagtagtcgctcgcgacaaaattcaaacatggacggaggaacttgtctcat

SEQ ID NO: 2750 - DNA, 963 bp, Bacillus licheniformis
atattccatggacagcttaaagcataagctggcagaaattttggatgtcattccaaggcattcatcagtcgtttacttggactacccgctatacggaaacgtcggggatctattgatcatgaaaggaacggaagctttttttgaagcatacggcatcaaggtgcgcgaaagatggaatgcggagaatttcattccgggccgccgcattccaaaggacgccatcattgtttgtcaggggggcggcaatttcggcgacttgtaccctcacttccagcagttcagagaacgggtggtcgaacattacccggacaaccggatcgtcattctgccgcagtcgatttattatgagcatgaagaaaatataataaaaacgcgcggcattttggcggctcacccggatctgcacttattcacgcgggaaaaggcatcattcgattttgccgtcaagcgtttcgaagaggtgaaaaacatcaaaatgatgcccgatatggctcaccagctctggccgatcgcggcacctgccgaaaagccgtccgagtccgttctgcggttgatcaggaccgacaaagaagccaacagcagcctgcagaaagcaggggagccggacacgtacgattggaacgtcatcttatcagaaggcgacaaacgcggaatcaaacgcctgcagacgatcaatgtcctcaacaaaaaagcgggcaatccgctgccgatcgcttcttattggaaacgcttttcggacagcctcgtcgacaaatcaatccgtttcttcagccgctatgaatcagtcgttacttcaaggctgcacggccacatcttatcgtgcctgctcggaaaagaaaacgtagtgattgacaactcctacggaaaaaacgcgaattactacaatacatggatgaaagacatcccgaatacgaaactgattcaaaaccatcagacagaagcagaaaaaccgcctgttcacgt

SEQ ID NO: 2751 - DNA, 843 bp, Bacillus licheniformis
atggaaatttatatgtttgtcgaccctttatctcccgaatgctgggcattggagccggcgatcaaaaagttgaaaatccgctacggccgctttttcacactaaggatcatcgccgcatgcagcattacagcgctgaacgttcagaaacgcaaaaagcgccggctcgcagaggcatgggaaaagatcgcatgcaggtcgggcatgtcttgcgacggaacgctcctgcacgacaaagcactctctgcaccttaccttgcctcgctcgctttgaaagcagcggaactgcaaggcagaaaagcagggctgcagtttttgagatgcatgcaggaaagcttgtttctcaatcagcaggatatcactgaagaacaggtgcttttagcgattgcagagcacacgcagctcgatttggaggaattcaaaagggatcttcattcgcagagcgccgtgaaagccctgcaatgcgatttaaaaatcgctgccgaaatggaagtggcatctgttccgactcttacgtttttcaacagcctccgcgaaggagaaggcttaaaggtaaccggaaattattcatatgaaatttacgaagaagtattgtttgaaatgcttggcgatgagccgaagccttcacaaacacctccgctcgaactttttatcgaatactttcaatttgtagccgacaaagagattgccgtcgtttacgactggacgcttgaacaggtggaacgggaaatgaaaaagctcgcgttcgcccgcaaagtcgaaagagtggaagcgaaacacggcatgttctggcgctatataaatgaacatcacgatgccggtccgctctatcaatgcgaaaaatag

SEQ ID NO: 2752 - DNA, 1890 bp, Bacillus licheniformis
aagttgtggacatcagcggaatgggggggcaggaagctcaggaatcaccgtttcaggcgcttcaaatcaaaggatttttccgcgatgacattcgcctggagcatgaccgatttgaaatcggcgaggcgaaaaatctgccgactttagatcaccagcatgtccctgtcgcagattatcttcattgtatcatcgaaggattttcagcagtataccgtctgatttctgatcatggcgaaagctacctggctacgattgaacattttaaaaactgcaccgttcgaaatattttgaagccgacagcgcactacgcctctcttttgaataaaagctaccaccctgattttctcagggatgcggtagaccgtgaagtgtttttatgccgggtggaaaagtttgaagatgcagacacagatattgcagcggcaaaaacagagctgaaagagctcattcggggagacatcccctattttctgtcgaagccttcagatacctatttgctcaatggcgaagaagaaccgattgccgcttattttgaaacgccgtccttcacaagagtaattaagaagatctcatcattttcagaccaggacttaaaggaacaagcgaatgtcatacgcatgtcgattctggctgcatataacgcgagacatgaaaaagacgcaatcgatatagaccaaaatcacccgagtcctagatcaggcgccttgcagccgctcgccatcgctgagaaagcggctgacgatttggctgaaaagcgaattgaaggcaatgatggaaaggacgtcacttggatcagtacagttattgaaggcgtcgaagaaatctcttggacgatctcccctgtcagtcttgatttatataatggcaatgcaggcatcggactttttatgagctatctgagccgcttcgcaaaacggccggagacttactcgcatataaccgagcagtgtgtatttgcgattcagcgagcgttgaatgaactgaaggaaaaagaagaattcctgaagtacgccgactctggggcattcacgggggtttccggctatctgtattttctgcagcatgcgggaacggttcagaaaaaaaacgaatggatcgaactcatacatgaagctctgccagtccttgaagctgtcatcgaacaagacgaaaactgcgatatcatcagcggttctgccggtgctctaatggttctgatgtcattgtatgaacaactggatgacccggtttttctaaagctcgccgaaaagtgcgccggccatttgcttcagcataaaacaaatattgaaaacggagcggcctggaaagatcctcatacacaaaactattacacaggatttgcccacggcacttccggcatcgccgcagctttatcccgattcaataaagtgtttgattcgcaatcactgaaaaaaatcatttcgcaatgcctggcatttgaaaagcagctgtacatcgcttccgaaaaaaattggggatcaaaaggaagagaacaactgtcagttgcatggtgccatggcgctgccggcatattgttgtcgagaagcatcctccgagaaaacggagtcaatgatcccgggctgcataccgacatcttgaacgctcttgaaacaactgttaagcatgggctcggcaataaccgctcattctgtcacggcgatttcggccaactcgaaatcctaagagggttcagggaagaattcagcgaactgaacaccattatacagaatacggaagatcggctgtttgcatattttccaagaaatccattcagtaaaggggtatcacgaggtgtggattcagcggggctcatgcttggtttaagcggagtcggttacggcatgctgcaatgccaatatggagaagaactgccggaactgcttcagctca

SEQ ID NO: 2753 - DNA, 1008 bp, Bacillus licheniformis
atgagttcctatcgttcggttgaagtttcaaaagggcctggagggtttggcggacctctggtgatcacgcctgatgaagagagaaataaaatcgtgtacgtcaccggcggaaacaaacccgattttgcggatcatttagctgagctgacggggtgcaccctggtcgacggctttaaaacgacagtacccgaaagcgaaatggccgctgtgatcatcgactgcggagggacgctgcgctgcggactttacccgcaaaagcgaattccgacgatcaatgtgatggcgaccgggaaaagcgggccgcttgccgcccatattacagaagatatatatgtttccggagtaaaaaaagagaatattaaactgctgggagctgtggaggagcctgaacagtctaatattccagaagaaaaacaaatacaaaataaacaaaaccattatagcacagagaaaaagattagtgaacagcagtcgccgaaagggatgatggcgaaaatcgggatggccatgggatcgatcgtcagcacattttatcaagctggacgggaagcgattgaaaccgttatcaaaacaattcttccgttcatggcttttgtggctctattgatcggcatcattaaagagtcaggcatcggagacatttttgccaaatatttatcaccatttgcaggctcactgcccgggttgctactaatctcgcttgtttgttcatttccactgctttccccgttccttggaccgggggcggtgattgcacaagttgtcggttctctgatcggcgttgagattggcaaaggaaacattccgccgaatttggcgctgcctgcgttatttgcaatcaattcacaagccgctgccgactttgttccagtcggtctgggtcttgcggaagcggaagtcgaaacggttgaagtcggggtgccgtcggtgctgtattcgcgttttctcacgggggcgccaaccgtttttattgcttggctggccagctttggcatgtatgacagctga

SEQ ID NO: 2754 - DNA, 2089 bp, Bacillus licheniformis
atgaatgttttcaaaaaccagtggagagaactgataaccaataaaaaactactgatatccgtgatcggggttctctttataccgctgatttacagcagcatatttttggcggcttactgggacccatacggaaacgtcgatcagctccctgtggcggttgtgaattccgacaaggggacgacatatgaaggaaaagaccttcatatcggcgacgaccttgtcaaagaactgaaagaaaacgataaattcgactggcattttacgacgaaggaaaaagcaatgagaggcttgcaaaatgaggaatactacatggttgtagaaatccctgaaaacttttcgaaggatgccagcacggttatggataaacatccgaaaaagctgaatctgatttatcatacaaacgccggacgaaactatgtcggcgcccagatcagcgataaagcgattgaacagcttcagcattcagtcggctctgaaatcacggagcaatatgctgaagtcatctttgacaatttcggcaaaattgcaaaaggtctcggtgaagcaagcgaaggagccggaaagctggataaaggactgaaagatgcgaaagaaggaagcgaaaagctgaaaaagaaccttgaaaagctcgcgaaaagccaaattcagttcaacaaagacggaatggagaagttcggcgcggcattcaatacgctgaacgacaaaattcatgagcttgattccgggcttgcacaatttttggaaaaaagcggccagctgcacagcggtgctcaacagctccaacaaggcatgcctcagattgtggcgggattggagcagatgaatgaaaaagcgcagaagataagcaaactcgaagaagcgatttcaaatgaaaaaattcagcagctcgaaacggcgctttcaaatgccgaaaaagcgaaaaaagaaatcagccagatttcgaaaaatattgatgagcttgaagcggcattgaaaaaccagcacagcgaagtcaaacaaattattgaatccagcaacatgctgacacaagaacagaaagccgcgcttatgaaacaagtcgatgaaaaaatgggaacggtgaaactccctgagtttgacaagttgaaagcgcaaattcccgatgtcagcgaacttcccgatttatccgggctgaaacagaagcttgaggaattgaagcgagtcccttcggatgtgaataaactttataaaggatcgcagaagattcagcaagggcttgatgcgctgacaaacggtttgggtgcttacaacgaaaaattcgcagaagcgaaaagcggatcatccaaaatcgccgaaggcagccagacgttagtcggaaagttcggcgatctgcaaagcgcggccgataaactgaaagacggttcttccaaacttgcagaaggggctaaatcccttgatgaaggtcttggcaagctgtctgacggaagcggggagctgtttgataagctgtctgacgctgccgatcaaaccggcgatattcaagcgggagacgaaaactacaatatgttctcagaccccgttgatgtgaaaggcgataaaatcgatccggtttccaactacggaacaggattaaccccgtatatcttgtcgctcggcttattcgtcggcgcattgatgattaccgttgtcttcgatgtgaaagagccggctgtccggcccgaatcagcctttggctggtttatgagcaaattcagcgtgctttttgcagtgggaattcttcaagcggcgattgcctgcacgatcattctctggggcatcgggcttgaagtgcaaagcgtctggagattctatctgttcagtataatcatgagcattacatgtcttgcgatcattcagtttttggctgcgacaatgggaaatccgggacgattcattgccgtcattctgctcgtgcttcagcttggaggaagcggaggaacatttcctcttgcacttgtccctaagttcttccaggtcatccattctgcactgccgatgacctacagcattgccggatacagagcggtgatttcaagcggagactacgcgtatatgtggaacaggctgccggctcggcggtgtcgatccagag

SEQ ID NO: 2755 - DNA, 705 bp, Bacillus licheniformis
atgtatatgaaaaagaaaatcagcatattgatcacagcaatgtttttgacaatcctttgtttttcgcctcaagcttccgctgcgtacaactcactgcatacgggctatgccacttatacggggtcgggctactccggcggcgcattgcttttggaccctattccgtccaatatgaagatcaccgctttaaatccgacagatatgaattaccgcggtgtgaaagctgctcttgccggcgcctatctgcgggttgaagggccgaaaggaaaaacgaccgtctatgttaccgatctgtatcctgaaggagcgccgggagcccttgacctttcaccgaacgcttttcgcgagatcggcgatatgaaagacggcaaaatcgacattaaatggcgtatagtcaaagcgccgattaccggcaatttcacttaccggatcaaagaaggcagcagccaatggtgggcggcgatccaagtcagaaaccacaaatatcccgtcatgaaaatggaatattacaaagacggaaagtggatcaacatggagaaaacggattacaaccatttcgtcagcaccaatctcgggacaagtccgcttaaagtcaggatcacagatatccgaggaaaagtcgtcaaagacacgataaaaaagcttccggaaaacgggacgtcaagcgcatataccgtaccgggaaaagtacagttccctgactga

SEQ ID NO: 2756 - DNA, 723 bp, Bacillus licheniformis
gagaagaggtcgatgtttttttatatgtcgatcacgaagatcgccttgcggctacgatgagaaagccgatcatcagcgctgaacaatacggctgggtggaagtcgttgatgccgtcagcggcatgggcgttttcgtcgatgtcgggctctcgaaggacgccctcgttgcgacagagcatctcccgccgtatgaatcagtatggccgcaaaaaggagacaggctgtactgtatgctgaaaatcacggggcacggaaggatgtttgccaagccggcgccggaggacaagatcagcgaactgtttactgaagcttcacccggcctgatgaataaagagctcaccgggacgatctaccgcttgatcgcatcaggctcttttatgatttccgaagccggcatcagaggcttcatccattcttctgagcgaaaggaagagccgaggctcggcgaaaagctgactgcaagggtgatcaaagtaaaagaagacggttctgtaaatctgtcgcttctgccgagaaagcaggatgccttgtcggttgatgcggaacaaattctgacttatatgagatcgagaaacggcgcgatgccattctgggataaaagcgatccagaggatatcagagagcgcttcaacatgagcaaagcagcatttaaaagggcgctcggccatctgatgaaacaggataaaatctatcaggaagagggttggacgtacgagaaaaaat

SEQ ID NO: 2757 - DNA, 1077 bp, Bacillus licheniformis
acgttttatgcagctgtatgagcaaattaaaaatccgaacaacggttatttctcacccgaaagaattccctatcactcggttgaaacgctcatatgtgaggcgcccgactaccgtcatatgacgacatctgaagcgtacagctattggctgtggcttgaagcgatgtatggccggtacacacaggactggtcaaagctagaagccgcctgggacaatatggagaaatatattatcccggtcaatgaaggagacggaaacgaagaacagccgaccatgaactactacaacccctcaagtccagccacttatgctgcagaacacccctacccagatctgtacccttcagcgctgaccggacagtatccggcaggaaatgacccgctcgatgccgagcttaaagcgacatatggaagcaacgaaacgtatttaatgcattggctgttagatgttgacaactggtatggcttcggaaatcttctgaacccttcgcacactgccgtttatgtgaacacttaccagcggggcgaacaggaatccgtttgggaaacggttccgcatccgtctcaggataatcagacgttcggaaaaccgaatgaaggtttcatgagcctttttacaaaagaaaatcaggctccagcaccgcaatggcgctacaccaatgcaacggatgcagatgcgcgcgccgttcaggcgatgttctgggccaggcaatggggctacagcaatactaattatttagaaaaagctaaaaaaatgggggactttctccgttacggcatgtatgacaaatactttcaagagattggaagtgccgctgacggctcgccttcccgcggtgctggaaaaaatgcatgtcattatttaatggcgtggtacaccgcttggggaggcggattgggacagtatgcaaactgggcgtggcggatcggtgcgagccatgtgcatcaaggttatcaaaaccctgttgcttcttatgcactgtcaacggctgaaggcggattgattccaaattcatccacagcgcgaagggattgcgaaaaggcgctgaaaaggcagctagaactttaaacatgtct

SEQ ID NO: 2758 - DNA, 772 bp, Bacillus licheniformis
atgcgtcctgacgaagtcagggctctgattcgaaaaggggaaataacgggtccgacagccggcatggccgggggttttacccaggcaaacctggtgattttgaaaaaagagctcgcttttgagttcttgctgttttgccagcgcaatcaaaagccgtgtccgattcttgatgtcacggaccccggatctccggttccgtccatcacggcgccggacgctgatatccgcaccgattttccaaaataccgcgtatacaagcgtggcgaattggcggatgaagtgacagatatctcttctttatgggaagacgacatggtcggttttttaatcggctgcagctttacgttcgaacaagcgttaatgaataacggaatccctgtcagacacattgaagaaaagcgaaatgtcccgatgtatcaaacgaatattccttgtgtcccggcaggccgttttcaagggcctatggtcgtcagcatgaggccggttccggaagagcaggcggtgcgagccgttcaggttacatcaaggcttcccgccgttcacggagggcctgtccatatcggcagtccagaagccatcggtataacagacatcgcaaaacccgatttcggcgatgcggtaacgataaaaaaaggggaagttccggtattctgggcttgcggcgtcacccctcaggcagtcgcaatgcacgcaaggccggagctgatgattacgcattcgcccggccatatgctggttaccgatgttcgggatgaacaatttggtgtgttat

SEQ ID NO: 2759 - DNA, 849 bp, Bacillus licheniformis
agaaggtgttgaggtggcggggtattctgaacgaacggttgagagttacatagattctccggatcgattaaagagattgtacaaaagagtattattcatcgtgagtctgtcgcagattttcggcggtgcggggctggctgccgggattacggtaggcgccctgttagcaaagcaaatgcttgggacggatgcgttttcaggagtcccttctgccttatttactttaggatcggcaggagccgctttcggcgtcgggagactttctcagcgttacgggcgccgcacgggcttaaccgccggctttatggtcggcgggatcggcgcaatcggggtcgttgctgcggccgtgatcaacagcatcatattgttgttcgtttccctgcttatttacggagcgggcacagcgacaaacttgcaggcgcggtatgccggcactgacttggctgataaaaagcagcgggctaaagcgatcagcgtcacaatggtgatgacaacatttggagcggttgcgggccccaatttggtggatgtcatggggaaatttgcttcgatcatcggcgttccgccacttgcgggaccgtttattttatcggcggcagcttttattctggcagggcttgtgctttatattttgcttcggccggatccgttggagatcgccaaaaaaatcgaaacctatagacaagaaaataaattagcagacgaatcgaagtctgccggtgcttcggacgatcaaaaggggattacaattggtgccgctgttatggtgcttacccaaattgtgatggttgcgattatgaccatgacgcccgttcatatgcagcaccacggacacagcttgggagatgt

SEQ ID NO: 2760 - DNA, 861 bp, Bacillus licheniformis
gaagatattcggcagcggccccatgcccgttgtggtgaacaatcattcaaaagcaagcccgcagtcgggattaagcaaggctgacattgtcattaaggctctcagtgaaggaccgatcacacgattgttggcgatctatcaaagcgatatgcctgaagcggttggcccagtccgcagcgcccgggagtatttcattgatttggctctcggttttgacagcatccttgtgcatcacggctggagtccgggggcaaaagaccgcctgttgaacggcgacgccgatcatatcaatggaatggatcacgacgggaccctgttttggagagccgattttcgggaagcgccgcataattcgtacacatcatacaaaaacgtaaagcaagcagcagatgacaaaggatatgccatcgaaacccgcacagaaccgctcacttttaaagcaagccctgataaaccttcggatgcgctttattctatacggttagattatggaacaaaatccgttacaaaccgtgtcgaatatggttatgataaaaaggttgaaggctatgtgagaaagtcagacggcgttttgacaacagaccttgaaacagaagaaccggttgttcttcaaaacattctaatagcggaagccgaacatcatatgaaagatgcgtacgggagaagggatattgaccttcgttcaggcggaaaaggactccttctgcaaaacggggaagtccatcggatcagctggaagaacgaaaacggccggatcataccgacggcggacggcaaaaccgttccgttcgtgccgggaaaaacgtggatcaatatcgttcccgatctcagcaaggtttctattagcaaaggagcaagagt

SEQ ID NO: 2761 - DNA, 1212 bp, Bacillus licheniformis
tgaagaggatagcggttcccttctccatccggttgattggttcaaaaatatttttgctggatctgaaagcgcatctggtgaaagggtatcaacaaaaacggccgttcttcatccggatgtatatgcctgtgtgattgttttggcggatgatattgcgaaactgccgattaaactttttcagaatcaaaatggaaacatacaacaggttcaaaataaagtcagcgatatcattctgaacaaagtcaatgactatatgacaagctttgtgtggaagcggcttttggttacaaggctttgcacttggggaaacagctacaaccttttactttttgataaagacggaaatgtgacgggtatcagaccattggatccggaagcaaccaacacaaatattgatcccgataacgggcgtgtttggtactccacaacgattgacggcagataccgtgagtttttttatgaagaggtgctgcattttaaaaacctgtctcttgacggaattgtggggcaaactccgatttcagttattcgggacaatatagggtcaaatagagctgccacaaaattcaacgcgaaattttacaagaatggcggtgcaccgttcggtgttgttaaagcgccgacccttttagatcgaaaaagtaaacaaattcttagagaagactgggagcgggtgaatgcggggcagtctattgcagttttagacgccgggcttgattattcacaggtaaccatgcctatgaaagatgcccaatttattgaatcgatgaaatggaatcgccaacagattgcatcgatttataaggtgcctccgcataaaataggtgagctggacagggcaacattttcaaatattgagcaacaatccttagattatgtcaaaaccactttacagccaatcgtcacaaatattgaacaagagttaaacgataaggttttgacagagaagcagcagggagctggctattactttaaatttaacctggaatcagagcttcgcggggatagtaaatcacgtgctgaattttataaaacgatgcaaagcgtaggcgcctttagcgtcaatactattcttcaaaaagaggacatgacaggtatcggggagatcggcgatgagcattatggaaacttaaaccttgttcccctttcaattatgaaagagtatcaacttagcaaggtcaaacggtcttcaaatcgcctgaaagggggtga

SEQ ID NO: 2762 - DNA, 669 bp, Bacillus licheniformis
aaacgattttgtgcgaaacggtatcgtagaaaacaacacggtttacgataactccacttacggaaatcctgcctatggtgatgactattctgcgggcggaatatatgttgacggaggacaaagcattgacattaaggaaaatacggtctacggcaacgatatcggaattgaagcaacgtctgaacataaagggaaatatgctgatgatattcaaataaccgacaacaaagtgtatgagaatgcgtatacgggcatttctatcggcggatacgaccaaaagcggggaggcaccagccattctgtcattgcacacaatattatttaccgcaatgatacaaaggggctggatggcggacagcttttgctccagtatgatacaaaaaacaatacaatcgaaaaaaacatcataacagcaagcgattcgcgaatatttatcgcaaacgattttacgaaaaatgaaggaaataaagtgaatcataacgtgtaccacaaggaatccggcaaagacggactatggatttggaaacagaatgaatacgactcgttttcgccgtatcaaaacgcaacaaatcaagatcaagactcgatttatgccgatccgatgtatcgcgacgagtcatctcatgactttacattagatcctgattcaccggcttggtctgtgattga

SEQ ID NO: 2763 - DNA, 846 bp, Bacillus licheniformis
  misc_feature (1)...(846): n = A,T,C or G
gaaagaaaaaagactttccgtcaatcggtttgccggcttttcttgacggggagcagctgatttctaagcaccctgatcccgctatgcaccggcatttaaggaaggcgcttatcgaagtgctgcagctgtttcagtcctttcatgaaaaaggattgaacgatccggattttcgccgggtcctccttgaccttgtcaaatggatgggcaaccatttggagaagtggctgaaaggggccgactgcgaaacggcgatgccgaaagtggtttggtacggggacaccaccaaaagccaacggtattttttatactatttgatgcttgtcggatgcgatgtgctgctgtttcatccggagggaaaagacgaatttcgccagcttgatcccgagcaaaagctttcttttgtcttcacatacccggacacgtctgcattagagccgttcccgactgaaaagccccagcgcaaagcaacggtggcgtaccgttccgcgaaggagctggatactgtcctgcacaatgaggattcgctaatgtacaaaccttggcagttcagggagcatactccggcctctgtgactttgaagacaacatatgatgaactgtttttaattgcgaaggaacgagcctttatcagacctaattttcaggcgtctaaatcaacggttaacattccgaatttattcgcgatggtcatgggcgtctccagcaatgaaaaagagtactgggaccgtctgcagacactgacggagtataaggagtcgcatacgatccggcgcttcccgtttacaaaggaagagacgtcgaattatcaattccattacagcgatgcgctgaatcaaacgngtaatg

SEQ ID NO: 2764 - DNA, 924 bp, Bacillus licheniformis
atggaaggatttaaagctattttattcggtcgaaacagcccagcattttcttgaaatggtatataaaaatcaaggaatggaagatgccaaaaaaaattcctataaaaacggagagcggtttattttttttcttaaacatgcggaagccttttacaagcaagccaaaatcgctacgttggaaatcaaaccgattttattattttacggcatggcacagctattgaaagcctgcctgttaatgacagatccttcctatccaagccatacttcagtgctcgcccatggcgtgaccactagaaaacgaaaaaaacaaaattaccgcttttatgaagatgaagtaaaaatccaaaggaacggcctatgtatgcacgtcatcaggtcccttttccaattatccggattggaagatgaacgattcaatatgaagcagcttttggcgagaattccggagatcaataaagtactggcatttcaaagaaaaccgaatccaatagtaaaagcagccgtcgaagaccggctcatttggctgccaagcgagacgcccgatgcttacaatatgtcgtcaaagcgtttcatcgaacatgtcgaataccatttaaactggtctttctgccgtgaagaaaaagaggggatcattttttccgccgctcaaaaagaatgccgtcccagcacttcgactaccttgctttatgatttggaacatggcgcatattattttccggctgaacgggatcgctttttaaagctcccggaaatattggtgcattacttggttgcttacaatttaagcatgattgccaggtatgaaacagaatggtggtatgaccttcttcttcaaagtgccagcgatgattatgtcatcatccaacagtttttacatatagtcgagtcaaagttcccttattatatcgctgaattgcttat

SEQ ID NO: 2765 - DNA, 1974 bp, Bacillus licheniformis
atgcccttaaaacgatcacccttccggatttcaataagaaagggggttaaggctatgatcgaacgcctcacagcgattgtcgatgcggaaataggcaaatttaagcgcaaaatgggcgaagttaaggcgttagcccgaagcatcccgaatagaatcagcgtaactgttaaagaaaattttaaagaggccgagcggcggctgggcgttttcgaaaacaggatggcgcggcttagcagggtgataaacgactttcagactgtgtttggaaacgcctttagcggcatgaaaatgtcgatattcccggctcttgtgccggcgatagcgtcattaacggcggctttggggtcattagggccggtcatcggcgtggcttccggcggccttatggggctagcgagttcattcgggacagcggcggcaggtgccggagcgtttggagctttagccatttccaatattagcggggttttcaaagcgtcttccgacctggcgaagctccagcaaaagctggacgaaacaacagacctgaaagagcgtgccaagatcatggagaagatcaaggcgattcaggaaagtcttggcgcagaagaacggaaggcgctcgacaccttggaggacttcaaagcaaactggcgcgagatagctcaagaaacgcaaaaaccgatcttgaagacattcacaaactctttgaatagcttcaaatccgttcttaacacactgcggccgatgtttaaatctgtcgcggcggctggccttgaactatccgagagcttccaaaagtctttgaatgctcccgatgtacagaagtttttcgattatatgaataaaaacgcaggcccgcaattcgccacgacagtaaaaacgatggggaactacttgcgcggctttttgaatttgctggttgcttttggaccattggggcaacaaatgtcacaaagtatgttgaaatcgtccgaagcattcgcgaaatggacggcaagtctctcaggctcagataaatttaagtcgtttatccaatacgttcagcaaaacggccctaagctgctgacgatccttaaaaacatcggatcgggattaatcggaatgtttacagcgttcgcgccgatgagtgcggacatgctgaccggtcttgtaaatcttacagcgcgctttaaagaatggggaaacagcctgagcgaatcgaaaggcttccaagaatttatcaattacgtgcgacaaaacacaccgacagtgctgtcactgatcgggcaactaagggacttgattgttaacttaggtgtcggcatggctccgttgggttcgcaaatcctgcaaatggtcacagggttcttgaaattcactaattcgatgatggaaacaaaccctattatcggtcaaatgatcggttatctcattacattcggcggcctgttcagagcgttaacgcctttaactgtcgctttttcagcagcttttaaatggaaagatgcaataagcacggtgaaaaaattagggacggcgataaagtggattggctcagtcattgggatggtcggaaaagcatttttgaccaatcctattttaatggttgtggcagccattgcggcagcggcttatctgatcatcacgaactggaaaccgatatccgagttctttgtgaatttgtgggaaggaatcaaaacaaacgcgatagcggcgtggaattcaatatctgagttcttttccggcctttggtctggaatagtcgaacttgcgtcaacagcatggggcagcctgacgtcgttcttctcaagattatggtcaggaatcaccacgacagcacaagcagcatggactggattcatgaatttagtaaagccaatttgggacggaattgtcgcggttttcggcccgacttttaacgtcatagtcacaacgttgtcaaacatctggaacacggtatctagcacggtatcgtccgtgtggaatcgatcaaaacagcgctgtaccaagaca

SEQ ID NO: 2766 - DNA, 699 bp, Bacillus licheniformis
atgggcatggattggcatattgaaactgaaacgctgttaaagcttggaatcgcaacattaatcggaatggtcatcggtctcgaaagggagctgaaaaacaagccgctcggcttaaaaacgtgcatcgtgattgcgatcagttcctgtgttctgacaatgatcagcattgatgcggcataccattttccaaggtcgaacagaatcatgatggaccctttgcggcttcccgcacaaatcatatcggggatcggcttcatcggagcgggcgtgattttacgcaaaagcaacgacgtcatttccggcctgaccacttcagcgatgatctggggagcggccggcctcggcgtcgccatcggagcgggcttttataaagaagcgtttgtcagtctgattttcattttaatcagcgtcgagtttttgccgtggatcgtcggcaaaatcgggcccaaccgcttgcaggaaaaagaaatccgcgtccgcatgtccctgaatgacaaggataaactgacggatatcttaaaggaaatgaaagcgaaaaaaatccggattcattccgtccggatcgatgatatgcgcgataatgaatttccgatcatggaaacgaaaatcatggttcataagaaaaggtatgtcaccgatgtctattacgatatcaaagcgatcgacggcgttgtcggagttaaatgtgatacgctgtaa

SEQ ID NO: 2767 - DNA, 598 bp, Bacillus licheniformis
atgatttggactgagtcgaatgaacacatgcaagcgcttgtttatcagcttcctaaagaaggaaaagccgtctgcggtgacagtttttatttccatgcgactgacgaaaccatggtgtgcgcactggctgacgggcttggcagcggtgcgttggcacgcgaatcctcttcggtcatcagcgaagttgtcgaagagcacggccatgaagatgtcgaaagcttgatggaacggtgcaatcaagcgctgaaacataagcgcggtgcgaccgtttcaattttaaaagtcgattttcgaacaaggacgatcgcttacagctctgtaggcaatattcgctttatcttatacgctccttcggacaaatatatccaccctctccctgtgacgggatacatgtcgggaaaaccgcaaacatacaaaacattcacctatacgtatgaaaaaggatcaagattcatcatttattcagacggtttggaagtacccgccctccggacttatttaaaacagcaccatacaccgggagatatatcgaatcagcttgaatcatacacacgaatgggaaaagacgatctcacctatatcattggacagctttttt

SEQ ID NO: 2768 - DNA, 805 bp, Bacillus licheniformis
  misc_feature (1)...(805): n = A,T,C or G
atgacaaaaacgataaacgggcatgaaatcattcaattgtttgaacagttctcgcctaagtctttagccgttgaaggagataaaatcggcctgcaaatcggcacgctgaacaaaacggtggccaatgtcatggtcacgcttgatgttctcgaagaaacggttgatgaagcgatcgcaaagaacgttgatttaattattgcgcaccatccccctgttttcaggccgctgaaacatgtcatcacagatcagcccggcggaaggctgatcgaaaagtgcatcaagcatgatatcgcggtttatgcggctcatacgaatctcgatgtcgctgacggcggtgtcaacgacatgctagcggaagcgctggaattaaagaacacaaaagttctggttccaacctatgaagagccgctgaaaaaacttgccgtctatgtcccgaaagattatgaagaacaggtacgcacagctcttggagacgctggagccggccatatcggcgcctacagccactgtgcgttttctgcagaaggagtcggcagcttcaagccgctatctgaagctgatccgtttatcggcaagcggggcgagcttgaacgggtcgaagaggtagagaatcgagaccgtttatccggcgggtattgaaaaatccgtgatcaaagcgatgagtgagcccatccgtatgaagaagtggcctttgatatttatccggtcgagcagaatccgcttcaaaaagggctgggccgcatcngtgaattgaatgaanagatgacactcgaagcgtttgcccgatatgtgaaaggaaaagttt

SEQ ID NO: 2769 - DNA, 738 bp, Bacillus licheniformis
tatttttaagacgcctgagagtgaatttgaatcagcagatcaagaaaatttcggtgataaaaactcgacagagctaatggatgaaatcattgaggattatgggattgaaatagacgtggataattacaaaatttatatctacaaaaagatggggaaacggattaatttcaccctagattcgcgctataatatgcccggcatttcaattacaacaaactcgcaaaacagtacaacacgtgcctggggatacggggccttaaaaaaggggagcagtactgatgacaaaaaccctcagtacgagtttgagcctattttatacattcatccagacgaaaagaaattcttgattgaagggaagccacgctgggctgaaccgatcagggatgagcgctataaaaaagccagcagtatgatttctgcattaaaaaggcatgtgaatccatatccggaaatgacggtagaagctgatttccaaaaaatctatgagccgaagcttttagagatcgagcaagatttctggaaaggcgacaccatccatgtcttggctgatacggctgatggtatcacatttgaagataatgtgagacttgtgtccatccagtacaaccctctgaacccatacagcagtccgaaattgacgtttgcgaacttccgcaaagatatccaaagcataaatgtggatcaagcgaaaaggcttagagatcaaaaacgatatattgaccagcttttcaaaacgct

SEQ ID NO: 2770 - DNA, 786 bp, Bacillus licheniformis
atgaaacaagcgattttatatatcggccatggaagccgtctgaaaagagcccaaacagaagcagccgcttttttggagagctgcaaagaaaacatgtccgcccccattcaggaaatatcttttttggaattggcggcaccggatatcgaaaccggctttaaagcgtgtgtggaaaagggggcgacgcatatcgcggccgtgccgcttctcctcttgacagccgcacatgccaaaagggacatccctgaagagcttgcccgtgcttcctcacagtacccttccgtcagcgtcgcttacggaaagccgatcggcgtcgatcaggaagtcgtcaaagcggtttttacaaggatcgaagaaacggggacgccatatgaacatgcaagagtcgtgttgatcggaaggggaagctctgatccggatgtcaaacgggatgtttatgatatttgcgaacggctgagagacctcacaccagtggatgaggtcattccctgctttatgacagcctgtgagccgcactacctggatgtgtttaaacagcttaaagaacgggacggaaaaacgacattcatcgttccgtatctgctgttcaccggtatgctgatgaacgagattgaaagggaaaccgcaaagctgaaagaaacgaatccgaatgtcgtgctgacggattacctcggcttccacccccatgtaaaaaacgcctttttgcaccgcgtagaggaagcggttatcaacaaagccggccgctttgattttacaggagcatcagatgctgccgctgcacattaa

SEQ ID NO: 2771 - DNA, 609 bp, Bacillus licheniformis
cctgatcgttgaggagaatcaagaagctgcgctgtccgcctttgatgtctgccagaaaaaggttaacgagcacggccttgagatgaaactggtcgatgtggaattcacttttgaccgcaacaaagtcattttttattttacggctgatggaagagtcgattttagagaactcgtcaaagatttggcatcgatctttaaaacgagaatcgagctgagacaaatcggcgtcagagatgaagcgaagatgctcggcggtatcggaccgtgtggaagaatgctttgctgttccacgtttttaggtgattttgagcccgtttctattaaaatggcaaaggatcaaaatctgtcgctgaatccgacgaagatttccggactatgcggacggctgatgtgctgtctaaagtatgaaaacgatgaatacgaaacagccaaagaacagcttccggatatcggggaagtgatcgccacgtccagcggcccggcaaaagtcgtcgggttgaatattctcgaacgcattctccaggttgaactgacagactgcgacaaagttgttgaatatacgtgggatgagctgttgcaagaaggtgtcgtatctgcacaaaccacaga

SEQ ID NO: 2772 - DNA, 1197 bp, Bacillus licheniformis
ggcttgtcagcggtttttaaatgatattaaaagagaaggaacaagagagtttccttacgtgtttgacgatgaaaaagcccgtcgctttctttactggatgacgcaattcaaacatacaaaagggccattagctggtgaaaacatagttccagatcgtattcaaatctttattttcggtaatgtttatggctggattcataaagatacaggataccgccgttttacaaaagtgtattggcaggttggccgtaaaaatgcaaagactcagagtctagcatgtgttgcatcctatgaagcaatggcaaacaatgagaaaatgtctgaagtttatataggggcaacaaagacggagcaggctcaaatatgttggaaggagataaaagcccaaatagaagggtgcgaacttctaaacaaacctgagcaaaaatacaggattgcatacagcaccattgaacacccaaaaacaaattcaaccatcaaagctttatctaaagatgcagggaagaccggtgacggatttaacccgcaatgcggcataatcgatgaatatcatgctcataaaacgtcagagatttacgatatcctggagtcggggatgggcgcaagaacgcagccgatcatggttattatcacgacagcggggcacgagttaaacaatccggcctatcgtgtggagtatgattatgtttcacgtcttctcgatccaaacaaagtagagacaaatgaacagtattttgtcatggtgaacgaaatagataaagacgatgacataaaggatgaaaggaattggataaaggctaatccgatattagcttctcatgaagttgggaaaaaatatttgcgagatcgtcttgaaatggctctggctgttcctgaaaagatgagggatttcctgaccaagaatatgaatgtttgggttaatatgcgcgacggtggatacatggatatgcaggcttggaaggattgcggatctgatcagttccctgatttatccggccgtgagtgctatgtagggattgacttgtcaaaacgaattgacctgacagctgtctcgtttattttcccattggataatgggagctttgctgtggatagtcacggttttatgcctgaagataccttctatgagcgcatgaagacagataacgtgccgtatgatttgtggaaggaaaagaactggttaaccgtcaccgacgg

SEQ ID NO: 2773 - DNA, 1935 bp, Bacillus licheniformis
atgaagcgctgtattttggtcgttggcgaaggattgatggctgaaggcgcatcacaacaattatctgctgaatataacgttatccgcaggtctgattttgagaacagaataccggcggagacttcgttcgttcttgtgctgcacgacgcttggcggcctttgttatatcgcgaggccgaaaaagtgctaagggcggcagggattccctggcttcgcgggtttgcatcttttggggaaggggtaatcgggccgctcgtttatccgtcagagtcaggatgttcaaaatgcgccgatatgaggtggtatgtctccggccccgacagcatggagacgcttgaactggaacaaaaaagcaatgacataaaccgcgatccgtgggcttcaaagaccggctgccgccagatggtcagcctgatctgcacagaagtcgacaccatcatgaacggcgggcgcggccgattggaaaaaaagctgtacatcgtcaatttgaaaacgctagaaagttcgctgcacgctttcataccggaaccgacatgccctatatgcggaaatctgcccgaagacggaccggaatccgcgcggatatcgctccggcccagcctgaaaacgaacccggacagctttcgcgtgcggaacacggacgacttaaaacaaacgctctccaaagactatttggaccagagaacggggatattcaacgccaaaatttatgacgcgattctgccgtttgccgatatgatcgtcaatatccctttatggatgggaaatgaaggggtaggtgggcggagccattcgtatgaagacagcgaattaaccgccattttagaaggtttggaacgctattccgggattgaaccgcgcggcaaacggacggtcgtacatgacacctatgaaaatgtaaaagatcgtgcgctcgacccggcaaaagtcgggcttcatcaagccgaacaatacacgcatcccgattttccttttcagccgtttcatccggcccgcccgctccgctgggtatggggctattcatttctgcagaaacggccgattctcgttcctgaatcgctcgcgtattacagcctggggcgggaagacagctttgtctatgaaacatcgaacggctgtgcactcggagggagtttggaggaagcgattttccacggcatattagaagcggctgagcgcgattcatttttgcttgcctggtatgccaggcttccacttcggcagctggatctcgactcttcaggagatccggaattgcgcctcatgacagagagggtgcgaagtgtggcgggatatgatctgcatgtctttaattcaacgatggaatacggcattccaagcatttgggcgatcgccaaaaacagaaaacgggaaggattgaatctgatttgttccgcaggcgcccaccccgatcccgtaaaagcggtgaaaagcgcccttcatgagctggcaggcatgatgttgaagcacgaccgcaaatttgaatctgaaaggagcaaatatcaccagatgctccgcagtcctgctttagtgcgggaaatggaggatcacagcttaatgtacggactgcccgaagcggaagagcggctcagttttttgctgaatcaaagccggcctctgcaaacattcgacgatgcctttaaaaaaagaaagaaacaccttgatttaaccgaagacctctgcgacctgcttgaagctttccggagtctcaaccttgaagtgatcgtcgttgatcagacttcccctgttatcaaacggaatggactttattgtgtgaaagttctcatcccgggcctgattccgatgacattcggacagcgcttcatccgcctggaagggcttgagagaattttcaccgtgccgaagaagctcggctttgcggaagagccgttaagaccagaacagctgaacctgcacccgcacccgttcccttaa

SEQ ID NO: 2774 - DNA, 795 bp, Bacillus licheniformis
atgggtacaaagaaaaaactaggattaggcgttgcgtctgctgcgcttggactggcattagtaggaggaggaacttgggctgcgtttaacgacatcgaaacaactcaagcaacttatgcagcaggtacgcttgacttaaatgcgaaagatacatctgcaagagtgaacttgtccaacttaaaaccaggcgacaaattcactaaagatttcgagttcaaaaatgacggatcacttgcgattaaagaagtgctgatgcaggttggctacagcaatttcgttgacggaaacgcgaaaaacggcggaaaaagcacagcggaagacttcctgaaacaatttaaagtcagcgttctgactgtcggagttgaaggcggtaacggctatcctaaaaacatcattttagatgaagccaacctttatgatctgtacaatatgtccgcgaaaaaagataagaacgcatatgaaaaagtgaagaaagccattgagccagagttcctgcatgacaatggcaaaatcaatgtagcgacaatcaacggaaaaactgcgcctgaatacgacggcattccgaaagacccatatgactttgataaagttcaattggtgattgagtttgtaaatgacaaaacaacagacgccagcggcagaatggtacagaacaaatatcaaggtgattctgtacagcttgacttctcattcgaagctactcaatggaacggcttgacaatcgacggcaaaaaacatgccgatgaaaaaggttatgtgaaagagaacgaaagagcgcacagtgaagataaataa

SEQ ID NO: 2775 - DNA, 765 bp, Bacillus licheniformis
aaaaagggatgaagcttttcgtctctatcaaaaatacgggggaaacattacgaatctcgcaatcgcaagagaactcggcgtttcaaataaaaaaatcagcgtttggaaaacccgcgaccgctggcaagaggctttagccggagatgacgcgaaccgtggaaaagcagacattcacaatgaagggctgaatgaacggcagcggctgttttgcatctattatgtgaaaagcttcaatgccacccaagcggcggtaaaagcgggctattccccggccagcgcccatgtgacaggctgccggcttttgaaaaatgaaaaggtggccgatgaaatcaggcgaatcaaaaaagaaatggtaggggagatattcgtcgaggcgatggatgttctccaagtctatgtaaaaatcgcgtttgccgatatgaccgattatgtgactttcggcaaaaaagaggtacaggctgtcggaaagtccggaccgctgtttgatgaagaaaacaatccggttatgaaagaggtcagctttgtggatgtgaaacattccgacctcgtcgatggcacagtcatcacggaagcgaaactcgggaaagaagggatcgcgatcaagctggccgataaaatgaaggcgctcgataagctctcacagtattttgaccttttccctgattcatttaagcggaaaattgaaaatgagaagctgaagctcgccagacaaaaagccgacaaagatgcggaaacgggtcccgttgaagtggtcatcgcccgaaa

SEQ ID NO: 2776 - DNA, 971 bp, Bacillus licheniformis
tggtcccttcgcttatcggaattattctgtttatgattcccgttaaaattgaaggaaatttaacgattccaattgctgttttttcaaatgcattgcaggagctgcttcagcagcaattgccgctgatcatgacggtcatcgtaaccgcaacatttatcttaacctttatcaccaaaacctttcatccggctttcatcaaaaaaagcgagtttttctataacctgctgaatgtatctttattttggtatatcgtccgcctagtcggcatgattttcgccgtgatggcgtactttaagatcggacctgaagcggtgtatgccaagagtaccggcggaacattattattcagcctgcttcccgttctcttctccgtctttctatttgcaggcctttttctgccgtttctgttgaatttcggcttgctcgaactgtgcggcgctttgatgaaaaacctgatgaggcctgtctttaagctgccggggcggtcatcgatcgattgtatggcttcatggctcggcgacggcacgatcggcgtgctcctgacgagcaaacagtatgaagaaggattctacacgaagcgtgaggccgccgtcatcggcacgactttctcagtcgtctccatcacgttttgccttgtgattatttcacaggttggccttcctcatatgttcgttccgttttatttgacgatattgctggcgggtgccgcagctgcggtgatcagcccgcggattccgcctttatcaagaaaggctgatacttatattacagatcaagcggatcaggatcaagagaagattcccgaaggatacactccgttccaatgggggctcagccaggctgtcgcaaaagcaaaacaaaatacaagcgtcaaagatttcttgcaggacggggctaaaaacgtactcgatatgtggatgggcgtcgctcccgtcgtcatggcgctcggcacagccgcgctgattgtcgct

SEQ ID NO: 2777 - DNA, 1082 bp, Bacillus licheniformis
atggatacttatcctctagatagcctatcaattgaagaagccatgcatagacaatttaaattggttgatgtcatgacaagacattttcgaggagaagaattgctttcacttggcgatttaggcgttgtaaaaggaatcaataaaccgcggttcacaaaaaaaatagaagagacactagctgatttctttggcacagagaaagcaatgttagttcgtggtgcaggaacaggggcattgaggtttggttttatgagctttttaaagccgggtgacgagatccttgtccatgatgcaccgatatatccaacaagtaaaacaacgttagagtcgatggggatcttgccaatatacgcggattttcacgattctgaacaaataaaagaagccatcctcaaacacccgaagttaaaaggtgtattgattcagcatacgaggcaaaaaatagatgaccattatgatttggctgaaacgataaaaaaaatacgttccatttattctgatctagttattattacggatgacaactatgctgcgatgaaagcagaaaagattggagcgcaactcaaagccgatttgtccaccttttcattgttcaagctattaggtccggaaggtattggagtcattttaggaagaaaaaatttaatagaaaaaatagaaaaaataaactattcaggcggaagccaagttcaaggttatgaagctttagaagctttaaggggtctgatatatgctccggttatgctggcaatacaagcaagtgtcaatgatcagttagttcactcgcttaataatggagccattaagggtgttaaaaaggcttatttggcaaatgcacaatcaaaagtcttacttgtagagtttgttaaaccaattgcagaaaaagtgcttcatcatgctaatgaattgggagcagcaccccatccgataggtgctgaatcaaaatacgagtttgcaccaatgttttatagagtgtctggcacttttttatctgcggatccatcactggcaaaaaaaatgatccgcattaatccattaagaagcggtcctgagaccattttaagaattctaaacacatccgt

SEQ ID NO: 2778 - DNA, 719 bp, Bacillus licheniformis
atgacaaacggaacaatccacaacaaagacggctttttaaaccggattgctgaaaggctcggccgcaacaggcgttctgcaggcgtcaccgttcccgattatatccaccagccgcagcacagggtatatcaaggctatacacaggatgagcttgtcggcgtcttaaaggaccactgccggaaaattcacacggagctgattgaaacagatgtcatcggcttgcatgatgccttgtatgaacaagcagcgcgatttggaggcgggcctgtcatgatcccgaaagatgaccgttttaaagagtacggactgtcaggcctgttaacggacaagtggccgaatgaagggacgaaagtgtgggaatgggatgcagcggccggagatgagaacatccagcgagccgaacaggctaacatcggcgtgacattcagcgagatcacgcttgctgaatccggaacggtcgtcctcttcagctcaaaagacaaaggacgttccgtcagcttgctgccgacgacatatatcgcgatcgtcccgaaaagcaccatcgtcccgcggatgacacaagcaagcgcaatcatcaaacaaaagattgcagacggcgacgtcatcccgtcctgcatcaactatgtcactggaccgagcaattcagccgatatcgaaatggaccttgtagtcggcgtccacggccccgtaaaggcggcatatatagtcgtggaggaccg

SEQ ID NO: 2779 - DNA, 1896 bp, Bacillus licheniformis
atgaagcactcctttttcttttttatgttcattgccttttttctcgtcactggtttttctgaagcaggcaaatccttttcgatcgagcgggctgatatacgcgcaacagtaaaagaaaacggcgatttaagtgtagaggaagtttacagatacgattttaaaggttcttttgaaggggcgacaagatcgttcagcgaagaaaccgcgagccgcctgaagaattttaaagcctatctccttcccgaccaccggagaaaaggcggtcaagccatcccgttaaagacaaagaaggaagacgggacttattttgcttattcggcatcaaaggatgaaacgaaaaatgtgatgtttcgctatgtgatcgaagatgccgcacaaaagtttgaagatacgtcgattttgatccattcattttaccaaaaggcaaataccgatttcggccgcgtaaagattgaagtgcgcctgcctgattcggtaaaggcacgggatattcatgcgtttttgcgtgaaaaaggaaacggaaagattacgaaggtgaacgattcatcggtcacctatgagacaggactctatcgcgcaggcacgggctccgagctgaggatatattttccgcaaagcgccttgaaggaggcggtccggcacccttcttaccagacaaaggatgagctgctgaaggaggagagagacgaggcgaaacgctacgctgagcgggatgaacgaattgccggcgctgaaaggatgattttgattttttcggggattgtggggttcatggtcatcatggctgtcatgctttcgtttttgaagaagagacgccgcgccatgctttcgtttgaagaactcgagtcctttgatcccgtgcttgtcgcatttctttacaaaaaaggccgtttcacagaccgcgatctcctggccggcctgctttcgctttatcagcggggattggtcactatgcagaaggtgcaggctgaagagaggtttctcgacgatcctaaggcgcctgatgacacatatgaatttgaattctccggaagcaaggcagatttgccaaagcctgatcagctcttaatcgaaaaactttttgagcagacgggcagcgatacctatatgttcaggctggattccctcagcgggccgactgaggaggaatgcaagcacaaggagcagctgggaaaatatgaacgaaagaggatcattcttcaaaacgtggttcaaaaatggacggaaagcgtcagacaagcgcctgaattcagggaactgtttcaagaaaaccgctggctgagaatgctgtcgctttcactgctttcagtccataccgggctcctgctctttattctgtatgcagatgtggtacatcaggccggattcatggcggcttgcgtcatatttggttttgcactgtcggcaggcattgttcttgcgaagtcaaagctgtatacgattctgtttttggccggattgtttttggcgtctgtttttaccgacagcgttcataccattttgtattacggcatatgcgtcgggctgtctattttattaattgccttcattccggccgtgaaagaaagcaggtatgcctccatctgccgaagatcgattctttcctggaggaaccatctgagaaaagaagatttgttctcagggagaagcctgtcacaaaacgaaaaaacgatgatctttgcaattgtgcttgaagtggaggatgaatctgccgtgtggctcaatcaatcagcaaacaggcttgattacgcttcccctgtactgggtatggctgcagccggctgtttgcattatccgttttacagctggcagctgccggattcgcagcagcacgccggtgcatatgatgcaggcggttccggagcgggcggaggcgacggggcaggagctttttaa

SEQ ID NO: 2780 - DNA, 1860 bp, Bacillus licheniformis
atgcttgtcattcagtggtgtgtgacaggccttgtccttttgtatgccgtgtcatttcatccaaaagtgtgcaggcggcgcctctttttttatgcaggcatcgttctcaggctgatactggttggcgccctttcgtttgaattggctcaccaaatgaaagccgctgagttttcaaacctgtacatagacgaacaagatgcgcttctgccttttatgcagtttttgctgttcggctatattttgcttgtctcttttcattatatgatgacactcgcggaaaaagggggcaaggggctgttttttgcatttgacattgcggtgatggcgatgccgcttttccaatcgctgttcagctttgccgcctatttgaaggaatttggagcggaggagcttgaagaattgccgctcgttctgttgttgattgtcggaataccgggactgatgatctgcttgttttttcagctttattggaaaagaaaccgttacgttctccttttgattttttatattgtgacgatcggcggtttcttcatcaaaaagcttggatacgaattttttccgctgaacgtatttctgacaatgatcggttttcttatgacatatcacttgctgaatgactcgagaaagcctttgttgatggtgaagcgtgttttagccgcgggcaccgccgtatttttcacgcttcacctcaatcctttttacaatttggcggatgccgcttttacaatctcacacccggaggtttcagacgtggttgatgccaattttcggcctgtttcggttaaagaagcgaagcagactgtcagctcgttttttccgacagagagctttatctatttgtcagctaccaaccaggattttcataacgtttatcatttcaaaacgaaagattacgatgcggacgttgacggctggacgggaatgatcaccaattatcacaatcaaaaaaagcctagcgggaatatcctgtccggtcaggcatatatcaagcggtcgaagcaatttctaagggaacacggccgcgaacttgacaaacaaatcaaggcaaaggtcagccgtgatgacggcgaagctactgttgaattttaccgtgaaggcgaggatcctgaattaagcacaatgtggtttacttggcggaaggagactctgatgggattccatgaggacgcgtctgtttacagcttagaaagcgtgaaccaagcccgcgtttctggtgaggatatcgagcggggagttgaagccgtctatcgtaagctgggcatacccgtctcatcttatcggctgacagatattgatttattattcccattcagcctcaactcggcatccatcaacataaagacaagtgacggaatggggatggagttccaccctgtaacaggtgcattaacggctatttcgatcaaatctgaaagcgccttgccttatcgcggacaagagcttgaaaaacgcttgctttcattatttgatcaagacatttccaatctgaaaagggtggagttagaaaaggatctgatagaatttcagaaaaaagaaagcgatgctgtgttaaatacggtctggaccatgacgaaacatgaagagggagcttatctgacggtgagaaaaaactttcaaaaagcagatgaaaaacccccctacacgtatgcagacggggaaaaagcttttcagaaagtgtctgaacgctatcaaaaagggctggtctatcataaacggacgaagcttgtaatcgtttcagacggggatcaaaagagccgttatgcgtggcttgtcatcatccagccgttcggctcaaatgaacatgacgcatacttggttgatgccgagacagatgaggtgaaacattttgatgacaaatga

SEQ ID NO: 2781 - DNA, 690 bp, Bacillus licheniformis
aaggtatgcggggtatgaaactgagcaaggcgttatcggcgatccggcgtcattggaactgacaaaggcgtgtgaagcgctcggctggaaaggcgaaggtacgccttttgacgtattgccgcttgtttttcaaatagatgggcgtcctcctgtgtggtatgagctgcctcgtgaaatcgtcaaagaggttcggattgaacatccggagattgaaggcttcaaaagtttggggctgaagtggtacgctgtaccgattatagccgatatgaagctggaagtcggagggattcattataatgccgccccgtttaacggctggtatatgggaactgaaatcggagcgcgcaacctcgcggatgcagaccgctataatgcgctcgaaaaagtggcagccattatggggcttgatacggagcggaatacttcgctgtggaaagacaaggcgcttgttgaattaaatactgcggtgcttcactcctataaaaaagccggcgtcagcatcgtcgaccaccatactgcggcaagccaattcaagcggttcgaggagcaggaggctgaagccggaagggagcttgcagcaagctggacgtggctgattccgccgttatcgccggcagcgacccatatctttcacagctattatgaaaataaaacgctgaaaccgaattacttttatcaggaaaagcctta

SEQ ID NO: 2782 - DNA, 1853 bp, Bacillus licheniformis
atgacacacctgactgcttccgctcgcctgaaagtaaaccgggatacatggtttcttcctgatccgaacggcggcgcgtattttagaaataattccgggtcgtttcgcttaaaaggatcttcgattgctcaatggttcgaaaaacttctgccaatgttcaacggggaacattcgcttgaagatttgacaaaaggactgcaagctccgtaccgaaagagagtatatgaaatcggagaaacgctttataaaaacggattcgttcgcgacgtcagccgcgatcacccgcacaaactggaaagctcagtgcttaaaacgtatgaagcccaaatcgaatttattgaaagctttgccgattccggcgcttaccgctttcagctgtcgcgccaaaccaaaatattggctgcagggactggctcctttctcacgaaattggtccggtcgctgatcgattccggtttttcaagaatccgtgcgatcgtgacggatgcatccgggcatgctttagacgaactggcagaaatatcagagcaaacagaaagcggactggagattggcttcgccgaaacgcaacattggcgggaagcggtgcgatctgccgattgggttttgtatgtctctgaccgcggcttcacagatgatctccacgatcttcaaacgttttgccttgaagagaacaaaggattcatacccggcatctgtctgaaacaagtcggactggcaggccctgtcttccaacaacacggagacagccgcttcgaggctgcctggaggcgcctccatcggtctgcgctccatgaagaacgaacgcttggaacctttcctttggcaggaaaagacatgctggcaaatgttattgtgttcgaattgatgaaagcagctgcggagcttgagccattatctaagaagaatcaagtgtacctgcttgatttggcaacgctcgaaggcggctggcatgcgtttcttccccatccggacttcagttgcggcaaggattcggctgaactcatctgcgaccttgaagcgaaactttcggaacaccccggaaaagaaacagaaagccggctattccaatgtttcaccgaactgacctcacccgtaacgggcatttttcatctgtgggaagaaaaacatttgccgcagcttccattagcacaatgctttgttcagacagcagatccgctctcttccggacctgcggagcttttgcctgagacggtttcggtcggtttgacccatcaagaggcgcggcgggaagccgggctgacggggattgaaatgtatgcatcaaggttgacccgttcttatccgaataacggagatttcgcgatcgccaccggagaaacgctggctgaaggcgtattaaggggattggagaaatgcctggaacaccggttgtgcgaacggataaaaagcggaaaagaaatgatttccctcgttcagctggacggaatcgaagaccggcattctgcattttatttaaaagcgctgacagtcttgtacggccaaccggaaatcggtttagggaaaaacatagaaggcttccctgtcgcatgggcgggaattcgcgggcgctggtacagaagttctggactcaacatcacatccgctctcagaaaagtgctcgaacgggcactgacagacaaagatcctttgaaaggtgcggatgttctgctggagcctggtgaactgaagcttgctatccccgtttcagctgctttgcaaaaaacactgctttccgccttgaaaaacaaccggggcttgcagctgtatgtctatgagctgcctgttgaaccatttttaaaagaaaaactagcaggaatctattgcgtgcagttgcgaaaggaggaaccttg

SEQ ID NO: 2783 - DNA, 972 bp, Bacillus licheniformis
  misc_feature (1)...(972): n = A,T,C or G
ttttccgttccgcaaaacaacggggagaaatcgatgaaacgattcttgaaaaaaagctgatcaattggctcgattcacatcagcccggcatgcagagggaaacagcggaggcattttgcaaagccgccctcaagctggacgaaatacctggacagctcttgagatcccggcaagtgaaaaagcttgccaaacaagcggcccgcgggacaatcgatggccgaaaaacaagctttatcaaaccgctcagcgtttttgccggacagaaaagtgctcacctccttgaccatcatgtgattaaatggtgcaagctgttccttgatgaatcacaatcggcatggcggcttccgcatcgtgagaaagggttttacagcgcatggcggcagcttgttgaacatgatcccgctctgtcgcgcgcagaacgccaacgcctgaatggatggccggaagagccgcgggacgctatgaaaaaagcgctccgagcgtttgatatttccaatgcagacgttcaggcataccttgaagctcatctgctttctctgccgggatgggccgggatgatgctttggcgttctcagcaatcgcaggacgaagaagaactgctgctcgagtatttggctgtccggctttcaatggaatggatgcttgttgagccttatttaccgctgcctaagccgaatcctgaaaaagagatgcagctcgttcctttgattgcgtcctggctgcattggggcggccttacgcctgaagaatggctcgaactttccgcagcagagcaaaaagcgagattaacactcgcccgccgctttgatgatataacgcgcaggcgtctctggctggaagcttgggaacaaacatacgccgctgaggtaaggaagctcatcacggcaaacaaacctgccgctgctgacaaaagcgaaacggtgctggcccaattcgcattgtgtattgacgtncgtttagagccgtttcgag

SEQ ID NO: 2784 - DNA, 570 bp, Bacillus licheniformis
ggattataatggccgcttttaccggcaacgtagcgaaaatgtttcagctgttcgggaaagccatgttccgctgcctgattttccggagaaggaaacacctgaggacgaatattttgcagaggcatcaatcaacagctccggaaacagctatactgaaatccgggcgcagctcaataaccgttcgggatggccggcaaagaaaaccgatcaattgtctttccgctactacgttgacttgacggaagctgtagaagcgggatattccgccgaagatataaaagtcacagccggctataacgaaggggcctcggtatcagagctgaagccgcatgacgcttcaaagcacatttactatacagaagtcagcttcagcggggttttgatttatccaggcggtcaatccgcccataaaaaagaagtgcagttccgcctttcggcaccagacggaacgtctttttggaacccggaaaatgaccactcttatcagggtctgtcacatgcgcttctgaagacgcggtatattcctgtttatgatgatggacggctcgttttcggacatgagcccggtta

SEQ ID NO: 2785 - DNA, 782 bp, Bacillus licheniformis
gtgaaggagctgatcaaagaaaaattcggaatctacattcgcgatcttacatcgtacttgtcttatcaggcttttcataccccgaattcgatgtttttgatcgtccctgtttcccacttgagtcaggatgagctggcggaattgtttagtatgagtcagtatttgcaagaacagcgcgacccatacgtttcatcttttatattgacaaaggacggggagatgacgtttgaggagaatggcgtctcatatgtgcttcttcaagctgctccccgcatgacaaacaggtccgtttcatttggtgcggagctcgccgaatttcatcacaagggaaggggatacccttacgaggtaaaagaaacctcgcggatcgggcagtggaaagaactttgggggaaacggctcgaccagctggaacaattctggattcaaaaaacgcaggcaaggcagctgcagccctttgaaaaacaatttatcgaatcgtttccttattatctcggtttaaccgaaaatgcgattcaatatttggcagataccgaattggatgatcagccgcaggccgctgactcgggaacgatttgccagcagcggctcacctgcgaggctttaaggcgcgagccgcttattaaaatcccgatggaatgggtgtttgatcatgcggccagggatcttgcggaatatgccagaagcttgtttcacgaaaggaaaaacttcaatgaaatcatgttgtttcttcagcaatacgaacagtacgcgccgctatcctcattttctaagcggctgat

SEQ ID NO: 2786 - DNA, 831 bp, Bacillus licheniformis
cgtgaaaggaataaaaccgactgataaagaacagatgaaggatattcaaaatacaccgaacgactatttttttgacattgaccatgtcggtgtctcaaacgtttcgcatccgattttgattgcttcctcgctcaagccgtttacacaaacgacgatcggcgctttttcctttacgacgagccttgcgcgcgaccgcaaaggaatcaatatgagccgcctgacagaacagctgcagcgctatcacgaagcaaactggacggttgacttccatacactgaaagattttgcaaaggatttagccggcaatatggaacaggaaagcgcatccgtctccgtcagttttccatggtatttcgaacgcatcagcccggaaaccaaattgtccggactgatgcatgccgatatccatatgacagtctcttatcatgaaaacaaaggcttttcgcaaaccgccggcatcaccgcccatgcgacgacgctctgcccttgttcaaaagaaatcagcgaatacagcgcccataaccagcgcggcataatcaagatcaccgcgcatatcaatgaacaggcggagatgccggacgatttcaaagccgagcttcttgccgcagcggaaacgaacgcaagcgcaaagctccatcccgtcttaaaaagacccgatgaaaagagagtgactgaacaggcttatgagaatccaagatttgtagaagacgtcctccgcttaacagctgccgacttatacgaaatggactggatctccgcctttgagatcgaatgccggaacgaagaatcgattcacttgcacgatgccgtggcgcggctatcgttttccaa

SEQ ID NO: 2787 - DNA, 841 bp, Bacillus licheniformis
atgcttgaaattacatttgaagatgattatgatacagccgcgtttttgcatctccttcgcaatgcggatgcgaatcggcatatcaggattcacgaagcgccagggaagatcggaattgaaaagacccattcctctgtcagtattcaggcctatattgagccggttctgacgagattttttacagaatgcaaagaagatgaatacatgctttcggtcattgaaggcgattattactttttggaccgggatgaacagcagcagattcttcaattggcccacagcattatggagggcgaacttgaagggcttcctctcaacaaggacgacacccctcgcgaacattacatcattcaggagctccaagcgatctgtcttgaggaaaacgtcttttcgattcggtcatttatgacgtttcgccttgcgaagtattatgaacgcctcagatcttatgtggaggcggcgatcgacgagtataaaatggagcaggaatatcagacattcattcaatcgctgagagactacgtcatgtcgaaagagccgatgcttgaccatgtccacattgtgcacgacggttactttgtattgtgggaattaaagtatatttctgaacgggaacaaaaaaaatacatagacaggcggttcgtaagagaacacccaatgtatattgattcccatctcctggctccgctcgtatcgattgcgccggaaaaaatagacctctatacagaagaccgggaacacgccatggttcagaccattcaaaatatttttcaggagagggtgcggattcttccgcttggcgcctttcatccgcgggaaaacattttggaagagcattctt

SEQ ID NO: 2788 - DNA, 961 bp, Bacillus licheniformis
ttgtgaggccgattatactgggcgtttttgcagccttcttttttgcttttacattcgttttaaacagggcgatggagcttgaagggggaagctggatctggagcgcttcgctgagatttatcttcatggcgcctcttttatttgccatcgtttggcttagggggaatgtgaaagagctttttcaggaaattaaaaaagcgccgggcatttgggtgagatggagcatcatcggcttcggtctcttttatgcgccgctctgttttgcggcggcttacggaccgggctggctgatcgcgggaacatggcaaatcacgatcatttccggttccctcttggcgccgcttttttatgaaaccgttcaaacaaaaacaggtcccgtacagataagaggcaaaattccttataaggggctcacgatgtcgttcatcattttaatcggggtggcgctgatgcaagctgagcacgcggcacagctttctttgcacgagatgctgctgtgcatcgcgccggttatattggcttcatttgcttatccgcttgggaacagaaaaatgatggaagtttgcgccgggcgcctcgatgcttatcagcgggtattggggatgacgctggcaagccttccgttttggctgatcctctcgctgtacgggctggcatcggcaggtgcgcccagccggggacaagtcattcagtcaggattggtggctgtattttccggaatatgcgcgactgtgctgttctttgccgcaacagatcttgtaaaaggggatatgcgcaaattagcggctgttgaggccacacaatcgtttgaagtgctgtttgcggccgctggtgaaattttaatcctatcgagtccgcttcccggtgccatctcatggagcggaatggctcttgtgattatcggaatggtgttgaacagccatgcatcgaatcaaaagccggcggttcaaagtaaagctgc

SEQ ID NO: 2789 - DNA, 744 bp, Bacillus licheniformis
ttatgtaaaagcggaaaacctgaagtttaaaagaacattttcgagaaaaatgatcttcattgtgcctttgattaatatttgcttcgcctttttaatgaatccgggattttttgtagcaggtacgtataattggtggtctgtcatcttaatgccggtcatgatcgccttgctttgtgcacaatcacaccagaaagaaaagaaagcgtcgaattataacggcattttttcttctcctgtagatttgcatcagatttggtatgcaaaaataagcgtcattgcgctctattctttagcatctcaagctgtttttttaggattcatggttgggatgcagtttgtcattcctcaattttcgagcattcatttgacagtcattgccgcgaatctgctgctttggctcacgacactatgggagatccccgtctgtttatggatagcgcgaaagtacgggtttatatctgccgttttgttcaatatgctgggcactatcatattgggcatcatgtcggcatcaagccctttttggtggctgaatccttggagctggccgatcagggtcatgtgcccgacaattggcatccatccaaacggtgtgcctcttgagaatggcgatcctttaacgagctgggcagtcgttcctccggctgttgttctatctgttctgttatttgctattttggcgcgtctgactaggcggtctttttctcctgccgttgatcgcaaatcgataaaacgggaggcggt

SEQ ID NO: 2790 - DNA, 612 bp, Bacillus licheniformis
aggagccgtcaacagaaatcgacgccgttttcacattgctcgtcgactgttcggcaagcatgcatgacaaaatggcggagacgaaacggggcattgtgctgtttcatgaagcgcttaaatcagttgctgtccctcatcaaatcgtcggtttttgggaagatacaaacgatgcgacagagacgagccagcccaactactttcatacggtcgtttcttttgcggattccttaaaagcaggagccggaccgcacattatgcagcttgaaccggaggaagacaaccgggacggatatgcgatcagacagatgacgaagatgcttgttcaaagaagcgaagctcagaagttcctgatcgtcttttcagatggagagccggccgcattcgattatgagcaaaacgggatcgtcgatacacatgaagcggtgatggaagcgcggaaacgaaatatcgaagtcatcaatgtatttttatcaaacagcgaaattgaagaatcgcaaatgaagacgatacaggacatgtacggaaagtacagcctttttgtcccagacgtcgatcagcttcccgatgttctgtacccgcttttaaaaaagctgttgaacaaaagtataggat

SEQ ID NO: 2791 - DNA, 533 bp, Bacillus licheniformis
atgcggcttgagcgtctgaattataataagatcaaaatctttttaaccctcgatgatttgacagaccggggattgacaaaagaagacctctggaaggactcatttaaagtccaccagttatttaaagatatgatgaatgaagcaaatacagagctcggctttgaagcgaatggaccgattgcagtggaagtgtattctctccaagcacaagggatggtcgtgattgtaacaaagaaccaagacgccgattcagaagacgatgagtatgatgatgattacatcgaaatgcaagtcaagcttgatgaaagcgcggacatcatatatcaattccattcctttgaagatatcattcagctttcagaaagcttacagcgaatcggtatcacagggggaactgtctaccactatgacgggcagtactttttaagccttgaagatctagggtcacatacggctgaaggggttgtggcggttctggctgaatacggcaatccgacaactttaacgatttatcgcctgcaagagtatggtca

SEQ ID NO: 2792 - DNA, 597 bp, Bacillus licheniformis
agctgatccactattcatcgcattttccgatcgtcgagcttgatgcgagcttttacgcgatacagcccgagcggaacaatgaaaagtgggtaaaggagacgccggaaacctttcagtttatcgttaaggcatatcagggaatgacagggcatcagcgcggggaaatcccctttgaaacgaaagacgacatgtttgctgcttttaagctctcattaacgccatacataaaagcgggtaagctggcgatggtcctctttcagtttccgccatggtttgattgcaagaaagaaaacgtcaattacttaagatgggtaaaagagaaaatgggagatatcccgtgtgcgcttgaattcaggcataggtcatggtttatgccccagttttacgacaaaacgctcgcttttatggaggagcagcaatggattcacagcatttgcgatgaaccccaggcgggcgaaggcagcatcccgactgttcttcacgcgactgacagccggaaaacgctcgtccgttttcacggccgcaacaaggaaggctggttaaggccatcttccggtcaaaattggcgtgaggtcagatatttgtatttatataatg

SEQ ID NO: 2793 - DNA, 629 bp, Bacillus licheniformis
gtggagcatcacaaatcttatcatgccaaagaattgcagaccgagaaaggctctgtgttgatagagggccctatcagtcccgaaaaactcgcagaatatgaatttcacgacgagcttacagcctttcgcccatcacaaaaacaacatgaagcattaatcgaaatcgcagggcttcccgaaggacgaatcatcatcgcccgtttccggcaaaccattgtcggctatgtgacatatgtttatccagacccgcttgaaagatggtttgaaggaaacatggaaaatttaatcgagcttggagccatcgaagtcattccggcgttcagaggtcactctgtcgggaagacgctgcttgcggtcagcatgatggatccgcagatggaaaaatatattatcatcacgactgaatattactggcattgggatctaaaggggactaacaaagatgtttgggaatacagaaagatgatggagaagatgatgaatgccggaggacttgtctggtttgcgacagacgatccggaaatcagctcccatcccgccaactgtttaatggcacgcatcggaaaagaggtcagtcaggaatcgatcgagcgttttgacagactcagattccacaatcgttttatgta

SEQ ID NO: 2794 - DNA, 1074 bp, Bacillus licheniformis
tccttttaacaggctgctgggacagcaggcagatcgaaaagcttagcatcgccatcggccttgccctcgataaaggcgaggacgataaaaacgtgaaattgacgtatcagtttcttgttcctaaaaagatcggacaagacggcagcgctcaggatccgtctaaagtggtgtccacctccggaaacacggtccatcaaaccatccgttccaccgctttgaaaaatttcccggtattctcgcagcatctgcaagtcctgattttctcagaggagcttgtatccgatatttctctggaagcattgatcaatcaatttattagggacaacagcatcagaaggagcagcgaggtctatatgacgcccggagctgccgacagcatactgaaggttgatggtgcaagtgaccctgcgtccgacgtgatccacagcatctctgaaaacagagcttcgacgatcaagctgctcaagcccgtcacattgaacgatatttcgattaaaatgcagtctgatttatcttatatcatgccgaaggttgtgatcgaaaaaggacagcttcagcttgaaggcggcgccgtgatcaaaaacaacaaataccatgcaaacctttcgccgtctcagatcgaagcgctgaatttattaactggcaatgtcatcggcggagtgatcgactcaaggcatgatggacatttgttctcgtatgaagtgttttcgatgacccaccgcgtgcgggcgatgaggcagaacggaaagtacaaattcgtcgtaaatgccaatattaaaggaaggctgtcagaggactggtatcttggagaggattcttttaatgaccaatatataaaaaacatagagaaatcggttcaaaaagacatcaaaaagcgggttgagcagctgatccatgtcctgcagcacgatatcaaaacggacgtcaccgatttttccgacaatgcgcggatcaattttccgaaggagtgggaaaaagacagattcaattgggacaaacacttcagcgaagcctatatcgactatcatattaaagcgacgattcaggactttggaacaaaaggtgcgacaaaaa

SEQ ID NO: 2795 - DNA, 705 bp, Bacillus licheniformis
aagactatggacgacttcgactacggtcgctgactttttaaaacatcataagatcagcataaaaggcgatgatgaagttaagcctgcgcttgataaaaagctgacgaaagatcaggcgattcacattactcgtatcaaaaaagtcaccgatgtagtggaagagaacatcccttttgaagtccggaaaaaagaggacgattcacttgaaaaggggaaagaaaaagttgtacaggacggtaaacatggcaagcttaaaaagcactatgccgttgttatgaaaaacggcaaggaagtttccagagaactgattaaagaggaaacggcagccgaaagcaaagccaaaatcatcgctgtcggtacaaagcaagccgcagtggctaaagtcagcgcgaatgtatcgcgcggaaatcaatcctcaggaaaggaattttatgtatcctctacagcttatacagcaagctgcaacggatgctcaggccacactgcgaccggcgttaatttgaaaaataatcccggcgctaaagtgatcgctgtcgatccgagcgttattccgctgggttccaaagtacatgtagaaggatatggctatgcggttgcggccgatacaggctcagccatcaaaggccgaaaaatcgatgtattctttccgaataagtctacagcttaccgctggggaaacaaaagagttaaaatcaaggtgttgaa

SEQ ID NO: 2796 - DNA, 951 bp, Bacillus licheniformis
tttgtttttcgaaagcgagcagggcaatattaaggcatttttcaatacagccgcacacacgatagagcacgaagacaggctcaacgaagaagccagaaagcagatagcgtttgggctgagctacccgcaagcgatggcaaaagcgttccggtctgtaacaagagaaggcggtaacatcgttgacctttcaaagccgaacaacattctcggattccattatgtgaaagccatcatgcaaaagcaattaagcatgaagcccgaaaccgtcaagcgccggtcctcaggctatcacgattcaacattccctgaagcggaccgaatcgcaagcgctacgagcatacgcaagtcgatttttgaaacgggaagccttgcggacagccgcttctaccttccaaagacaacggtcgatgagctcgatgaatacgcccggactttcggcatgtggcactcgcctgaagattatttcccctttttgaaatacagcctgcatacaatggatacagaagagctgaaagggatatacgaagtggaagaaggccttgagcaccgcgtcaaaaaagcgatccggaaagcaggctcttttaaggaatacatggagcttttgaaaacgaagcgctatacgtggacaagactgcagcgcatgaacacccatatcctcacaaaaacgaagaaagccgacgttaagcgcatgttaaacgaaacacatccggcatatatcagacttctcggaatgacaaaaaaagggcaggcctatttggctgaaaagaaaaaaagcttgagcgcaccccttattacaaagacgggatcgttttcccatccttccctccagcttgacataaaagcgggccaagtatacagcgccccgctcaaagagccggtgcggacgatgctgacagagcaggaatattccctttcgccgatcaggtatgacgaagacagccggatattttt

SEQ ID NO: 2797 - DNA, 561 bp, Bacillus licheniformis
atggctagagcgattaaacgaattcagaaaatcgagataaccgaagaggaccagagaaagcgtgatatgaaagaaatagaggatgcattagtcgaaaataaggaagccattcttgaaatgctgcatatgattggccacatgaacgagcgtggtgtattgccattgctgcgcggcctttttggccaaggagataaagttcttgacatcttagtgaaaaaggcagatacagaggaaacggccaatacactgaaaaatctgcttcttctgttcggaacgcttggcatgctggatgtaaaacagcttgaacctctcattttgaaagtgaatgcgggggtggcaaacgcggtggaacagaaggacagcgaagagaaaacaggttattttgatatcatccgctcgctcaaagacccggaaatcaacaaagcagttacgctgcttttctcctttttaaaaggaatgggacaagatacaaaggagctggaacgcacgactcagcctccagagcaccaaaaacatcatcaggaaccccgagagaaaagggggatgaataagagggattga

SEQ ID NO: 2798 - DNA, 675 bp, Bacillus licheniformis
gaggttacggaacggcacggattgccgggaaaattgactaccggctcatcaaaagccgcccgaaaattttttggggctattcagatatcacttttttacatacagcgatcaggcaaaataccggacttattacatttcacggaccgatgctcagttctgacatcggcaaagatgacgtgcatccgcttacccgccgctcctttcagcagctgtttcaaaaaatgacgctctcttatacagaggaactgtcgcctttggaaacgctcgtacacggcgcggcggaaggggagctcgtcggcggaaacctcgctcttctggtgacgacgctaggtacgccttatgaaattgatacgaaaggaaagcttttgtttatcgaggatgtcgatgaagagccttatcgaatcgaccggatgctgaatcaattaaaaatggccgggaaattatcggacgccgccggcatcctgctgtgcgattttcataactgcatcccgaaaaaacgcgataagtcgctcacattaaaagaggttttccaagattatatcgcctctgaaggaaaaccggcgctgtccggctttaaaatcggccattgttcaccgaatatcgccgtaccggtaggagtgaaagccgtccttgacgccggcaaaaaacggctcaccatcgaaccgggaatttctt

SEQ ID NO: 2799 - DNA, 787 bp, Bacillus licheniformis
atgagttacttaaatcataatcaaggatacagagaaggtttattagaaacacgttcagtaataaaaaaggataattatgcggtaatcacacctgatggcttggttaataatgttgtacctggctttgaagattgtgatgtaacgattttaggatccccgcgtttaggtgcaaggtttgtagattatttggtaacagttaaaaacaagggcggaaacaaaacaggttttgccggtgatggtatccaatcatttgtgtacgttgaatatggtaaaatcaacgcttttgcggatggtgaaaaatacgaattagcaaaaggcggattcttatatgtgcctccacacttacaattgacatttgaaaataataataatggtgaggacagccgtttgtttttatacaaaaagcgctatcagccgcttgaaggacatacaccagaaatcgttgcaggtaatgtgaataacattaaacaagaagcctatgaaggtatgaaagaagtattaattcaagatttactgccaaaagaaatcgcatatgacatgaacattcatattctttcattcgagccaggtgcttcgcatggttacattgaaacgcacgttcaagaacacggtgcctatatattaagtggacgaggtgtttacaacttggacaacgagtggatgccagttgacaaaggtgactatatttttatgggagcttatacgccgcaagcaacctatgcaattggtttggatgaaccattctcgtatatttattctaaggatgcgaatagagatattaatctat

SEQ ID NO: 2800 - DNA, 1209 bp, Bacillus licheniformis
catgcttgttttcgcgcttccgcttgcggcatgccaaaattccggctcgggaaacactggcggacatgaggagcatcatacaaaggatcattcggagatgaaagaaaaagacgctgattctcttccgagtgatttcaataagcgggccgaagaggggctcctggtgaaaaacacaaagaactcgacaaggcttgacgcgaatacaccagaagacatgagcatcaaaacctctcaaacgatatggccggccactcataaacaaaacaggccgggcgcagtgattctagtttcgggcggatcatggcagacagctcttgcatcagcagatttgatccatcatccaaataacgggcctgttttaatcgcggaaaaagggaaaatctccgggcaaattcagaatgaaatcaaacgcttgaacccgacgggcacttcagacgggacgcaaatcatggctgtcggagaatttgattcaaaagcgcttcaagctttgaacacttttaaaataaaagagctcaaagggaagaacgcggctgatctggcaaaagagattgacaaagaatacgcggaggcagccggtgaatatccgaaaagcgtcatcatcggatcatccgaggatgatgcagaactttattcgctcccggctgtaaactggatcgcccacatgcctgagccgatcctgtacgtgaacaaaaaaggcattcccgaagagacggctgaagcattaaagaaaagggacgccaaagcaaacatctatattctcggccctaaaaaagcggtttcggaaaaaacggagaatgcattaaaggaatacggaacagtcaaaagaatttccggagacactcctgtcgcaaattcgattgcatttgcgaaattcagggataagaacaccggctttggctggggcatcacagatccgggacacggactatcctttgcatcaaccgctgcgcccgagcttgcgcttgccggagcgccattttcccatttgggaaaacacgctcccctgcttttactcaaaaatggacaggcagacagcacactatacagctatctgtccgagatcgagccttcatttcatgacaggccgcaagacggcccatacaaccatgcattcattctcgggtcagaaaatgagatttcatttcggacacaaggcattcttgatggcatattggaaattaagtctgcggatggaggacattccggtca

SEQ ID NO: 2801 - DNA, 1782 bp, Bacillus licheniformis
atgacgacggtttcgatcagctctaacccgacagacatcgaaaaatggtataaaaactggctaaaaacgcaaaaaatagccggatttatacgcgaaaaaccggcggaaaagttgcttacaacatggtatgcggaaaaagtagtctccggggagataatcgcaagtaagaaaaatattctcgcttgtaaacgacatcttcgcgatttaaaacgcgcaggaacagacgaatttccatacgtttttaacgaagaaaaagggcatcgccccatacagtttatcgagaagttttgtaaaccgtctcaaggacaatacaacagtttgacgcttcaaccgtggcaacattttgtgatcggatcactgtacggttgggttcatcgcgataccggccttcggagattccgtgaaggccttgtttttgttgcgcggaagaacggaaaaacaacgaaaatcagcggtttagccaattttgcgataacaaaggacgacgaaccgggcgctcgggcctacgtcttagcaaactcgaagcaacaagcgggtgttttattcgaggaaagtcgtgcaatggttcagaagtcgccggtacttcggaagcgtctgcgcgagaatcaaaaaggcatctaccatgacgcgtccatgagtcagatcgaggcacgggcgtctgatagcgaaaagttagacggtttgaatacgcacctcggcatattcgatgagatacacgaattcaaagattcaaaattgatcagcgtaatcaagaactcaagggcagctcgacggcagccgttgatcatctacatcacgacggccggctatcaactcgacgggcctctcgtcgaatattacgaaattgcttccgatgttttggacggatctaacgttcaggagcggaatttttactttatggccgaattagacgacatttctgaggtggaaaacccggaaatgtggatcaaagcgaaccctaacattggggtaacgatggatattccgtcaatgattcaggacttcaatgcggaccgtcacgtccctcgtgaatacaacgactggctggtcaaacggtttaatatcttcgtggataacggagaggaaagcttcatagacttcgaagtcatcaagagcaataacggacatgtcgatccggaatcgttgcgtggtatgagatgcattggcggcttcgacttatcacaaacggaagactttacaagcgcgtgtctggagtttttgctgccggataatcgcgtttttgttatgtctcattcgtgggtaccggcggcaaaagtacaaaaagataacgaaaaaatcgactaccgtgggtttgaagccgacggttttttgacgattatacccggaaattacgttcagtacgagtacgtttacgactggttcgttgaaatgtcgcgtaaatatcagatcgataagatcacgtttgacccagcgaatgcgatgcgattggttcacgatcttcaaaactacggatttcaaaccgaagttgtgcgacaagggtacattactctgagtgacccgttaaagcatatcaaagaattattgcttgacggaaacgtcgtttacaacgaaaacaagcttttcacatggtatctaaacaacgtcaagctcgtcgaagatcggaacggtaactggttgccgactaaacaaacgaggtaccggaaaatcgatggctttgcggcttttctgaacgcacatacacaggtttatctcgatatgacgaagccggttgagggcggaagcgtcggatttatctcaattagcgatctattaaacggttag

SEQ ID NO: 2802 - DNA, 747 bp, Bacillus licheniformis
atgctgctattttatcaattccttgtttggcttattgttttggcgctggctctgtacgtagctgccgtgtggcgttttgaaaaacagctcgccgaaaaaacggtcgccatcagaaaaacgtggtaccttctttatgtcatcggcgccgtgatatattggacgcacgatccgcagtcaattttcacaaacccgcttcattacctgatcgttgccgtttttttcacgttgacagacgcttttattttcttaaatgcctactttaaaaagctcggcagctctgaactcgcgacagatacaagaatgcttctcgaagaaaacaacgacctcctccacacgtatcaaaacaggctgaaaacgtttcaatacctattgaaaaacgaaccgatccacatctattatggaaatatagaagcgtatgcagaaggcatcgaaaagctcatcaaacggtttgccgaaaaaatgaatatatccgctgcactttgcgaatataattcagaagaaagcaaggatcatttgcttgagcatatggaaaaccggttcgatgttcaagaaaagcttgaccgcaaagacgtttattatgaagaaaacggaaaaatggtcctcattcctttttccatccacgattttgactatgtcatgaagttaacctcagaagaccttgtcacagaatttgattatctcctgtttacttctttaacaagcatctatgatcttctgctaccaaacgaagaggaaggtgacgactga

SEQ ID NO: 2803 - DNA, 714 bp, Bacillus licheniformis
attagggtttgtactgtttatgtcgatgtttgcttttgtcagtgtagtaccggcagctgaggcgaaagtcattgatcatgacaaagtgcaaggcttcagcgaagtgacccctgtgacggtttcccaaaaagcggccaaacgttttcagccttatttgaaggttgcgagcggctgcgtgccttttccggcagttgacgcacaaggcaacacaagcggaggtctggagcctaccggagcgcccgaaggccactgcagcaaaagcgtgggacaagtgtactcacgatccgcatggtataatggagtttgggcgattatgtatgcatggtattttcctaaagattcacctctgcctttaaaagcattcggccatcgacatgattgggaaggtatcgtcgtatggatcgacaatccggcaaatcaaaatccaaaagtgctttccatcgcttattctcaacacggtaaatttcaaaaaacagcgccaaacaacaatattatggaaggcgatcatccgaagatccgctatgatgctcctcaaccgccgatcaaccacagcctatatgtggacagtgcaaagggcggcacccagcctctcatcgggtgggaagatttgacgcctgccgcaagaaacgcattgaacacaacggatttcggaagcgcaaacgttcctttcaatgatcacaatttcacgaataacctaggaaaagcatggtttag

SEQ ID NO: 2804 - DNA, 741 bp, Bacillus licheniformis
tgaagacggaccctgcagccggcgatatcgtgaaggaaggttcaactgtcaagctatataaaagctcaggcaaagagaaaactgaagtcgatgatgtggtcggccagaaagtcgatgccgccaagaagcttcttgagcaaaaaggctttaaaaacatcaagacagaagaagtgcacgatgaagaagaagcgggaaccatcatcgaacaggaccctgcagccggaaccgaaatcgttgccgccgacgacgaggtcaaattaacggtcagcctcggtccggaagccattactttaagggatttaaaaacatacagcaaacaggcggcttcgggctatttggacgaccatcagcttgtccttgtcgaaaaggaggcgcattctgaagacgtgccggaaggtcaggtcattaaacaaaagccggaggcgggggcatcagtcaagccgggagacaaagtcgaggtcacgttttcgctcggacctaaacaaaagcccgtcaaaacggtgaccgagaaaattgatattccttatgaaccgggagcggcgggcgaagaacaaaacgtccaaatttcgatcgatgatgaagaacacagcatttctgacgtctacgaaaatttcaaaatcacagcgccggcagagcggacgatcaaattcaggattgcgcccggccaaaaagggtattatcaagtaacgatcaacgataaagtagtcaggtcaaaaacgattgaatatcctgaggatgaat

SEQ ID NO: 2805 - DNA, 767 bp, Bacillus licheniformis
atgatacggagtatgaccggtttcggcagcgcgagcaaaacgaaggatgggctgacagcagctgttgagctgaaatctgtcaactatcggtttaaagaagtaaacgcccgcatgccaagacctttgctctatttagaagacaaaataaagcaaacgatttttaaacatatacaaagggggcggctggagctgtttgtttccgttgacgacgaggctctggtcacccggaaaatccaggttgactggccgctgcttgaagagtaccagaaagccgcgcgcgaaatgaaagaccgctgcgggctttctggagacatcacgcttcaagacgcctttcagtttgagcatgtcatccaagttgaagaagagccaatccaaaatgacaagcttgaagaggttcttctggaagcggtcgaggctgccgttctagaattgtgcagcatgcgcgaagcggaagggctgaggctgaaggacgactgccttcagcatattgaaaggcttgaaaagctgacagacgacatcgcagagcttgctcccaaggtcgtcgaccactatcgggaacgccttgaggcgcggcttgaagaatggtcaacagacggtctcgatgaaagccgcctgctgacggaagtcgcactgtttgcagaccgttcggatatcacggaagaagtgacgaggctgaaaagccatttccgccagttccgcgatatttgcaaagcgggaggagccgcggggagaaagctcgatttcctcgtccaggagctcaaccgtaa

SEQ ID NO: 2806 - DNA, 1045 bp, Bacillus licheniformis
atgccggttcatttttttgacgcgattgtgcttgacattctgtcatccatgaagggtgagcgttctccaagcgcggtctatcatttattaaaaggaaaaaggtcgtcacagacgatacaggacgccggtttatttgccgtttcaaaatacttcggcttttgttcggctctgtcgagagagcaggtggcagccagcgttcaacgattgaagcaggagtctttggtcagagaaaaagcggaaagcggcgcttacaccgtcaccgaaaaaggagaagcggaacttgccggcttttttgggctttatccgtggccccgccattttcacggcggctattatcaggcggcagcgaaagtgatgtgggcaaggatgtcgcttttgatccaagtgctctccaacaagctttaccgcgaacgcgtgtatttgccgatcgtaaaagattatcagattcagaactgggttaaacagtatttaagaaaccggaatgctgctgaaacagcggcccagtttcaccaagagctgaaagagaagctgtctgttttaaatcatgatgaacaggccgctatttttgttcactccctgacatccagaacaaaagcgggctatacattcagacagctttccgaaaaaatgaaccttgatgagtggtacatatatgcactgttttgggatgttctgcaccattttattcaatccgcccaaaatggtgaaagtccgctttttcaaacgctcattcatgacattcctttgaatgatggtctgacacaatcgacgagaaaaacgctctttcttataaaagaagggtatacaatagaccggatcgcaaaaattagaaagctgaaattggcgacgatcgaggatcacattgtggaaatcgccattcatgatccgtctttttccatcgatcagtacgtgtcgaaagaggaacagaaaattattgccgattatgcgatagcgaaccaaaccaataaaatcagacaaattaaagagggactcggcggccgatacagttattttaaaatccgcctggccctgtcgaaaacggtga

SEQ ID NO: 2807 - DNA, 614 bp, Bacillus licheniformis
ttggaagcgagcaccttactgattattgattttgaatttacaatgcctgagggaaagtatcacccgcaaaattttttcccggaaatcatagaagcagggattgtaaagacggttcatgatgaggtggttgagacgttttcaagctatattaagccgaagaagttccctaaattaacgaggcgctgcaaaaattttctcagcatcacgcaggaacaggttgaccaaggcatcacgtttaacgcgctgattgaaaagctgcgggagcttgatcctgaccgaaacagcgtcatcattacatggggaaacatggatatgaaagtgctgaagcaaaattgcatgttcaaccatgttccgtttccgtttaaaggagagatgagggacctttccatggagtacaaggaatttttcggcgacaaaacattgacgaatttgtggaaggcagcggaagagtacggcgattcaggaacgggaaaacagcataaagcgcttgacgacgcgatgacaacgtataagttgtttcggctcgtagaacgggataagaagtatttggaaaatccgaagccgacgacgatcggcgaacgggttgacctctcaaaagtctttccgcacgccac

SEQ ID NO: 2808 - DNA, 685 bp, Bacillus licheniformis
ttgtttaacgaaatattatggattagttttgcgatcattaattttatcattgttctcttcttttttaaacgatttggcaagaccggtttatttgtctggatcggttttgcgacagccgccgccaatatcgaggtagtcaaaacggtcgagctgttcggtttgactgcgacgctcggcaacatcctgtacggaagcgtgttttttgcgaccgacgtcatcaatgaaagatacggaaaggaagaagcgaaaaaagccgtttcaatcggttttttcattctgattaccttgacgctcgtcatgcagggagcgctcctattcaagccgcatcccgaagacatcgcacagcctgcgctggagacgatattcggcttcttgccccgcgtggccctcggcagcctgctcgcctatatcatcagccaaacgcttgatgtttatgtatattcgggaatcagaaggttatttccttccgaccgggcactgtggcttcgcaacagcggcagtacagccttaagccagctgcttgatacgttgatttttacgagcgtcgcgtttatgggcgcttatccgctggatgtatggattcagatttttatcacgacatacgtcttgaaattcgttgtagccgtattcgcagcgccgtacgcttatgccgctaaaaggatcacccctttggatgaaaggagcg

SEQ ID NO: 2809 - DNA, 594 bp, Bacillus licheniformis
atgacaaatagcagaacgaatccaaaggttgatgaatttttaagcaaagccgaaaagtggaaggaagaatttaagaagctccgtcaaatcgtacttgaatgtgagctgaacgaagatttcaagtggaagcatccttgttatacgttcgagaataaaaacatcgttttaatccatggatttaaggaatattgtgcgcttttgtttcataaaggcgcattgttaaaggaccccaacgggattcttatccagcaaacggagaatgtacaagccgcgcggcaggttcgattcaccaatgtacaagaaatagctgaaatggagaccattttgaaagcttatataaatgaggccattgatgtagaaaaagccggcctgcaagtggattttaaacaggctgcagaatatacaattccagaagaacttcaaaaaaaattcgctgaaatcccagctttaaaagcggcttttgaagcattgacgccgggccggcaaagagcatatattctttatttttccaaaccaaaacaatccaaaaccagagagtcgcggattgaaaaatatactcagcaaattctcgatggaaagggattgaatgactag

SEQ ID NO: 2810 - DNA, 678 bp, Bacillus licheniformis
aacatcctcgggatgtcacatatacagaacgaaaaataaccgttgaattttatttaaattcaatcatcgctgaaaacttttatcaatttagacgggagctttacgcgcttttagttaagccgtttccctattatatctcgaccgatttattgccgaatctccgttttcgggtaacttgtgatggaaattttagtatcccaaaagaaaaggagaaaaactttgtaacgttcacagttgaatttaacaacatcacgggactggcagaatcgaaattcacttctctgacaaagcaaaattttgacgttgagcattggagcccaggcatgaacattcaaatgcgtgacgatctggaatacaggttcaaaaatcgaaagaggtttcaggtttataacactggtgatgcctatatcaatcctttggaacatgactacaatgtggccttatgggcggccggaaaaaatgtgacgatcatcaaccatacaaatggtgaaaagctgaaaattgaacaggaattaaaaaaaacgcagcgtgtttcttttattaagcaatacacagtgatcaataaaacacctattaaaacatccggcagactcccgggactcgatataggaatgaataagtttgaaatcttgaataccaatgattttgaaatcatatttgatacccgtttctactacg

SEQ ID NO: 2811 - DNA, 579 bp, Bacillus licheniformis
atgaactggtatgagaagcttagcgagtatttccctattgaagaaatgaaatcaaaagagcatatggaagcattgttaaaggaacaaaacgatatttaccataaagaagaaggccgtcatcatgtgttgatgtacgccgaattcgactcttttattttcatcgactatttattcgtttctaaagacgcacgaggacagggacttggatccaagctgattgagaagctgaaaaagaaaaacaaaccgatcctactcgaagttgagcccgtggatgaagatgatgccgatacggcgaaacgtcttaaattttatcaaaaggaaaactttaaacacgctgagtcgattggttaccgccgccggtcactcgcaaccggcaaagtgaacaaaatggagattctgtattggtctccaaaatcaaacacagagaaagaagtgtttgacgcgatgaaagaaacgtacgaaaaaatccatacatacaaagatgaaaaatggtatggagaatcttatgaagatgtggatgacgtccttacgattgttgacgatcataaacagaagaacattttcgatgaattaagctaa

SEQ ID NO: 2812 - DNA, 741 bp, Bacillus licheniformis
tgatactgcccgacaggcagcttaaaccaagaaagaaagggatcaccatcctgatcgataacggggttcccttgagcttttttaaagatacgattcacggagcggcagattatatagattttgtgaaatttggatggggaacgtctttgattacgaaatatttggaggaaaaaatcgatagtcttaggcagaatgacgttcaattcttttttgggggaacgttgtttgagaagtttttaagccaggataaaattgaagattactaccgctactgcaaattatatggatgccgttatgtcgaaatatcaaacggaacggtccgtctctctaataaagataaagcaagctttatttccgacttttcgaaagaatttcacgtgttcagcgaagtcggcagcaaagacagcaccctcagcagcgagctggagtcagccgaatggatcgattatatcctcgaagatcttgaagccggagccgagaaagtaatcacggaaacgagggaaagcggcacgagcgggctgtgcaaaagcgatggagaaatgcggtcccagcttattgaggagatccttcattccggtatcgcttcaggggatttaatttttgaagcgccgacaaaacagctgcagacgtgtttcattgaaaaaatcggtcctgacgccaatttggctaatattccgtttcaagatgccattccgcttgaaacgctgagactgggacttcgatcagatacattttatttat

SEQ ID NO: 2813 - DNA, 1725 bp, Bacillus licheniformis
atgaagactcttgatgttcaggcgctgcacaatgcaatagatcaaacgctggaacaattaaaacaacaatcagacgaaatcgccaaagtcaaaaaggctgttgagggcatcacatcacttgatgatgctttaaagggaaaaaggcggcgacgcgatccgcgcctttacgaggaatgccacaccccttttctacagttctatgatacttttatagaggaatacagttccgcgctgaagaaaatgaaaagcgcgctgaattccctggaaccaaaccataacggatttatttcacagtcctttctcgggcatgagttggagaatggcttgaatgccgctgatcgcacaacgaaacatttggtttctaaaaccaacgccacgatcgcaaaagtcagccatattgtcgatttaccggatttgaatgacagcggttttcatgaacaaaatcagaaagcgttaaaggaaatcagcacgactcttgaaaagctccatgcgtttgaccgcgggcaaaccaacgccctgaagacggctgaaaacgaccttgagacgatgcagagatacatcgcaaggctcgaaaaaatgtataccggtcccaaaatagaaatcaccagttatcaaaaaggcgcgattttaaagtcggatgataactctacaataaacggactacctggcggacttcagggccaactggagaatgtcgaaccgtctccgatggagatgatgcttgaaaagctcaacaaaaataaacgatctaatgtggatacggtgattagggaagacaataaagaaaatatcaatcaagacgtttatgcgaacgattttgatttgaatgcgttgcaaaacgaagcagaaaaatatccgaaggtttatggagatattcgggtcattgatggtaaactatataatcataaaggatggaaaagggtcaaaacagttgatgtcgccgatgaagtggttcaaaatccggcagacattaaatatatcggtgggcgttaccatgtatatgaaaatggtcaaatcgtaagaaagtacattgtaaacggtaaagtagagatggaagctgttaaacgtattccaaaaagtcgaagccaagggaatcttaagcgagattttgaaggaactcctttagaaccagtaaatgatataggggattttgttgcaaaagaaatagcgggcggtaatgatgcggttcgggtcataacaggcagagatccggacacaggtgaaaaagtctctaatgtcgagcgtgctgcgtccggaacttctttaacacctgttggtcggttgctaaagtacgggaaaaaaggatttaagttatttaaaggtgaagaggcgggaaagaaagttgcgaaggtagataaaacaccttcctatggcaaacaatccgtaccaaaaggtccgtaccgtgaagtaaatggtttccctgcaaaagttaaaccaggagctcaagaaaaacatattccaggaacaccaaattataaacaagaagttgcaaatggcagaaccaagagtatcttctacggggataataaaaaagcgcaagagttgcttgataaatatgctggcacaggagatatgttaaaaaaaggaaacaaagaaagagtggattttggtcaagtaataggaaaatactataatacagagacccgtaaatatgaagagactacaagaggcatgatacattatggaaaaaacggcgctcatatagtaccttcacaaccgtcttaa

SEQ ID NO: 2814 - DNA, 1072 bp, Bacillus licheniformis
atgatgagtgccactgccttgccggcctttaggctgcacattcatccgaagcatctgcttgagttgaaaaaagacgtctggagtgatgaagccgttcccggcatgctcttgaccggttcagcaaagacgcctgtcgcagtgtcatacagaggggcccacacccgcaaactgacgaaaaaatcctatttcattcaatatccggacaataaagaaaaggctgcgtttcatttgaacgcggaatatcatgatccgtctttcatcagaaacaggctttcctttcatttttttgaacaaatcggcgtccttgcgccagcagcatcacacgttttcctttatatcaatgaaaaaaaagaaggcatctatttaaaaatcgaatctgttgacgatcatttcttaaagaggagaaatttagaaaggggggccatttattatgccgttgatgacgatgctaatttttctctgctgagttccttcaataaaaaggctaagcaaaatctcatgcagggatacgaaagaaaaacgggttcaagccgccacgatgactacctccatgagtttatctactttatcaataccgccaaagacgacatatttgaaaaagaaatcaaacgctatctcgatgtcaaacaatatttgctgtggctcatcggcgccgtctgcacccaaaatttcgacggctttgtccataattacgcgctttatttaaacggtcgcacaaaaacgtttcaaatcattccatgggattatgacgcgacatggggacggaatattcacggggaagaaatggagcacaaccggattccggcgaaaggctataatacgctgtctgcaaggctgctcgacatcccggcttttcaatcccaatactttaatttaatgaaaaatgtcttgcaccgccaatttacaatcagccggctttcgcggtatgcggtaaactggcacgagacaatcgcgccttttcttgaacatgatccttatacaaccgtcacatacagccggctcgaagatgagcaaaaacaaatttttcatttcatcgatcagaggaagcggttcctgcttttcgagctttccc

SEQ ID NO: 2815 - DNA, 840 bp, Bacillus licheniformis
gagagagcttaaaaatgccaaaatcaatttcgtcagttatgtcgacaaagcggcgaacaaaaagaaattcttcatgacgaagtcgagtgaaccgccgacatttcaaaaggaagtcaagctgattgcaaaagccgaggatgaaaagaagctcgtctacggcgttgtctacgagccggacattcaggatgcccacggcgactttatgacggctgaagaaatccaaaaagccgcccacggttttctgaaaaatgcccggaagatcgacaaggatcacaatttccagggaggcgtcggagaagtcgtggagtcctacgtagcgccggctgattttgaagtaaacggcgaaacgattgtgaaaggctcttgggtgctggtgacaaaagccggcgatgagatctgggaacagattaaaaaaggaagcatcaccggctacagcatggcgggcactgccgaaacggtcgagcacgcgccccaagccgactctgaaaccgatgagcccggcagtttctttcagctgtttaagcagttttttgccggcgacaaacaaaaaacgggagaggaagaaaaaaagatgaaacgatcagaagttcaaggaacgattgaagccgtcttggctccgcttctcaaacgtcttgacgatttggaaggggataaagcggcagatgaaaaagagcaacagacagaccaagacgcacatgtgaaggaaatcgtcgaggacatgctcgcccctcttattgcacgcattgaagcactcgaaaagatgagaggcgcctcaaagcaggcagcagccgaaaaagacggggaagaagaagttaaaaaatcgatttggagcggattgct

SEQ ID NO: 2816 - DNA, 540 bp, Bacillus licheniformis
atgacgattattcactataactattcggatacagaattaaaaaatattctcgacagcatgatcattattgtggatacgagggagcagaagaaccagcatgttcttgactatctccgcaaaaagaacgtatctatcaaattcaaagggatgaagacgggcgactattctgccatgatcccgaaaaacgaggaatacgggattagccgggacatgtatttgaacgctgctatcgaacggaaaaatggagttgatgagctggttcaatccattaaggaccgttctcggtttgaaaatgaattgatccgtgcagccaaacaccccttcactcttcttgtggaggatctggaaggctaccaaaaaatattgaacggaaaatatcgctcacaatataagccgcaatctttgcttggcagcttaaaaacgtttgaagtccgttacaatttctcaaccgtttttattaatccgagcgcgaccggaaactatatctatcaccattttcattatatggcccgggagctgttaaaggggggccttgtgtga

SEQ ID NO: 2817 - DNA, 828 bp, Bacillus licheniformis
atgaaaaaaagtttgtttctgttcgtgttcagtttgtttttgatggcgattccagcattttcggcttcggcgaatgtttacgaagatgagtatgaacccaacaattctttcgctgaggcttacgatgtagggttgtggaaatacaagacgatttcggcgacgattcacagcgaaagcgataaagattattacaaattttacgcgacaaagggagaacagcttgccattcacctaaagaacatcccggcaaatacagattatgatctatatttatttaaagatgcttacggctatcccgcagtaggatcttctgaaagaatgggaaaccaaaatgaaatcatccgcttggatgttcccgagacaggccgatacattgcggtcgtcatgtctaaagacggttcatatgacggctggggattttacagacttgaatttatcgacagaatgaagagcggtgcttatacggcgaatttgtctccgtcatccatctcaagcccgggacagggagtcgtttctccggttgccgccgtcaatcttgccaatgcctcggccattcccgaaggagcgactgtgaaaagcgtttctgccgagggaacgatatatccaagtctcggacacacctacagagaagtcctgaacaaggaagaaggcgtttggcacacatcggtttcaggcggcacactgtttccggatctaaagcctgaacttgcgcttcccgtcaaaacgacatggaatgtgagatactattcgctcgcttggagcagttcaacttggagatcgccgcagctgaagatcaattatcaatacgattcaacatacggctggtaa

SEQ ID NO: 2818 - DNA, 711 bp, Bacillus licheniformis
atgaatgaaaaccagctatatttggaggaagcgacccgctggaaaatgaagtttctcagaaagccgtcgatggctgagcggatgtcgaaaggggtacagtcgaaaattaacgcccgcattcccgccaaagttcacaaggcgataacagaaagcattaaaaagatggtcgaggctactttgctcggctcaaatttaacgacttttgacaagaaaacaggcacgctttcgctaagggaaaaagatgagctggctcagaagacaatcgctcaatatcaaaaggcggctgctgttgaagggatcggaacaggcgcgggcgggatttttctcggactggcggactttccgctcttgctcggcattaaaatgaaatgcctgtttgaattggcgtcgatttacggatacgatattaaggagaaagaagaacggatgtttcttctgtatatttttcagctcgccttttccggagaagcgcaccgaaaagaaattttccgcatgatcgaacattgggataccgaaaagcgcgaaatcgattggcaggcttttcagcaggagtaccgggactatctcgatcttgtaaagctgcttcagcttgtgcccggcttcggcgcggtcgtaggcggaacggctaactataagctgcttgggcaccttggggaaacagcgaggcacgttttccatctgagattgattcatgagacagccggatattga

SEQ ID NO: 2819 - DNA, 642 bp, Bacillus licheniformis
cttttaatggggaagtagagacggagaatgagaaagtatatcagcgcagccaagtcaacaaacagcttcaagcgctgctggatcaatatcatattgccattccagcggatgcggcgctcacctttacgattacaccgattgattatcaagtaaaggtaagcggaacagatgatgagcaactcatccatcaaattgaacaaatattgcaatcaggagaaaacagcaaacagttatttctgcatatcatgaaaagcttgagcagcgattcggcacaatattccaaagaagcgcaccaaaaatatcagacggttcgcgagatatatgaggtgacagggtatcacctgaaagatttggaagtggttgatggccgatatgtaacaccttccggccgtgatttattagaagtgtataaagaagagctggagaaggatcccgtcctcaagaaaacggctcatctcgcaatcgctcattatggagcagagctgaacaggcttgcggaagccgaatatgattctgttccggatttcatcttgtctattgactacagcaacgggtcattgcgggatacagggcaaaagaagagctatggaaccggggatacggcttggctaagagaattaaagcgccgaacgggtgtgaatg

SEQ ID NO: 2820 - DNA, 1110 bp, Bacillus licheniformis
taccatatgatttggttgcgacgaaaatgaatttttggtatacagccttaaaaaacaattggacaggcaaggctgaggatactaagaaagaagttgaacgagaattagaacaaatggaacaaaatcaggatgtgattgtctattacaacttactgctcttccggcataatcttcaacttgattatatgtattctaaacccggtgtaaatttaaatagtcgttttgatgagttcaaaaagattcgcgatcagaataatctggaaggaatgttggattattattatcattttttcgctggaatgtatcatttcagacaaaaagaattaatccttgcgctgaatttttatagggatgccgagaaaaaactcgattcttttgattgtgatgaactggaaaaggctgaattttatttcaaggcatctgaagtgtattaccatatgaaacaaaccatcttttcgatgaattatgcaagtcgtgcgtataacttattcaaaaagtatgatacttacggtgagcgtcgagtacaaagtcagtttattattgcaggtaactggctagatcatatgtatcccgaaaaagctctacataatttaaataaagagcttaaagagtcagagacacaaggaattcttcatcttatgggttcatcacatttaaatatcggaatatgctacaataaattggaagatgtcgataaagcaacctacaattttcaaagagctctgaacctttataaagaggagaagcatagttttttgccaaaaacattattcaacctcgcacatgtcagggcaaagcaagggaagttgtcaataactgatgacctatactatgaaggcaaagagttggctgaaaagaacaagaatttagatatgcttgcaaagtttgatttaataaaagggctttatctttcatttgatctggatatggttcgcgaatcgttcaagtttttcgaaagtaaaggcaagtatgcagacatggaggaatacggtcttatagcggctgaactattagagaaaaaagaaaaaattcgagatgcagtggaattctaccggataacagttaatgcgagaagacaaattcaaaggagtgcttttctacatgtaaact

SEQ ID NO: 2821 - DNA, 622 bp, Bacillus licheniformis
atggttaaagttgtgaagaattatgtgaaagtcaatcaatatactcggccagggttgaagttggcaggagtgaaagggattgtcatgcactggacggctactcctggcgcgtccgcactgaatgagcgaaattatttcaacggcacatgtatcgctgataaacgttacgcttcagcccattattttgtggaccgtaaagaggcgcagcacatcatccctgaaaacgaagtcgcatatcatgcccatgatcaaaatcgctgttatgtcagctttttaaaaccaaacgctaacacaacggcaatcggtgttgaaatgtgcgtcgaaaaagatggcaagattcacagccaaacgattcaaaatgctgctgaactggttgccgatctgtgcaagcgttacggcctttctacaaacaaaattgtccgccattacgatgtgacaaataaaagctgtccgactccctgggtgagggatgcaagccagctgacgacattcaggaaaaaatttgatgccttggctcggaaatacactgtgtcaaagacacctagttcacgaacccagtaagcgaatccaagggacctttctatataaagggcattcggataccagttaaaggccctaaaaa

SEQ ID NO: 2822 - DNA, 1013 bp, Bacillus licheniformis
atgaaaaaagtttcagttgttttgttggcggcagtcattttagccgcaggcgcatttgcggccgtccgctatttcgtcccggaaaaagcggagccggcaaagagcggcggttcagacctgcttgtatcgataaccgatcagaagctgatgaccgcttactatgaaaatcaaaataagctgtatgaagaaaagatgacggattatccggctatggcattagaccggaaaaaacgaattctttactatacaaacaccgataacagcaatgtgaagcatttgatcaggctggatttacagtcgggcaaaaaaacaaccctatattcaggagatgaatatgtcgacgggctcagtttatcggcggacggttcgaagctgttcatgagatacaaccttgcggaggagaggaattttcaccttgcttcctttgatttaaaacaaaaggcgtttcatgtcatctatccatcgttgaaaaacaaggacgaaactgtcagctactatcagtacaacaaagctgacaatcaattcgttatgctgcattattcattgaaggaagactatcaaaaaacagatgatgcgaacaacaaaggcgtgccgcccgaaccgacgaatatgaacatttccatggcgggtgtgaaagatcggcaaaaggtgagaacgatagcaaaatttatcaatgacgtggcaatttcgccggatggaaaaacgattgtctttacagaatcggctgatgatcagaaggcgatttatgcgatggatgccgaaacgaaaaaatacaaagcgatcatttcagatcagcaggcattttcattggtcgattcagcacagccgcaattctcgaaagacgggaaaaagctttactttctcgctgaagcaaaagatgcgaagctgcttgaagatgaaacggggagcgaagcaagggtgagaacgatctattcgtatgatatggatacgaaaaaagtgagcaaagcctgggaaaaaacaaacgggatcatcaacacctttacggtcattga

SEQ ID NO: 2823 - DNA, 545 bp, Bacillus licheniformis
atggatgaaaaacaatgggagcagtttttagcgccgtaccggcaggctgttgaagagctgaaagtgaagctgaaagggatccggaccctttacgaatacgaggaagagcattcgccgattgaattcgtgacggggcgggtgaagcctgtgccgagtattcttgagaaggccaagcgaaaaaacattcctctgcacaacattgaaagcatgcaagatatagccgggctcagaatcatgtgccaattttttgaggatattcgcattgtcgtcgatatgcttttggcgagaaaggacttcacggtggtggataagcgcgactatatcgcggaacataaagagagcggctaccgctcctaccatctcgtcgtgctgtatcctttgcagacaatcaacggggaaaaacagattttggttgaaattcaaatccggacgctggcgatgaatttttgggcgacgattgagcattctttaaattataaatacagcggcaacattccggaaaaagtaaaattaaggcttcagagagcttcggaagcagcatcaag

SEQ ID NO: 2824 - DNA, 846 bp, Bacillus licheniformis
tgcgccgatgtttaaggcagtctctttcttttaccgattttttcgaatttcttgttgccgacatgtttgaacaagacggcttgatccttttgaattccggagacccgggcatcagaaaccttgaagcgcgctttttccggcagctgctggacaaaaacgatgagctgaccgactctgtcaaacggcagcaggaattgatgaaacaactgggttacacaccgattatcgaaggggccgcacaacatgcgaacattttttatgagcgcgacggcgagcggtttttaattgaaaaagaaaacggcgcgttttttataaaagagcttcatcttcagtggtctgaagcagagctttgcgatttgatctgccagaacccggaagcgttcagcaataatgtcgtaacccggccgctcatgcaggaatatcttcttccgacattggcgttcatcgccggtcccggagagatcaattattggggcgagctgaaaggcgcttttcaggtcatgggctataaaatgccgcctgtcgtaccgaggcttcaggttacattccttgaacggcacatcgaaaaaaagctggacgaacggggaatcgaactccgcgaatcgattgaaaagggagcgcgggccaaaaaagagcagtattttcaagataaggttccgagcggatttaccgattcggtcaaacaggcgaaagaaaaaatcgaaaacattcattccgcagtgcgcgccgaagccctcgaaatcgacggcagcctcggcccccttttagaaaaaacgcgggcttcattcaagatcagctccaatttttggagaaaacagtcatcagaaggattgaagaaaaagaaaa

SEQ ID NO: 2825 - DNA, 879 bp, Bacillus licheniformis
ttcagtcttattacaatccttttgagaaaaagatctacatgagccacttttggaaagacaggaaccaccgcgatatggtagacggcttgaagagcgatgtatacttgcggtcaatcggctcccgctacagctcgatgaaagacttttcccgcatgctggactcggctcggaaatatcagtttaagagtttggcaaaacagttgtttatgctttttgaggatatcagaattgaagagtccatcaagagggagcgccccggtacaaagcaggtattttcaaaccggaaatcgatgtaccgcaaacactttgcgacacagctgacgctgaatctggagcggagcatttttacagatgctttgttttgcgctgtatatcttaagctgaccgcggagtcgccgcttgaagagataccggctatccatgaatcggtcgatccgatgaaggggtttatagaagccgagctcgcccgcgtattcgaagcgcgttcaactgctgacatcgtttcgtttgtaaacgggttaatggaaggttttgaagaagtgctcgaaaaagatatgctgaatacgtacttcttttttccggaacttgactacgaacaagttgacgaagaagcgctctttcaagatttaaaagcaaaaccgaagctgagcgaggatctgacgctggaagagaaaagtgcgggtgacgagggaagttcatgaagaagaaatgccgacttggcacagagaaacggaagctccggccaaaagctttctccagtttgatttggagcacgggcgcaaaatccgatatttccgggcggcgctttaagagaagagaagacggcgaccaagcgctcggggtctgttcaaggaacggcgaagcagacgaaaaggaaga

SEQ ID NO: 2826 - DNA, 495 bp, Bacillus licheniformis
tcggggaccgcagccaacgcgaggatcaaaaaccgattttcaaagtggaggatggtgcaacgctcaaaaatgtcgtgcttggcgctcctgctgctgatggtgttcacacatatggaaacgcttccataaacaacgttgtttgggaagatgtcggcgaagatgccttgactgtcaaaagcgaaggaagtgtcacgataaacggaggatcggcccggcttgccgcggacaaaatctttcagattaataaagcgagcacatttaccgtgaaaaattttactgccgatcaaggaggcaaattcattcgccagctcggaggctcgacatttaaagccgtggtcaatattgataactgtacgattacaaacatgaaagaggcgatcttccgaaccgacagcagtacaagttccgttacaatgacaaatacaagatactcaaaagtcggtcagaaatggatcggtgtgaagcatgctacggaaagaaacaatcatgaatttt

SEQ ID NO: 2827 - DNA, 690 bp, Bacillus licheniformis
cgctattttattgaccgcaatcatgttaagcggttgtttgtaccctgaagaaagaaaggcgaaaaacagcgcaccgcatcagcaccagctcaaagaagtgcaggcggccgttgatgaattcagggaggcgacgggagggcttctgccgattaagacaagggatatgggcgtgccaatctatcaaaaataccctatcgattttaacaggctgtccccccggtatatggctgagccgccgggcacatcctatgaaaacggcggagagtacttgtacgttcttgtcgatgtggaaaaaaagccgacggtcaagctcattgatgtaaaaatgtcggaaatgatcagggagttaaagcttcgggtcgaaatgtataaagatcagcacaagtatccgccgtataaaaaagtcgtatccaagaacttattcatgcttgaccatgaaaagctcggactgaaagaggcgccttctgtcacgagtccgctttcgggcacctcgctgccgcttctcgtcgatgaaaaaggcgacattaaagtggattaccggatggatttggccaagctgatgaagaagtcgaaaaaaacggtaaagccgggcgaggaagtccaagatttgatgtgggaagagacgcctttcgttccggcgttttcggtaaagtacacagtgaatgacaaacaggaacctgtttttctcga

SEQ ID NO: 2828 - DNA, 1067 bp, Bacillus licheniformis
atgagaagaggaattattgtagaaaaaaataaaaaattcgtcacattgctaacccctgacggacaatttttaaaagcaaagagcacagaggaagattatgaaatcggtcaggaaattgcttttcccgcggagacgagaatgtcgagaaggcgtgcgggcttttttgatctgctttcgctccgtccgctgaaagccggcgttttttcaatcgccgcgatcatgctgctcgctttcatgatcatccctgatgttttaaacaataaagcatacgcctacatgacgatcgatatcaacccaagctttgaattgacgctcaacaaaaactgtgaagttatcgatttggtgccgctgaacgaggatgggaaggccttaatggatagtataaaaaattgggaaaagtctgactttaaagaagtgatcagtgaaattgtcgaagacagcgataagagcggttatgtcaccgaatcaaaagaagtgcttatcgccacagtatacgaaaacaatgaagatgacacgtataaggcgacggtaaaaagcgaaatcgatgatgtagcgaaaaaatacgagcagcagaattataagatggaagcggtggaatcagaccttgatacgcgtgcaaaagcccaaaaagaaggcatctcaacaggccgttatatccgttcccacaaagatgaattagaagacaaaaacaaagatgatgacaatgaaaataaaaaagatgatcaaaatcaggaagaaaacacaggagaaaaggagaaagctgtgaaagaagaagatcagccggaacagcatacggatgataaagaagcagatacggaagatcatccggacggcgaaaaaccttcagatgaagatcagtctcaacctgatcaagaaatggaaaaagaaaaggagtcaaattcccctaataccaaaaaccctcaggaacataaccataatgacaaagacggtcagcagacggaggaaggaacgccaaaaagcggttccggttcaaatcaagagagctctaaatcacttccttaccaaaaggagaaaaagccttctgaccaaacgaataaacaagaata

SEQ ID NO: 2829 - DNA, 880 bp, Bacillus licheniformis
atgcagattcgcatgactgaatatcaggttcccgaccccgaatcggggccgtacgggatcacagtatgtgcaaacgggcgcatttggtttactgaacaaaaggggaaccggattggtatgctcacagagtccggggatatcaccgaatatacgattccgacggagagcgcaggcgcctcgattattacgtccgggattgacggcgagctttggtttacagagtataaagcggggaaaatcggcaaaatcacgcctcaagggaaaataaccgagtatgctcttccaccgggtgctgccccgtttggaatcgctgcaggctgtgacgacgccatgtggtatacagatatggccggacatcaaatcggcaggctgtcctcttcaggcgaaataacagaatacaaactgcccaaaccaggagccttcccgtcatttattacaaggggagcagacggcgcgctctggtttacacaaaaccaaagcggctccatcgggcgaataacggcagatggagacatcagcgagtatccgctgccccaagaacaatccggcccggtcgggatcactgccggcccggacggggctttatggtttacagaaataaacgcaaatcaaattgggagaataacggtctcaggaaagatcagcgaataccagcttccgacagcgcatgcacgcccgcacgcgattgccgcaggcggtgacggagcactgtggtttacggaatggggcgcgggtcaaatcggccgcattacagtcgacggggatattacggaatatccaatcccgacggcagattctgaaccgcacgggatagcggccggatcagcccattcgatctggtttgcagaagagtgcggccgtattgggaaaatctctatcc

SEQ ID NO: 2830 - DNA, 792 bp, Bacillus licheniformis
caaaacagatttggaaaacgaactgaaaaaaattgaaaaatgggaaaaggaacagcagaaagcatggttttgggaaaggatcggccggctgccgttcaaagttctggacaagcttacgccggcattcattcaagataaaatcggcctgctgctagacgaaatcggcggctttattcaaaatggaggccaatatttgacgtccgaaaagcatctgatccgccagtttcaaaaaaagctgccggatgaaacgatcgaaacgattgaagatattcaatgggctcctttggaagtgatggatcaaatatgtgaaaatctcgggaaaaacagggcgaataccgcagcagtccaaggagcgacaaccggtgtgggcggcttgttcacgcttgccgtcgatattcccgcaatcctcggcctttctttaaagacattgcaggacatcgcggtatcttacggctacgatcctaaagaaaaaacggagcggatgtttattattaaatgtctgcagctcagcgctgctgatattgtcgggaaaagggcgatcattcaggaactcagccgataccatcaaccatcaggctcccgtgaaaatatgatttcgcaaattcaaggctgggcgggaaagttgttatacataccgcgattctttcggatgggaaaagctgtttcaaatgtgccagtagccagaatcctttttggtgcaatctcaaatctttcaaatgtaaaccgggtttgcccaaaacgggggttatgatttttttaaaaaccgggcctttttgaaagagttttgggaac

SEQ ID NO: 2831 - DNA, 722 bp, Bacillus licheniformis
tcttacaaaaaaccagctgatcggactgatcatcgtactcttcggaatcagcatatttttgcaaaacagcgggcttggagacgcgttattctggccgctcgcttttctttttgccgggtattttctccacaaatattcccgccgctggctcgggtctgtcatgtatatttttgcaggctttctgctgctgaaagacatcttcagcattacattcagcctgttcggctttttctttgccgctttcttaatttatgcggggtaccggctggtgacaaatcagccggtatttgaccgccataagccgaaagacaggggaaaggaaaaggcggatttcaagccgcttcaggagaagaacagccctggccagcgcagcttctttttcggtgatgtaaaattgatgaaaacaccttttgacttaaatgacttgaatatctccgggtttatcggtgacgtgaaaatcgatttgtcaaaggcgattatttcagagggcgaaaacaccatcgtcattacggggttgatcggagatgtcgatatttacattccgtccgatcttgaggtgtccatcagctcttctgcattcgttggagacattgacgtcatcggcggccgaaaaagcggcatcggcaatcaaatctattccgagacagagaattacgagcagtcggcacgacgggtcaaaatttcgatttcgctgtttatcggcgatgtggatgtgcggttca

SEQ ID NO: 2832 - DNA, 1251 bp, Bacillus licheniformis
tttatacagtccagccgggagattcactatttgtcatcggcgccaagttcggaatttcgattgaccagatccgattggcgaatgggttgatcgcaacaaacattgtccccggacaggctcttttaataccgctttatacatataccgttcagccgggagacagttattacacgattgcccgccggacgtttgtatccgtcgaagcattgcaaaaagcaaatccgtctgtaaccccttccaatatgaggccggggataaaagtgatgattccggaattgccgaaaaaaccgatcactgctttaggatattacacactgagaaacccccggttagaccaggaattgattcataattttgccccatacgccacgtatctggcattttttgaataccacatttcaagcgacggatcgttaagcgagctgaatgattcaccggccgtacaaacggcttggagacggcgcgttcctcccctcatgacagtcaccaatctaactgaatcaggcttcagtccgtctcttgcgcaccgcgtattaaatcagcctgccgtaagaaatcgcctcatcgacaatattgtccaaacgatttccagaaaaggatatgcaggcgtcaatattgatttcgaacagattttggaggaagacagagatttattttcaggttttctccgcctgttgaaagagcggctgaagccgtccggctatgtgttgacgattgccgttccgccgaaaacaaatgaaaatatcgcctggctgaaagggtatgactatggcggaatcggtgcagtgagcgaccttatcttcatcatggcatacgactggcaccacgggacaagcgagcccggccccattgctccgatcaatgaagtccggcaaacaattcaatttgctctccgccatgtccccaaagaaaaaatcgttctcggctttccgctttacggctataactggaccctgccctatcagcccggtgccgtataccccggaatcgccaaccaagacgccgttcagctcgccatgaagcaccaggcaccgattcaatatgatacaaattctgagtccccttttttcagatacaccgatgaacagggcagacggcatgtcgtatggtttgaagacgcacgcagcatcggaaaaaaactgcagctgatcaccgaatacggacttgacggcggcggcgtctggcagctcacactcagttttccgcaaggaacatggctcttgaccaaattctttcgcgtccgaaaagtct

SEQ ID NO: 2833 - DNA, 684 bp, Bacillus licheniformis
gaaagccgcttatcatttgcgattttgacggaacgatcacaacaaacgacaacatcatcagcattatgaaacaatttgctccagaagaatggaccgctctaaaagacggggttctgtccaaggacatatcgattcgggacggagtcggcagaatgtttaatttgcttccggccagcctgaaagaagacattacggcatatgtactgaaacaagccgagacccgccccggatttaaagaatttgtttctttcctggatgagaagggtcttccgttttacgttgtgagcggagggatggattttttcgtctatcctctgcttgaaggaattgtcggaaaggaccgcatttattgcaacgaggccgctttcaccagccgcaatatcgagatccgctggccgtatccgtgtgacggcggctgcggaaatgactgcggctgctgcaagccttccatcatccgccggctgaaaggccgggacgatttcgttgtcatgatcggggactctgttacagatgttgaagctgccaaatgttccgatttatgcatcgcgcgcgactatttgctgcgggaatgtgaagagctcggcttgaagcatgcggcattcggcgatttccgcgatgtaaggcgaatactcgaagagaccgcggaggtgaaagaatggatgtctgagcaaaaacggcaggaac

SEQ ID NO: 2834 - DNA, 516 bp, Bacillus licheniformis
atggaacaaggaaaaaagaaaaaaacaatcggattcaacattattaaaagcgatccgacagacggacacgggggatttggagcaggcgcattaagccttgacaacatctcgcctgtcattgtcgatgttgaagagaaagaagcgtttgtggatatcggcgccatgcacgcccgcagcacggttgaaaaaggaatcaaatttttgccgaacaaagaagaggtgccgaacggaaaaccttactggcttgtgtgggttacgatcgaccgcagggaagaaggcccttattatgcgggtgtgacggcatgcgaaatgacggtcgacagaagcatccgccgcggctacaaatcgcttccggagcacgtcaatttaatggataagtcgatgaagcggaagattatcgtcgagcatatggatgaaggttctaagcgcgttcttgccgattttctgaaaaaccatgatcaagggctttgggaccgttcatcagacgagctgaaaaagggactgctccagcaatag

SEQ ID NO: 2835 - DNA, 593 bp, Bacillus licheniformis
atgagctgtccggagcatattgttcagcttatgcataaataccttgacggagacatacttccggaagatgaaacgcgtttaaaagagcacctccaatcatgcgaaggctgcaaaaagcaccttcatgaaatggaaaaatccatcgctcttgtccagagcacgtcgcatcttacagctccggcgaactttacagccaatgtgctggcgaatctgccgaaagaaaagcggacggcatcgatcaacaggtggcttaaagcccatccgtttttagtggcggcggctttatttgcaattttgatgggcggcagctttttctccagctggaaaaacgatcacgatttcagcgtatccagccagcctaatcttgtggtgaaaaacaacacggtcatcgtgcctgaaggggacgttgtcaaaggcgatgtgaccgtgaaaaacggaaagctgattatagagggcaaagtcgacggcgatgtcacgattgtaaacggtgaaaaatatacggcttcagcaggacaagtcaccggtcagatccatgagatcaacgaggtgttcgactggatctggtataagatcaaatcgaccggaaaatcggt

SEQ ID NO: 2836 - DNA, 1007 bp, Bacillus licheniformis
gtgaagaaaaaggtttatacttttggtttagcgtcgattctcggaacagctagtctatttaccccctttatgaacaacacggcatcggcagaaacatctcagcaaaaacaagaaattcagcaaaagcgttctgaagtgaattcaggcatcgagagcaagcggaaagaaatcgccaagctgcaagacgagcagaaaaagcttgaaggtaaaatccaagagcttgataaaaaagcacttgaaacaagcaacaaaatcgaagacaaagaaaaagaaaacaaaaaaacgaaaaaagaagtggaagctctgaaaaaagaaatcaaagaaaccgaaaaacggattgaagagcgttcaaaagtgattaaaaatcgcgtgcgcagcctgcaggaaaacggcggatcccaaaactatttgaatgtccttctgggcgcacaaagcttcggagattttatcactcgtgcaactgctgtttcaacaattgttgatgcggacaaagacctgcttgacgagcaggagaaagataaaaacaagcttgaaaaagcaatgtctgatttaaatacaaaactggacgaaatccaaaaaacactagccgatttaaaaacgcttaaatcggatcttgataaacagctgaaagaacaggcaaacctttctaagcagctgcaaacgaagcaagcggcagcagaatcagaactgagcgatctgaaaaaagaagcgggctctctgacaaaagaagaagccgctcttgaacaaaagcttaaagaagaaagagctgcggcggctgcagcagcaaaagcgaaagaagaatctgcgacggctgaaaagtctgattcaggatcttcatcaagctcaaattcaggttcagtcagcaaatctgacggatcgtccaacagcggttcttcaagcagcaagaaaagcagcagcccgtcaagaaactactcttccggttctgttgtaagcagcaatggaaacgcgattgaagctgccatcagcacaggttcaagcattgtcgg

SEQ ID NO: 2837 - DNA, 588 bp, Bacillus licheniformis
cagaattaaagctcggcaaaaagcctgatcgcagcatttatcgctcgctgaccgaccatattcatcttcgcgtcgaacggcataaaaagggactggatattaaaaatcccctgctttgggagacgaaacggctgtataaagatgagttcgccatcggcaaagaggcgctggccatcattgaaaagaagacggggacagctcttccggaggatgaagccgcctttatcgcgctccatatcgtaaacgccgagctgaatgaagaaatgccgaacatcgtcaatattacgaaagtcatgcaggagattttaagcatcgtcaagtatcactttcatatcgaatttgacgaagaatcgcttcactattaccgcttcattacccatttgaaatttttcgcccagcggctgttcagcggaacctatatggaaagccgggacgactttttatttgaaaccgtcaaaaataagtaccgggacgcttatgtttgtacaaataaaatcaggcagtatatcgaaaaagaatacggtcatcagctgacaaacgaagagcttctgtatttgacgattcatatcgagcgagtcgttcatcaaa

SEQ ID NO: 2838 - DNA, 900 bp, Bacillus licheniformis
  misc_feature (1)...(900): n = A,T,C or G
ctttttggatcatgaactgaaaaacgctgatttaaagcgacggaaatcgtctcggggctcaagctggaaatggatanaatcatcgcaagcatcagcgatatcgttgatttggacaattggacgcttgacgattatattgataaaatgtntaaagcgcaaacaactcggcaaaacaccatcgacgctgtgaataaactggatgaatcgctcaagaccgaatacacaaacttacaagcgctcgacagcgccgtgctcggcaaatattccgggctgatggaagctacaagtcatggaaaaaccgccctcaccgatgtattttagcttgaaatcgttccactcaagcgagatctataaaaatacgatagaagtcgaaaatcaagccgccaattatattgaattcaaaaatgaacaggcagaagcgcgcaggcttcaagaaaaacaagaagaagaagcgaacaagccttgggatttaaaagcgcttgacgctgccggaacatttgtcggagaagtcagcgggtattatgattataagagagccgctgaaggcgtcgacccggtcacaggagaaaagctgacagacggccagcgtgtcgccgccggagcaatggcggcagcaggatttattccgatcgtagggtgggcaggccgagccttcaaaggcggaaaagccatttataaaacaggaaaaggactcatcgccgctgatcacgcgcttgacgcctacaaagcctcaaaaacgttgaacgtcttgaaaatgacggaaatgggcgcctacggccttgtcgcttcaaatgggttctcagaagccgtcacgggcaaggacatgtttggaaacaaagtttctgaagagaggcggaaacaaggcctgatcgaagccaccttgagcctcgtcggtgcagg

SEQ ID NO: 2839 - DNA, 723 bp, Bacillus licheniformis
atgaaagtgttcataccgaagcagcacggcgcctgggcgatgcttgtcatcccgtttattctcggcatgttcgccggaggcgcagatgtaaagcatattccgctgttctgcggatggctgtttctatatcttgcggcatctccggctatgatgatggtgaagaagaaaaatatcgtttactatcaaaaatgggttctcatctacggcattccggccgtcgttttcctgcttatttcggtcctgctggagccgcagcttgtgtatctcggtctgccgctgtttccgctctttctcatcaatctttattatgcgaaaagaaacaacgacagggcgcttttaaatgatatagctgcaatccttgttttcagcacgggcgggcttgcgagcttctggatgggagcggggaagcttgatggtgaggcatcgtttgtttttatccagtccgctttgtttttcacagggagcgctttttatgtcaagtcgatgatacgtgaaaagaaaaacaatcgattcaagctttattcatggggctaccatgttttcctgccgttcgtctcgctggccgcaggggcaggatgggcggtgatcggcgtagtgccgagcagtcttagagcgtggtttttccacgggaggaaactgtcgattaagataatcggaatctctgagctggtgaatgcctgtatctttatggccgtgttgatcgtttttctgctgcaaacgtaa

SEQ ID NO: 2840 - DNA, 655 bp, Bacillus licheniformis
ttgcaccacatcacagagattctccccgatacgatcaaacgcgcgctcagcggtcttggcgaccatgaaatcgatcagatagaagaaattcgggttcggacaagtcgtccgctggaactggtgaacaaaggaaagccgcgctttctcccttatgtggcgacgcctgaagactcggcgcttcttttaaacagattgggaaattacagcatgtatacactggaagaggaattgaaaaaaggatatgtcacgatcagaggcggacaccgcgtggggcttgccggccgggttgtcgtcgaaaacggggccgtcaaaggaatcagagaaatatcatcatttaatattcgcattgccaaagaaaaaatcggcatttccaaaccgtatgtcccccatttatttcaaaactcgtggctgaacacgctgattatcggtccgccgcaaaccggaaaaacaacactgctcagagacctcgccaggctgatcagttcgggaagcggcaacgcccctgccaaaaaagtggggattgttgacgaaaggtctgaaatcgcaggctgtgtaaacggcataccgcaatatcggctcggcgaccgggcagacatccttgacgcctgtccaaaagcggaagggctgatgatgatgatcagatcgatgagtccgg

SEQ ID NO: 2841 - DNA, 789 bp, Bacillus licheniformis
atgagtatagcaagcacgtatgaatggcttgaacaggcttcatccgtgcgggaattgccaagctttctcctgccgtattttaaaggcgcttcaaaagcggatgcggcggcgattgtcagccacctgcagatccacggcttgttccgttcgtggacggacggcgaacgtacgatgaagcagcttaaggaaaacggcgtatttcagcatgtcagacgggaagaacagctgctctgcaaaagatggaacgggccggatgttccgattttcatcctgccggtcgatgaaagaaaccgcaaaatccgcgtcgaattcggctcgaaatcaggcctcgcgttcagcgacaaattatttttgtttttatcggccgatcttccccggtcttcaatttctgcgatcatgacacacgaatataatcacgtttgccggttagaaaatatgccgaaagaagaaaaaaagatgacgctgcttgatacaatcattctcgaaggccttgcagaatatgccgttttcgaacggctgggagaagccgaaacagccgcatggacgtcatattactccgaaaagcagcttcgtcatttccaggaccggttcgtaaagcctcatttcgacctgcgccgacacgatggccggctattctccaatattttatttggaaaaggacattaccctgacatgctcggatatgctgtcggttacagtattgtgaaaaaatatttatcggctcgaaaattgaaggttgccgatgttttagcctttccgtcagaagactttataaagctatcgctttaa

SEQ ID NO: 2842 - DNA, 736 bp, Bacillus licheniformis
atgataagtgtttcgggctaccggctccgtcctgaggatatcgaaaaactgaatgtcagtcagacgcagagagacatcgcaaaccggatgctggccatgccgtccggatatagatacggttcaatctcagaactgttatttgagctgagattcagagagcataccgtcaaatcggccagagagctgatcaacagcggagcgaagtttgccaccttttcaaagacatacgggaatgaagagttttggagggtgacgcctgagggggctttggagttgaagtacagggcaccggcttcaaaggcgattcgaaatatttttgaaagcggcccttcttatgcttttgagtgcgcgactgcgattgtcatcattttttatatggcgcttctcaaaacgatcggcgaccagacatttgaccggaattatcaaaggatcattttatacgattggcactatgagcggctgccgatctatacggataaaggaaacgactaccttccgggagactgcctgtatttcaagaaccctgaattcgatccctcaagaccgcagtggcgcggagaaaatgctattttacttgaaaataatctctatgcggcacacggcctggggatcttaagcggcgaaacaatcattgaaaaactgaacgggctgagaaagcctcatgcacagacgtccgcctatctgctttcccaagtgacgcgggttgatattccggcattaattcaaatgatcagat

SEQ ID NO: 2843 - DNA, 1303 bp, Bacillus licheniformis
atggcagagaaaaagaaaacgtatctcgaagaccaattagaggccgtcatgacgaaagaagacggtacatatatctttcgttttcaaagagagaagatcaatcttgtgaacggcttggaagcaaacgtcattaaagaagtcgatccttcctttaataaagaagccgtcatgaccgatgatgaagtccaaattatgattcagcctccttccgaatataaagaatttcgttatataaaagggaaaaataaaaaaagcaagtggctattcgcgtaccagctcgtgaaagccgttgaagaacattcaattaaaaggctgcacctgatcgctgcgcctgaaaacattgtttttgacaaagggttgacgcctaaatttttacattatggagtgaaagaaagcattccgccatatgaacacgacgaagaaagacttttcaatgaagtgaaagccgccgcggcgcttgctgtcgacgggcaattttcttttgaagagtatttaaaatacagcgaaaccatcaaattttcagatcaggtaaaagacatcatcacaagcgggacatacggcgatttgaaagccgtcattcaaaagaggatcgatgaactggatgccaaagaaaaaatgcttgtccatcttccgaagaagaaatggaagattcaaaggtacatagggttaggactaattttatgcttaataccggctgttttattttccttctattcattattcttcgcgcagccgaaacagcaggcgtttatcgaaagcaaccgctacttcttaaataaacagtacagcaaagtcatcagtacgcttgataaatatgatgccgatgagatgcctgattctgttcagtatcagctggcttattcgtatatcatcgttgacaatgtactgaaggaagccgatttacaggaagatgccatgaagagcctgacgcttcaagtcgatccgaataatttcctttactggattcagatcggacgcggcgccaataaagaagcgcttgagacggcccgtaagctggaaaacaatgcacagatcatgttggcacttatgaaatacacagatgacattaaagccgatgataaattgtccagtgatgagcggcagaaacagctggatccgctcgaaaaagaacttgaagaattgaagcggacagcggatgaacagaaagccaaaactgaagaaaaccagcaggcaaacaccgagcaaaaccaggcggacgtagaggccgcaaaggctgaaacggagaaggccgagaaggaacaggcgaaaaaagaaaataaagaaaaggaagacaaaaagaaaa

SEQ ID NO: 2844 - DNA, 656 bp, Bacillus licheniformis
atgcaatttaaaataggcgatatggtcgtcagaaaatcttatcgaagagatattttatttcgaattataagaattgatcaatcggcaaatggagaacctgtagccgttttgcacggagatgaggtcagattaatcgctgacgcgcatttgggggatcttgagattgtccgcgaggctgagtggcagatgagaaagcgggaagaagaaacgagaatgaaggaatccctcgatcttctccgccaggattacaaactccttcacgataaacatgagtaccgcgccacaaaccaatataacaatcaacagcagtactttcatatgcccggaagagtccttcatttagacggggattcggcttatttgaaaaagtgtctggcgctctacgaaaagatcggggttcctgtatacggcattcattgctatgaaaagaaaatgtcatcagtcatcgaggaactgatcgatgaataccgcccggatcttctcgtcattaccggacacgatgcctattctaagcagaagggcgatattaacaatctggatgcctacaggcattcaaaagattttatcgaaaccgttcaaaaagcgagaagaaaaattccccatcttgatcagcttcgtcatttttgccggcgcatgccagtcccattttaatcact

SEQ ID NO: 2845 - DNA, 613 bp, Bacillus licheniformis
atgggaaacagggacgaaatgattctcgtggtcccgcgggaaaacgtatttgcaaatgaaacgctgaccttccaaggcgtcaacagcgacggtgagacgatcgggaagatcatggcgcatattgaacgccacttcagtgaaatgagaaggggagacgccgaggaagatcctgcatttaaacagccgatcccttatgttgtcatcaaaagagaagacgaaatatttgtatatgagcggctcgaaggcggaggggaagcgcggcttcacaacaagctgtcactcggcttcggcggacacatgaactttgccgaagggcttgactttcccgatattctgaagttgaatacagaccgcgaacttgatgaagagcttctaatcgaggaatcagctaaagaaaaaatggtgacgctcggactgattaatgatgatgaaaacagcgtcgggaaagtacatatcggaatcctttcagcgcttgaattaaaaccgggcgcacacgttgaagtcaaagaaaaggagcagattgccggccgttggatgaaagccagtgatctgaaagaaaaaagcgtctatgacagacttgaatcttggtcacagtttgtcgttgatatcttag

SEQ ID NO: 2846 - DNA, 642 bp, Bacillus licheniformis
  misc_feature (1)...(642): n = A,T,C or G
gcgtctgggaaaagaattacacgttccttttcatctccaggctaatcaaaatctctgctgactgttttgccttcaattctattttatggtttttaatctttgacggaaaaggtgcaatcggcacttccctgcttcttgccgtcacttttctccccgaagcctttttggcgccgattacagggcctttagtcaaaagaagcgccctgaaattctggatgtacttttcggatttaacaagggcagccgtcgtcattactataccgatttgctatttaaacggcttttcaccgatgtggtttgttttaggcctcatgatcatccattcggcaacaggcgcgacatataacccggcgtcaattacgctgattccgcagatcgtgaacgaaaatctcatccaaaaagccaacgcgattctccagtcttcttcagaaatcatcaggctgggagccgttacattgtgcggagtgctgctgacttttatcggtcctgcaacgactttggtcttttcatttatcttttatatcatatcgggcctattcatgctttgcatcanatacagcatcacccggactcattcacagtctaagtctcttgctcaaagaggtacatattttggcagaataaaaaaaggatttcccttgg

SEQ ID NO: 2847 - DNA, 648 bp, Bacillus licheniformis
atatacttgctttcggtgcacacagcgatgatgtagaaatcggcatgggaggaaccattgccaaatatactaaaaaaggctttcaaattggaatctgcgatttaacccaggctgaactgtcttcaaacggaacagtcgaaacgagaaaaagcgaagcggcgctggcggccgaaattctcggcgccagtccgcggatttccctcacgctgccggacagggggctgtttcccagccaggcggcgatcagggacgttgttgccgtcattcggaaacataaaccgaagcttgtctttgtcccttatccaaaggaccggcatcccgatcacgggcacgcagcggaaatcgtcgaagaagcggtcttttccgctggtatacataaatacgaagatgcagaaaaacagccggcccataaagtccaaaacgtgtactactatatgatcaacggttttcacaaacctgagtttgtcatcgacatttctgaaacgatcaatcaaaaaaaggatggccttgctgcttatcagagccagttcacccgttcccggcagtcggttgaaacaccgctgacaaacggatatattgaaacggtcgaagccagggaaaagcttttgggaaaagaggtcggcgtcgcatacgcggaaggggtttttt

SEQ ID NO: 2848 - DNA, 600 bp, Bacillus licheniformis
atgaaaagccgtaatctcgtccgatttttcttttccgtattgggtgtcggagctttgactacaagtattgtcggttttgccatagagtggggaagatataaggagctgtttctttccttcgaggtattggagattctgtctgttcttttctggtttatcggggttggcatgatctttagcgtgattgctcaaatgggatttgtgattttcttaacgattcaccgctttgcactggaaattttcagatctcattctttgtggaattcgattcagctgtttttgattatatttgtcgcgtttgacttggtttacttgcgctttctgttttttgaaaaagatggaggctccatcattccgtacatttggctgccgctctttattttggcggtaggcattgcggccgcttatgcaaagcaaaaacagtcctctaaaaaaacgttcgtttccgcattatttctaatgtttgtttttactgtgatggagtggttcccggcgttaagggtcaatgaagaggactggctctatttaatgctgcttcctttattagcctgcaacgcttttcagcttttaatgctgccaaaatttcaggcacgcgcttag

SEQ ID NO: 2849 - DNA, 696 bp, Bacillus licheniformis
atgaataaaagaacctggatcgaaaagctgatcggccacctgctcccgaaagacgagaaagacggaaaaaagctgacgaaatatcactactttctgctgctttttgttctcggcgtttccttcatgctcgtcagccagatcttctcttccgaaccttcccaagagccagcggcagatcagccggcggcttcacaaaaagctacgtctgaaagcaccgtacagagcggtgaaggagaaaaagaagtgttcaagcccgcctcagatgacaaaccgaaggaatcgatccaagattacgaacaggaatatgaaaatcagctcaaagacatattggaaaccatcatcggcgttgaggacgtgtcaatcgtcgtcaatgttgatgcaacctcattgaaaatattcgagaaaaacagaaaaacccaggaaacttcaacgaatgagacagataaacagggaggcaagcggacggtgtctgaaatgtcttcagacgaagaaatcgtcatcatcaaaaacggagataaagagacgcctgtcgtcgttcagacgaaaaagcccgatatcaggggtgttctcgttgtcgctcagggagtcgacaacgttcaaataaaaaagaccattattgaagcagtgacaagggttcttgatgttccgagccaccgcgtcgctgttgcccctaaaaaaatgaaggaggattcataa

SEQ ID NO: 2850 - DNA, 669 bp, Bacillus licheniformis
aagagaaggaagcctgatttatcaaaaccctttatcttctcctgaagatctccgcggctgggtgatggaagggaaaggaatcgttcgttttcagaacggccgcctgcatatggagaacgaacttgacgctgagcaatatggggacgatgctcattttgtttactggtgccctgagacattccctgatggaattgttgtgaagtgggatttctaccctgtgcgggagcctggcttatgcatgatattttttgcagccgccggcatgaatggcgaagatttatttgacgggcggctggcggagaggacggggaaatatccgcaatatcattccggggacatcaacacattgcacctgtcgtatttcagacataagcatgctgatgaaagagcattccgaacatgcaacctcaggaaaagccgcggctttcacctcgtctgtgaaggagctgatccgcttccgcccgctgcagacgctttgcctccctaccggatgaagctcataaaggacggggcatacgttcgtttttcaatcaacgagctgcccattttggaatggacggatgacggcaggcgtttcggccctgtttacggcgcaggaaagatcggcttcagacaaatggctccgctggaagcagcctacgccaactttgaagtgcgcaggctgctgcg

SEQ ID NO: 2851 - DNA, 618 bp, Bacillus licheniformis
atgaatcgaaaaggcggaattttttctcaagaaccaatgaatgaatatatttctcatacggatccgctagctgttaaacaaatagagaaagtcctttccgtctatttaaaggaagccggagaccggcccatcgtgatcgtttgcatcggtacagaccgctcgaccggagattcgctcggtcccctcgtaggaatgaaactctccgcaaagcagctgacacgttttcatgtctatggaacgcttgccgacccggttcacgccgtgaacttaaatgaaaagcttgatcatattcatcagcagcatcaaaatccttttatgatcgcgatcgacgcctgtcttggacgaaccaaaagcgtggggtctttccaaatcggcaaagggcctttgaagccgggagcaggcgttcagaaaagtttgccggaagtcggccacgtgcatattaacggaattgtcaatgtcagcggttttatggagtattttgtcctgcaaaatacaaggctcaatcttgtcatgagcatggcaaatgtgcttgcggacgggctgtcgcatctggaaaagaccggatcgcagcggcgccatgtgtcaccaattgaaagaatgaccggaagaatgtcataa

SEQ ID NO: 2852 - DNA, 722 bp, Bacillus licheniformis
atgggtattaccagacgttttttttaaatggattcagaatgaaaaggggttcatattccgaacaagcgtaacggttttatggtgttcattttcgacgacgagaaccatttagtaggggaagattcgagcttatggattcagcattacggaaaaaatcagcttatagcgagcctgagaaacaaaggttataccatggtaaacagcaatttattcgtcaggcactggggctcagaaaaaacggttgcatacgtgaaacagctgattcattacgtgttcaaacaagagatattaaatgcaaaaattcatctattggcggaaggcacaggggccctcattgcagatgagctccttcgctcaatcccgaaccaaatacgttctacagcgatggttaatccttgcctcgatcttcaggctcatcataaacgagaaaaagaaaacaagtttttctacaaacagtttattaaagaaattgccgaaagctacggaattacggagcgggaggcagccgattatccgttcaaaagcatatccccttatcacaatctcgtacccgttcatattgggcaaagactgaccgggtcacggcatcggtatatgatccatgccaaaacgtttgaggagcgcaagctaaaaggccgtcacagcgtggggcttaccttgcacctgtccgaacatcctcagcgcattcattcagcaatcgcgaactttttcaaaacgcatga

SEQ ID NO: 2853 - DNA, 662 bp, Bacillus licheniformis
gtgatgactatgttccggcgtttcttgatgacagttttgtttgtccttgcttttatgacgaccttctttgccgtttcaggcgtggaggcacaggatatatccagctgggcaaaagaacgcgatctgtccttgaaacagctgatgctcacctttaaatcacttcccgaagaaaaagcggaaaagacgtctctgtctgccgcagaacaaattaaaaacaaaccgaaatcgcttgaagacgcgtttgactggagcaagtatccgaagcaaaaagtcaccgcgaccggatatacagcaggggctgaatcaacgggaaaacagcctcatcatcccgattacgggattacatattcgggagtcaaagtaaaaagagatttatattcaaccgttgcagccgacccgtcggtctttccgatcggcaccatattgttcatcccggactacggctatggggttgttgcggataccggatcagccattaagggaaaccggctcgatttgtactatgagacggttgaggatgtttataaagaatggggcaaaaaaacacttgatgtttatgtcattaaaaaaggaaacggcaccattaccgaagaggatctcctgaagctgaatgaaaataaatcgatgcaagtattcagacaaaaatataaaatggcgaaaga

SEQ ID NO: 2854 - DNA, 696 bp, Bacillus licheniformis
ttgaagtaatccttcgatcgattcttgcctttggtattttattggtaggatcaagattgttgggaaaacaaacaatttcacaaatgaatatctttgattttattgcatcaattacattaggcgctattactgcaaatctggcttttaatacctctcttaaaattcatcacatggtactggctttttttatatttgtttttgtgatcttagccactgcgtatatatccctttggagtcaaaaaggccgcaaattttttgccggtgatccaactgttgtgattcaaaatggaaaagttcttgaacacaacatgcgaaaaatgcgttatacaattgattatttgaatcaacaacttagagaaaagaatgtattcaaaatcgaagaagtactctatgccattgttgaaacaaatgggaccttaacagtattaaaaaaaccacaattccgaaatgtgacaaaaaaggatttgtgggttgccactacgccagaaggaaaactcccgattgaattaatcatggatgggaaaatgaagaatgaaaacttgaaagataatcaactcactcaggcatggttacaatctgagatgaaaaagcgtggtctatccacagatgaagttttttatgcagtattatcacctgatggaaatatctatatagatacatatgaagatcatatacattcttcttttgataaagaat

SEQ ID NO: 2855 - DNA, 771 bp, Bacillus licheniformis
aaagggagataggatgagtcagcatgcacttgtattacaatctgattttggccttgatgacggggcggtaaatgcgatgtacggtgtggcttattcggttgacagttcaattcggatttttgatttgacgcacaacattcccgtttttcacatttgtgaagcttcctatcggctgctgcagtccgtttcttattggcctgaaggcactgtcttcgtgtcggtcgtcgatccaggggtcggctcagaacgccgcagcgtcgcagtcagaacctcttccaatcaatatatcatcacaccagacaacggaacactcacccacatcagccggcaaaatggaattgccgaggcgcgctatcttgatgaagcgcaaaacaggcttccaaaatcaggcgaatcacatacattccatggacgcgacatttacgcctacaccggggcaagactggcagccggcgctctcagcttcgacaggatcggtccggaagtttctatagattccatcgtcaaactgccggtcatggaagcgtacatcgaaaatgattggataaccggaacgatcgatattttagatgtccggtttggaaacctttggacgaatatcagccggacgctcttcaagtcacttgatgttcaatacggagatccagtagaagtcgtcatcaagcatgaagacacaaaagtctatcagcaaacgttggcatttggccggtcgtttgccgatatgcctgtaggcaagccggttgtttatatcaattcattagaccgcttggg

SEQ ID NO: 2856 - DNA, 1143 bp, Bacillus licheniformis
aatgtccaaaaaagaacgagaattgcgccagaccttggcggaaaaacgtacaagaattgaagcactgaccgatgaagggaaaatggacgaagccaaaaaactgcttgctgaggctcaacaaattaaagatcaaattcaaacatatgaggatttacgaaacatgcaggtttcatatgcacaagaagagccgcagcaagatccagaggcaaagaacccgcaacagccaacggatgatatcgccaaaacagatgcgaaaaatcatgctcagctttttgcatctgcccttagaacaggcaaagtaccacagcctcttgccgcgatgaaagaaggtgtggatgaggacggcgggcttattgtaccgcaggatatctccacgaaaataaatgaaaaacgacgtcaatttgatacgttggcaaatctcgtcgatgtcattccggtatcaacaaacaaagggtcaagggttcttgaaaaactagcggatatcaccccgttagtaaatcttgaggaattagcagatattgaagaattagagaaccctaaatttgaaaacataaagtatagcattaaagactatgccgggattttggttctttctaatgatttgcttgcagatacacaagaagcacttttgcagtacctttctaattggcttgccaaaaagtcggccgtgacccgcaatacgttgattcttaatcaattaggaacacttgcaaaaaccacagtatcgaagcaggacgacattaaagacattctcaatgtcaaacttgatccggctattaatgccacgactaaagttgtcacgaaccaatcaggatttaacgtgttagataaactgaaagacgctttcggccgttacctgcttcagccgaaccctactgatccaactaaaaaattattgttcggtaagccggtatccgtcatttctgataagtatttgccaaacggcggtacaaaaacgactccaaaatatccattaatcattggagaccttaaagaagctgtcaaactctttgatcgtcagcaatattccattttaacgacaaatgtcggtggtaaagcattctaccgtaactctacagatatgcgaatcattgaacgtgaggacgttgtactttgggacacggatgctgttgtttacgcgga

SEQ ID NO: 2857 - DNA, 1029 bp, Bacillus licheniformis
gaaaggaacgctctggatcaatgatcaggagatgaagatcaatccattcaaaggaactgaattcggacctgtgctgactgacggttcaatgtctgctcaggttgaggcgcaatttccgtgggggaagctgaaaagcgaaaaaacgccgattgaaggtgaagaaatcgaagtcaatcttgcatcagacaaagggtttatggatgacatgatgaccgctgtcgtcaaccatacaaaggaagcagcaaaggcctttgcaagcggcaatgtcagcggcatgacaatggccgccccgtcttatcaaaaccgcctgaaagaggtcacggacgggctgaaaagcagcagcacctactataaaggcacctacttatctactgtatttgatcttgattcgttccggctatacaaagaagacgggcaatggaaaacagagctcaaagggattgaaaagcacaaatcggcctattatgacgactacattgcgcctaaactgaaagaaaacgatagcggatatacgtacacattggtctattccgaaggcaagaaaaagtggctcatcgaaaaaagcgatcctgaagccgttatcgatatcgagcatcaaaaagaaatcaaaaatgacaatccgaaggaatacacatcggcatgggcctcagcgaaaggggccatgaacaatgcatcagcaggcgaagagctcaccgaccaaaaggttgctttcgccattgaagcgtatttatacaggctacaagacgccatcaacacaaacgatttcggcctcgtccgcgacagcttgaaagaaggaagtccgctgtacaacgatcaaaagaaactggtcgctaaactgtacaacagcgggacagaggaggaagtcgtccaattcagcgtaaacagctggaagcaaaacgggcgggaggcaacgattaagacaacggagaaaattaatattatcaaaggcggaaaagaacagttaaaaacgtatcattggacatatcacgccgccatcgaggacggcagattgctcttaacgtcaataga

SEQ ID NO: 2858 - DNA, 612 bp, Bacillus licheniformis
atgttggagcaattattcagctattttacagaagagaatttaacagagttttttcagagctacagggcttttggtccttttgtagccgtactgctgccgtttattgaagcgctgctcccgtttttgcccctgctcgtgtttgttgttgccaatgtaaattcgttcggtttatggcaggggtttttgttgacgtgggtcggggcatctttaggttctatagcggtttttctttttatccgccatttcggccagcaaaaagcactcggttttatccgcagcagtccatccgtaaaaaaactgatgatctgggtggaaaaacggggcttcggtccgctgtttctcctgctttgctttccattcacgccttcggcgacggtaaatgttgtggcaggactttcgcgagtcagcctgctgcctttttcattggcggtgctttgcggcaagttcgtgatgatttttatggtgagctttgtcggccatgatctgaaggcgctttttacccagcctttgcggacagccgccgtgatcatcgtcatgctgatcttatggtacgccggaaaacgggttgaacatcgtctgaacgtgagattcagccagagagagaaagactag

SEQ ID NO: 2859 - DNA, 1077 bp, Bacillus licheniformis
atgcgaagtaaaaagttttttctgatgatgcttttgatgattgtagcagtcgtgtcaacagcctgcggaggcagcaaaagcgcgagcggagagaaagaagatacgaaaaaagcagataatgcagaagttaaaatcctaagctccgaatatacgcttcctgatgattcatcaacaaacctgcacgaaaatgaacttatactaaagatcaatgtttccgtgaaaaatacagggaaagaaccattaatggttgataaaagccaattcagcctttacgaaggcgactcaaaaatgtcggacgtcagcgtatatgatgaaagaaacaaaaggcttcgctcttcgacgctgaattctgacaaagaagtcgacggaaatatctattacatcgttgaaaaaggcaaaaagtttcagcttgaatacacacctgacatgtacggtgaaaataaagccgatcctgtcaaattcgagatcgacggcggcagcgacgaattactgaaaacggccaaaaaacttgaagatccggcaaaagctttgctagcttacacagacgtaacgattttcggcaaagacaataataactttgataaactggtcgacgaaaacaaacgtgaagtcgttaccgattaccttgaaggcgctcaaaaatctatcgttcgctctttaggatattatgatgaagaagatgtggataaaaagaaattgaataaactgatcagcgccatccaaaacgcctatcaagaaaaatctcaagtcaaagcagttacaaaatcaatttcaggcgatgaagcaactgttgaggcaaccgttacgccaatcgataatacagatgtccaaaagaaagtgaagaaaagactggaagactatgtgaaagacagcggcaaagacttcatgtccagagatgaattgatcaatcctgcgattgacatcatgagtgaagaaatcaaaaaagcagaggcgacttcaagtgagaaaaccgttgaagtcaaacttgaaaaatcaaaaaatgacaaatggaaaattgatgctgataattacaagaccgaacaatacttctcaagcttccttaaaagcaacaactaa

SEQ ID NO: 2860 - DNA, 519 bp, Bacillus licheniformis
atatgatattttaggagtttatatattggggattgtgacagcgttcggcggaggggcgatcagaaacctgctcatcggagttccagtgtccgccttgtgggagcaggggagtctgtttctaatcgctcttgtctcgatcacgatcgtttttttgtttccgaagctcctgttaaagcactggagcatctggggcagcttttcagacgcgatcggtcttgccgcatttgcgatacaaggagccctttatgccgttcacatgaaccatccggtcagcgcagtgatcgttgcggcggtcttaacaggaagcggcggcggaatgatccgggaccttctggccggaagaaagccgcttgtgctgaaaacggagatttacgccgtttgggccgctttgggcggattcattatcggcatgggctgggcggagaagccgctcacgttgtatatcctgtttgctttgctggtcgcgtgccgtgtatgttcgtacatgttcaactggaagctgccgaaccgttcgctgcg

SEQ ID NO: 2861 - DNA, 513 bp, Bacillus licheniformis
ttaaaatatttgaagatgctgctgcgtttaaaacagctattgaacgcaaaaacagtgaagacggtctctcccggattgtctcgacctttgattatttacataaaaaagataaaaagacttacatcgttgatgaagaagggattaacatgccctggaacagcacccaagataaagtgacatgggcggaaaatccgaattctattaaagaagtcggctccatttataccgttcaagggtttgatttaaattacgtcggcgtcgttctcggcccttccgtaagctatgatgaagaaaaagacgaactggtaattgatacttccaaatacaaagatacaggggcattcgtgttacgtacagatttgtctccagaacagaatgaacaaattaaagaacaaatcatcctaaattcaataaatgtcctgatgaagcggggcatacaaggcctctatatttatgcgacagatcctaaattaaaaaagagactactcgagttagaaaggggaaaatggtcat

SEQ ID NO: 2862 - DNA, 1101 bp, Bacillus licheniformis
atgaacaagatcgccgcggaagaagtcgccaacatccttaatacatggtaccgcgccatcagaagaaatgatgctgaacagtcgatccgaatatttgaagaagtcaaaccgatgctggcagagatggaggaagaccaagaggttttaatctactattctctgctggaactgcggcataaaatcatgctgtatgatacgcggggaaaaaagatagaacagcaagaggagttaacgaacggcggcagtgctgcatcacatatgacatcctattactactacctgttttcaggagcttatgaagtgtataaaaagaattatgagcaggcgatcagcttctataaaattgccgagaagaagcttgctcatgtacatgatgaaattgaggtggcgcaatttcacgataaagtcggaaagctctactattacttgggccagaatatcgtctctttaaaccatacccggcaggcgatggaaattttcaaggggcatggcgaccatgatatgaaccttgtttccacttatattacgatggccggaaattatacagagatggggaaatatacagaggcggaagaatatttaacagaagccatccatacggtaagaaaagccggcgactgttttaaagaaatgcagctccttcataattttgccttgctttatgcggcgatggacaattcggaaaaaagcattcagtttttagaaatcgttttggatgatcaagcatatgctgcatcagattattatttcaatgctgtgtttttaatgatcaaagagctgtttaaagtcggagaccataaacgcgctgcagccttttacaaagaagggaaggaaaggtcgaaatccgcggcgaataaaatatttgacgccaaaatcgatattttatatgcggcttatgcaggagatggtgaacaggcggttaaagactgcaaagacaacattgaaatcctgtttcaaacaaagcaatacgacagcgccagagaactttcgctcttaacggccaatgtttacagatcaaagtcactttataaagaagccgcacatttctttttggaagcgattaaagcggaagaaaaaatgaaaaaagtggagggaatgtga

SEQ ID NO: 2863 - DNA, 978 bp, Bacillus licheniformis
atggtagaccgcggacttttatataaagaatggaaacagcatttctggatttttttagttgtttttgcagcggtgttgctgagtgaaccgcttgcgattttgaatgattatttccagtaccagggatgccttgcagaacagaaaaaatttcccgatatagagtgcgttttatataaagattatggggtaagcggggccatgagaatgttctgggttggcggagtcgcgcttgcgatcagccagatcgggtttgaacggagcagaggaacgcttgactttacactcggcctcccttacaagcgcggcgtcattttcaatactaaatatttcttcggcatttcaattcttttaacagcccagctattatcttacttgttatcttacgctttgattattttgtataacgttgacgttgtctttttccatgagtattttatcggggcggttatcttctgctttatggtctactcgcttgtcatggcggcgggcgcgatgaccggcaatccgctggcccagatgatcgttgctttttcagcgtcgattctgccgtatttgctgatcggccttccgctggccaacttacgaatcatcctgggtttctttgggcatgaccctgctttcttttatggtgaaacagaactactagattatataacgccgatcatatacctcaacagtttcggcattcaagacggcagcctggcctttacgcttattccgctcgccatggggatcttgttttatataatcggctatttctgctttatcaaacagcagcttgaacggaacggacattttttcctttggagaaaaatggatcgtccgatccagattctcgtgattttattcggcatctggggattcggcacagccgctgcttcgagtctgttcagctatatattcggtatgttgatcggttcggcagtcggatttttaatcagttacttcttgattttcaaaaaaataaaacagctgtaa

SEQ ID NO: 2864 - DNA, 459 bp, Bacillus licheniformis
aagctggtaaaggacttcttgaaggtacgttgcaggctggcacttctgccgtttctgataagttgcttgatttggttggacttggtggcaagtctgccgctgataaaggaaaggatactcgtgattatcttgctgctgcatttcctgagcttaatgcttgggagcgtgctggtgctgatgcttcctctgctggtatggttgacgccggatttgagaatcaaaaagagcttactaaaatgcaactggacaatcagaaagagattgccgagatgcaaaatgagactcaaaaagagattgctggcattcagtcggcgacttcacgccagaatacgaaagaccaggtatatgcacaaaatgagatgcttgcttatcaacagaaggagtctacggctcgcgttgcgtctattatggaaaacaccaatctttccaagcaacagcaggtttccgagattatgcgcc

SEQ ID NO: 2865 - DNA, 602 bp, Bacillus licheniformis
atggaacaaaacgtctccatgggaagggtgctgagcttttgtgaatgggtgctgaagtttttttacgccaatctgctgtggtttgtttttactatgctcggccttggcgtcttcgggtttatgccggcgacgactgcattgttttcagtgacgagaaaatggatcatgggcaaaaccgatattccgatattcaaaacgttctggcaggcgtaccgcggcgagttttttcgttccaacgccatcggtctcattctggcggcggccggcatcatcatttatgtagatcttgcttttatttatccggatcatctcctattgcacgttctccggttcgtcattatggtttttggatttttgtttttgatcatgctgttttatatgttcccgctgctcgcccatttcgattggaagaagcgaatgtatttcaagttttcgctgattctgggcatatcgtatttgcagtatacattaacgatgatggcggtcactgcaatgctttatatcgcttttgcgtttctgcccgggatcgttccttttttcagtgccagtctgcttagttatgcggttatgtggctggcatatcaagtgttgaaaaaagcgga

SEQ ID NO: 2866 - DNA, 547 bp, Bacillus licheniformis
atgcttctgctgcttttgatcattaatttcttcggtacggtttacgggtattattggtaccttccgcagctgacgaatacgccagcgaagtttctgatcttcgttcccgacagcccgacggcgaccttgttctttttattcgttctcatcggacttttattgggaaggaatgctccgctttttgaggcgcttgcgcttgttacgcttgtcaaatacgggctgtgggcggttgtaatgaatgttctcgtgcttgtggtgaccggaagccttcattggacggggtatatgctgatcgcgtcgcacttcgcaatggctgtgcaaggcgtgctgtacgccccgcatttccggttcaaagggtggcatttggcgcttgcggctgtttggacgatgcataacgatgccattgattacttgtttggaatgatgccgaattattctatgctcgatcaatatatgccgcagatcggctattttacattttggctcagcatcgcttcgatcggtttggcctactaccttgtcttgtcccgaaaagcttttaagctgt

SEQ ID NO: 2867 - DNA, 757 bp, Bacillus licheniformis
ttggagactatcccgtcttcagaagttggaatcaaaataaaccgctggtacaacgaaattcaaaaattaaacgtaatagaagcagaacgattaaaggcggaagttcacttagctatagaaagaatggaagaagatcaggacttgctttcctattatcagcttatgaattttagacatgagttaatgttggaatatcttttcccggcagaaaaaaagctgagcaaatctgattatcttagggaaattgagggacagggaagaaaattgtcaggcttgctcgaatactatttttcctttttcaccggaatgtatcatttttctcgcggaaaatacataaaggcaatcaaggcatatagagcagcagaaaaaaagttgacgaaagtttcagataaaatagaaaaggctgaattctattataagatggcggaagtgttttatcatatgaaacagactcatatgtcaatgtattatgtgtctctcgcttatgatatttataaatcctatgatgcatatgtgattcgaagaattaattgtctattcgttgttgctgggaattacattgatttatcaacccatgatcaagctttaccgcatcttttaagcgctaaggaatccgcggaagacattcaaaacaaggcgatcgttgcaaaggctcttttaaatgtagcatattgttataatgcaatggagagaccaacaaaagctattgaatactctcataaggcgattgatgtagcaaaggatataaaaggcagcg

SEQ ID NO: 2868 - DNA, 1349 bp, Bacillus licheniformis
atggcaaaactgacggcacgttttgaacttgaagaccgggtgtctaagaagctgcggaggattcagaagggttttgcgattttagaaaagagagcagaacgattgaaccggcaaatcaaaattaacattaaaacggatgatcaagctcttgctcagcttaaaacactgaacacttacctgatgagaaagttcattcactccgtaaatattgcagtgcatataaatgaccaggcatccgctcaagtaatagaaatacaaagaagattaaaaagaattccgccagaaacaaccgttaagttaactttagcagacaatgtctcgcaaaagttaactaaaattaaaaggatgctctctaagcgtgaatatttcttatcaatctctgctgaagaccgtgtaacattaactgttaaaaaaataatcggctatcttaaaaacaatttgaaaaaaggttattcagttcagttatatgtacttgataaagtaacgaaaacagcaagcagaattgcctcgctcctaaaaaaactagagaaaacgtacattgtcacaattgatttaaacgacaaggcgaccaacaaaatcaaaaacaaaaaagtttcaggagaaacatcagaagtcaaacacgataaaaagggatctttctttgaacaaggaaaagacttgttaggcgaatggtggaaaaagtcaggatggccttggataaaggatactgggaaggaaattggcaaagcatttgtagatcgatttaaagatagactgatggaaaaattgaacaatgatatttttgacaaagtcattgataaaatcttagggcctcagtcaacaaaaggttctcagtcaaaatcaagcggaccaggccatggacaatgctgctgctgtttatatccgcagaaagatcctccgaattcagccggaaataggcaaaatgtctctgtttcaggttcaagtgaagagcataaaggctggaatctaaaaagcttatcaaggggaattcttccagccgcaaagatactcttctatttaaaaagtttaaggcccaacaaagagcccggtaaacttgcaaaattattagagcccttaaaaccaatgattgaaaaattaaagccgctaggtaaaaaactaagtccgctaggcaaacttttgccgcttacagatctaatcggcatcaacaaagataacgcaggcgaaaaaattggttctgtaggcggccgtatgttaggaacttttggtggagaagctgccggaatggcgatcggaggattggttggaggacctccgggtgcaatgattggaggagtagtgggcggctttgcaggcgggatgggcggtgaaaaggcaggcggttccctcgg

SEQ ID NO: 2869 - DNA, 662 bp, Bacillus licheniformis
  misc_feature (1)...(662): n = A,T,C or G
ttgaagaaaaataatcgtttcatcagtttgagcatcttgatgctcattttcggcattatgctgtccgtgcagttcaattcgctgaaggcgccgaaggtccgcgatacgcgggacatttgggacctcagggaggacttgaaggaagaacagaaaaaacagcttgatctgatcagcgaaattgacaagtatgaaaaaatgctgaacacatacagtcatcaagaagaaacctcgcggacaaaagcgttgaatgaaacgcttcaaaacttaaaaaaacaggccggcttcacagatgtcacagggaacggaatcatcatcaccatttctcagctcttctcggaagaattgacaggggaatcgattcaaaatccccctcccgaccttctgaaaaagctgattaatgaactgaatatgtatgaagcggaagaaatatccatcaacgacagaagggttgtcaacacgacggtgatccgcgatatcaacggaacaaccaaaatagacggttatcctttggacaactatccgataacggtaaaagtcatcggcaaaaacgccgataaactatatagccgaatgaatgcttcatccctgcaggatctgttcgcgggagaaaatctggatttgcaaatcaaaaggcctngaaaacaatcaaaatcaaagcttac

SEQ ID NO: 2870 - DNA, 1491 bp, Bacillus licheniformis
atggagccgttaccgggattttcggtagtacgaacagatggtagcgacgggcagagatcaataaaattaaacggctataaaacaactaataaccagtacggctaccagtttgtaaaaaacgaaaatacagttgtctacgatgacgaagagtacatcatcaaaacacatcgcgaaagaacgtaccggaaaggcgtcggagttgaggcaacggccattcatcgcatctttgacgacttgaggaacaattacatttacgatgagaagacgggcacgctccgattggatgcgatgctctcttttgcattggagggaagcggctacacattcgaaattgatacgacggatttaccagcgtcagtcagagttgaaaattttggatggaataactctctcgctcttttccgagacattctcgaaaagttcggtgcagagttcgactacaaaggtaagaaaatctatgtcgctaaaaaattcggcatccaaagagacgaaccttttctgcgttataggttcaacgtaaaggatccggaaaaagaaattgatacaagcagtttcgcaacgtatattcgaggttacggaaagaaagacgataaaggaaactatttgtttgccgagtacacaagtcctttagccaaaatatacggtattaagcacgctgacccggttaaagatgagcggtacacagacaaagatagtcttctcgcagcaatgaaaaagcaactcaacgataacatcgatatttctcttacctttacagccattgaacttgaaagtatggggctcagggatattaaaaagggtgattatgtttggtgtgtgattgaaccatttgacttaaatgttcaattacgagctgtaagcagagaagattactcggatgaaaccaagtcacctacgtttacttttgggactattacgaaaaaagcttcggatattatcgcgagctttaatacgacaaaaaaagcggttgacaaggttatcgacacgtctaccggaaaaataaaagactctgcaattgacacgacgggcctcacaacgaaatccgagtttcagtcgcacgtagataacaagatagtgcacataacagcggaggaaagagctgcttggaatgcggcttcaaattcaatcggtgatttaacttttatcacctggagcacgccaactcttaaaaatggttggattcagtatacggcgaataccgaaagctatccgattcaatacggaaaggatgcgatagggacggtcaatatcagaggagctgtttcgtcaggggtagtcggatcttcaactccagtctttactttgcccgctggttttagaccgccgtttcctcacctttttatcggtgtttcatctgtcgcaacagacggtacgcctcaatattttcgtgggattataaagacgaacggagatgtttgcattgagaatatctcaaacaaagatactcccaatcagtttatcggtatctatacgcaatttaaagcgatttaa

SEQ ID NO: 2871 - DNA, 659 bp, Bacillus licheniformis
ttggcgatctataaacagttttacgtcgataacggcacttcttatcagcaggtggacatccgcaattacagcaaaaaagatattcccggtttgattgctctccaaagagaatgctttccgcctccgtttccggaagaccttctgtggaatgaagagcagctccattcccatattgaacgatttcccgatggagcgctttgcgcagtttccgaaggccgcatcatcggttcgatgacagcgctcatggctgattttgatccgcatcatccgcaccacagctgggatgaagtgacggacaacgggtatatcggcacacatcaaaacgatggaaactccctttatgtcgtcgatatttccgtgtcccccgactatcgaaaactcggcatcggaatgcggctgatgcaatccatgtatgaactgacggtctttaaagggctcaagcgtctcattggcggcggacggattccccattatcacaagtcggctgaagaaatgacgcccgaacagtatgttcaagctgtattggacggggaaaagcgcgatccagtgctctcgttcctgcttcattgcggacgctctccagtttgtgtgattcccggctacattgaagatgaggaatcgcttgattatgcggtgttaatggagtggaaaaatccttt

SEQ ID NO: 2872 - DNA, 582 bp, Bacillus licheniformis
ccacgaaggacaggatcatcgaatctgccgtggaactgttcaaccaaaaaggtttttcaggaacatcagtccgcgaaattgcccgagcagccaatgtcaatgtcgcccacatctcctattattttaatggaaaaggcgggttaatggagcatttagtatcccgtttttatgaaggctatttaagaatccttgaaaagggccatgaacgccttcaggatgcaggtgcaacggattgccttcttcaattggtttttgatattctatcgtatcagcatgaacatcgtcaattaactcggtttgtctatcgcgaagtcacgattgattccacactgaatcgtgaagtgatgtcgacatatttaacgaaagaaaagtacattctccatctgatcattgaaaagggaaatgaggacaacgaattttcccgttttcccctttcccattttatgattcagctgaagtcgcttttaatgatgccttatctgcagcctcaatatatttcagaagtgctttatgtacagccgcacgagccgtacttttatcaggcgtattacaaggaagtcaaaacatggcttctcagtctgt

SEQ ID NO: 2873 - DNA, 693 bp, Bacillus licheniformis
aaaaaccgcagctgatgatcaaagatgcggccgtcaatgaatggcagctgtttgatctgcggggaaaacggtcatgggaagaaaaaatattgaagctggaccctgcgaaacgggcgtgcatctgcttccgcgaggaaacaaaagcaaagctggcagggacaggccttgaagaagagctgaccgtcatcagcggccctgaagatgcagagcggctcgaccttgagagccgttatgcggtatttatagatattccgcagtcgctcgacatctttgatcatgtaataaacggcaaaaagctggagcgcatttatctgattttttatcaatcagacgaacattttttctcaacattcccaacaagggaatattttaaatggtactatgctttcctcctgaaaagaggttcttttgacttgccgaaatacggcggagagcttgccagacataaaggctggacaaaagacacaattgattttatgacaaaggtgttttttgagctcggttttgttacaatagagaatggtgttttatctgttgtttatcatgccgaaaagcgcgatttaacagattctgaaacctaccgggaaaaacagcgcctgattgaattggagcaaaagctcatttattcttcggcggatgagcttaaacagtggctggataagcggatggcggaaaaagccggcgcttataaag

SEQ ID NO: 2874 - DNA, 753 bp, Bacillus licheniformis
atgatcgatattcattgccacattcttgcgggcgttgatgatggagcagcatgtatgaatgacagtttagaaatggctaaacaagccgccctccaggggattcatacgattatcgccacaccgcaccaccgaaacggtgtatacgaacatccaaaagaagccatccttgcagctgtttcgggtttaaagacgagaatgcaaaaggaaaacatcccggttctcattacccccgggcaggaaatccgcctgtacggcgaattgaagcgcgatcttgagcgcggcagactgctcagcctcgccggcacaaagtatttgctgattgaacttccttaccaccatgtcccgcgttatgccgaaaaggtgctgttcgatctccaattaaatggttacattccgatcatcgcacaccccgagcggaaccttgaattgatggagaatcccgatctgctgtaccgcctcgtcaaaaacggcgcctgcgcccagctgacatgttcaagtcttgcaggccgtttcggcagaagcgtcaaacggctcgcccgccgctttcttgaagcgaacctcatccactttatcgcatcagacgcccacaacctcacgacccgatctttcttttttgatacagtagaaaacgattacggccgcgatttcttgaacgtgtttacagaaaacgcgggcctgctcctggaaaaccgggagattcataaagaaacaccgcgtcccgtcaaaaagaaaaagctgttgggcctgctgtga

SEQ ID NO: 2875 - DNA, 741 bp, Bacillus licheniformis
ttttgaggatatccctttcttgcagtacctcggcgatgccgttgatattctccttgtttggtacgtaatatataaattaatgatggtcatccgcgggacaaaggcggttcagcttttaaagggaatcgtggtcattgttctcgtcaggctggccagtcaatatttaggattaagcaccctgcagtggttggttgaccaggcgatcacatgggggttcctggcgattattatcattttccagcctgaattgaggagagcgctggaacagctggggcgggggcgctttttttcgaggagcggaacacctgaggaagagcagcagcagaaaacgattgatgcgattacaaaagcgattaaatatatggcgaaacgccggattggcgcgcttctgacaattgaacgggagacgggaatgggcgattacatagaaacggggatccctttgaatgcaaaggtcagctctgagctattgatcaacatctttattccgaacactccgcttcatgacggagccgtgattatgaaaaacgatgaggttgctgcagctgcctgctaccttccgctttctgaaagcccttttatttcaaaagagcttggaacgaggcacagagcagcagtgggaatcagtgaagtgaccgacagtctgacggttgttgtatccgaagagacgggcggcatcagcgtcgccaaaaacggagaccttcaccgtgatttatcggaagaggcattgaaaaatatgct

SEQ ID NO: 2876 - DNA, 568 bp, Bacillus licheniformis
atgtggaagaagcgcacggctgtggcggagcacgtatacatagcggacacagcgtcatttgtgacagagaaacaggcaaagatcgtaatcgattacgggggcataccgggggatctgcattttggactgacgaaaaaagccggggcaagggagccgatgtataaaagaggaacggagattttcaacaggaggcagatttctatcgtctcggtagaagagtgccttgaaattgccggacggctgaacattccggcggtccttccggaatggctcggggccaatatcgcattaagcggcctgcctgatttaacctcattaagagaaggaagcagaatcgtttttccaagcggcgcctctttgttgagcgagggcgagaatgagccgtgcattcagcccggagaagtcattcaggagcagtttcccgacaaaccgaagcttgcttcgcgctttgtgcgccatgcgatgggaagaaggggaatcgtctgcatcgttgaacgcccgggcctgatccatcaaggcgaccaagcagaagtgtgggcgtattcgcctgctgccatgaaagacgcca

SEQ ID NO: 2877 - DNA, 551 bp, Bacillus licheniformis
gtgatatgtcaagagtgtaaagaaagaccggcaacttttcactttacgaaagttattaatggtgaaaaaaaagaaatgcacatctgtgaacaatgtgcgaaagagaacagcgagtcatattctatgaatgaaagtggcggattttccatccataatttattatccggactgcttaattttgactcgtcttttacaaacagcagcgaggcgcagctttttcaacagccggatcaggttttgcgatgcaaaaaatgcaatatgacgttcccggaatttcgaaaaaccggccggtttggatgttcggaatgttataaaaccttccactcctatatcactccggttttaagaaaagttcacagcgggaacacggtccacgcgggtaaaataccaaagcggatcggcggtaatctgcatgtaagaagacaaattgaagcattaaaaaaagagctgaaagaattaattcagcaggaggaatttgaaaaagcagccaacatcagagatcagatcagatcgcttgaacaaaacctgaatgcaaacaaggaggaggagga

SEQ ID NO: 2878 - DNA, 1458 bp, Bacillus licheniformis
atgaggcgtttacaatcgttagaagccattgaaaaagtaaaaaacggggattatcatgttttgcgggatgccgaatggctgaagtatctcgttttaactgaagagcaaaatatcaacctggagcggatttcttcgctagagaacatgcctcagaatcccgtttttctttatgttgaacagacgctctctattttggagaaagctgacattcctgagctggaaaaagaaatcattgaagaggttctcatatggagtgaagcggctaagtgcggccagcctcataaaagaaaggaatggcgtgaaaaaggttttcagcttgcgatccataatatcgggtcggcgcagatttatgctgatcgaagacaggcgtacatgccggaacggcaggatattgaagaactcatccatattttgattgtgacgcatggactcgtcggacagtatatccgcggggaaacaaggtatcgccaattcactcctcttatcgattggattgaaacatctgaacttcagcacatcgatatcaggcgggttctatacgtgctgaacaaatgtatcattgaagcggtatcgccggcgctttgggattcgatagaacgagacgtgaaccgggtaatcggccaaatctgcacaggagaaagaaataaagactggccgtttgcggaaaggatcagaaaactgcggggacaagcgctcgattccggtgaagacagcagccggtacgagcggtttttgagggagcattcggcggaagatacgctgagacgcttctttcagcggattgatttatggtatgtggaatccgccttgtcatcattcagttttgaagagtttgtcaaaatctttctgctcgtgcttcgttctgtcaaccctttatcagtcaagcacatcagctttgagccgctgatgaaggacatgtaccgtgattaccagggtgtgaggcatataaatgtttataaaaaacgaattatcgaagcgtgcttaaaagagatgtcgatcagcgatttgctttacggcgaggtgcctgtaaatgaacacgtttcgcttgctgttcagccgtttgatcaggcttctgagattgtcggcgtcacgttttcattttcgcaggcaggactgaagctgattgaattttgccaggaagcggagaaatcgcctttatatgaacgggcgatcgtgctgctttatgatttttttgagtttcgcaaggattcgtttgaccggctgcaaaatgaagcggcttatctgtctgatatgaacggtgctgaagattataaaaagaagattgccgattatgccgttggagaaagaatgctcgacatcggagccggaggcggcgtgatgcttgatttgctgacagaccagcatccagaagcagaggtcatcggaatcgacctttccgtcaatgtcattgaggagctccaaaaaaaaaagtgcgcgaacataagccctggcatgtga

SEQ ID NO: 2879 - DNA, 800 bp, Bacillus licheniformis
atgagcgattggtatatcatcataaatccaaaggcgggaaactcgacggccttcagagcatggaaatcattgcagaaagacctccaaaaggcaaatatatcgtaccgctcgtttatgactcagcatcccgggcatgctgaggtgttggcaaggcaaatatcaacgatgcaggatgacaggctgaagcgtcttctggtgatcggcggggatggaaccgtccatgaagtgctcaatggtttagtcagcttgcgggacattcagctgagcgtcatcccgtcaggcataagcaatgattttaaacgcggctttggcgtgaaaaaatcgaatgtcatcaaagaaatgaagcgaaaagggcaatcgctgacccggacctatgccctcggaagctttcatacgaaagacagtgaaaacgaactttattttgcgaatcatctcagcctcggatttgatgcatgcaccgccaagaagatgtcagctttgccgaaatggacggctgctctcaggctgaatcatttgattcatccgctgattttctttgtcacggcgtttacgtttaaaccgtttgttctttcgtatgaaaacggggatgacaagcgtacgtttaaaaaaatctggtttgcgtcggtttcaaatcatccttactatggcggaggaatgaagattgcaccgaatgcgaatccgcgggatgagcttttagacgtgatcattattgaagacctgcccgtcttgaaaaaagccggcctcttgtttgcgatgatattcggcaaacacgtcggcaaatacgggtgacggcatttcag

SEQ ID NO: 2880 - DNA, 476 bp, Bacillus licheniformis
atgggccgtaaatggaacaatataaaagagaagaaagcgtccaaggatgcgaatacgagccgaatctacgcgaagttcggccgcgaaatctatgtggcggcaaagcagggagagcccgatcccgaactgaaccagaacctgaaattcgtgcttgagcgcgccaaaacatacaatgtcccgaaagcgattattgagcgggcgatcgaaaaagcgaagggcggctctgaggaaaattacgacgagctgcgctatgaaggcttcggtccgaacggagcgatggtgatcgttgacgcgttgacaaacaacgtcaaccgcacggctgccgatgtgcgctccacatttggcaaaaacggcggaaacatgggagtgagcggatctgtcgcttacatgtttgatccgacggccgtcatcggctttgaaggcaaaacggctgatgaaacgctcgaattattgatggaagcggatatcgatgtccg

SEQ ID NO: 2881 - DNA, 744 bp, Bacillus licheniformis
atgaagacaaaacaaacggttaatgcccttatttttattgtggttttatttttaattgttcatgtctttcaatcgcttgaagcagcgggcaatacgccgcttgaacagctggcggaaggtttgagccgccatgatgtcgagcttgaagagtggaccatgcatacaaaaaaacagcttaccctaagtgaaaaagatttttttgcaaaactgaaacatttcaagaaacagcatcgacaatatgaatggactttaacgcgggaagacgacgatacagttaaagcgacaggtgtttttcaggacaaaaaaaatcatatcaattccaaaatacatttggtatccacccacaaaaaccagagacttgtttcgtatttattgtatgagcaaaaaggcgcgggaccacgggaaaactggaatgctacatataagcagtttgaacgggatgcattcgacataatgcgagaaaagaccgcaatttttacttgtctaaagggccatttaaatggtatgatgaatgttgttttgcaaaaaaaagcaaatgagctagtacatgaatttgatgcaaagtcagttgaagatttaattgaaccaaatttcgtttctatttctgcttacactaacgagtggaaagaatccatcaagacagaaaaacaccgtatgaatttgcaagtctcgcttagaaatgcgggaatgggcgaaaaacttaccgtcacggttggcacaccaatcgtcacgactgaatattaa

SEQ ID NO: 2882 - DNA, 669 bp, Bacillus licheniformis
aatctcgttttgaaaatcgtgataagcgcaggaaagcgaatcttgtgcttaacattttaataggcatcgtattggtattaatcgttgtcgttgccagcagtctgatgatgaacagtccgaaggagcaggcgcagcaagatgtctcgaaaaacgattctgaacagacgacagaagcgcctgcttccgacaataagaaacaaacatctgatgaagatgtaaaagatgaggacaaaggaaaaagcgattctgccgataaagaagacagcgattccgactcagacaaggataaagaatctgcttcagacgaggacaagtcaacatcagatgatccgtttgaaggagccgaagtgacagaaggcggttcaagcgccaatgttgaaaaaacgatcatcaatcctgactgggagcctgtcggcacacaacagagcggacagcataccgcaacatatgattcctcttcacaagactggaaggaaatgcttgaagccatttcatatgcgacaggggtttctaaggataacatgacggtgatctggctcggaaacaacggcagcccgcaagatgcgaaaggaaccattcgggcgaaggacactggcgtcaaataccaggtagccattacttgggttgacggaaaaggctggaagccgacaaaagttgaacaattgaaat

SEQ ID NO: 2883 - DNA, 1443 bp, Bacillus licheniformis
atgaataataaatacttaatttattcaaaaattcttttaaccaacgacattcgaaaatttaatactaaaagcaaatggcttgcattattcgtattgatattgtcattcgttgttttccctttaataattggcagctttgctgggtacatcattaaaaatctagtcatcattcatctttctttttttctgtttatccttactgtaaatattgataaaagtattttcagagttatgttttcctccgacaaaaaacaaatggccattctgggaatcaaattggatcaatttatattaggaaaagatattagtaaattttatagttcatttttatctttaatatctttttatgttggttcatcgattgtatattatctcattcatcagtctttggaagaagtcttcgcgattgctgtgattggtttattgtccgctatactaggatatttgcttagacttcattttataaggctattagtattgcctaaattcataaatgtctcaagcattattggctttttcacaaatggaattttaattctttggatcttttttatactcaaatataatttgttatttctaaacatcaataatatgcgaattttttcaatatctataccaataatggtatctttaacaatcctgttaattatagtgtggtataaaagtttaagaaacctttccatttttaatgatcatttaaatagcaagactgatacaaatttgaagaagtctagagagagcagaagccttctatattacgagctgatccttctatataggaacccgcctgtaaggtggtcggttttattatttattttaagtttatcagcaggtttactaacaatcattttgtatggttttaacactgatcgatttgcagacactggaatttccaacgaattcagctttatgttcagcgtgctgttcccgttagtctttatctctatcatgattcaatcattggtttcttttgatattgatggtcttattatacctttgaatcagcacaagccaaactttattaaaaacaaaataaaagcaaaaaccaaaatctctgtcttagcacatgtgttatttgttttaatctatgctgcgatttcaaatttttatataaaaccggatcattttattgcattatccattatcttattgatgatagctgttactttggggttaagctgtctcacttcaactatattgtttccatattttaaatgggattacatttatcaagttcccagtactttaagcaaaatctttcttaatttagtatttggattactaatagggttagccattgtttcaacttacaacaaagttttgtatgttgttatttttatcactttgttatgtatcataacgctactgcactccataaacaagcaaatatggaaatcaacaatcaacaaaaattacatatcaataaaatctttattcgagtga

SEQ ID NO: 2884 - DNA, 650 bp, Bacillus licheniformis
atgaaccgaaagaaagcaatgctgatttacaacgggaatgcagggcaaaaaaatgttgaaaaaacactcggtgctgccgtaccgattctttcacaagctatagacgaactcatcgtgaaaccgacgagaaaaaagcgcgatgcgttcgaattttgcctggagatcggggaggatatcgggcagttgtttatcttaggcggtgacgggacggtgcatgaatgcattaacgggattagccagcttcaaaccaagccagatatcggcatcctccctggcggtacatgcaacgacttttcgagggcgctccgcattccccagaacatagagaaagcggcggaagcgctcgccaatggaagtcccgtcccggtcgatgttttaaaagcgaatgatcattattgtctcaacttttggggcatcggattgatcacggaagcttccagccatatcaatcaaacggaaaaagcgctgctcgggagaatcagttattttacaagcgcactgcggacaatctccaatcttgagcccttctcttttcgtctgtcgatcgacggagaagagtttgctgacgaagcggtcatggtcgtcgtgctgaacggcccctttatcggaacgaacaagatcccccttccgcagctgagcatcaacgacgg

SEQ ID NO: 2885 - DNA, 1438 bp, Bacillus licheniformis
atgaaaaaaaagcatgcggtccaaaaaaatttagcgaaaaatgttgaatatttaaatgaaaagcttggtgtcgacaaaagcttcgacatgatccggcttgatgtcgtttatgctgatagagacatgtcgctttatcttgtcgacggctttgtaaaagatgatattatgcatcatttgcttaaaaatctctcaaggctcacacctgaaaatctggaagacgatccgcttgaaaagctgatcaaaacgcatatcccatacatcgaaattgatacggaagatgacctcgacaaagcagccgaccaggtgctgtccgggccggctgtcctccttgctgacggagttgaccatgcgattattatcgatgcgcggacgtatccggcaagaaatccggaggaacccgacaatgaacgcgttgtcaggggttcaagagacggcttcgtcgaaacgatcgtgtttaacaccgcactgacgagacgaagaatccgcgaccgttccctcagaatggagttcctgcaggtcggcagaagaaagcaaacggatgtcgtcatctgttatttggaagatatcgccgacttggaaagtgtaaaaaagctgaaacaatcgcttgaagcgatcgacacggatgctttgacaatggcggaaaagccgctggaagaatacatcgccggccgtcatggaacccttatccgacggtccgctatacagaaagacctgattactgcggccgttcatttgtacgaagggcacattctcgtctttgtggacggctcgccaagcgcgctgattacccctgttactttttggcaccatctgcagcatgccgaagagtacagaaacaaacctcttgcgggtgcttatttgcgaatagtccgttttatatctgtcttggcatcgatctttttgctgccgctgtggtttctgctttccgtccatcccgatcttttgccggacgcccttgaatatatagggcctgaaaaaaaaggagcccttccgctgcttgcgcaattcatcattattgaaatcggcgtcgacatgatgcggatggctgcaatccacaccccgtcgtctcttgctacggctctcggactcgtagctgctttaatgatcggcgaagtggcggtgcaggtcgggcttttctcgcatgaagtcgtcttgtatctcgctgtcgcagccatcggcacgtttgctacgccgagctatgagctgagcatagcgaacaggcttgcaagaatcgttctcctgatcgccgcaggtgcattcggaccgatcggctttgtcattgcgatattctgctgggtgatttatctcgtcagaatgaagtcgtttcatgtgccgtatttatggccgtttattccttttgactacagagccttccgcgatatcgcaattcgcacgccgatgccgctgaaaaacagaagacccgtatttgtgcaccaag

SEQ ID NO: 2886 - DNA, 494 bp, Bacillus licheniformis
gtgacaaaggaagatgtaattgaatactacgagaaagcgggcattgtgctgaacgacgatgataaagaaaacatccaaatcatggactacggattaaataagctggataagctggggcttcagctgttcgtctatgtcaacacagaccgctactgcgccaaagagctcgtattattccctgaacaaacatgccccgaacaccggcatcctcctgtagacaagcagaaagggaaggaagagacattcaggtgcagatacggaaaagtgtatttgtatgtagaaggagaaaaaacggaagccccggccgttatgccgccggacgaggatattgaacatttcaccgtttggcacgaaattcagctcacgcccggcgaacagtttacgattccgccggacacgaagcattggttcaaagcggggagtgaaggtgcggtggtcacggagttttcttcaacaagcaccgatgatcacgatgtgttcacagatccgagaat

SEQ ID NO: 2887 - DNA, 548 bp, Bacillus licheniformis
atgttcaagaccgcaatgctatcgataagctgttttctgtttctatctgtaacagcttgtgctcccacggaccaagcagctgagatggactatgatcaaaccaaaaaaatggttgtcgatatattaaagacagatgacggaaaaaaagcgattcaagaaatattaaatgatgacaaattaaatgaaacacttgtaatggatgaaaaaactgtcaaagaaaccgttgaaaaaacaatgacctccaaaaaaggagctgaattttggaaaaaagtctttgaagatccaaaattcgctgaaggctttgccaaaacacttcaaaatgaacatgaaaaagtgctgaaaaaactgatgaaagatcctgagtaccaaaaaatgctgatgcaggtcatgcaggatcctgaaatggccaaaaaatacggtgaacttgtcagaagccaggaattccgaagccacctgcaggaagtcatatctgacactctgacaagccctctttacagaaagcagtttgaagaggaactgaaaaaagctgctgctgaaagcatgaaaga

SEQ ID NO: 2888 - DNA, 1434 bp, Bacillus licheniformis
atgatgctgaaaatgtggcagaaggaaatgggcaagctctttaataccggtacaaaaaaagcgatcgccgtgctttttttgcttttggcggtaacgatgggaagcatcatcggctacagttttacaggcatgtttttaagcgcgtttctgaacggcgaagttcgttctctcggattgttcgtgatttccatgtttatgaacgcgtcgatttttacatttgttttcttcattttatttaaagtaaggacgccagagcagcacagcttttccatgcagctcagctggtttccgctgacggccttccagagaagcctcggatatttcatcccgtttgccggagcggtttcatttcttgtcctgtttatgattttcattctgctgattccgaactttgtcgccagcggtgttgggttttggtttgcttttgcgttttttgcacttctttttgtacagatcatctttttcttttcgcttctcaatcttgtctataacttggtgtatatgttgattttaaaattcggctttccgctgcaaaagtttttttcaatgtttgtccttgtcgtgttagccgtgttttacggaatcacatcattcgatcttggaaacattcagaacgcttattcgtcttttgattatcatttgacatattttgcagcgccgctgtttctcatgctgaacggtcaggcgtcggatgccggcgtcattccgattgtgctgatcttgacagcagcagtcacggcctcttttatgtcgctgaatgttgtgccgatcctcactgaaaaaaaatcatctaaactgttttcatttattaaaatcccgtcatcaaagccgctgtctttggcggtgaaagaaataaagtctcaagcccgaaatgaagaaaatattttaaacttcatttttttgcttttggctctatgctttttgaaatacaagtttcagtttggatttaccggtgagagctatttggttctgggaggcgtgacaggtatcatcgccttcaattcatttggcaacgatctgcggatgatgcagatgtataaggcgcttcatttaaaaacggcaacggtactgtggtcaaaatatctcgggctctgtatgctcggcctcattcagctctttttgttttccgtgctgacgtggactttcccggagagctttccggtctttttaaagacggttgctgtgatcttaaactcgattgcgatgttctatttagcgggcattatttttccgcttgaccgaaacaacccttatatggggatcttctctttcggaatgctcctgctctttttgattccgctgtttttcatcgtgaattatgcggttgataacgtcacgggcgaagcgctgctgtttttcataccgtgccttgaattactgctgatcctgcttttatacggagggtttaaatggaggtaccattatgatcattaa

SEQ ID NO: 2889 - DNA, 444 bp, Bacillus licheniformis
atggcattaaaagcgcaaaacacgatttccggaaaagaaggccgtctttttctcgacggacaagagatggctcacatcaaaacatttgaggccaatgtcgaaaagaataaagctgaagtcaatattatgggccgccgcatgaccggccacaagacaacaggggcaaacggcacgggaacggcgacattttataaagtcacgtctcaatttgtcacgttaatgatgaactatgtgaaaaaaggcgatgatccgtatttcacgctccaggccgtccttgacgaccagtcatcaggccgcggaacggagcgggtcacgctgtatgacgtgaattttgactcggccaaaatcgccggtcttgacgtcgactcagaggcgctcgaagaagaagtgccgttcacatttgaagatttcgacgttcctgaaaaactgaaagatacgttttaa

SEQ ID NO: 2890 - DNA, 1062 bp, Bacillus licheniformis
gcatcaccacttcgcaaacagcagttctcatcaccaatttcctgcttgggacagggattctgacgctcccgcgaacgtctgttgacgaggtggggacgcctgatgtctggatcacgcttgtattaggcggcttggtcgctctgacggccgcagtcatcatggtaaagctcaaccatcaatatcctgataaaaccttttatgaatacagtcaggacatcattggcaaatgggggggcagcttgatcagcctgtttttcgcatgttacctcttggcccattccggttttcaggtccgctcaatgcttgaaatcatccgcttttttctactggaaggaaccccccgctgggcagttgcgatggtttttttgtgggttggcttatatttgatcgtcggcggcttaagttcgatcgcccgcttgtttcaaatcgtgttacccattacattcattctttttctgctggtcgtgttcatgagtatcggaatttttgatgtggacaacttgcgtcctgtactgggagagggaataggtcctgtcttaaaaggaataaaggtgaccgcactgtcgttttcaggtattgaaatcattttgatcctgatgcctttcatgaatcagcctcgcaaggccattcatacgatcatgatcgggatcgccatccctttgcttttctatatgatcacagttgttatggtgatcggcgctctgtctatagacggagtggtttcacggacatggccgacgattgacttaatgagaagctttgaaataccaggtctgatatttgaacggtttgagtctttgctgctggtcatctggatcatgcagctgttctgtacctttgcgattgctttttatggttcggcattaggcctggcccagctctttaaaacaaatattcggccgatgatgtttgttttgcttccggtcatttatctgattgcaatgatcccgaaaaacatcaacgccatgtttgcatttggtgactttattggaaacagcggcgtttatttaggcggtttgaccccgctcgtgctgctggtgatttcaaaaataagaaggagaa

SEQ ID NO: 2891 - DNA, 1431 bp, Bacillus licheniformis
atggcttatcataatagagaaaaagaaatcacgaacattctcaaaaaccatgaaagaaaagcgaaccagctgctgcggttagcccaatccagccgtctgcttgatacttttaataaaatatgggtttcgatagaaaataaagaacttccgaaatttgtatcaaaaaacgtaatggattttaatgtggcggatatcaaatcggaaatcaacgattggataaaggatttaaaagagtgccaggagaatgccaggcgcaaatttgagtctatggaagaccccacaccggaagacttaagaaaacgcaacaatatttcgagtgacgctgttcttttaattagccaatacgagaatctaaaaaatggcattgatcaggtggaacaagatttcagcaatgtcgcccgcacccaccgcgccccgatgcgcgaagctttgacagacctctcaatcttgtataattcagttaaccatgtaaaaggcgatttttcggattataagaatgtttctgtttatgtgcatgggattgaggatagtgggaatggtttctataaaagtgtaaaggatgctgcgaaaaagggcgaccttatcgttcgtattacaacaaatgaaaaaaacgaatatgtttatgaatactattatattgacaaatatggaaaaatgtatataaaggaaacttatgaagaaataaaaggtcttgaatacttcgacactaacggccgtctccatattgtttatgacacaaatgaacccaatgagcatcggcaagcaacaagtgacgatttagcagaaaagttaaatgagatggggctgatgaatgaggagacaaagatcgatatgttcgggcacagctatggaggaagaagatcgctgcaatttgcgatggattaccctgaccatgtgcgaagcatcacaacaatcggaactccatatgataaaaatctcttagctgccggggcaaatagagcgcgctggcttgcagataatgctgctggaagagatactatgaatacaagtgattatttagattttaatgaagaaaacaaaaacaatgataatggaaaagattacagtaatgcctacactgatatggactgtgaggcgatgactgaagatattaatcatttgaaatctgccaatcctgaggtgtatcaaaagctgcagaagatggacattaccgctgcggcgggatacagaacagaggatactgtaagtttttccccttactataccgcaagcggaaaacataaaataaacagtgatgatatcgtttcggtcgaaagtcaacacggtgacatattaggcgatctcattgataaaaagccagaaattgaagtaagaggttccggtgtaaccaatcctggacatatttatgaaattgaagactctgaatttgttgacttgattcgagaggtcaacaaaaaagaagcagaatag

SEQ ID NO: 2892 - DNA, 543 bp, Bacillus licheniformis
atgaaaaatcttgaacagacatggcgttctatattagatgaatttcatcagcaagcgaatttgcgcgaaggccacatcgtcgtcatcggctgcagcacaagcgaggtggccggaaggcgcatcggcacttcgggaagcgaacaaatcgctgaagcggtctacaaaggactggaagagctcagggacagaacaggaatcgccctcgcttttcagtgctgcgaacatttaaacagggcgttggttgtcgaggaagaaacggcgaaagcataccgtcttcccgttgttttcgccattcctgtcccgaaagcggggggatcgatggcttcatatgcctataaacatatgaaggctcctgttcttgttgaacaaatagaggccgatgcggggatcgacatcggcgacacgtttataggaatgcatttaaagcctgttgccgttcctgtccgcgtctctcaaaaacagctaggcgaagcgcacgtgacgcttgcgcggacaaggccgaagctgattggaggcgtccgcgccgtctatgaagcggagtag

SEQ ID NO: 2893 - DNA, 494 bp, Bacillus licheniformis
atgggaagcatagtgaatgatattttaatgtggctgaccgatcttggctatttcggcattgcgatcggtttaatgatcgaaatcatcccgagtgaaatcgtactcgcctacggcggatacatggtctcaaacggctcgattacgataacaggcgccgtgattgccggcgtcatcgggggaacgattgctcaattgtttttatactggatcggctactacggcggacgtccgtttttatacaaatacggaaaatacttattgatccaaaagcatcacattcaaacagccgaaaaatggtttgagaaatacggcggaggcgtcgtcttttctgcccgcttcattcccgtggtcagacacgccatctccattccggccggcattgcgaaaatgccgattttaaaattcacgggtctgaccgtgctggccatcataccgtggtcgatactgttcgtctatctcggcgtacagctcggcagccggtgggaccatgtgaa

SEQ ID NO: 2894 - DNA, 576 bp, Bacillus licheniformis
ggccccttccgatatcgaaggggagtttattcattttggatcaccaagactttttcaaattttccaggcagtgcaaaaaaacggcaaatttattcgcctttatgagaaaatccgttccgaaggggctcatatccctctggaaccttggctcggcatgaatgtgacgatctcgtaccagtccgacatgaaaaaagataagcttctgtcccttggccttcacttaatcagcggccagctgaccgaatcgtttcaagagcaaatggaagcacgcgagctttcctcacagatctctgactactgttatacgatgtcgccgttgattaagccggaaagcggcataaaacggcttgagcgctatatcgaacaggcggccagaagcgaaccgcttgattgggctgaagcttccctgaaacgttggaataacgacctggcactcttaaaccaattttacgaggatactgaagaaaaaccggaggaatacgaaattgagaaaaaggccctccaaacgctttacgagcctaaaatcgatattaaagttcaaaacgggggattattttatctgcgtaaaaaaaattc

SEQ ID NO: 2895 - DNA, 776 bp, Bacillus licheniformis
atgaaaccggccaaagtatccctactccaccgattgctccagtgcctgaagcaatgtgtcgattgttacacagtagatcgtgtgacagcaataaacatttttgtgaatattttattgatttcggctgtgatctcattcccatattctgctgcggcccctggcgcaacacagtccggcgatcaatattcagcttttgaagaattggagcggaatgaagatccagcttcttaccgaattacggagaagaacgcaagagtgccgatgctcatcatggccatccatggaggcggcatcgaacccggaacgagcgaaatcgccaatgaagtgtccaaaaactattccctgtacttgtttgaagggctgaaatcatcaggcaatacggaccttcacattacaagcacgcgttttgacgagccagcggcgctcgcaattactgcaagccaccagtatgtcatgtcgctccacggctattacagtgaagaccgcgatattaaagtaggcggcacagaccgcgctaaaatcagaatattggttgatgagctgaaccgctcggggtttgccgctgaaatgctggggacagatgacaagtatgccggaacccatccgaataacatcgccaacaagtcgctttccgggctgagcattcagcttgaaatgagcacgggtttccgcaaatctttattcgaccggtttacactaaaagacagggcggcgacgcaaaacgaaacgttttaccgatttacaaagctgctgacagattttattcatgaaaacta

SEQ ID NO: 2896 - DNA, 499 bp, Bacillus licheniformis
ttgttaaaagaacatgcaaagctgatgaaggtcttctcggattcgggggagattgtcgggcggaaaaagctgcagaaaatcatttatatcgcaaagaaattggagcttcctttttatgaaaagtatgattttcatttttacgggccttattcagaggagctgacgcttcaagtcgaagaactttgcaatctcggatttctccatgaagtcaaagaaaaaaagggcggctattatcaataccgctattcacccactgaagcgggaaagcagtttttgagccagtgtgagctggatatgcgggatattaaagcctatttagacgacgtaaacggccagtcatcgcgttttttggaactggtgtcgacgattttgtattttgaggggctggagcaggaagagattagagaaaaagtgtttaccgtaaaaagcaaacagcggtatacggacgaagaattcgatgaagccgtcgcttacataaaaaagctcagaaatctttgtt

SEQ ID NO: 2897 - DNA, 834 bp, Bacillus licheniformis
tcggaaccattcttttattgacgctgccgctgcctgcaatggttcaaacgatcaggcacggtctaaagccggggatttcggtggggttggtcagtttacccgtttcattgattgccggttccttaggcggactgatgtttgctattccagtaagtgccgcgggcgtgatcatgggcttttactacagaagaaaagagccggcccaagcgattgctgcagcagccgttacatatatggtttcgttcgtcctgctgcttatcatcagcgttcagtttcttggattaaacttaatagagacggccaatcaagcatataatgaaacattcaaaacctttgaatcgagtatcaaacagtttggaaatgataaagaagtggctaagcagattgaattgttaaatgagcaattcaaacaggcgcaatatttatatccaacggccattgtgatattttccggaatcactgcgtttttgaatcatctgctcgcaaagccggtgcttcggcgcatcatacaaataccgtctctgaaaccgttcagggatatgagacttccgcaaagcattatttggatctatttgttgacgattcttctgtcgctggctcccgttgaagagggcagtgtatattactctgttctgttaaatgcgagtctcatcatgggctttgtcttggtcatccaagggttttcatttgtgttttacttttgccatgccaagaaactgccaactgtcctgccggttctttttttaattatcgggttgttttcgcccctgctgtaccttgttcgcatcttaggtataattgatataggctttaacttgagagaaagagtgaaaa

SEQ ID NO: 2898 - DNA, 609 bp, Bacillus licheniformis
gggcttgaccggaattgaaacgagtgacattatccaaggggtgatcgatcgctcaaagcccgattttgtcattgccattgatgcgctggcatcaagagggatcgagcgtgtgaattctaccattcaaatttcagacagcgggatacaccccgggtctggtgtggggaataaaagaaaagagttaagcaaggatacgctcggcattccggtcatcgccatcggtgttccgacagtggtcgatgccgtcacgatcacgagcgacacgattgattacatgctgaagcattttggaagagagatgagagacgacagtccgtccaggtcgctcgttcccgcggggatgagctttgggaaaagaaaggtcctcaccgaagaagaccttcccgatgaagagcaccgcaaatcgtttctcggtatagtcggaggcctcgcagaggatgaaaaaggcagctgatccatgaagtcctcgctccgctcggccataacttaatggtgacccctaaagaggtcgatacatttatcgatgatatggcaaatgtgattgcaaaccggactgaacacagcgctccatgaaaatgtatcgcaagacaataaaggaatgtataacca

SEQ ID NO: 2899 - DNA, 425 bp, Bacillus licheniformis
atgaaaaggttttttagtgtaataattttaggcgccctgctgctgctcgggacatctgcgccaatcgaagcggcagactacggacgcgacgtcctcggctcaaaagacggctggggcgcttatggaaaaggaacgaccggaggcgctgacgcttcttctgatcaggtatatacggtcaaaaaccgcaagcagcttgttgaggcattagggggagacaataaaaagaacagcgaaaatgatacgccgaagatcatctatgtgaagggaacaatcaatcttagtgttgatgatgacaacaatcctttaggctatgaagattataaagaccccgcatattcgatcgaagcgtatctcaaagcttatgatccgaagaaatgggggaaaaaggagccgacaggaaagcttgaagaggcaaggctccgctc

SEQ ID NO: 2900 - DNA, 590 bp, Bacillus licheniformis
atgagaaaaagaggcaggaatcgtcagtttgtgctggctgtaaatggaagaagcgcggttaagacagtattcttatttatcgtcagcctgctgctcgtttttattttatcaggcgtgctcacatcgctgcgtcctgagttaaggccgtcttcatcgttgtaccgggtggctgatgaactgaagggcgagacctttgggctcattttgggaatggaaaaccactactttgcatcagaattgccggaaccgaataagcgctttgagctttcccccctcgtcctgaagctggcgaccagcattaatttgaaagatccgcgaagttttctcggacgggagcttccgggattctctcattttgactcggaaatcctcattgccgggcaagggacggattatacgaatatgccgtcagaatctccgccgccgactgaggtcttaaaagaggagagagaagcgaatcttgcagagcttgaagggaaacagaaaaagaaaacagacggggaaaaacctcctgaacaatcgacgggcggccgcaaagtcgtatttatctacaatacgcacaatacggaatcgtatcttcccttttaaaa

SEQ ID NO: 2901 - DNA, 638 bp, Bacillus licheniformis
ttggaaaatcaggagtatgaaatcatatctattcatgtaggccgtccgcgtacatacgaattcgacggtaagcaggtggaaacggcaatcgtgaaggagcctgtcagcggacctgtctatttgagccgtacgaattttgaaggggacgggcaggcggatctgattcaccacgggggagaggataaagcggtttgcgtctatccggcggatcactacatgtattgggaaagcgtcttgaagcgaaagctgccagaggcggcatttggagaaaacgtgacagttaaagggctcaccgaaaaagaagtgtgcatcggcgatatctttaagctgggggaagctcttgttcaagtcagccagccgcgccagccttgtttcaagctggccaaacgtctgaatcaaaaagatatggtgttaaaagtgagggacaccgggtacagcggattctatttcagggttctcgaagaaggaattgttgcgcctgattcgcggctgcagctcgtttcaagagatgcgcatgaagccacggtctcgtatgccaatcatttgatgtaccatgacatgggcaatcacccagccattcggaagatccttgaggttgaagcgctgtcggaaagctggagaagctcatttttaaagca

SEQ ID NO: 2902 - DNA, 432 bp, Bacillus licheniformis
atggattttaatctgtttatgaacgatgtcgtacgccaggccagacaagaaataacggctgccggctacaccgaattgaaaacgcctgaagaggtcgatgaagcgctcacgaaaaaaggcactacgcttgtcatggtcaactccgtctgcggctgtgcaggggggattgcaagacctgccgcgcaccatgcggttcattacgataagcgccctgatcatctcgtcaccgtttttgccggacaagacaaagaagcgacggcaagagcaagagaatattttgaaggatatccgccttcttctccgtcattcgcccttttgaaagacggcaagattttaaaaatggtggagcgccatgaaattgaaggctatgagccgatggctgtcatcaccaagcttcaaggactgtttgaagaatactgtgaagaagtataa

SEQ ID NO: 2903 - DNA, 549 bp, Bacillus licheniformis
gcatgaacggccatgatttgaaagaaatgcctgttaacggcacgccgatttcagaagaactcagccgcgaggacggcattaacctcgacacggcgggtgtgacagatataacggcgacacagccggtcaccgtctattatttggctgaatcagataaaggcacatattacgttccggtgacaaagcggacgtctgcaaaagaaaaagatcaggtgacggcggcgattaaagagctgactgaaggaccggacaataaaagcggcctgctctccgatttccagggcgacgtcaagcttgaaaacaagccgaagattgaagacggccatgtaaccctcgactttaacgaagcgatctacggaagtgccgacggccagaaaaaagtgatatcggatgaagtgttaaacagtatcgtgttgacattaaccgaactgcctgatgtgaaaagtgtgtcggttaccgtgaacggaaaatccgagctcgtgaatgaaaaaggagaaaagctttccaagccggtttcaagaccgagcaaggtgaacacaggtagttttt

SEQ ID NO: 2904 - DNA, 1392 bp, Bacillus licheniformis
atggacaaacaacggttcaaaaacgaagtaaacaagatcgatgtccctacaaaagaaatccgcgaatcgattgataaaggcatcaagcgggccaagcgggaaaaaacgtttcggccgaagcgcgccgtgaaaaggactgtttttgtttcgagcgcggccgccgtgctccttctcggtagcggcttcgtttccccagcgatgcaaagcgtgttggctgacgtcccgctgattggaaaagcgtatcaacaattccatgactatgtcggccaaaacttggtggcgggccagcttgtcactgaactgaacgagaaagcgtccagcaacaacatagacgtgacagctacaagcgtttattttgacggcggaatcatcggtatgacgtttaaggtgaaaagcgatacaagaaaagatttagatgatggagcgagaatgattcatttcacattatttaatggcgagcgcaaatgggctatcgcttctcaaggagacttgaagaaaacagaggacggctataccggctacattcaagtaggctatccagacaaacatattcccgataaactgacactcccggttacgatcacaaatattaacggaatcagagggaaatggaagttcgacattccggttgataaactgccgtataaaacgctccacataaccaaaaacaatacacaatcggcggatggccataagctcgccgtaaaaacggtaattctcggaaaagaatcgactgtcatcgactatgaagtatccaattcagaggaacatccgaacgatcgtacatcggttataaaagtgaccgatgataaaggaaatgaaattccttatttgagtggcgggcagtggacgacggacagtacaaagaacggaaacaaggttcgtcacgaagaaaggctgatccttggaaaagtgaataaaggaacaaaacacctcaagattgaggcgagcagcagtatgggcgattccgaaaagacgctgcctctcacaaaaacgcccgccgcgctgagcgctgaccgtcatgacttccagattgccgttgatcaggtgaaacaaaacggaagtaaattgtctgtcgactatcatctgaaacatgtcgatcaatctaagattgatattgacagcatgcaaaactttttagaaacgatgtcactggttgattctgcttataaaagcattgacgaagcgccgatgggacacagcgtaaaaggtaattttacaaaagtgcttgatcctaaaaagctccgattccgatcagactttacgttagatggtgaatttggagcgaaaaacttcagccttgaccgatattcgcttgatgtcgaatttggttatttaagcgcattttattctacaccgtttaagccgatcaaagtgcagttgccacagtaa

SEQ ID NO: 2905 - DNA, 1053 bp, Bacillus licheniformis
ttccatgcccggtgccccggtgtcaactccacctcaacatcggtcccgtccagcttccgcatttcgctcataacccgcattcagcatgtccggtgccccatgaaccgcagagcccctatcacctcaaagcaaaccgcctgttgtacgaatggcttggcagacaagcactccgcccggtgcttgacccgtatttgcaagagatcagacaaaggcccgatttgctgctggaacacaaaacccgccaggttgcggttgaatttcaatgtgcgaatatcaaaaccgcagcgtatcgcaaaaggaccgaaggctttctcagactgggaatcgagcccgtatggattctcggcggaaaccggataaaacgcttgacgggggatttatttcagctttcgcggtttcactggcagttcattcagaaaagcgacaagccccaaaagctcctgtttttttgccccgaacaaaaggctttcatcatcttcgaacacctcattccctttcaaacaaacaaaacatccgcatccttgcgctttcttcctcttgctgaagcaagctggcgtaatgtaacagaacgagaaagccgttcgcctctccagctcaaaggctggaaaaagaacatcctcagctttcggatgtcggccgtgcgttttttatcaaaagaaacgaagcagattgccgccctcttttatgaaaatcatcagcttccgctcccgttttttccctcagaagcctttctcccggtgccgtcaggctatatttttgcccacccggtttatgtatggcaagggtacctttttttatttataacgaagcatgatacatttcgcctgcagtctgcgcttcactatatggactggctcatcaagggcaaaaggctgaagctgagatggagcgggcggcaaacggctgcggatgccgtcggtgaatacatttgttttttgcataaaaaaggatttttggtgaggaaagaggaattttattattccgcgggttcttttgttccggagccgcggttagaggcgctgttaaaaagggatgaacattatttttccgaat

SEQ ID NO: 2906 - DNA, 550 bp, Bacillus licheniformis
ttgatgtgttaataggcgaaatcctgacgctttcgatgatggcttttgcactcggcatggatgccttttcagtcggtcttggaatgggaatggccaagctgaaaaggaaccaggtttttcaaatcggcgtcattattggattgttccatgtcatcatgccgcttggcggaatgattgcgggacagtttctttcgggtgcgcttggtgcgctggcgggatatattgggggagctcttttattggtgctgggcattcagatgattgtcgcatcttttaataaaagcggggagcagatcatctctccgcacggcttcggcttgttcgtttttgccgtcggcgtcagccttgacagcttttcagtcggtctcagcctcggcctctacggaacgaaaccgatattaacgatctttctgttcggtttgttcagcatggtgttaacttgggcgggccttctgcttggaaaaaaggttcaaacgtggctcggcgcctacagcgaagcgctcggaggagccatcttgctgagcttcggtctgaagcttttgctgcccat

SEQ ID NO: 2907 - DNA, 562 bp, Bacillus licheniformis
atggagatgcctaggctgatcatgcaaaatatccccggccgcatcggtttaacaacgacgccgccagatttgaaaatggaacagccgcgcgctgacttgaaaatcgagcagccgccggccgaactgaagattacaaccaccccttcaaagctcacgattgaccagacaaaagcttgggaagacttagaaagaaagcatatatttaaaaggattgaagaaggggcgcagcagggctatcaggattggctcgccggaatggcacggaccgctgaagaaggagacgaaatgatgcggatcgaaatcgaaggcaatccgcttgcagaccaggcgaggcggaacagcgagcctgaaccgattcaaatcggcgttcattttacgccgtcatttgacagggtgaaaatcgcatacgaaccggctaaagtgaacattgaagcgacgccgcgcaagcctatcatcgaagcaacgccgaataaaccggttgttaactatacgccgggcagtgtgaaggttgacatgctccaatatccggaggtaaaaatagatgtggaatacccaaaacaaa

SEQ ID NO: 2908 - DNA, 830 bp, Bacillus licheniformis
atggagtggaatagaacaaaaacaatcttcattatcgtcttcctcatccttgatatctttttggcctttcaatactttaataagcgcagcaacaatcagtttccgattttagaaaaatcaacgctgcaggaggatatgaaagcagaccatatttcatacggcaatttgtctaaagagacgtcaaaaggctcctcaatctctgcacaaaagcgagtctttaagcaaagcgagattaaatcgttaaaagggcaaaagccgaaggcgttaatgaataccgcaaaagagaacgctttgacagaaatagaaatggagtttgaaacacccattgcgcttccgaaaacggatatgaagacaaaagcaagggaaatcgtgaatgaagagattatcgacggcaataagtacaagctttggaaggtcgataagtccggaaaacagattgttttcttccaaacctataatgggaattacatttttcaggaccggcaaaatgatgataacaacgagatgggcgaagtcgttctgtacctgaataataaaaacgaagtcgtgtcttataagcagtcaatgctgcaggatattaaagaagtcaaaacggaaaatctgatctctgcagtcggcgcggttgaagctttgtactacccggattatttgaagaagtacagcaaaattaaatcagccgagcttggctatttcacgcagtatccgctggcaagcgctcaaattttcgtgcccgtttggcggatcgaagtggagcgcaaaacggacgataaaaccattcacgaagaatttatcgtggatgcacgggacggagcgcttcttcaatcacaaga

SEQ ID NO: 2909 - DNA, 1379 bp, Bacillus licheniformis
  misc_feature (1)...(1379): n = A,T,C or G
atggatgtgaaatacgtaccggaagaatggcagggcatgaaagacggtcttgatgcgctgacgggcggccaatacggcggcggtatgaaatccggccttataaaactcaatgatctcttggaagatatcgaatccaaaatcaaagacaaggacagcgacaggtcgatcagctttacccacaccagcaaaaaaagcaagatcgaggaactgtttaaggattatcaaaagctggccgacttttgcctgaaagccggcagtttggtggcagaccacattgacagccctttttataaaaaaatagacgcgttcgccgaaaaaatgcgcggactgaccatacataattacaccaccgtaaaccggatcggctccaaggaaaccacttacgtcggatacggcatgtccaagcaagcggttgaaaccgacaaagcgaaagtgagcgtaaatgatatcttcaaagactcggaatcgtttgatcacgtactgagcaaagaatttgaagaattccagatcaaccaccccgacattgagttatcgtatgaagaatacacgaaagcgattgcctcttcccgcggatttgaatacgaatcaatcggcgatgtccaaaagaatcaggaattatggcgggatcttctggccggagcaggcattatcgtgctcaccatcttttgcgcaccggcaggtctcacggtggccgtcgcctacggaggagccaatatcgcgagcgcggcaacaggaaaagactggatgacgcagcgggagttaaacacaggcgaaaggtttgaaagaggcgtgttcggcgcccttgacatcatcccaggcgctgccgcggcgaaaggctcatttaaaagcgcagccacaatcggccaaatttcaagcaaaacagaacatatggtacaatctcttaaagacagcaaaaacatctgggcgaaccgcatgaaggtgaatgggctgaaagctcaagaccggctcaacgacgcaggcttcgccattaaaaaacaattcgccaaaagcgccgacgccttgagcgatattgcccgcggtgcagaagcaggagcgggcggcaccctcgtccgaaaaggatccaattactccgcccacgtcaacgacgcccataaggcttcgaaagcgaagatgcaggattcgattcagcgggttgagaaggagattgaagctgggaagagtgttaaaagtgttgttaaagaagtagatgttaataggaattcaccagttaatccgaaattttcgtgggaacaattggatnaatcttttgaagataatttagggactgtattaaaaagcataaataacagtcaatatnttaatgacttgaggcttaaatctatnaataaactntcatctaaagaggtggaaaagtataa

SEQ ID NO: 2910 - DNA, 444 bp, Bacillus licheniformis
atggaatttatcgtttatcttgccggagaaatacatagcaattggcgcgaagaggtgaaggaaaaagcaaaatcgctcaagctgccgatcacatttgtcggaccgatggaaaatcacgagcgctccgacaacatcggtgaagaaattatgggcaagcaggctgattcaatcgcaaaggatgatgcagcctcggatttgaacaattttagaacttccgttttaatgaacaaggcggatgttgtcatcgctcttttcggggaaaaatacaagcaatggaacacggcaatggatgcatcatacgcgatcgccaaaggcaaaccgctgatcatcatccgacccgaatcactccatcatccgttaaaagaactgtcaaacaaagcgaacattactgtggaaactgtaaatcaggcaattaaatcgctgtcatacgtatttgaaagccgg

SEQ ID NO: 2911 - DNA, 1374 bp, Bacillus licheniformis
atgaaagatttcaaatcagatatcattcattgtctggaacaaaaagagtggaacaaagccatgaagcgcctaaaggagtgggaagcccagggatcgcataacgagcctgacttttattttcttcaagcctctctttctgtctatctcggccatgactataacgcttggctgtggctctggagagggcttgatctttttcctgaaaacagatctttaaatctgctgatgggaaaagtgtgcctgcgcaccggaagggaaaaagaaagcgcggcctatcttcaaaaaggagatggagcagaaaccgcaagctggccgaagctggatcttcctgttgacgaaaaaaccgaacctccggctgggcaaatccgcattttgcaaggcacaatggaaatcgccaatcaaatgaataccttggctaaagggctctcacagcatggcgcgcttgcccacactttaaattactatccgtattatttaaattacgctgccgactacacctggtcattgctgaaagaacgcaatacgcccgccatgaatgcgaagctgagaaggcttgccaatgatctcctgccatcctatgatttgttccattttcatttcggcacaagcttcacgctggacatgtcggattatcccattttaaaacaggctgagaaaccaatggtcatgcatcattggggcagcgatgtgaggctttattcaacattggctaaaacaaatccatacgccgttgtcaaaacgaaaaacgaagctcgaattcgataccacctcaaacgaatttcccaatatgtccagcactgcatcgtcgccgatatggagctttacgagtatgtaaaagactattatgagcatgtccacatgattccgaccatgatccagcttgaccgctatactcccgactacaggtcaaatgaaaagccgctcatcgttcatgcccccacctctcccggaataaaaggaacccgccacatccttaaggcggttgaatctttaaaagaaaaatacgattttcattttcacctagtacaaggagtttctcatgaacaggcaaagaaaatctaccaaaaggctgatttgatcattgatcagcttcatatcggcagctacggattatttgccgtcgaatcgatggcaatggggaaacccgttatctgctggatcagtgattttatgaaggatcactatccttccgaactgcctcttataagagcaaatcccgccaacattacagaggtgattgaaaatgtgcttaaaaaccgggatatgctgccggaaatcggccagaaaggaagaaagtatgcagaagttcatcatgatatggtgaaaaacagcaaaaaaacattggctgtttatcagtcgctactttcggaatga

SEQ ID NO: 2912 - DNA, 504 bp, Bacillus licheniformis
atgagaatccctccatattataaaaagcctgggtggcagcgtttttttgcgggaatgatgtgcggagccatcatcagctggttcgtgttcctgtttacatacggaacctttcaggagaagcaggtcgtcttgatcagggaacagaaagagcgcatcaatgatttaaatgaccagatcaccatttaccgcgaggatctgcataagctgaatgaagacaataaaagaaaactgctgattcaaagcgtcgacgtcaagctgatcaacggcaagcaatacaagctgtcacagccggacatgatgaactttgaggagcatatccgggataacatttcagatgtcattacaaaggatatcgaaagcgtctaccggacgaaggagcttttaaagcggacgattgaaaataaagagtatacgataaacgataaaaagtacaaggcgaaagtcaccgaactgacgatttatacgcggctttccgttgaaatcaaaatctctttttccgaataa

SEQ ID NO: 2913 - DNA, 446 bp, Bacillus licheniformis
atgagcgaaaaacaagaagaaaaagtatatgatttatccttttttatgccgggacaaaccgttgaagccgaagaaatcaaagtgccgatctcaaagcggttcgtcgataaaaagggcaatgtcattccgtttgtgtttaagccgattacaaccgagcgcattgacgagcttgaaaaagaaaatacgacttataaaaacattaaaggcagaggccgtgtcaaggatctagacacccagcgcttttacgccagaatcgccattgaatcgacgatctaccctgacttccgttcaaaggaattaagagaagcctataaaacggccgacccggtcgaagtggccaaacgcgttctctccgtcggtggggaatatgcgaactggctcaacaaagcgattgaaatcaacggctttgaagacgatcttgaagatctggaagaagaagcaaaaaa

SEQ ID NO: 2914 - DNA, 612 bp, Bacillus licheniformis
aaaactcaaaatcgtacatgctattgtgttgggcagcgtgttgcagggtctcggtatggcgctgtttttgtttccgaaccatattccttcagggggcgcagccggcatcgctgttttgctcaatttctggtttcaggttccgcacggattaaccgtctgggctgtcaacttctcgctccttttgacggccgttaaatggcttgaacccgtgacagtcttcgggacgatgggggcgattaccatgacgtccgtttcggtgcagatcttcgaatcctgtatgccggttatgacgacgaacaatatctggctggatttattttacggctccgtccttttgggagcgggggttggactgctatataaatataatatttctaacggcggttttggcgccttggctttaatgatatcgatttaccgcggcggaaaaccgggaactgcgctgtttatcatgaatgcattcatttttcttttgaccgcgtctgtcatcgcctggggaatcgttatccaggccttaatctgccaatggatttctacgaggatcatcgatgcgatttatcagattcgcttccggccgttattgatgcctatcgccggtttccgcaacaaaaa

SEQ ID NO: 2915 - DNA, 848 bp, Bacillus licheniformis
atgcgtacagagcaggaaatcatcgatttggtgctgaaggtcgcacgggaggacagccgtgtcagagcggtcggcatgaacggctcgcggacgaacccaaacgtcccgcggacgaacccaaacgtcccgaaggacccttttcgcgattatgatattgtctatgttgtaacagatatgcagtcttttctcgatgagccgggctgggtggacgtttttggagagcggatcatcatgcagacgccggaagcgatggagctgtttccgaatgagcttggcaaccgcttttcgtatttgatgttatttacagacggcagccgcattgatttgattcttgtgccgcttgaagaaaagctggaatatagcagggaagacggcttgaccgtgatcctgttggataaggatcaggatctgcccgtcatcccgccgccgacggatcgggaatattgggtgcaaaaaccgtccccgcaatgcttcgccgactgctgcaatgaattttggtggacatcgacatatgtggccaaaggcttgtggcggcaggaaattctttatgcactcgatcatttaaatctcgtcagggccatgctgttgaaaatgctcgaatggaaggtcggctttgaaacgggcttttcgctgagcataggcaaaaatgcaaaatttttggatcgctatgttgatcaaaatacgtgggaaaggcttttggagacgtatccgccagctgattataagcgggtatggaacagtttgtttaagatgtgggagctgtttgaagagacagcagcagcagttgctgaacatctgaatgaacaataccttttcgcagaagcggagaaagtcagacagtatctgag

SEQ ID NO: 2916 - DNA, 564 bp, Bacillus licheniformis
atatgacaaaggatacgtatgaagtaaacagttcgacaatggctgtcctgcctctgggagagggggagaaacccgcctcaaaaatacttgagaccgacaggactttccgcgtcaatatgaagccgtttcaaattatcgaaagaagctgccgctatttcggatcgagctatgcgggaagaaaagcgggcacatatgaagtcattaaagtttcccataaaccgccgatcatggtggatcactcaaacaacatttttcttttccccacattttcctcaactcgtcctcagtgcgggtggctttcccatgcgcatgttcacgagttttgcgcggcaaagtatgacaacacgtttgtcacgtttgtcaacggggaaacgctggagctgcccgtatccatctcatctttcgaaaaccaggtttaccgaacggcatggctgagaacaaaatttatcgacaggattgaaggaaaccccatgcagaagaaacaggaatttatgctctatccgaaagaagaccggaatcagctgatatacgaattcatcctcagggagctgaaaaagcgctatt

SEQ ID NO: 2917 - DNA, 691 bp, Bacillus licheniformis
atgaaaacatactttcaaaaagattatcagctcggctcgtttcagctattttcagcatcccatattgtgactttgctagtgattgcggcgcttggtgtttgtctgttcgtcttcaggaagacgctccaaaagccggaatggaaccggttaattcgttatgtctttgtggcggttctcattatttcggaaatcggctaccactcctggttcgtttatgtgaactcatggacgccgcgctattgtttgccgctccacctcagcgacctttcggtttaccttgtcatcatcctgttattgacgaaaaacctcaacttgtttaaatttctttattttgccggtttgggaagcgcgctgcaggcgattctgacgcctgacttgggaaggtacggctttcctcatttccgcttttttgaatttttcatttcccacgggatcgtcgttctcgcctgcctcctgatgattgcagccgaaaggtataagccgacggttcgctctctctgggtcacgtttcttcttgtcaatgtttatggcgctctcatttttttgatcaaccgtttgctgaactcgaactatatgtacatgatgaagaagcccggcggcggagcatcgctgttagatgtgctcgggccatggccgtggtatcttttatcagctgaagcggtcacgatcgtcttcttctatcttctctatt

SEQ ID NO: 2918 - DNA, 1166 bp, Bacillus licheniformis
ttgccgcaaaacaatcgtttgcaattttctgtagaagagtcaatctgttttcaaaaaggacaggaagtatccgaattattatcgatttcattggatcctgacattaccgttcaggaagtaaatgattatgtatccatacgagggtcattagagctgacaggcgaatacaacatagatcaaacccgggagtatgcagagctgcctgcgacaagccgatttgtagaagatgtaaagctgaaaggggacggcagcgcagagctgacgcattgtttcccagtggatatcaccatcccgaaagacaaagtcaatcatttaaacgacgtatttgtttttattgacgctttcgattatcagctgacagatgcgaggatgctgacgattcaggctgatttggcgattgaaggcctcttgaatgtgagcggtgaagcgggtgaagaagaaccgcgcactatgcctgcggccgtccatccggaagaggagctcgaacctgcctacagatcaccttcaaacgacgaagatcagggtgaagagaaagaatatttgatccagcttgacagaccttacgaagagcaggacgaagaacaggcggaagaacatgataccggtgaggaaacggttccgatttaccagtcgtttctcggaaacgacacagaggaagctaaaccgttttttacagcgtctttgtcggcggcagagcgtacgaagcgcgaaatagaaaatcaaaaagaagcctctcttgaacagccggaagaagaatataagctgaaaagagagaaagtggaagaggaaccggaagaatatgagctgaaaagagagaaagtggaagaggaaccggaagaatatgagctgaaaagagaagaagcggaagaagagccggagctgtcgcacagctcttatcaacctcacgaggaactgaaagagaacccgttctacagtgttcctcctcttctgaaggaagaccagaatgacagggagcctgaggcttttgaggttgaggtgacacaggaagcagaagcgattgatgaagaagaggaagccgggcatacgattgaaatcccggaatattcgtttcatgagcagacggagcccgaagaagaaagagatgaaatgcaggcagcggatgaacaggaagtgtcagcaaaggaaaacgacaacgcactctattt

SEQ ID NO: 2919 - DNA, 415 bp, Bacillus licheniformis
  misc_feature (1)...(415): n = A,T,C or G
atgtttatgggtgaataccagcatacgattgattcaaaaggccgcatgatcgttccggcgaaattcagagaaggcctcggcgagcagttcgttctgacgcgcgggcttgatcagtgcctgtttggctacccgatgtccgaatggaaactcatcgaagaaaaactgaaggcccttcctcttacgaagaaagatgcacgcgcttttacccgcttttttttctccggagccaccgaatgcgaattggacaagcagggccggatcaacattgcatcgccgctgttaaattatgcaaagcttgagaaggaatgcgtggtcatcggagtttcaaatcgaattgaattgtggagcaaagagatttgggaacaatacgtagaagagcaggaagattcatttgccgaaatagctanaaacatga

SEQ ID NO: 2920 - DNA, 475 bp, Bacillus licheniformis
atggaaatcctcacaaactttcctttgctggcgagctttgccgcgatctttttcgctcagtttatcaaggttcccatttactttgtcgtctcaaaaaaatgggattggcggcttgtcacaagcacgggcggaatgccgagttcacactcagcggccgtcacggcgctctcgaccggtgtagctcttgatcacgggatggattcttctttgttcgccgtttccgcaatatttgccgttattacgatgtttgatgcaaccggagtgagaagacatgccggagaacaagcaacagtgatcaaccggcttgtccgcgattttaaccgctttgtcaacgaagcgaaggatttccctaaaagccatcaggaagaaaaacagaaaaagctgaaggaactgctcggccatcagccgattgaagtgtttttcggcggcctgaccggcattgcactgacgctgcttctcgattatttattgatgt

SEQ ID NO: 2921 - DNA, 634 bp, Bacillus licheniformis
gtggaacagcaaaaccagccgcaaatgcagatcaatcaaggcaatgaaggtatgcagcatatgaatcacggggggcacgaagtgttcgacatgcatgaagtgctgtccggaatgatcggcgtccttgagcagtatatgatgttcagggagcatgtcaaagatccggagctgctcgacattttggacaggcagcatcggtttatttcgtctcagtacaacattacgacagaatgtttcagaacggggcaaaagccgagtcaggaaacggcaacgtatatgatgaaagaggaccgcaaattcgtctacggtttaaaagatgcccagccgaaacaaccgaagcaatctgtgcaggctattgatgacgcctgcatcagcagctttatgctcggcttgatgaaaacttgttgttcgtcgctggccatggcggctcccgaagtgacaaaccctgtctgcagaagggttctggcagaccagattcctcactatatcgaaatggcttatgaaattttcctttatcaaaacaaacacgggtactatcaagttcctcagcttgcgccgcaagacatgcagaagatgacttcagcattcgctccggtgcaaggtcagccgcaaatgcctccaagcgggcagcaga

SEQ ID NO: 2922 - DNA, 460 bp, Bacillus licheniformis
atggacgaccataatcatacgaaagaattaaaaccgacagttgaaaacctttcaaaagcgatttatacagttaaccgccatgcgaaaaccgcgactaatcccaaatacctgtatcttctgaaaaagaaagctttgcaaaagctgcttaatgaaggaaaaggtaaaaaggtaggcctgcatttttcgaaaaatccaagattcagccagcagcagtcagatgtgctgatatctctcggagactacttttttcacatgcctccaacaaaagaagacttcgcaaaccttccacacttaggtacattaaatcattcgtatcggaaccctaaagctcatatgtccttgaatatagcgaaacagcttcttcaaaactacacgggaatcaaagaaaaaccgctcgtcacaaaccggaagcgtccagcctcaaaacccgtcttcaagaagcttggcgaaagctattttt

SEQ ID NO: 2923 - DNA, 615 bp, Bacillus licheniformis
catccaacaaacgctcacggcattccaaagctcttagaaataagacatttacttacacatgggcaacaaattcgtaccgatctaaattgttattccgctctccgtactttgggtgcatcaagtacatatgttcatgttcgaggttgttgcagcaggttcattggaaggtgttgcaggccctttaacgcttaattggctcggtaggcacgggggacgtccgtttttgcaacgttacggcaaatacttctttatcaagcctgaagcgcttgaaaaatcggacaggttttttgaaaagcacggcgggtttgtcgcattcagcggccgttttatacctggaatcagaacgctgatttccattccgtgcggactcgcgaaaatgaatgtgtgggtattttgtatttatacattcctcgcgatcacgccgattacgttcgtctatgtctatttaggcttttacctcggcgaaaactggagcaaggtcggcagcctattggacggataccttcttccggtcggcatcgggttcatcgttttgttcgttctttacctttggttgaagggcaggcggaacaaaatcaaatcgcaaagcgtttcagcctttataaataaaaataa

SEQ ID NO: 2924 - DNA, 985 bp, Bacillus licheniformis
atggcatctgctaaactgcagcagcgattggatcaatataaagcaatttactctgagttaaaaagcgatttaaaatggaaagtcacagatcagcggacattaatgatgattgcttccatgtatgtcgtcaacaagcggccttttgataaagaacggtttttaaatctgagtgaggctgtcaaacaggccgccggtacattttcgccgttgaggtcagcccatcgctacacttttgccgctatgtttgacgtacgcttcgaagaacctgaaacgcatatcagaccttttttcactctttatgtaaaaatgaccggcaacggattcaaaaaaagtattttcacttatttgtccgctcttattcttttgacaaaataccgtgatgagcatgatcatgacagcaaaatcaatcgggctttgtctatttacaaaggaatgaaggacaagcacgtttttttaacatctgccggcgactacccgctctccgtgcttttggccggttcagatatggagacaggtgaactgattgactatatcgaagcgttttaccaaaagcttaaccaggcgggttttcgcaaagggaacgatttgcagtttctcagccacatcctctcgcttatgccggagcaggattcagatcagcttgtcgcccgctccctccggatatacgatgaattgacaaaaaagcataaaagaccaaagcctgtccattacccggaaatcggactgctcgcgctgcttgagaacggcgaaaaagacatagatgccatcactatcatggcaggcgcattgaacagcgataaactgttcaggtggcagaaagacatgaatctgaaaacggccgtcaacttgtacatgagcgaaaaaacggaagacccggcgcttttggatacagggctttatcaaacgcttgaagctgttattcaagcacagcagacggcagcaatcgccattatgacaagctctgctgcagcgtctcaggcaaacg

SEQ ID NO: 2925 - DNA, 450 bp, Bacillus licheniformis
atgtttggatcagatttatatatcggcctcattttaggagtcttactcagtttgatttttgcagagaaaacgggaattgtaccagccggcctcgtcgtaccgggttatttgggacttgtcttcaatcagccgattttcatgctgctcgttctttttgtcagtttgctgacgtatgtcatcgtgaaattcggactttccaaaattatgattctatacggacgcagaaaattcgcagcaatgctgattacgggaattcttttgaaaatcggttttgattttatatatccggtgatgccgtttgagattgccgaattcaggggaatcggaatcatcgtgccggggctgatcgccaataccattcaaagacagggattaacgattacgcttggaagtacgcttttattgagcggagcaacattcgtcattatgtatgcttactatctaatctaa

SEQ ID NO: 2926 - DNA, 771 bp, Bacillus licheniformis
attttcaagatttatcacaggaaaacctttttttaaaagctgagctggcaagatcacatcaattgatacacgagcttgaagcaagctattttcaccagaaaaatcataagctcagccgggaaaacgcagcaatgaaacagcagcttcagcagctgtcattcgaactggagcggatttcggcaaacaaggaagacaagtcggccgaaacgctcaaccggataaaaagcgaattgctgagtaaaatcgtcgttcttcaggagcttcttcaaaaagaaacctatgcaagaaaacaagagatagaagaaaagcaccgccttcatttaacaaatgtaaaagccgaagaagagaaaaaaagcttacatagccaaatagaatacgaaaagcttcatgcagaaagagaaaaaacgctgagggaaaaaaaggaacaggagctcaaaaacgctgcatacgaaaatgcccgcctgaaagatgaacttcatgctaaaagtcttcagctcaaacaaatcgaaactgatgttgcggtattaaaagagcgggtgacggaaacgaaaagccggcttttggaggctgaaaaaacaaaagaagcgctgttttatgaaacgattctctcttataaaaggcaactcgatgaaagtgataagtggatcgcttctcattttgccgatattgatgcatttcagcagacggagaaggcgcttgaacaaaacgaggaggtttttgaacggacagaacagatcgaggcggtgcttcaaactttacagagcaaggtta

SEQ ID NO: 2927 - DNA, 1344 bp, Bacillus licheniformis
atgatttataaaaatacggctgtgcactttgatgtcaatgcacaagtgaagcgaagtgtatcagcaaatattcagttcagtacacaagatatcgggaccgcaaaattgtcgtttaacctgacaaaggacggtgtgcctttgccgattagtaaggcaacccatgccaagctattcatgaaatttactgacggcagccaggtctatgtcaatacagaagtcgaagacgcgctgaagggcgctattttttatgtcttaacgccggaacaaatcaaacatgccggtaccgttcacgcggagctttatgtcaaatatgataatggtcagaaaatgagtgtccataaattttcttttgagattgataaagctctcattgatgcggatatcgtgcccgttgccgaatactactttgaagattttgaaacgttcaaagctgaagcggaagaaatgattgatgacttgcaggcaaaatttgaaatgcttgataatatcgaaaccaaagagggagcccaagcaagagctgacgctgccgaaaccaatgcaaaagcttacatggataagcacgcatctaaaaaagacaatccgcacggtgtcacaaaagatcagatcggcttatctaaagtagacaatgtgaagcaggcgacaaaagcagagtttgatgagcaccacagcgataatactcgacacataaataaagctgagcgaacgaaatggaatgccggacagctttataaattaaccgatgacaacggcgggagaacgctaattcctgatgacactgacttattaaccttaccatcaggactttattatggtgtcagtaacaaagttgtgaattctccagaaccgaaggcggtcgagtggtttcattacgatgtttcaactaataatgcacgcaaaacgatcgtggtaactgctacggccaatcctaaaaggtggtttgggacaatccacactgacggatcatttaaaggttggcagagatttataacggatgccgacgcggaagttacctggcaatcacctactttgttaaacgggtggaagcagtatggaacccataaggttcagtttagtaaaaatgcccttggagaggttgaaattatcggctcaataaccggtggaacaattggttttgatgtgccggcttttatgctgccggctggatatcgccctatacaaatgcttcattttataggtgtagcttctagtcaaggcactggcaccactcctcagtaccatagaacccagatcgccactgatggaactgtttacattcagagttgttcaaatacggtaaacccaaacgaatttattactttcggttttaaatttaaggcggcttag

SEQ ID NO: 2928 - DNA, 732 bp, Bacillus licheniformis
gggatcgtttacgattccgatgatgaaaaaactgggctataaaaaagaattcgccggtgcagtcgaagcttccgcatctaccggcggacagctgatgcctccgatcatgggagccgccgcctttttaatggttgagttcatcggcggaggcattacgtactgggatatcgcgaaagccgcggcgatcccggctgttttatactttacgggcatctggatcatgacgcactttgaagcgaagcgcctcggcctgcgcggactaacgaaagaagaaatgccgaaccgcaaggaagtattcaaaaagatttatttgctgcttccgatcatttcggtcgtcgttttgttaatgtcgggcatcacggtcatgcatgccgctttgtattcgatcgttctggcgatcctggtcggtttgttcaataaagaaacgcgaatgggcgttaaagggattgtgctggctcttgcggaaggagcgagaatggcgctttccgttgcggcggcaacggcagctgccggcatcatcgtcggagtcgtcacaaagacgggtctcggcctcaaacttgcaaacggcctgctcgatttggcaggaggcgcattattgccttcgctctttttgacaatgatcgccgctcttgttctcggaatggggtcgccgacgacggcaaactatgtcattacgtcgacgattgccgcgccagcgttgattttgctgaagcatatccgagcgctcagggc

SEQ ID NO: 2929 - DNA, 483 bp, Bacillus licheniformis
atgtcagaccaaaaagaaaaaacgaccattgttttatttagcggtgacctagataaggcgattgccgcttttattattgcaaatggcgccgctgcttatgatcatgaggtaacagtttttcatactttttgggggcttaacgctttaagaaaagatgaaccggtgccagtaaagaaaggaccgcttgaaaaagcgttcggctttatgatgccccgtggttcaaagaaactcggattatctaaaatgaattttgccggtatcgggcctaaaatgatcaaacatgtcatgaaaaagcacggcgtactgtctctgcctcaactgattgaaatggcgcaagaacaaggagttaagcttgttgcctgtacaatgacaatggacttgttaggcttgcaaaaagaagaactcatcgacggccttgattatgcaggtgttgccgcttatctaggcgatgccaacgaagcaaaggtgaatttatttatataa

SEQ ID NO: 2930 - DNA, 1332 bp, Bacillus licheniformis
atgatcgaagattacggagagaagtacgaaaaagagaggcgggtttttttcgcttggcaggacattgaagagccggagcgggacatatcggtggagttagatcatcaaggccgcttaatcagtttgacaaaagagtatgaaccggtggtggaggaagctcttcctgatgaaaggctgctgcaaatcgcccttcagtttacagaacagcattacccgaatgcgccttatgaatttgttttccatgaaaagaaggtaacagaacaattcgttcgttttacgtatgttcagactgtccttgatcttccgctgccgcagacgggcttttatgtccgggtcgccaagaacggagaggtgattgagtttcgctataacggcgggacgagctctttctccattccaaagcagatagctgataagcaatcggtaacagccgattatcttgaacatgttcaattcgaattggcggttgaaaaaatccgcagtgaactttatgaagggggagatgatctcccgcatcttatttacgaagcagacttgccgtttttcagctatcccgccgatatcacggaaaaacgccagatgaagcctgcggctgatgacgaggaagaagaagacacattgccgctccctgtgctgcctgaggctgaccgtcatgctgatatcgatgacatgatcggctttaccccttcgatgcgaaaaatccgcgaaaccgatttgggagagtcaattggaacagtgtggcgcctgggagacgaccctgagccgagagatcggagtatagccggctactttgaaacatggaaccaaaatacgttgaaaatcgtgaaagacaaaaactcggggaagctcaaaggaatcgcttcttttatcaaatcggaaggaccccctgtcttgagcggggaagactgcttgaaacgggcgctgcaatttttgtacaggctttatcccgacgctgatcggctttttcgaatgcatccggcggaaaatgacggggacaggtcaaacgcattttttcaatttgatcttcaatacaaaggggtgccgttaaggcttggctctgccaatatcagcatcaatcggacaaccggcagggtcgtcggttatcacggcccggaaatcgagccggaaacgctgatcgatctgagtccttcgccatccatttcagaggaggaagcgaaagccgtttttgcagcggcatttgatgtgaagctgcagtgggaaagggactacagtcgggaaaaggatgacttctacaggcttgtctaccggccggtatacccttactttatcgatgcccatgacggaaaggcgtttatgagcaaaaacatataa

SEQ ID NO: 2931 - DNA, 465 bp, Bacillus licheniformis
gtggggaaaaatatttctgacataatcgaacagtatttgaaacaaatattagaacagaacgggaaagaaatattagagattaaacggagcgaaatagccgataaatttcagtgtgttccttctcagatcaattacgtaatcaatacgcgttttacgagcgagcgcggatatattgtcgaaagcaaaagaggcggcggcggttatatccgaattattaaaattaaaatgaacgacaaaattgatttgattaacaatattatgaatcaaatctatacaaggctctcccaggctgcttcagatgacatcattttaaggctgttagaaaatggtgtcattacagaaagcgaagcgaaattgatggtgagtgtcatggaccgttctgttttatatattgatttgcctgaacgagacgaattaagagcaagaatgatgaaagccatgcttacgtcacttaaatttaagtaa

SEQ ID NO: 2932 - DNA, 467 bp, Bacillus licheniformis
atgagtaacaaagtgatcgataccgtcagcgaaatggtccagcctatactagacaatcttcagcttgagctcgttgacatcgaatttgtcaaggaaggccagagctggtttcttcgcgtgtttattgattcagatgacggcgtagacatcgaggaatgtgccaaggttagcgaagctcttagtgaaaagctcgatgaggctgatccgatcaagcaaaactattttcttgaagtatcgtccccgggagctgagaggcctttaaagaaagaagccgatttcatgaaggcgctcggaaaaaacgtatatattaaaacgtacgaacctattgaaggcaataaagagtttgaaggcgagctttccgcatttgacggtgaaaacgtggaggtcacggtgatgatcaaaacgcgccggaaaacgatcaatattccatatgacaaagtagccaaagcgaggctggctgtttcgtt

SEQ ID NO: 2933 - DNA, 1323 bp, Bacillus licheniformis
atgaagaaattgtacgaccgatacaaggcggaacctgccggcgtgccaattcttcaacgtaaagccgtggattatgaagactttgagacaggtcgcatcaagcggattgatcataaggtaaacaacaagctgaataactctttcgactcggaaattgtagataccaaagtcggctatcttttcggccatccaatcgcttatgaggtggatgacaaatcaaagtccgggaatgtttcagcgatcaaacagttgattgaggatttcactttgagaaatcacgttcctgacgaggacagcgaatgggggaagatggctgcaatttgcggttatggcgcccgccttgcttacgtggatatggatgggaaagagcgctttaaaaacatcgacccttgggaagtcgttttcataaccgatggcaatattcacgaaccggaattcgcattgcgctattacgagacttgcgacggacagctaaatgccgaattttacgattctaccgatattcactattacagcacgttggacagcgcagtgtttgaagatgaccgcatacaaccgcacatgttcaaaggctgccctctattcggattagccaacaataaagagttaaaaggcgatgctgaaaaggtattgtctcttattgatgcctatgaccggacaatctcggacgccagcaacgagatcgagcagtaccggcttgcgtatcttgtcttgaaaggactaggggcagatgatgaaaccttagaaaagttgaaagaaaccggggttctacagctgctagaagagaatgacgaggtcagttatctcacgaaggacattaacgacgccattatcgagaaccatttaaacaggctggaaaaagatattctccgtttcgctaaatctgtgaattttacagacgaatcattcgccggcaatgtttcaggcgtggctatgaaatttaaactgatggcacttgagaataaaagtatcacgatggaacgaaaaatgacagcagccctccgatatcaatttaaaatccttttttctgcatgggggacaaaagggaaagcgagcgaagacgactatttaaaggtttggttcggcttcacgcgtaatcttccggtaaaccttcttgaagaatctcaaatcgccgggggtcttaaaggtctggtcagtgaagaaacgcggctttcattgctgtcatttgtggatgatgttcagtatgagattgacaagatgaaagaagaacaggacgaatatacgcggcatttaagcccgttagatgacagcgaagataaggcgccgcaggacggtgagccagacgatgaagaatcagaatga

SEQ ID NO: 2934 - DNA, 483 bp, Bacillus licheniformis
atgaaacggggatcaactctctttttaaagatagctgttattcttattggaatcccagttcttgctttgtgcatattttttgtgccggaaatagcgaattttgcagccgaattgtatccgggtatttcttatttgaaatatctcgtatatgccgatttgtatgcagcggcgatacctttttattttgctctgtatcaagcctttaaacttttaagctatattgaccagaataaagctttctcagaattatctgtacgggctttaaagaatataaaatactgtgcaatcaccatcagtattttatttgcggcaggcatgccgctcttctatcttatcgcagagatggacgacgctccagggatcatactgatcgggttggtccttatttttgcttcaatggttatcgcagtctttgccgctgttctccaaaggctattgcaagaagcgattgatataaaatcagaaaatgatttaacagtctga

SEQ ID NO: 2935 - DNA, 579 bp, Bacillus licheniformis
  misc_feature (1)...(579): n = A,T,C or G
agaactggtatgtgtatttgcagcagcaggctgcgcaaatccagaagctcgaaagtcagattgccgtattgcattcggagttgaaccagctgaaagaaaatcccggnacccggatcgaccggatcgaatacaaatttgattcactaaaaattgaacgcttggacggaacgctaaatatcggactcaatcctgcggacccggataatgtcgaaaactttgaaatcagccaacagccgccgggtatcggaatgcttcagcaggagcttgacagccagctgatgcagcaaacgagacagcttgtcgatgcctatttaaacgaagagacccctcgtttgctggaacagcttgaagaccggtatgacagcaaactggacgatacaaaccgccaccacattatcgaagacatcagaaagcaaatcgacagccgtatccgctactacgtcaaacatgtaaagcctgacggaaacatccagccccgcgagcatgcagaacggctggccgactatgtcaaacgagatatcgcacgggcaatcgagcactttctcaaatcaatacctgacgaaatgaaaggaaatgaaa

SEQ ID NO: 2936 - DNA, 807 bp, Bacillus licheniformis
tgaatttacatggacgccaccggacgaagaagaaaccgtctacaaagacgatcctaaagtggtggcgccttatcaaaagaaaaacgagcccaaaaacaaccgcaaaacgaaaacgtctcttacgtatcctgtgaagcgatttgccgcgaccatcgtctttgctgttttgctcgggacgggactcggtctgtttgcgctgaatctcgcaacgcataaagaaggagtgccggcttccggcagtcttggggcggatgctgaaaacggccagaccgttaaagccggtgactccggtgccgaggagaaaaagagcggagaaaaaaatagcggacaagcgggagaatcttttaacagcttcgccgttcaggccggaaagttttcgtctaaagaaggagcggatacgctggcctctcaaatcgcagacaaggggtatgccgccgtgtcgattgccaaggacgacgggttttatgtaatcgccggaataacgggagaaaagcagatgacatctgaacttggcaaaatattaatcgaaaacgattttgaagcgtggggcggaaaagagcttccggttgcaatcgagtccggtttgctggagccttttaaagaagcggctgagctgtcggcaaaagcgattctcggcgcggaggttacatctcaaaacatagccgatgtcaaagctcaacttgacggggcccaatcaaaaggctctgaagaggtaaagaagagcatactggaagccgtcaaccttctggagaaaccgaccgcagccaacggctggaagagccagcagctattgctgggccaaattaa

SEQ ID NO: 2937 - DNA, 465 bp, Bacillus licheniformis
atgtttactcaagctaatttatttttgatcctgcttttggccatcgctttaatcgcgaaaaatcagtcgttgatcatcgctgtatccgtcctgcttttgatcaagctgatcggcctcgatcaaaagctgtttccagccatccaatccaaagggatcaactggggcgttaccgttattacaattgcggttcttgtgccgatcgcaacaggagagatcggctttaaacagcttggcgaagcgatgaagtcatattacgcatggattgcactcggagcgggcattctcgtagcattgatcgccaaaaacgggatcacattgcttgcagaagacccgcatatcacgaccgctcttgtatttggaacgattttagcggtcgctttattcaaaggcgttgccgtcggcccgctgatcggtgccgggattgcctatcttgtcatgcaggccgtccagcatttcacatcttag

SEQ ID NO: 2938 - DNA, 939 bp, Bacillus licheniformis
aagaatggctaaaatccttacatctaccgaaggaatggaacgacaagcatggttagaagcgcgacggcgaggcattggtgggagcgatgtttctgccatactcggacttaacaagtggaaaagtcccattcaattatacatggataagatcggcgaaagtcctttagaggataacgaaagcgaggcggcaaggctcgggaatctattggaggacatcgtagcccaggaattcagccggaggaaagggctgaaagtgaagaagcggaacgccattttacaacatgagaaatacccgtattttttggcgaatgttgaccgcctgattgtcggccggaaggaaggtcttgagtgcaagacggcgacagtttacaagcgtgatgaatggacggcagacagcgtgcccgatgcgtattttgttcaatgccaatggtacatgagtgtaaccgggttcaaaaaatggcatttggccgcccttatattaggggatgttgtgaacccttggcgattccatgagatcgagcgcgacgatgaattgatacggatcatggaagaaaaggcggcttatttctggaatgaacacgtttctaaaagagtgccgccgccgtttgacgggtcgcaatcatcaaaggatttactggcggccatgtacccggagcatgtcgaggattcggttgatctgccgggatactttgatagcaagattgaagaatacgagcggacgaaagagaagatcaacgaactgacagagaagaagcaggccattgaaaacgagatcaaagggattctcggtgaaaggaaacacggttttgttgctgacaaaaaagtcacttggtcgaggttcccggttgaacgctttgacaaagaaaaattcaagagagaacaccctgacatctacaggcagtatgtgaaagagggtaacggttcaagattttcaatccg

SEQ ID NO: 2939 - DNA, 669 bp, Bacillus licheniformis
atatgtacacttggtagtcgaactgacgatagggtttgcagcattgtttctgatgacgaaaattctgggaaaaacccaatttgcccaaattacgccgtttgattttatttcggctttaatattgggcgagatggttggaaacgcgattttcgatgaggatgtcaccatctggaaaatccttttcgccatcctcatttgggccgttctaatctattcaatagaagttttatcgcaaaaagtgcaaaacatcagaggttttctcgaaggcaggccgagcattgtcatcaataaaggaaaaatcgattacaacgcccttaaaaagaacaaattggacctgaaccagctgcagacattggcacgtgaaaaaggctgtttttccttacacgagatccaatacgccatcttggaaacagacggttcgatcagcgtcctcccaaaacacaaatacgggatgccgacaaaagatgacttaaacattccttacaaaccggttcagctcccggtgccggtaatcctcgacggccagctcgaaaagaacaatctgcacgaagccggatttgatgagctttggctgcaaaatcaattatcaagtcagggtatcactcagtatcaagaggtgctgtatgcggaatggcgcggtgatgaggggcagctttacatcacaacata

SEQ ID NO: 2940 - DNA, 607 bp, Bacillus licheniformis
ttgaagccattgcgattgcattgccgcttctgattggaattgtgtgcggaatgacggcttccttagaggagcaggcaggccgttttcaagtgctgttgggcggcacggctcccaaattaacggcttatttaagcaaagtcacgctgcttctgatcatgaacatttttgcggtattcttggctattggactctacttattggggctcagagctctttttcatgtgccgaacctgccaagctccctttttttagaggctggggcatggctggcagccggaagtgtcacactttatttcatatactttttgatcagctgtacattcggaatgggggcttcgattttagcaggcggggcaggccttttgatgacagcgctgatgaacacgggattgggcgatgtcatttggaaatataatccctgggcatggggaatcaggctgacagggtataaggggattgaccgatttgtccaaattgatccgtctctccgctctgttctagatggggaaatcaagcagggggctttcatcatggtgtttgctataatagctgtattcgctctaagcatcatttggtttatccgctgggaaggaagaaaagcttttga

SEQ ID NO: 2941 - DNA, 1178 bp, Bacillus licheniformis
atgaagactcttgatgttcaggcgctgcacaatgcaatagatcaaacgctggaacaattaaaacaacaatcagacgaaatcgccaaagtcaaaaaggctgttgagggcatcacatcacttgatgatgctttaaagggaaaaggcggcgacgcgatccgcgccttttacgaggaatgccacaccccttttctacagttctatgatacttttatagaggaatacagttccgcgctgaagaaaatgaaaagcgcgctgaattccctggaaccaaaccataacggatttatttcacagtcctttctcgggcatgagttggagaatggcttgaatgccgctgatcgcacaacgaaacatttggtttctaaaaccaacgccacgatcgcaaaagtcagccatattgtcgatttaccggatttgaatgacagcggttttcatgaacaaaatcagaaagcgttaaaggaaatcagcacgactcttgaaaagctccatgcgtttgaccgcgggcaaaccaacgccctcaaaacggctgaaaacgatcttgagacgatgcagagatacatggcgcggctcgaaaagatgtataccggaccaaaaattgaaataaccggctatcaaaaaggttcgattttaaagccggatgagatggataccttgagtggaaatcaagaaacagcgatgggtgtcatgttgaaaaaagtcggagacaaagaagatgcggacattaacactctcgccgatccagatcgattaaaaaaattggcgacacaagtgtccaaaaaagtgtatactgacgaagaattagaaaacctgagtgaaaaagaattagaaaaactaaaaaaggtttataaatatgtgaatggtcataaatactgttattatttagatggtaaatatgtcgtcggcatacagttggttgacgatcctcctgcagaggataaagaagtaagtgatttagagaaatattcaagaattggcttggagctcttaggtgaaagtgactttgaacgagctgcattgggatatgatcctgatacatacaaaaagctttctctctttgaacggttcgaggccgctgttaatttaacgcctccattgaggattgtcaaatggattcgcaagggagataagctagcaaaagtttcgaaggtggataaaggggctaaaacagctggagatgt

SEQ ID NO: 2942 - DNA, 768 bp, Bacillus licheniformis
atgagaagtttattgagaagcgcgatgatcttatgtatgattttccttgtcttcatccctatagcctccggtgcggcagcctctgaacagaagcggtttgtttatgatgaagccgggcttctgaccaaacaggaaatcgagaagctggaaacgctggcagccaaattgggcgccgaacgggagaccgactttatcattgtgacgaccaatgatacaaacggccgcgatgtaaagaaatatgcggaggacttctatgacgaaaaagcgcccggctaccagaagaagcacggaaatgcagccgtattaacggtagatatggagcatagagaagtctatcttgccggctttaaaaaggctgaagaatatttgaatgacgccaggctggacaaaattagagaaaaaatcacgccggatatatccgacaagcattatgaggccgcattcgaaatgtttatgaaggcggcgcatgatgatatggagaagaaaccgtgggcggacagcatcttttttaagacgtggtttcaattgcttgtttcggcagtcatcgcgggaattgccgtcgccattatgaaatacaattcaggcggcaaagtgacagtaagtgcaagcacttatatgaacggtgatacgtccggagtgatcagaaataatgacgaatacatcagaacgaccgtcacaaaacagagaaaaccgtccaataataaaagctcaggcggcggaacgacgagcggaggccattcgcacagcggcagccggggaagcttttag

SEQ ID NO: 2943 - DNA, 821 bp, Bacillus licheniformis
atggtgaaaaaatggagcaatgacagctgcacgcttgaagcggatgtcgacttgttcagcaaaaggatcagaattgtcaattatgaaggcaatgtgtgttcattttttcccgacatactgaaagaagcaaaaaaacatgatatagggaaaattatcattttcaccaaaacgactgacagagacgcattgcttgagcggacgtttgaaccggaagggaaaatcgacggatactttaacgggcatgatgctgacgtgttcgtaaaatatgtaaaagaagacaggcgaaaaaccgctgactggcttatgcaggatcaaatgctggcagagctgttcagcacaccccgcatcgccgagatccaaaacgcttcctttaaaatcaggcgggccgtctctgttgatgcgcctgttctcgccgacctctacaacagcgtctttcctgtatatcccgcacctgtttcagattcggcatatctcaaggaagcgatgggaaagggggctgtttactacctcgcttttgacggcgaaaaagtcattgcatcagcaggcgcagacgttaatcccgctttggggaatgcggaaataaccgactgcgccgtcctgccggaatacaggggcttttcattgacgaggcggttgattgccgagcttgaaaccgacttgaagcaatcgggcatcttttgcgttttttcaatcgcaagagcggcttctttcggaatgaacgccagtctttatcatttatcatactcatacaggggccggcttttgaacaactgcctcatttatagaagcattgagaatatgaacatctggtgcaaaaattt

SEQ ID NO: 2944 - DNA, 549 bp, Bacillus licheniformis
ttgagaaactgttttttgtcaatttggagtgtaattgacccgttttattattttttttcaagactgacactcattgaccaaacgaaaacgagcatttttcgcgtccgtctaacaaagtacaaagggatcgatgtggtgttaagcgatgggacggttattaagaaaaacgatgttctgatcaaaattcatctgcacaatattaagctgatcaaggagcttcaaaatattgagagcgctgtcggaagaggcattctcatttatcaaaaagcgtatttttcaatgccgatcttggccgaatatatcaaaaatcatcaccggtcagaccaaattaaaggcatcatcggcatcactacgctgcataaaggagttgagaggctcggttttgaagcggttgagcctgcgaaccagttttacagagtgttcaagaagctgacgcagattccgatcttatatttaacaacaaagcaattttctcttcgcaaaatccccccttcccaatatttgtttatttcgaaagaaaaattgttcaagtcctatctgcagaaataa

SEQ ID NO: 2945 - DNA, 712 bp, Bacillus licheniformis
atggctggccattctaaatggaaaaatattcagagacgaaaaaatgcccaagatgctaaacgcggcaaaattttcatgaagcttgccaaagaaatatatgtagccgcgaaagaagggggaccagatcccgaatctaacgcaagtctgcgtctcgtcatcgataaagccaaaaatgcaaacatgccaaatgacaacatcgaccgcgccatcaaaaaagcttccggcagccaggatggaaaaagctatgaggaaattacgtatgagggctacggaccaagcggtgtggctgtcatggtcaaatgtttgacagataataaaaaccggacggcgacaagcgtcagaaccgtttcagcaaaaacggcggcagcttgggagaaacaggatgcgtttcttatatgttcgaccggaaaggatatattgcaatcgaacgtgaagatcttgagatagatgaagaagagtttatgcttgaggtcattgatgccggtgctgaggagcttgaaacgagcgaagagctgttcgagattatacagagcccgaacagtttgaagaagtgaagaaaagcttggaggagcgcggctacaagctggcaacatccgaaatacaatggttccgcaaacctatgcagaagtcgatgaagcgcttcaggaaaaagtcgaaaagctcattgacgtgcttgaagatgatgacgatgtgcaggaagtgtatacgaacg

SEQ ID NO: 2946 - DNA, 486 bp, Bacillus licheniformis
gcaaaaagacagctccggcttgcagaaggaattgaacgacctgcaatttcaactgtttcggatgcgtgaaaatatgaaggatatctccaaagattcgcgagtgctcggtattgatcaatcgaaagacgatgaatggatgattgtccattcgattgatgatggccggacatgcaagatcatgttaagcgattgccagtcgccgtaccgcgggaggtgtgatttttctctcgtcgcttcctacacagaagaaaaacgcgcgatccatatcggggatattaaaggaccggcaggctttggatatggttcaatctgtatgaagtatttaaaggaaaaagcccgcgagcataacatccccgtcatcaccggggacattgctaaaagggattgggaccatgtggaccggctgatccatttttacgaaaagcatcattttgaagtaacgatcgatcctgattcaaaatccggcgaaattcagtggcaggatct

SEQ ID NO: 2947 - DNA, 465 bp, Bacillus licheniformis
tcgtctcaaaggttgaactgcctgaagttcaaaacgcaatccagaccgctctcaaggaaatcggcacacgctatgatttcaaagggtcaaaaagcagcatcacactcgaaggagacgaactctttctcgtatcagacgacgaatttaaaatgaaccagttgaattttttatttgtcggcaaactgatcaagcggaacgtcccgacgaaaaacatcgaatactcacaccttgagaacgcttcaggcggcacggtcagacagcgcggaaaattagttcaaggcatcgacaaagaaaacgcaaaaaaaatcaataaccttataaaaaaatcgggtctgaaagttaaatcgcaagtgcaggacgatcaagtccgcgtaaccggaaaaaataaagacgaccttcagcaaatcatcgcgatggtgagggaagccgacctgccgattgatgttcaatttataaattttcgat

SEQ ID NO: 2948 - DNA, 462 bp, Bacillus licheniformis
acaccctcagcaagctgaagcgcatgccgatcgaatccttgaatcttgaagccatttcggtcgccaccaacctttaccggtcggcgcaaaagctccgcgtcaaaatggagaccgaggtcctttcctcatatcaattgtcttggacggctttttcgattctttacgatctatgggtatggggcaggcttgaaacgagaaaactcgccgaactgtcaggaatttcaacagccactgcgagcaatgtcattaaaacgcttgagaaaaagaacttttgcgtcaaaagcgcggatccgagagaccgcagacacgtttacgccgagatcacaccggaaggaaaagccgcgattgaagagctttatccggcgttccacaaaggggaaacaatgctgatcaagggcatgacaaaagaggagcagaatacattgatcgagctccttcgaaaagtgaatgacaatcttcata

SEQ ID NO: 2949 - DNA, 633 bp, Bacillus licheniformis
tctgtcatcggtcagtcggacgaagtgaggcttgaatttttcggggggttccctgaggctgaacgaaagcgggctgtgctgttccccgaatatgccgagccgtctgccgaagattttcagcttcaagcctggggaagtcatctacccgcaaaaatttgcctccatcgagcatcgcgagcttctcggctcattgatgggcatcggattgaagcgccaaaagttcggcgatctgatcttttcggacggaacatggcagtttatctgttcggaagaagtcgctgattttgttttcacccagctgacacaaatcggcaaggtgaaagtttcccttgaaaaaattccgctttcaaagcttaaagtaccggagcaggatgtcgaaataagggatgatacggtttcatctttgaggcttgatgcgatttgctcggcaatgagcaggcaatcccggcagaaagcacaggttcttgtgaaaaacggcctcgtgaaagtgaactggaaagtcatcgaagacccttcatatgcactggctgaaggggatatggtttcgatccggggatttggccgcttcagaatgaaaaacattgacggcaaaacgaagaagggcaaatggagattgacgtttgaaaaacaaaa

SEQ ID NO: 2950 - DNA, 599 bp, Bacillus licheniformis
atggaagaattctattattattggtcaatgtggtttttatgggtgctgacgacttttatcctcgagaaaaacaggtttcgcttttatgcgtcagcatttattttgctcaacatcattttaagtatgtatcaggtcaggctctttatgtattttaatgccgcctatttgtcgttttatatcggagccttcatgctgtgcggttttttgaggcttcataaaagtgtcaagcggctgctgcttcatctctcgatggtgtccgcctacggttttttgtttctgtttgcattatatgaccctgtttggtttatcctaaagcctgaatggctgatcatcatcttgtttgtcatcatgacagcagcttttgaaagaagcttcgccgtccgtctcggggtgtttgtgctcgggatgtgccagggggagctcttgtatacattcgtcatcagaaagctctatggagacattgcagcgggcggttattcatggctgtcaatgtgcgctgcggggatcgttctcgtttacggaatatcccagtatgaacagctgatgcatcaagtctatcataaattgaagcgattgaataaaggagcagcaaaaatgtc

SEQ ID NO: 2951 - DNA, 521 bp, Bacillus licheniformis
atggagaaaaagaagctcgatttaagtcaatatgcagtccggacagacttagccgtggaagcgagggatctggcagaggaaaaggaagcttctccaaagaaagagctgaaagggtttacagtcaaagaatacgaaaaagacgggatcaaaattcagacgatggatattgatgaagaaggagcgaagctgtcggggaaaaaagccggccgctatttaacctttgaaacacaagggatcagacagcaggattccgtattgcaggaaaaagtcgtcgatgtcttcgcaaaggaattttcctcgtttctcgattatttgggcattccgcgggatgccagctgcttaatagtcgggctcggcaactggaatgtcacgcccgactcgctcggccccctagtgacggagaaccttctcgtgacgaggcacctgtttcagctgcagcccgaaaatgtagaggaaggctaccgtccggtgagtgcgctttccccgggagtcatgggcttgaccggaattgaaacgagcga

SEQ ID NO: 2952 - DNA, 1257 bp, Bacillus licheniformis
atgcgcctgtccggaattcagggggaaaatctccgcagtggacatgtcggcattcgattccaagaagaagcttttgcttatgctgattcgcttgcggttgatgccggcagtgtatggatttgcggccatttaccagaaaatgatcgagcacagaatgaagaaataggcggtgaggaaatgacctttcaggaactgaagatcaatcttgcagaatggcttttgctcaaggtgaaatatccttctgaatatgtgatgggaacgccgggtttaaggcgctttgaacaatataaaggcaagaaaaaaatcattctgactttaattccgtcccatgataatttgggagatcatgcgattgccctggcaagccgcacattcatagaaaacgagtttcccgattttgagttaattgaaatcggcattaacgatatttacaaacatgcaaaagcgctcatgcgcatccgccaccccgaggatatggtattcatcatcggcggaggaaacatgggggatttgtaccgcaatgaggaatggacgaggcgcttcattatcaaaacattcaagcattataaaatcgtccagctcccggcaactgcgcacttttccgagacgctccgcggcaaaaaagagctgaaaagggcgaaaaaaatctacaactcccatcgccggctgttcatgatggcgcgcgatgatacaacctatcaatttatgaaacagcacttctcaaaccaaacgattgtaaagcagcctgatatggtgctttatttaaagaaagaacagcagtctgaaagagaaggtgtgttggtttgtttaagggaggataaagaaagctttctcaggccggaagagcgtaaaaagctgctgaaggctgtcggcgacgagtatggcggtgcaaaaacttttacaacgacgatcggcaggagggtcagccgcgtgtcccgcgagaaggagctgaaccggctttgggatcagctgagaggcgcggaggtcgtcgtgacagacaggctgcacggcatgattttttgtgcgataacaggaacgccgtgcgtcgtgatccgctcttttgatcataaggtgcttgaaggctttcgctggctgaaagacgttccttcgatgaagcttgtggaaaatcccgatgcggcagaggttctcggcgcaatcgaagagctggtcaagaccggtgactcgcatcgtgagaccccggcaagggatcattatttcgcagatttaagacggaaaattatgggtgatgtccaatga

SEQ ID NO: 2953 - DNA, 474 bp, Bacillus licheniformis
tcgaatctcctattcttgctatcgtgatggccgtcattgtcatggctgtcagaatcaagtcatctgaaaaaccggctacggccaaaaaaattatactgcctccgatttttatgagcaccggtgctctcatgtttttatttccggtgttccacgtaaccggtgctgaatttttggaagctctcaccgtgggcatgatcttttctattttcttaattaaaacctcaaaatttgaaatccgcgatgataaaatctatattaaacggtccaaatcgtttgtgtttattttaattgcgctgctcgtcatccggatcgtgatgaagagcatattaagcacaacgatcgattacggcgcactgagcggaatgttttggattctggctttcgggatgatcgttccttggcggattgccatgtatttatcgtttagaaagctttcaagccagattgaagcgtcaaatcacatacaggtcaatt

SEQ ID NO: 2954 - DNA, 480 bp, Bacillus licheniformis
atgttcggactgcaggatattgtcaaattcctctggtcgttcttgatcgtttttcctgccgtgtcggtgcttcatgtcttgggccacagcgccatggcggtgttgttcggcgggaaatcttcgcttgaaatcgggatgggcaaaaaattgctgaaaatcggccctgttcaaatcagaagtgtctacttcatggattccttctgcaaatacggggatttaaaatacgataaccgtttcacgaatgcgatgatttatgctggcggatcgctgtttaacttaatgtctatatttattatcaatctgctgattatcaaagacatcatacccgaaaatatttttttctaccaatttgtttatttttcaacctattatgtattttttgctttgattcccgtgaggtattccgaaaatcatctttatgatggaatggcaatttataaagtgctgaggtatggagagaagtacgatattaataactga

SEQ ID NO: 2955 - DNA, 620 bp, Bacillus licheniformis
  misc_feature (1)...(620): n = A,T,C or G
atgacgctgaccacacagttctatacgatgctgnccatggccggaatgggggcatggcttggcgcttcccttgacacctatacccgttntgtcgttcgctcgaaaacagcaaggtggctgttgtttctccatgactttntgttttgggtagtacaaggcctccttttnttctatgttttgctgagcgtgaatgaaggggaattccgaatttatatctttctggcggtcatgcttggttttgccgcttatcagagcctttttaagcaggtctatatcaagcttttggaatggatgatttccttttttatattcatctccaggctggtctcaaagatgatgcggatgatggtgtttcggcctgttgtatggacgtttcaagccattttagccatcattctctttacaatgagaaatatctatgttctttttcgtttttttgcggtatgtttatataagatattaaaatttgcaggatacccgatttattttatactatatcaatgctgcaggcttcttcccgccccggttcggggattgttgagacgctttttgcaaaaaggagcaggatttttcgaaaaggggaagaaactattcataacaattaaggcaaaacttttaaa

SEQ ID NO: 2956 - DNA, 568 bp, Bacillus licheniformis
atggaagaaacttcgaaaaaacgagaaaagaatatggacgataaggctttgacccatgagcttatccatctgctcagccactcaaggcacgactggatgaataaactgcaattgattaaaggaaacttaacattaaaaaagtatgaccgcgtatttgaaattatcgatgaagtggtcatcgaagctcagcatgaatcaaagctttcaaaccttagaatcccgcgcgcggcgtatgagctgcttacatttaactggatggcccattcgctgacgcttgaatatgaggtgatcggtcaagtcaaggatttgtcagcttatgaagaaaggctcgtcgttctcatcagaaagctgtttgggatttttgacgatgccgttttgaaaggcagcgacaatcatctgacgatcacgctgcagacggacggtccggacgaccgcctcgtcatctttctcgatttccacggcgtattcacaaagctgaccggtatcaaagactttcatcattcactggccgacttttatgaaatcaagcggtttgatgtaacagaccgtgagtgcatcgccgaaattc

SEQ ID NO: 2957 - DNA, 775 bp, Bacillus licheniformis
  misc_feature (1)...(775): n = A,T,C or G
ttgcaagacatctacggacaattatcttatttgaaaatcaagctgaatcaaaagctttcacatccatatttggcgaagcatctgactgcgccgaaagttgatgaggataagctgtttcttttctacgctctgtttgaggaaacggatttaaaagaagctgacaaggaaagttacatcttaacggcgatgcttgttcaaacagcccttgatacccatgatgaagtcacgaccgcagcttcaattaaacaggacgattataaaaaccgccagctgaccgtattggccggtgattacttcagcggcatgtactactcgctgttatcgggtatgaaggatatttatatgattcggacgctcgctgcggccatcaaagaaataaacgaacacaaaatcaggctttacgaccattccgcanaagatgcagacagcctgaaaaaagcgtcagcatagtggaagctgcactntttcaccatctcgccgaccacttttacctgcctaactggaaaacagccgccaatgactntccttgtctttaaaaggtttgnggccgaagaaaaagcttcagattcccggctgctggagacgatcatacagaaagagtttccggaaggacaggcttcatgcggacagctggctgctgcggcttataaagaagccaagcttgcgatcaaccagtcgcttgccaaaaagcccgccgtccaaaaatggcttctgaaacgcctgcaggaaattcggcctgaaaaacgaacttatcatcagaaagtggaagaagggt

SEQ ID NO: 2958 - DNA, 450 bp, Bacillus licheniformis
cctgcgccccgacacaagcatctactacggccaggatgggtatgatgaattgatgaataaagcgctgaaaaagtataaagaaaaacagcatattacattaaaagatgatgattttttgaagggcatggaaacgatctatcattatccgggagaattccttgaccgaacgctcgaattcgacggctttgcttttaaaggggaagcgatcagtgacaaacagctgtttgtcctccgcttcggcatcattcattgcatcgccgactccggcgtctatggcatgctggtcgagttccctgaaaatatggatattaaagacgaccagtggcttcatgtaaaaggaacgctgtcttccgaatactatcagcctttcaaatctacaattcccgtgctgaaagtgaaggattggtctgcaataaaagagccgaaagatccttacgtttatcggacata

SEQ ID NO: 2959 - DNA, 453 bp, Bacillus licheniformis
gcagttttgtcgtttcgttattaacttccggctttttggaagaatttttaaaatggtttttgctgatggtcagcacctttcagcatatcgactttgatgaacactatgacggaatcgtatacgggacaagcctttcattggggtttgcgacgcttgaaaatatattgtacctcatcggaaacggggtggagtacgcctttatgcgcgctttgcttccggtttccagccatgctttattcggagtgatcatgggcttttacttctgcaaagcccgtttttcggatagcaaaacaaagatgaaatggctgctatgctcgctttttattccggctttgcttcacggtctatacgattatattctgctcgccttaaaaaactggatctattttatgctgccctttatggcgtttctttggtggttcggcttgcgcaaagcaaaaaaagcccgttccg

SEQ ID NO: 2960 - DNA, 430 bp, Bacillus licheniformis
gtgacgctttatacgaaaaaagagattgttgcaaaagcgcgggagctcgcaaaaatgattgcagaaacggaagaagtcgactttttcaaaaaagcggaggcacagattaatgagaatgccaaaataacgggcataatcaaccaaatcaaagccctgcaaaagcaagccgtcaactttaaacattacgaaaagcacgaagcgcttaaacaaacggaagcaaagattgacgcgcttcaggaagagcttgacgagattccgatcattcaagagttcagagactcccaaatggaagtcaacgaccttcttcagcttgtcgcgcatacaatatcaaaccaagtgacaaacgagatcatcacatcgaccgggggagacctgctgaaaggcgagaccggttcaaaagtgaaaaattcatcaccgagctgttctctat

SEQ ID NO: 2961 - DNA, 777 bp, Bacillus licheniformis
gaaacagaagattccatctgaatacgttgctagaaagctgaatgattggtacaacgccattcggaaaaatcagatcgccgccagtgaatcattgaaagcggaaattttaaatgattttcaagacatggaagaaaatcgggacgtcctgctctactattcgctgcttgaattcaggcataaactgatgctcagctatttgaaaccgaaagagactgaaaatattgaaaaaaacctccgcgacttagaagaaaaagaagaccaaatgacgggtttattaaactattattactggttttttaaagggatgtatgagttcaaacaaaagcggttcgtcaaagcaatcggctgctataaaacggctgaacaaaaagtcagcgcactggaagacgaggttgaaaaagcggaattttattataagcttgcggaaatctactattatatcaaccagagatacctgtcgatcaactatgcgacgctagcttccgacatttttaaccggtatgaaacgctaaaagaaaaaaagattttctgcgattttatcattgccggtaattgggttgaatcgatgacatacggacccgcgctgaaaagcctggccaatgcgcttgaagacgccaggaaaatcaaaaacagccatttgacggcagccgctcattttaatttgggaaattgctatttccaccaagaatcgtaccgggaagcctcagatcattaaagagcgccctttccatttttgaacaggaaagttcatcatatattcccaaagtgctgtacaac

SEQ ID NO: 2962 - DNA, 1239 bp, Bacillus licheniformis
atgacgactttgacaggggacattgtaaacatggtcaacgagcagattgtaccgaacatacatgaattgcagacgtaccaaaatgataaaggacagattacagagcatcacgaaagggcggaacagcttctgctgcaattgattgaagacgcaggagccatttatgaagcggttcacttaacggctgcaaaagaggcgtttaaagaggacgttttggattggatcagccgcggattaggggagacgccgtattttgaccggttattgacggcttaccgggctccgcatgatcaggagacgaccttttttgcggcgccgatcgtgacgccgaatgggcctcatgcgaaaggctgctattttgaagcctttttagccgttcgtgaagaacctgccatgatgaggccgatagaagaggatctgcctcatcctgaaaacggctgccaatcccttaagctgctcgccggaacaaaggggttcacggaagaaaaatgcatcgtattcttccctgaaaatgtgaaaacaaaagagaaaatcacatcacagacattcgcgattttctactttaataagttttatcacatttaccatgaggacacgctcaaaagagcgagggccatttttgaacatgcgcctttcaagtcggctcagctttcccacgaccgcacatatgaagcaagggtgttgtggggctaccttcacgactattttcatcattgcggaaaaaaaccttttcatctccatattcaggcgaaaatgaattttttcgcaggcattttagaagaagtcaaggtcgattgccaagcaatcctgaccttgtgggagcggcaatatgacggctgggaggaaattatcgaatttgttttgtatgagcggctgctgcgctatccgagccagcataatgcaacgcggaattttgattccgggacaggctattttctgttcagctggatgattgaaaacggccgttccattcaaaaaggagaagagaagcgcgtgtcgcttgaccttccacgctgcatggacgatttaagaaagcttgtggccgaaattgaacagctggaagaaatcgaggatgacacggcatacaaagaggccgcggagcgctatgtcagacaatacctgcctccgggacgggaaggcgagcgattcagcgtcccggaacagtatttcattgacgagatcaataagaaaatcgaaaccgcccgtcttcgatttgaacgggagagactggaagcgtga

SEQ ID NO: 2963 - DNA, 636 bp, Bacillus licheniformis
ggaaagaatatatactgttgaagggtgcatgttttatacaaagcagagaaaaggaaaaaagaacgcaacgattatttttgaagcgggctacggtttttcttcaacgacttggcagcccattttatccgatatagacgaagatctcggcttgtttgcatacgaccgtgcaggccttggcaaaagcgggccgagcaccagcaaacgaacagcggatcagatggtgaaagaactaaaagcgctgcttgcagcagcagacgtcaaaccgccctacctgtttgtcgcccattcgttcggcgccgtcattgcaaggctgtttgcaagccggtacagcgatgaagtcatcggcatggtgctgcttgatcccgcttgtgaagatcaggaggaaaaagtgctgccgctacttccggacacattaaaagaagattatgtcaaacagttttcgatcgaagggtcccatgaggactttaaacaaagcctggacatgctgaagcaggaaaagacacacctcggttcggttcctttgctaatcctctcggcgggaaaaaggacggaggcggcgaagcaagctcatcaagaatggctgaagcttcacagcagactgctgtatctatcgcatcaaagcggctggaatcaggc

SEQ ID NO: 2964 - DNA, 1238 bp, Bacillus licheniformis
  misc_feature (1)...(1238): n = A,T,C or G
atgagcgaaatcattaacaatcgggaaacgcagcaaggtctgcctgaggaaaaaaagcagcttctgaaggagatcatcatcgaccttcataaaggaaagccgcttgccgacgtcaaaaaacggttcgaaaaggcattcggctcagtcaatgccgaagaaatcgcccagctggaacaggcgttgatgaaggaagaaggcattacacctgaagagatccaagagctctgctccgttcacgccgctgtgtttaaaggatcgattgaagacattcaccgcgcggacgccgacaagcagcctggccatcccgttcatacatttatgaaagaaaataaagaaatcgacctccttttgaactttaaaatgcagcttcatttggaacgctttgaaaaagaagatcatcgcgacaacattctcaaactgctcgcagacttaaatttgctagctgacgtcgacaaacattacagcagaaaagaaaatcttctgttcccctatttagaaaagtacggaattacagggccaagccaagtcatgtgggctgtcgacgattttatccgcaagagcattaaagaagtgaagcgtttgttggaagagtatacgccggacaaaaaagatgaggtcatccgcgaactaacgtttatcattcaagaaggcacggaaatgatttataaagaagaaaatatcctcttgccgatggcgctcagaacgctgacagaagacgaatggctgaaaatcgcagccgaaagcgacgagatcggatattgcctgactgctccggaaacggtgtggaagcctgaacgccatcagatcaaaacgagcgaagaggcggctgatggctatgtcagactccctaccggtattctgtctgtggatcagcttgaacacatgatgaaccatcttccggtcgatatcaccttcatcgatgaaaacgatgtggtccgctatttttcacacggaaaggaacggattttcgcccggacaaaagccgtaatcggccgaaccgtccaaaactgccatccgccggctagcgtccacatcgtcaacaaacttctggacgactttaaatctggcaaaaaagatgttgaagatttttggatcaaatttaaagacaaatacgtgttcatccgctattttgccgtacgcgatgaaaacagccgctatatcggcactttggaattcacccagtacatcgccccgattcaggagattaacggnngaaaagaaaattttgaacacgagcg

SEQ ID NO: 2965 - DNA, 1233 bp, Bacillus licheniformis
atggctggcgctggccgattcgataacagcctggattcattgcgtaataagaccgacatattaaatcggactttacaaacgcaaaaggcaaaacttaacgagttgaagcggcaatatgaagagagcgtaaggacgacgggaaggtattcggcacaatccgaaaagctcctcgcccagtataatcgaactgttgcagcggttcggaaaactgaggatcagttagaccttcttaaccgtaaaatgagagagcagagcaacggcttcagtcaattaggcgctaaaattagcgcaagcattaagacgatcgatacgaagttgcgcgtattggattcgtcatttgaggccgcatcagccggcgtaagggatttcggttctactaccgagcaactacgacaaaaatcggaacatcttacgcaatcgatctcgttacaagagcagcgacttaaaaacatccgccgactgtatctcgaagctaaacgcgcaaaaggcgaagatgctcaggcgactcaagaattacgcgttcaaatgaatcaagcgacggcacaacttcgaacaactcaagccgaactggccgcaacgaaccgacagatccaatcgaacacgggccgttggaacgagctcggcaaccggatgggtgaagtcggggaccggatgcgggacgttgggggtcgaatgcaatctgcgggatctgaaatcgcgatgtcattcggcgtagcgacagcggctttaggcggaggtcttgcggtttcaacgaaaaaagcgatggacttcgagcagcagatgtcgagcgtgaaggcggtcatgaatccggcagaagccaaccaatacagcgctgcccttacggaattagccattaaactcggtgctgatacgaaatacagtgcgcttgaggctgcgcaaggtatggaagaactcgtaaaggccggtgtatctacgaaggacatactgaatggcgcacttaagggcgcgctatcgcttgcgacagcgggagaattagagcttgcggatgcggcggaaattgcgtcgactgcactgaatgcgtttaaagacgataacattagcgttgcacaggcagcagatattctcgcaggggccgcaaactcttctgcaacaacggttggagagatgcggtatggtcttcaaatgacatccgcagtagcagccggtatgggactgtcttttaaagacacggctactacactagccctcttcgcacagaagggattaaagtag

SEQ ID NO: 2966 - DNA, 1050 bp, Bacillus licheniformis
tcaagaagtcgccaatatgctgaacgactggtacatactgatgaaaaaacgagacatttcaggttcaatcgaaatgaaagatgacatagataaagcaattgaaaagatggaagaagatcatgacgttcttctctattatcaaatgctggattttcgcttaaggcttcttcttgaagatatctcccaatcttccacagaaaaattggaagccatcagttttaaggacaaagatccaaaaagtacggacgataagctgaattattatttttatctgttcaaagggatttatgaagactacaagcaaaaccatacagaagcgcttaattttttcagaatagcggaaaaaaggctgagcgtcattcaaaatgaaattgaaaaagccgaatttcattataaaatcggtgttttgtattacaacttaaaaccgacatggctgtcgattcaccacatcaacattgcctcaggcatcttccaagggtatgacgggtatgccaagcgggtcatcaactgcaaaatgctgatcgggctcaattatattgaccaatttaagtttgccgaaagtgaagtattgttaaaggaagcaattgaaaaaaccgaaaaaatcggcgaccaatatcttttgccttatacctactataatatgggctttttgaagagtaaggaagataaacacgaagaagcgctgaagtattataataaagcttttgcaatcaaagactttgaaacgaaagccaagtatgcttaccttctatgtgtatatgaaaacacaaggtctcttttcaaaaccaacgatcccgaccaagcttttaaatggatcgacacaggctttaaaaaagctcaagaagtgaatagcgaaattttcgaattaaaattcaaaactttatatacattacattccgattgtcagaataaactggaagtaatcaaggactttattcaccaattagaagataaaaaagcatgggttgatctggaggaattgctgatggacgtagcgaattactatagggaaaataagttatacgaagaagccatatatttctacattaa

SEQ ID NO: 2967 - DNA, 762 bp, Bacillus licheniformis
aggtgaaaaagaacgaaaaacgcaaaaaggaatttccgcatatttatgtcattctggctgtcatgattggtcttatggcgcttgcgacatatatcattccggcaggcgaatatgaacgggtggaaagtccggacggcagggaaatgattgatccagcgtcctacaaacgggtcgaacagacgccggttgatattcttggcttgcttacggcggttccgaaagggatgacagaagcggctccgattattgtgtttacgtttgtgattggcggagcttttgccgttctgaggaaagcatctgtcattgagctcggcgtccgtctgttggccgatcagttcaggaacaagcctgttttcgttacgcctgtcttaatattcgttttctccggcatttcctgttttatcgggacgcctgagctttcgatcgtttatgtccctgtcattcttcctttgctgctgtccctcggatatgaccggatgacagcagcagcaatcgcattgtgcgggacgatcgccggctttacgagcgctttgacaaacccatttaccgtgggaacctcacaaatgatttccggtctcccgctttattccgggatggggtacagggcggtcatctttgttgtcgttacggcgattgccgctgtttatgtgctcaaatatgcggaaaagatcagagcgcatcctgaaaaaagcctgacgggcaaggaagcagtcgaacccgtgccggcttttaaagcaggcggacggaaaaaagggccgggca

SEQ ID NO: 2968 - DNA, 447 bp, Bacillus licheniformis
atgaaaagaattcttatagttcttgccggaattggccttttaggtgcgggcggatgcggaatgcttgatcaggtgaatgacggattgaactatacaaatgaagcggccggctatatccaaaaagtgaagacatttgcggaggaggcgccttccttggctgaacaggctgtaaacgacacgggtgcaaaagaaaagctggaaactcagcttgagtctatccagcaggctgcagccgattttaatgaattaacccctcctgatgccgcagccgaggttcataacaccatcgagaagcataatgaaacactgcaaaaaagcgctgaggatgttttgaaaagtgttgaggaaggaaaattaacagtcgagaagctggagcagtcagaattggtgcaaagcgctcagcagatcagcgatgtgatgggccagattgaaaaattgaccgaatag

SEQ ID NO: 2969 - DNA, 472 bp, Bacillus licheniformis
atgtttcataaaggtgcgacggccgtcgcttcggcaaagcattccggttactttgtcgccgtcaagcgggaaggcatttttcactattcacttgagcaaggctggaaaaggctctttcaattaaaaagcaaaatttgttccatcacctatatcggcgattatttattcggcgcaggggagagaggaacgattatcagatcgtctgaccaaggggcaacctggtcaatctcaagctttccgacaaacgccacgatttggtcgatcacggggagaacggacggctttgtgtgtgcgcatgggaagcattgcatttacatatccgacgatttcggcgtctcatggaaagtcgtcaagccgttttccggtttgagtcatccgcccgttatccgctctctgtgcctccatgaagagcgcctttacatcgggacgcttattcttgaattggcctgctgcgcttggggccttcgaattt

SEQ ID NO: 2970 - DNA, 682 bp, Bacillus licheniformis
  misc_feature (1)...(682): n = A,T,C or G
atggcacagattattaaaatacaggactgtatttcaaggtatgaacaagatccttatcattatatcaaccagtttatccgcttgaaaaagcagcgctggcagtcaattaaagagatggctgaaaaaaagaaagaaagctttcatcacgataaaggagccgccggtgatgaaacgtttggaaaaagaaagaatacatttacattaaagagaaaaaaagaagcatccgatattaataaaggaaaagaagccgatgaatggtttaacggactggacggagaaacggatgaaagcttgatcgcaagaattcctgcggcaggggaagaactcgtaccgttttttaaggaatacgtgtacgagtttcagctgaaatgggcaagctcgacaatctctgacatatccaggctttcccgggaaataaaaagcgataaaatcctgcacattttggcacagcagctcccggattcatatttcatcatgtatcggccggtgctgcaggtgaatcaggctgcggtagagctcagcgtcttgattctcactccccttgaaatctactgtatgtcatttcttgaaggtgagagggacagcgcatntatcggttccaaagatcgtntttggaaagaaaaaacgggtaggggcanggaacggtcattgttaaatccggctgtcgagctcctcaggacag

SEQ ID NO: 2971 - DNA, 648 bp, Bacillus licheniformis
aatatgccgatatcctttcgatcaatgtagggaagccagaggaaattcagtttcaaaataaagctgtgtctaccggaatatacaagaagccggcaagcggccccatcttcctgtcatctactaatttcacgggggacggacagggggatctcattcatcacggcggcgcggaaaaagcagtgtgcgtctatccgtatgaacattatctcttttgggaaaaggaactgcaaagaaagctggaatacggagcatttggcgaaaatttaacgatcaagggtctgctggaggatgacgttcatatcggcgacatctttcagctgggtgcagctgttgtacaggtgagccagccgaggcagccctgctataaactaaccgtaaggtacggtatgccggacatgatactgaaggtacaagataccggatttacgggtttttactttcgcgtgctgaaagaagggttcgtctgtaaggagcatggtctgaaacgaatctcacgccaccctaaaggcattacgatttcatacgcaaatcgcatcaagcatcatgaaaagaacgatattgagggcatcaaaaaacttctcgaggtggaggaactgtcggcaaattggcgtgcatcatgtttaaaacggctgaacggctttgagccgg

SEQ ID NO: 2972 - DNA, 405 bp, Bacillus licheniformis
atgaaagagttttgggagaacaaccttgtggaaatcgccgcgtactacagtgtttccgttttgtgtcttgtgatatttttatctgtgtttgaactcgtcaccacgtataaaaattgggaggagattcaaaaaggaaacatggcggttgcgatggcaacaggcggaaaaattttaggcatcgccaacgtgctgcaaaaatcgatcagccagcataattccctgctgcaaatgatggggtgggggctgttcggttttatcctgcttttgatcggctacttcatttttgaatttctgacgccgcgctttaaaattgacaaggagattgaaaacgacaaccgcgcagtcggcttcatttcattcgtcatttcagtaggcctgtcatttgtcgtggcttcgggtatctaa

SEQ ID NO: 2973 - DNA, 433 bp, Bacillus licheniformis
atgcacccaaaacaaatttgtgaagaccttgcctttttaggttcacctttagttctggatggggatgacctttatattgagcatccggagaacgtctatccagaacttgtggaatttgttcagtcacataaaaaacggatcatccagtatttaaaaggtgaatactcagtgcaggatcataaagtcaaacagaccattgataaaatcatcaattattttatgggcatagatcaagaaatgaatccaaaaatagacgactggttcaatcatgagtgggatgcggcaatcaaagccgcgagattgcttgttctattttgggagaacggctggagagatctgaacagctccgttgcgaattttgaggatgaagaaacggacaaactctctttagaaatctatgaaagggccatgtcgtactttaaggggaagaaag

SEQ ID NO: 2974 - DNA, 599 bp, Bacillus licheniformis
atgaaaaaaactccaatttatgtagaaatatgcatccaggcagaaatggagcggctatggcgctatacccaagacccaaccctccatcggcaatgggacttgcgatttacggacattacctatttaaagcgcagaccgggtgaacctcagaggttcttatacgaaacgagaatcggcttcggcttaaaaatctccggcaccggggagtctgccggaaacgtatttcaagatactggagacagagtctcgtcactcaagttcgctacaaaccacccgctttctgtcattcgcgaaggaagaggatattggaaatacagcgagagcgaaaccggaatcacgtttatgacacaatacgattatgacacccgttacggtaggctgggccggcttgcagatatggcattcaggccgctcctcggctgggcgacggcctggagttttgatgcactgaagatttggcttgaaaaagggctccatccaaggctgctttttcaaaaaacattggtctattggctcgtttgtctgctgttttctttcgtctggatttaccaagggcttgttccaaagctcatcatggctcaccctggggaaatcagcat

SEQ ID NO: 2975 - DNA, 792 bp, Bacillus licheniformis
agagaaattgaaaaacgacatagcgaagcaggagcaaagaaacgaggttgctcaagatgataaaccaaaaacaattcttgatgcaatgatgaaacataaagaatcgtttgaaatggctttgcctaaacacttggacgccgacaggctgattcgtttagcggttacagagttcaggaaaaacccaatgcttaaagaatgcacgcctgagtctttgcttggagccgttatgcaagcggcgcaagttggattagaaccggacgcgctggggtcggcctatcttgtgccttattacaacaagaacaagaacgttaaagaagttcaattgcagatcggatataagggcttgatcgaattagtcagaagatcaggccaagtaacaagcattgtagcaaatgaagtctatgaaaatgatgaatttgatttcgaatacgggataaacgaaaagttataccataagccgacgatggatgcagaccgcgggaaactcaaatgtttctatgcttatgcccgatttaaagacggcggccatgcttttacagtcatgagcgttgaacaaattaatcagattcgcgataaattcagcaagtcgcaaaagaacggaaagcattttggcccttgggctgatcattatgagtcaatggcaaaaaagacggttatcaagcagcttgtcaaatacatgccgataagcgtcgaaattcagaatcaaataacgagggacgaaacggtgcattcaagcttcaaagaagaaccaaaaccgatttacgcgtttgaagaatcgccagacattatcga

SEQ ID NO: 2976 - DNA, 645 bp, Bacillus licheniformis
atgttgaaaaagacattatggatgggtgcaatcctagcatcatttttgcttttctccgtgccggtcagcgcacatgtcacggtaaaaccgaccgaatcagcagcaggctcatgggaaacatacactgtcaaagtaccggttgaaaaagacaacgccacgatcaaggtcgttctcagcatgccggacggtgttgaatttcagcagtatgaaccggtgccggggtggaaaacaagcactgaaaccggcaaaaacgaaaaagtaacaagggtgacgtgggaagccgaaaacggcggcattcagcctggtgaattccagcagtttaccttcaccgccaaaaaccctgacaaagaacaaaaggccgcctggaacgcataccaatattataaggacggcacaattgtcgagtggaccggtgatgatgacgccgataccccgcatgcaatcacaagcattgtcgacgctgcaaaactcggacacgaaacggttgatgcacacggcgcttcaacgaaacaaaacgctgccgcagaaaatgaagacagtcaaggaggacaagggattcaaaccgcttccctgatcctgtcgatcctcgccgtgcttcttggaggtgctgcgctgctcttgacagtgcggaaaaagaaatcgtaa

SEQ ID NO: 2977 - DNA, 491 bp, Bacillus licheniformis
atggatgaaatcttagctcttacgtttcggacgatcgttttgtatttcatcatctttattttgtttcgcttgatggggaagagggaaataggcgagctgagcatactggatcttgtcgtttttatcatgatggccgaaatcgcggttttggctattgaaaatctcgatgaccaccttctccatacgatcatcccgattctcgttttgacgctgatccaggttatatttgcatatctgtcattgaaaaatcaaaaaatccgccggcttctcgatggaaaaccgacgattatcatagaccgcggaaaaattgatgaacacgccatgaggacacagcgctataattacgatgatttgatgacgcagctgagagataagaatgtggaacgaatcggggatgtttcatatgcgattttggagccgaccgggaagctttcagtgtttacaaaagacgggccgaacaaaatgatcgaactgccgttgattgttgacgg

SEQ ID NO: 2978 - DNA, 567 bp, Bacillus licheniformis
tgcaggaaaacgaaaaaagcggctatgacattgattatcacgaaaaagcgggaagcgactgtttaatcttttcgccccatggaggaagaatagaaggcggagtgagcgagcttgtccgagcttttaatgatgattattcaacttatttattcgaaggaaaaaaggatgagaacaactccgatcttcatattaccagcacaaactttgacgagcctctggcattgcagaaaataaaagaacaccgctataccatcgcattccacggctattcgggcgaccgtccgcacacgcttgtgggaggaacggacagaaagctggcaaaagccatcgtcaaatctctgaaaaagtctgacttttccgcagaattggtcaaagtggacgggaaatttgccggaactgctgaggaaaacatcaataatgaaagccagacaggaatgagcgtgcagcttgaaatcagcacggctcagaggaaagagtttttcgaagacttttcctataaagagagggaagagacaaaaacgagaacattccgaaaatatgtcaaggcggtccgcaaggtgctgcagg

SEQ ID NO: 2979 - DNA, 682 bp, Bacillus licheniformis
atggaaactgtgaaagaaattttggttgtctacgggcgaatcattaccatccttccgcttttattggttgtcacattgttcatgggaaaacgctcaatcggagaaatgcctgtgtttgattttttaatcattattacattgggtgccgttgtcggagcggacatagccgatccgaagattgaacatttgcataccgccgctgcggtggctgcgattgccctattgcaaagactcgcttcaaatctcatgatcaaataccgaacgctgggacgtctaattacatttgaaccgaccatcgtcatcaaaaacggaacgtttatcgtcggcaatctgaaacgaatcaaatattcagtggataatattctgcaaatgcttcgggaaaaagacgttttcaatgtcagcgacgtagaaatggcgtttgtagaggcgaacggaaatttaacggtatacaaaaagccaaataaaatggaaatcacagctgaagatatgggaattcaaaaaagcagcggcgaattttcatatccggtcatcgttgacggaaaagtgtacacgtctgtccttcagcaattgaatgtaacagaaagctggctcaaaaaccagctgaagaagaaagggcttgaacgaatggatgaaatctttttcgcttcggttaatcaaaaccatgaactgcatgtttcgctcg

SEQ ID NO: 2980 - DNA, 600 bp, Bacillus licheniformis
ttcgatgtatgaacgggtgatcgaggattttcaccttctccacccaaaactcaaggagcggcatcagctcactcaagaaaacgtgttcaaaggaaaaggagtgatgacggaaatttccggcggttcatactgggtcagactgttgttcaaagcgggaacggtcttccgctgtttttttcccgaaagggggaggaacgttccgttcacgattgaaaatcacattcggctgacgaaaaatgatacaccggcagccgtttggaacaggactttcttttttcaggataaacaaaggcatttcgatgctgtcatgatctatgataaaagccgtgttgaaatcatcgactatttcgggcatccgccaatcttaatctcaagcctgcggtttaaggcggaggccgacggctcattatcgattacttctgtcagacaatggctgcctttattcagaaaaaagctgccccttccaaagtgcttatacggtatttccagcgtgaatgaatcgtatgacgaagaaaaaggctgttttacaattgacgttcatgtgaaaaacccgctgttcggaacgctgtttgcctacagaggaacgtttaacagggagga

SEQ ID NO: 2981 - DNA, 1059 bp, Bacillus licheniformis
aaaactttagatacatatgggcgtcgcaaacagcgcaggctgtcggatcaatcttgatgacgatcattgtcatggtcgatgtatttaaggaaacgaactctgtattcggatccggtctggttttggctttatcctcgttcggcagtgtattaggcggagcgatcgctgcttttgctattcagcgtctcgatctgctgcaaacagcggcctggtcaacatggttcagagcggtctgtgcattatgcatcggcttatgccaatcgcttggcttaccctcttatatcatttatctgctgctatttttgcaaagctttgtcggctcctggtatactcccgcacagttaggtttactgtaccaagccattaaaaagcgcgattacgtggctgcatcgggaagcatcgtagcggtcaaccagtttgtccaggcggcaggctggggtctcggcggctttttaaccgttttggcccagacttatacgttgacagtgtttacagcagcactctttttcatatcagggcttttaatcagattgccggatttcaaaaaagcgattatccctcgtcaaaaagcccgcgcacaatcggtctggcgcactgtttacaggaagaaaaccgttttgctgcttacgatgatggacatgtcggaaggtttagcaaatgcagtctggacttccgccgttttgctggcttttactaaagaggcgctgaataaaggagaggcttggtggggattcatcaatgccggttattttttgggagcgattttgggcggcattctcgctgtgctcttttccaaccagctcaaaaaaaggcttggcctcatgattttctttggctccgtttcaatgggcatcacaacgcttttattcgcctattcgtccaaccccctcctttcggttatcctctgtatcatgatggggccgctttatcaagtaagagacgtcagccagacggttatccttcaagatacattgactgatgaagagcgtgcaccggttaccgccgccaaaaataccattttggctgcatggtctatcataacaatcgcccatcatgggg

SEQ ID NO: 2982 - DNA, 423 bp, Bacillus licheniformis
atggatcagcagcaattgaagaacaaggtgcttgatattctcgatcatcataaaatcggttcgcttgcaacggttgaaagcggcaagcctcattcccgctacatgacctttttccatgacgggctgacgctttatacaccgacaagcgatgagacgcacaaggcggaagagattgataacaatccgaacgtccacgtgctgttgggttataacggcgaaggattaggcgatgcataccttgaaattacaggtacggcaaagctcaaccattcaaaggatttaaaggacaaaatttgggatgaaaggcttgagcaatggtttgacggaaaggacgatccgaacttgaccgtgcttgagattgagccttcggaaatcagactgatgaatgaaggcgaaagcaccccggtcacgcttgacatgtag

SEQ ID NO: 2983 - DNA, 1200 bp, Bacillus licheniformis
atgaacttgatcaaatggattttgttttccgttatttcattcgccttttttcagccggcaccagccgctctattaaaagaaaaggacgactatactattcttgtttatatgattggttctgacatggaaagcgattttcatatggcaagcgatgacattcaggaaatgatggatgcgggttcatcttcaaacgtcaatgtcgttcttcagacaggaggagcaaaaaaatgggcgaacccgtcgatcagtcacaaggtgaatcagaggtggaaagttgaacatcagaagctggtgcccctcgaaaatgtcgggaagaaaaatatggacagtcccggctccgtcacagattttatcacatggggagtcaaaacatatccggctaaaaaatatgtattgatcttttgggggcatgggcttggctcagttgacggctacgggggagacgaaaacttcggcaataagaaaatgaaaataagcgagctgcagtcgggaatcaaaacggcctatgaacatacgaagcaaaagtttgatttaatcggttttgacaactgcaaaatggccgggattgaaacggcatatgccttgagggattatggtaagtacatgctggcttcagtcgactatacgaatcaaaacggctgggattataaaagggcgctgcagtctgtacaagacgacccttcaatcgatccgaaagagcttggcagggaaatcgctgcaggctacgtacagcagtcaaaagaaaacggtgaaacagaagacctgcagcagtctttaattcaattgaaccgtgtcaaagacgctgtcgatgccctcgacagattgagcgtaaacatgaacctggcattgaaagagcctgacggaaagcgcctgctccactacgcgcgtctcgctgctgaagattatgcagatgaatcggatatggttgatttggcggatttgtcaagcttgatcggtcagcagatcggagccgagaaagaagcaaaagaggtcgtaaaatccgtcaagaaggctgtcatcatgaacatcaaatctccggagcatccaagaggaagcggcatgtccgtttattatccggccagagacaaccataagcggtttgcggaaaaatcgaaaatataccgcctgcttgacttcagcagccggtatcaaacattcatcaaagattactcgcattcaacatttaactttgatctatag

SEQ ID NO: 2984 - DNA, 1200 bp, Bacillus licheniformis
atggatgtttccgtcaaactcgacgccgaattcaccagacgggaaacggaaggcgtcgttattttcaatacggacagcagatcgctgccagccgcagaggcgaaggcgactgtgaaaaacatcagtgaacacatctcccggcaatcgtttgatatcgtctacaaaaaaatcgacagcacgatgagaggaaatatcggagccgagcttcaagcgatgtacgaagtgtttcagccggactttgtgctgatcgctcccggctaccctcaaaacggacgccaggttatcggcggcatccattatgtgaacggcgtaaagcttgaagaaaccgaagcggcaaacgatccgaaaacgcctgtagccgagtcgaatattcaaagattaatagaaaagcagactcgaaataagagcgggcatttatcatatgaagacatccgccgcggacacgggcatgtccgcaacaagctggaacgctttcgggcggaggggatttcatatgtgacggccgattcggttcacgaatccgatctgcaggggctggcgcttattctggagagtttgccgtattctatcattttggccggttcggcaggcttgatgagctgtctgcccaaagcgttcaatctgaaagaaagggagctcggtcaaaccgttccgtcttccgaccagccgatcatgtttgtcgtcggaagcatgagtcggacggggagggaacagcttcacgaactattcgccggacgtgcggctgaaaaaattgaaatgagatcagagcgcgtgctgtgcggcggagctgagaaaagaaacgagttcgaacggctgaaggaaagggcggcggacgtccagcgccgttcgaaacacatcgtcctctgcacctcagacaatgcggcagagacacagaagattggtgaaagccgcggactcaccccagttcaaacgagcaatgcggtgtccggtgcacttggcgaatttgcgggcgagctgattcaagcttttcatgtgaaacggctgttcttaaccggaggtgacacggcatatcaagtgctgcatcagcttcggattcatgagatacgattgctggacgaagtagagcccggcattccgctgggagcagccggtgaagaattgtacattgtgacaaaggccggaaattttggctcgcgttcggtgatggcaagtgcggcaatcaagctacaaggaggataa

SEQ ID NO: 2985 - DNA, 411 bp, Bacillus licheniformis
aagaaaggagcggattcgtatgttgaaaaaaatacagattcaaacaaaccggcgcgatgaaatgcttgatatcacaaatgacgtccaaagattcatctcagaaaacgatgtttccagcggcgctgttatcgtctactgtccgcatacgacggcgggtataacgatcaatgaaaatgccgaccccgatgtcaaacgcgatatgctgagaagattcgatgaagtgtatccgtgggaacatgagcttgaccgccatatggaagggaatacagcggcgcatttgaaagcgagcacggtcggggcatcgcagcatatgattattgaagggggcaggcttgtcctcgggacttggcagggcatatatttctgcgagttcgacggcccgaggcaccggacgtgctattttaaaatttt

SEQ ID NO: 2986 - DNA, 526 bp, Bacillus licheniformis
ttgcttaaaattttcaccactcaattgacgggaatcttcaaccggattcaagagggcgaggcccaatcgatagaggacggcgcccgcttgttggctcaggcggtcatcagtgatcattcggtttatgtatacggaaaaaatgaattggaaggcattttgaaagaagcgatgtacagttctgaaccgttcccctcagtcaaaccgctgcagaaggacgaagaaaactggcccgattttgaaatgacggacaaagtgctgatgttctgcgccggttcagcggatgacgaagaactgaaaatggcggaaaaactgtatgaaaaaggaatcggacttgttgtcgtctccccttcgggaaaagacggcgtcccgatcgcatccttcgccgatgtccatatcgattcaaagctgagaatgccgcttcttcccgatgaagacggaacaaggtacggatttccgtccctgatggtcagcctctatatttatcatgccctatcctttacattaaaggaaatcctccaggaatacc

SEQ ID NO: 2987 - DNA, 573 bp, Bacillus licheniformis
atgaagaaatggaagagcttatttttaattttagcagcagtcaacgtcatgatacttgccgggattttcattctcatttccctgcccggcggacaaaaggagccgccgcgtccgactccgagcgaatatcaattgaacgtgacgagcacgaaagattcattggccgcattcatcaacacgtacttggaaaaggagtcttcgcctgatcttgactatcaaatcgaaatcgatgatgaattccatatcgtcggtgcgatccgcgccttttcctcgacagtcgatgcgagggtgtcctttcggccgacggtggaaaaaaacggagacgtggtccttgacgtgacgagattttcgatcggcaagttgaatgttccgatatcgatggtgctcaactacatggatcaattttatgaccttcctgattttgtacacgttcgttcagacgctaaagaaattcaagttcgtctgtcagagatgccgcttaaaaacggaatgtatgtgaaagcaaaagacattgatttagaaaaagatcaaatcgaatttgtttattacaagcctgcacaaacagattcataa

SEQ ID NO: 2988 - DNA, 420 bp, Bacillus licheniformis
ggcaaagcctgtttgtgtttgacgcctgcgtcattacattatcccttattttttacctttcctataaggaagcaatgtacacgcttgttgccgtatttgtcgcctcaaaggtcatcgactttatgcaggaaggcggttatgccgcaaaaggcgccaccatcatctctgaaaagaacgaccagattcagcgcaaaatcattgaagaaatggaaagaggcgtcacagttttaaaaggtcaagggtcttatacgaagacggagcgggacattttatactgcgtcgttccgaaaaatgaggttttccagctgaaaaatgtgattacttcggtcgacccgcacgcttttgtagccgtaagcgacgtacacgacgtgctgggagagggttttacgcttgatgagaacaaaaatcccatcacccgct

SEQ ID NO: 2989 - DNA, 393 bp, Bacillus licheniformis
ttgaaatcgttcaaatcgtaggactgggaatgatcgccaccttcctcagcttgattgtgaaagagcaaaaaccgacgtttgcttttttgattgtcgtttttgccggctgcacgatttttttattcttagtagatcaggtctacgaaatcattcggatgattgaaaaaatagctgccaatgccaacatcaacatgatgtatgtcgaaacgattttgaagattatcgggattgcttatattgcggagtttggcgcccagctgacaaaggatgccggacagggtgcgattgcttcgaagatcgaattggcaggcaaaatcctcatcttagtcatggctgtgcctattttaaccgtgattatcgaaacgatcatcggactcatcccttccatgtctt

SEQ ID NO: 2990 - DNA, 543 bp, Bacillus licheniformis
atttatctcacctagaagaatacgtcaaaaatatgtaccaaaagttcggtttttttgaacctcaccagattgatatgaatcgcatagccgctcattttaatatttggattcactatgaaaatgtcaacagcatgatgattaagcatgacggcatgtacagcattattctcaacagcagtctttcaaaggaaaagcagtgggaggactttgcccatgagctgtgccacgtattaaagcacgccggaaaccagctttacatgaatcagatgttcagggagctgcaggagttccaggccaatcaatttatgtaccatttttgcgtccctacttttatgcttttaaaaatggattttcctcagctgcgatgccaagccgctaaaatgatcgccgacctctttaaagtcacggagtcgttcgctgtcaaacggatcgagctctttgaaaaacggcaggccggaatccagtttcatgaggcgtggatggcaagcctttcccaagagagcgaatcggcgaatgctccacgctttgaagaagtagacgaac

SEQ ID NO: 2991 - DNA, 573 bp, Bacillus licheniformis
atgagccaggaacttgaaatcgaatttaaaaatatgctgacaaaaaaagaatttgagaaaatcaaatcatattatcaattttcctccgagcaatttgttatacaaaaaaaccattattacgatacgccttccttctctttaaaagaaaaaggagctgccctaagaattcgcgaaaagcagcagcgatttgtcctgacattaaaagaaccggcgcctgtcggactgatggaaacccaccaggagctgacccggaagcctgaaatcgaaacgttcatgattccgcatgggccggtatacgatcgtctgaagcgtctcggcattgaagcggacgagctcatccttttcggaacgcttgcgacaagccgtgcagaaaaaaaattgccgcagggcttaattgttttggatcacagccgatacttaatggtagaagactttgaaatcgaattcgaagtgacggattatgaacgcggaaaacgggatttctctgaactgctgaaatcgttcggcatccctgagcgtgaaaccaaaaacaaaatcgtccgattttatgagcaaaaacttaaagatcaataa

SEQ ID NO: 2992 - DNA, 374 bp, Bacillus licheniformis
atggctttattacaaaaaacaagaaagattaatgcaatgctgcaaaatgcggcagggaagccggttaattttaaagaaatggccgaaacgcttcgcgatgtgattgattcgaacattttcgtcgtcagccgcagaggaaagcttctcggtttctcgatcaaccagcagatcgaaaatgaccggatgaaaaaaatgcttgaagagcgccagtttcctgaagattatacaaaaagcctgttcaacattccggaaacgtcatctaaccttgacatcaacagcgaatacacagctttccctgtggaaaaccgcgatttgttccaagcgggtctgaccacggtcgttccgatcatcggaggaggcgaaagactgggcac

SEQ ID NO: 2993 - DNA, 419 bp, Bacillus licheniformis
atgcggaagcccacaatcaaagagctcatctttcaacatatgaaggaccatctgtcgatctatttatttgtttctgtgctgttcttaatgggtgtgattttcggcgcggtcatcgtcaacagcatgacgatcggtcaaaaagaagatttgttctactatttgaatcaattttttggacagctttccgaaggaaaagcagccagctcaaaggaaatgtttttgcagagctttcttcataatatgaaatatttaggcttaatgtggattctcgggatatccatcatcggtctgcccgtcatttttatcatggtcttcttaaaagggatcgtcgtcggatttacagtcggctttttggtcaatcaaatgggaatcaacggctttttcctgtcttttgtctccgtgctcccgcaaaatattct

SEQ ID NO: 2994 - DNA, 516 bp, Bacillus licheniformis
acggtgtgatcatggttggaattattctggttatcaatattatatatgtaacgtttttaacccttcgcatgatactgactctaaaaggccagcggtatctcgccgcttttatcgggacaatcgaaatgcttgtttacgtcgtcgggctgggtcttgttttagataatttaaatcaaatccaaaacgtgatcgcttatgcggttggatttggaatcggcatcatcgtcggcacgaagattgaagaaaagctcgctttgggctatattaccgttaacgccattacgaaagagcttgatttggatctgccgaaacagctcagggaaaaaggctacggggtcacccattgggtcgtcggcggacttgagggagacagaacggcgatgcagattttgacgccgagaaaatacgagctgcagctgtacgaaacaattaaatcaatcgattcaaaagcatttatcatttcctacgaaccgaagacgatacacggcggattctgggttaaagccgtaaagaaaa

SEQ ID NO: 2995 - DNA, 429 bp, Bacillus licheniformis
ttgaaaaactgatcagtagttatcactggatggcaaaagaggttcagagattgcaaagggtgctttacggttctgacatccctatgcgaagctggggtgtcgctcaatatgggttataagctgccatgccaaagggaagccccggcaagagtcaggccgagctgagggatatggacataagacaggaacgtctatacaagcgtctagaatacttcgaagaacgtgtatacgcgattgacgcggcagcaagaacgatcgaaggggaacagcataaagtgatttatgattgcatgatggaagggatgagctatcgagccattggccttcatcttggcatatcgcgggaaaccgtcaagcggatgaaagacgagatcatcaaccagttgtgccaaaattgccgaattgtgcaggtgttgaatcctaaaaaaa

SEQ ID NO: 2996 - DNA, 615 bp, Bacillus licheniformis
cgcttcatccgcagacaattacgccaattttgccgagcttgccgaacatgaaacagaaggagaagattaccaaatcgaatacacagacatgggcaccgaactgttgattctttcaccgcacggcggaggaatcgaaggaggtgtcagtgaacttgtccgcgccttcagcgccgattattccacttatttatttgagggaatcaaaccctcgcaaaactgggatctccacatcacaagcaatcattttgatgaacctcaggccctcaaagcggtcaaagagcacagctatgtgctggcttttcatggatatcatgacatcgttgaacatacgcttgtggggggaacggatacaggaggggcgaaagcgattgtcagagcgctgctgaacaaaggtttttcggcggagctggtcagcccgagccaccggcttgcaggaggaaatcctgaaaatatcaataatcaatgcaaaacaggtcaaagcattcaattggaaatcagcacgcctcaacgagaggcttttttttcggagttcggcctgtggacgcgggcaagttctaaaaatgagacgtttcaagcgtatgtctcagctgttaaagaagttctggaaacgaggta

SEQ ID NO: 2997 - DNA, 429 bp, Bacillus licheniformis
atgctggaaggatggtttttatggctgatgctcgcttggatcgtcatcatgatcgtcctcttgtcaatcggcggttttttcatgtttcgcaaatttttaaaaaggctgcctaaagaagatgggaaatctgagctggactggcaggattattatattgaacagacaaggcatttgtggaatgacgaagaaaaagaactgcttgaggaattggtttcacccgtacccgagctgtttcgcgatgtagcaaaagcaaaaatcgccggtaagatcggggagcttgcattgaaagaaaaagcaggcgccatcgaccgggatttaatcatcagaggctatattatggccacaccgaaaagagaccataagttcctcgtgaaacgtttaaaagaaaagaacattgatcactctacatatcaagagctttttaaataa

SEQ ID NO: 2998 - DNA, 480 bp, Bacillus licheniformis
atggcagctcccatcaccgccatccgcaaagaagaaaaatctgaggagcaaataaagcttgaaaaactcgaagaactcaaagcccttttggctgaacaggaagccgccgtttcaaaaacgatgaagcttctcggcgaactgaacggcctcgggatccttgatgccgcagacagcatgatcggcgcgaaggaagacatcgccaaaatcgtcctcggccagctgtccaaagagccggccaaaaacctgatgaatacagccattgcagcaggcggcgctctctccaaagccgaaccggaagtcatggggaaacttgtagaaagcatcgtcgccggcacaaaacaaggagaggactttttaaaaagcgataaaaaaaccggagtcctcgatctgctgaaagccatgaacgatccggacatcaaccgggccgtcggcttcggcctgcaatttttaaaaggcatgggaaaagcgctgaaagaataa

SEQ ID NO: 2999 - DNA, 1155 bp, Bacillus licheniformis
atgctcatgctctcagcctgtgcgccgaattttgggggagaagaagagcaggagatggtgcagaaaacggataagtcgaaagaaaaagccatcattccgaaatacaacatctccgattcttattataaaatggttcttcctttcaaggcggggaaagcccgcggcttgacgaccgaacgcctgaatacgcggctggatatcgatgaatttgagacaggcatgatgcgccttgcgcaagattcattttctactgacgattacctttttcaagaaggacaatacctggatgaggatacggtatcgagctggctcgcccgcaaaaaaacgggggacgacttgaaaaaagcggagaaagacgataaaaacttcaaaaacctcggactgaacccggccctttccggaagcggatcaacagagaagcaaaacgaagaaagcccgatatacctcgcccatatgcttgagcacgactacctcgtccgcaaagacaaggatacgattgagctcggaggcgtcgtgatcggccttgcgctgaactctgtccactactaccgcgaaaatgtcggcgacccgcaaaaagaagtgaccatcagcgacaaaaagctgaggcaggaaggcgaaaaaatcgctgaagaagtggcgaaacggatcagaaacatggatgatctaaaaaatattccgctgacgatcatgctttacaagcaggcgcctaagtcatcgatcgtccctggaaactttatcgccaaaaccgatgtgaaagcagggacaagcgagatcggcggctgggataaaatcaatgaagagtacacgttcttcccttcaacagaaggttcggagaagcatccggatgacgcggagctcttcaaacgctttaaaaacaaagtcgatacgtattttccaaactacacaggggttgtcggcacggctctctataaagacgaccaaatgcaggacatgaaaatcaacatcccgatgcagttttacggcaaaagcgaagtcatcgcctttacccagttcttgaccggtgaagtgatggactactacggcaaaagcggactgaacgttgagatcaacattaattcgtcagccgggcaggaagccgtcattctgaaaaagccgggagacaaagaaccgaccgtccatatttatgattcataa

SEQ ID NO: 3000 - DNA, 1155 bp, Bacillus licheniformis
atggaactatttgatctgaaggcaaacttaaacactgtaggaacacaattagcatcggttgaaaaggaaatcatgaacaaagcggctgaccctaacgcttctatcgatgaagtacggtctctaaaacaaaaaagagacgatcttaaagagcgtatggacatcctgcaaaatcaacacgatactttagagcgggaacaaaaagctaaaattcaagcaagtcttgaaaaagcaaaagcaggcgcgtctgctggacttaacagcgaagatccaaaggttaagaaaatttctgctaaagcaggcttaatccgtgcaacaatgagaaaagaggtaccggctcctgaagtacgtgctgcgctaggagataataacggaacaggtggggagaaactccttcctaaaacagtttccgaagaacttattcacgaaccttttgtaaagaatccgttgcgtgaactttcaacgtatacaagtgtaacaaatctcgaaatccctaaagttgatttttcccttgacgatgatgatttcatccaagatttacagactgctaaagaacttgaagtagacggagatgtggttactttcggacgccgcaaattcaaagttatggcgaaaatctccgaaactattttggcggctactgatactgatctggtcgctacagttgagcgcgctttacaatccggcctagctgcaaaagagaaaaaagtttctttcgcagtaacaccgaaacagggagaagaggaaatgtccttctacgctgccggaattaagcaagtcactgcggaagataaatataaagcgatcaaaaaagctattgcggatcttccagaagacttccgtgaaaacgcaaaagtaatgatgacatacgcagactatctcgaaatcattgaaactttggctaatggaagtgcaactctttacggtgcacaaccggaacaaatcatcggtaaaccagttgaattctgtgatgctgcggttgatcctatcgtcggtgacttccgttactctcacttcaactacgatccggcaatcacttacgaaagcgacaaagacgttaaaactggcgaaaatgtatttgttcttactgcgtattttgatcacaaaatcaaactgaaatctgcattccgtatcgctaaagtagacactactccctaa

SEQ ID NO: 3001 - DNA, 444 bp, Bacillus licheniformis
ggtcaatgcgcgcgctgagactttggcggagaagccgagctttcgaaagccgctgatcagacaaaggtgcctcattccggcagacagtttttatgagtggaagcggaccgatgcaaagacaaagcggccgatgaggatcaagctcaaaacaaatcgactgttttcatttgctgggctttgggagaagtggcagcctgcaggcggcaagcccgtctatacatgcacaatcattacgacaacgcccaacgatttaatgaaagacattcatgaccgcatgcccgtcattcttgatcgccaggctgaaaaagaatggctgaatccgaagaatcaaaaccttgcatacttagaaagccttttaaaaccatatgcgtcaaaagagatggaagcgtatgaagtcgcgcctctcgtcaattcaccgcatcataattctcctgagctcatcaa

SEQ ID NO: 3002 - DNA, 442 bp, Bacillus licheniformis
  misc_feature (1)...(442): n = A,T,C or G
atgaatcctttacaggcgtttgaactaaacgagatttcaaataatagcctgcagcaggagagccgtccacagtttgagattacggacatgaatagtctaaattgggcgtttcggaaaatagctgctttaaagacacaggaaaaagaaatcaaggctctggcggcaacggaaaggcagcgtatcgatgaatgggaaactcaggagctaaaacctctcgcggacaatctggcgttctttgaaaaactggtcagcgtttatcactcaaagcagctcgttcaggatcccaaaagcaaaacactttccacaccttacggtaagtcaaaaagccgcacaattaaagagcagcctaagccaaccgataaggatcagcttctncagcatgtgaaagaggccggtctcactgaanttatcanagaagatgtcaaatggggcgaccttaaaa

SEQ ID NO: 3003 - DNA, 599 bp, Bacillus licheniformis
gtgcgaatcttttttttgatcctaattcaaaccgttatgctgctttcagcctgcggcattcaaaataatgcccgaaatgaagcaaatgagcttcccggcaacagaccgattcatgtaaaaaacagcgcccaggagccggtgaaccgcgaagacggacaagccatctcacggcgccttgtaaagatcaccgaaagcgttccgggtgtcaatgatgcgaccgccgtcgtgctaggcaggctcgccgtcgtcggaattgatgtgaaagacaatttggaacgcagcaaagtcgaatccattaagtattcggtcgctgaagctctgcagaatgacccttatggagcaaacgccgccgttgtcgcggatcccgacactgtaaaccgcctgcgggcaatgggcagagaaattcaagcgggacgtcctgtcaaagggattctcgatgagctggcagccattgtcgggcgcgtccttcctgaagtgccgaacgacgcaacagacaaccagcaaacaaatcctacaaaatccaacaacgaccagctgaatgagagaaaccaaaaacaactcgaaaagaagcagaataatcaatcgaacaaacatatgaa

SEQ ID NO: 3004 - DNA, 425 bp, Bacillus licheniformis
atgcgaaatgaaacccgcacgcttttactcaaccctgatctaaatgttgaagcctaccgctttaaaggcattatccagaagtttccgaatcacttccacgagtattttgtgattggttttattgagaaggggcagcgctatttgctttgcaagggagaagaatacatcattaatcaaggcgctctcgtgcttttcaatccttatgacacgcacagttgcgagcagattgacggaaaggcgctcgattaccgctgcattaacgtgatgcctgatgttatgagaggatttgtgaaggagatcactggggccgacagcctcccatatttcacggagaatgtcttgttccgccatgagctgaacgccagcttgaaggagctacacattcaaatattgcaaaaagaaaaagccttgaaaaaagaggagct

SEQ ID NO: 3005 - DNA, 438 bp, Bacillus licheniformis
atggaacgccattattatacgtatttgatagaagaggaatttgccagccattattttggaagagagtccgtcatgttcaaactgttttacgattatcattggacgagccccgatcaaaagtctcaattagccgcgaaacagatcgagtttattacaaaaccgattcccgctgctcatatacacaaaagaatgaaaatgaacctctgccgggaagactatacacaggttgactatgtatacagattgattgttccaaaaggaagcgcttcttttattatcaaagaccgtcatattgagattttggcaaagggtccattcgatgccgaaacggttttctttgaggtattgcgaaaagtcagtccgtgttttcttgcgatggattttaatatgaaacgttatggctggctgaaccctgtgaaagaaagaaattttgtataa

SEQ ID NO: 3006 - DNA, 1137 bp, Bacillus licheniformis
atgaaaacttatgacgcatttccagaaccaattggcggctatactgtcggtcgaacccagatggattttgagtacacggcatcagatcactcaaaaagagaactgacggcgtttgtgtactatccgtccgacagtagcgaaggtaagactacatcaacgtacatgtttcctgaagtctacgagatgtttaatgagcagccacttgtcactgcgttgaaggatgttttctctatagatatcaagacccagtgttacgacgaccttgctctctccgggaaggaaaagcgctatccggtattattctatgtttgcggcgggggcggttctccagaatggggtacagtgatctgtacagacttggcaagcatgggatatgttgtggtaagcatcggccatcagaatagcacgatgtataagcgtaaagatgggcgcctgtttaatgtatcaaaggatttttcggatgtcattatggcgttttctgaagatccggagatgctggcgttggctggtaagatggagatgcggcctgacgatgaaactgccattgagatgtgccataacgtgcttacactgccgatacttgccaagttaacagagtatagtgagttacaggcagaagatgtaaggtatgtagccgattatctttacaaactggactctggagaactgaattccatctttaagggcagattgttgcttgacatcggcatgggcatagtcggacattcttatggagggcctacgacggcgattgtttgccgggacgacgaccggttcgcctgcgggattggcttggatagcggtgcgttcggccttctcgacagcgaccttaagaaacccttcttgctactgttttgtgaacctaactataacatgaatgcgataattggcgctaacaatagcatggaaacctattatttctctgttgatcgtgttgcgcatttagattactgcgacatcgtgtttaccagtgttaatgaggaactcagaggtgaacgggatgctatggagatgcgaaatcttgttacagactatacgaagaacttttttgatcattacatactgctgaaggctgcaagtgtggaaagtctggcatacgatggcgtggacttgatcaagaagaccagcaacaagtga

SEQ ID NO: 3007 - DNA, 579 bp, Bacillus licheniformis
gatgtacggcgcgtgtgaagcgatcatgaaaatcgcctggctgaacgggatctgggttttattcacgctgggaggaggcattgttttcggctgggcgccgagcacggctgcgatgttcacggtcgtgcgcaagtggctgctcggccggacggacgcaccgctgttcaaaacgttttatcaaacgtataaaaaagagtttttcaaagcaaacggacttgggctcatcctcattaccgccggaacaattttattcgtaaactatcaatttttccgcgtccgtgcggatttattttcgatcatgatcagctatgccacactggtggccgggctcatctatctcgtggttttcatttatatttttccgctttacgttcatgttcagctgccgtttgtccgctatttttcacaggctgcgctgatcggtctcgttcgccctttgacgacggccggaatggctgctgctggttgcttggtcgtgtatgtgctgttgacggttccgggtctgatcccattttatggtgtcagtttgtttgctcttgtatcgatgtttatcgcacatcgctgttttttgcgtctgga

SEQ ID NO: 3008 - DNA, 417 bp, Bacillus licheniformis
ggcgttgctgcaggcgaatcctggcttaaacggcggccaagtgtccgcgggccagtcgattatcattcccggcatcagaaatccggacacaattccataccggattgccgtgtctctcaacggaagaacgctcagattgtatgagcgagacagacttgtaaaaacatatccgattgccgtcggaaaaatcctcacacagacgccgagaggcgaatttgtcatcgtcaaccggcagccaaatccgggcggcccgttcggcgcctactggctgagcctgtcaaaacagcactacggcatccatggaacgaataacccttcgtcaattggcaaagctgtttcaaggggatgtatccgcatgcacaatcgggatgttctggaacttgcttctatcgtacccaacggaacccgagtgtccat

SEQ ID NO: 3009 - DNA, 562 bp, Bacillus licheniformis
atgctgaaaaaacaaacggtttggcttttaaccatgttaagtctcgtcgttgtactgagtgtctactacattatgtcgcccgaaggagaaaatgtcgtcacggttgatgacaaggaacaagttgccgctgaaaaagaaaaaccgatgaaagaagagcctgccaaggatggcaaagatgataccgcgcctgctaaagacaaaactaaagggaaagatacaaaagataaagaaacgtctgcgagtgagcagaacggagaggttgtcacagaggaatcatcgggtgatgaagatttattcacaacataccgcatggaaatggacgatcagcgcagcagggagagggaggaattaaccgaaatcgtcagaagcgataaagcgacggcaaaagaaaaaagcgaagcttacgacaagatgacagagctcagcgaagctgaaggaacggaaaagacccttgaaaccctcatcaaaacaaaaggctattaagacgccttggtcaacgccgacggcgataaagtcaatattacggtgaaggcgaaggagcactcgaaagccgcctgcaccg

SEQ ID NO: 3010 - DNA, 612 bp, Bacillus licheniformis
atgaaatcgaaatttgctgctctagctgcgtttttaatctgcatgctgccggcggcaagaatcgagcatgctcaagctgtcatgttgttctcgaaaaaagataaacaggaaatggaacggctgatggaaagccttaaacaagaagaaaatcctgctttttcccaattgacagatgagaaaagcttcattgaagccgcgcatctgtcagctgaagaggaggaggaaatagaagaagctgaagaagagacgactgatcttacacataaagaaaaagatcttttatcaaggcttgtacacgccgaagcgaaaggcgagtcatttgaaggaaaagtggctgtcgccaatgtcgtcctgaatcgggtgaaagacagccgatttcctgacagcgtaaaaagcgtgatctatcaaagaaacgcttttgagcccgttctaaacggcagcatcgagaaaaaagcagaccgcgaatcagtggaagctgtggaagaagcggtagatcaaaataaaaaagaaacagaagctttatttttctataatcccgacatcgcttctgatgactggattaaaacgagaaaagtcgtgaagcgcatcggcaatcatgtctttgcgatctag

SEQ ID NO: 3011 - DNA, 414 bp, Bacillus licheniformis
tgaaaacctgcatggaaaacttaaaagaaatgattgatgtcaataccattatcggagatcctgtggaaacacctgacggcagcgtcatcctaaccgtctccagagtgggattcggctttgcggctggcggaagcgagttcggcggcaataaaccggccgaatccaaagcgagcgatggagaccgcgaacgaaaagaatcgaagctcccgtttggcgggggaagcggaggaggcgtatcgattacgccgattgcttttttgattgtcggatcatcaggcgttaaagtactgcatttggatgaaaacacgcacgtcatcgataagattttagactcagctccgcaaacgatcgaacggattcagcatatgtttaagaaaaacgataagcagaagcaaaatatgaaccgtcaaaacc

SEQ ID NO: 3012 - DNA, 1119 bp, Bacillus licheniformis
atgtcaagcctaccgatcaaggcgtataaaaattatcaaccgattgagtctcaggcttccgagcttctgacatacgcgccgaatcataacatgacatccgggcaatttatcggccttttggagacgcatcgggccgtatatggcaatgcttacgcaataaaacggtacggaatgcgttatgaagtcgttggattagaggttttggatccttcgagagtgcagccggtgattgaagagactactcgggatctttggtacgagattttaggagacaacggaaattatttcgttcacaacatggacatgattcacgttaaaaatacgtcggtagacggtctaaaaggaatctcaccgctaaaggttctgcggaacgccctcgactttgatcgagatgtccggcttttcagtctagaacaaatggatggagcaaagatatcattcattttggaattagcgaaccaactcgacgatacgcgcaaagaaaagatgttagagaactttaaaagtttctataaagacaacggcggcctcttaattcaggaaccaggggtaaaaatccgcgaattaaagaaggaattcatcgatacaaaggcgtatgaggtcgaaaaagtgacacgttcaagagtcgcgcaggcctttaatattccgttgtacatgcttggcgagacacagggcagcgtctccaatatggagcaactttatatcgattatgtacaaggaacgctaatgcctatcgcaactcagtacgaaaaagaattcaaccggaagctgctgactgaaaaggagcgcaagtccggttattattttaagtttagtatgaacgcgttattgcgcggagacatgcagacccgcggtaatttctatcaacaaggcatccggagcggctggtttaagccgaatgaggtgcgtgcatgggaggatttgccgccagaagagggcggagacacgctttatttaagcaaagatttatttccaatcgaccaggttgcgcaacagaaaatcacatcggctgatgccccgacgcctccatcgttagaaattaacgaagatgataacgaggactcgaaaggaggtgaggacgataaagaagttctgggaaatcaaagcggcgaagaatga

SEQ ID NO: 3013 - DNA, 618 bp, Bacillus licheniformis
ctttcttgctgctggcatttgccgtcagcttggacagtttttcagtcggatttacttacggattgcgaaagctgaaaatcccatttaaagcgattttgattattgctttttgctctggtgccgtgatgtatattgccatgatgatcggaacccttttggcgaaattcctgcccgttgtcgtaacagaaaggctcggagccgtcatcttaatggggatcggcgcatgggtgctgtatcagtttttcaggccggagaaagaacaggatctcgtcttctctgaaaaaacgctcattaaccttgaattgaaatcgctcggaatcgtgatacacatattaagaaaaccgacaagcgccgacattgataaatcaggaatcattaccggtatagaagctttccttctcggtttcgccctctctattgacgcgttcggcgcagggatcggcgcggccgcgctgggcttttcccctgtaccgatgagcattacggtaggcatcatgagctcattgttcgtattttgcggaatacaggcaggccgatttttatcgaaatggaactggatggataaactgacctttcttcccggtatattgctgattatgatcggcatctggaaactgt

SEQ ID NO: 3014 - DNA, 535 bp, Bacillus licheniformis
atgaaatttaaaaaaaatcagtttcagccgcttcaggagcttgagatgccggatttccggcagcaaatgggccccaatccttatccgcagatggggcagatggggcaaatgtaccagcagcagggacagcagcctttcacccaaatgggagggcagcaatcgtatcagcagcccggtccccagctgacccagccgcagccggcaggcgtccaggtccctccaatgccttcaggacagcagccttcaccgagcatcccaggcatgctgccgcttgagcaatcctacattgaaaacattttgcggctcaatcgcggaaaagtggcaaccgtatatatgacattcgaaaacaatccggaatggaatgcgaaagtctttcggggagaaattgaagcagccggccgcgaccacatcattttaagcgacagaaaaacgggcacacgctatttgctgctcatggtgtatcttgactatattacgtttgatgagccgatcacttatgattatccgtattcaatggcctcatatacaccaagat

SEQ ID NO: 3015 - DNA, 1116 bp, Bacillus licheniformis
atgtacctgaataaaaagagcgatattcctaaattaacagataaagagtattattttcttagccaaaacacatatagtaccgataaaatgaaagaagcattcaaggaaagaacacctatagagagtaaatcaaataaggctttttttgttgataaaattaaaagggactctgacactggacttgatgcgtatgtttttgttcaagcaaagaaaaaggacggtaaatgggttaaacctaacgcaccagaaaacgtcgtcgtggccttcgctggaacaaatcctaaagaacagttttttcaagatgttattgatgcagacggcggtaacgttgttatgggtcttgatccgaaaaagaaatcgcaatacataatcgaaaaagatgcgaaggatacatcaaaaacaataggaaaatacaacgcaaccccctcacaagacgcgatgcttagcaccggtaaatacaaattaattacgaaaacgtcccaaatcgggcaagctgatgatctggtacgggaagttaaacaaaagtataaaggcacctcgacggttatttcaaccaccggacactctcttggcggcgcagaggctgaatacagcgctgtgaacaatgatatatacgcagtcgcattcaacaatccttccgtcgttaaattgcattctgaagaaaagcaaaaggagatccgaagcggcaaatatgactcgtctgtaaaagcgattgtcaatccggatgatatgactggttccggctggtggaatgagtacgaacgacacgcaggcagaacaatatataccaaagacccctctacttcgcgtgtggaacgacaaatacgactagatccgaagtatagcggcggtatatttggcacagtgtttaatgtcgctgtagactacattgctaccacagcaatgggaatgccggatacacacggcctcaacaaaggcaactttaccttcgacgaaaacggcaacgttcaaaatatagagggcgatgaactcgtttatgacaaaaatttaaaagcgatgcttccaccggaagttgcatccggaagtggcgcaattaaagtaacgcccgaagttgccaagcagctcgcgcaaaaagtaaatgcttgcggacgatga

SEQ ID NO: 3016 - DNA, 486 bp, Bacillus licheniformis
atgggcaaaaaaacattaattttcatactgatatttggtattatctttttaacagcacttcttgcgggagcgaatgtctaccgtacggcaatggatcagaaagaaaacggccacgagcaggctgccgaaacagccaggcaggaagccggcttaaaacaagttgacagcgtggagacgtttgtcggtaaagaaaagcagtacattgttacaggggcagacaaaaaaggcgacaaaatgtatgtttgggtgcctgctgacaaaaagcagaaaacgctttacaaaaaagcatcagccggcattaccggccgccaggctgcaaaagctgttcaggatgagggcctgatgtctgagcttaaagaggtgcaccttgcaagggaaggcaatgttctattgtgggaagttacatacttaaataaagatgggcagtacagtttaagctatgtggactttataaacggaaaaattcacaaaaatattacgccttag

SEQ ID NO: 3017 - DNA, 536 bp, Bacillus licheniformis
atgattgatcaaacgttactgcgtgcgaaaatcaaggagatcacaaggcatccgcttgtgaagcattttttgagcaacccaaggtatgagcggcttttcaaccacgtgttggaacatccggattctgaagaggcagagtgtctcgatcgtgaatttaagcgattttacaaaaaaatccgcatgatcaaatacatcaactcgatgatccggattttctccgtcgactttgataaaagagtccggaaaaaccgagagcgttttccattgatgatcgacgacagtccgaatctgcccgagccgccccgaggggatctgttagacgatgtcttggaacaggaagaggaattaagcgaacacctgcaagacccgatgctttatgaagcgtttttgcaattgacggacaagcagaaaaaagtgcttgcacaaatttatattcatggggtatccatgcaggaaattgctgactctttgggagaatcaaggcaaaatatttcaaaaattcataaaagggcactcgaaaagataagagagctgct

SEQ ID NO: 3018 - DNA, 529 bp, Bacillus licheniformis
atggaacgtcaagtttttatcagactccgccaccggcttgaggcagatccggatgaattgattttgctcggccatatcgcacaggtagcgggtgaccgcggatacaaagaaaagcttgaacggctgcctatttatcaggtcagcaaagcggatcaaagcatggtggtgctggacgtgatgaaggtgattgaagctgtacataaatcgtttcctgaccttgatgtccaaaccgtcggcggttctgaaaccatcgtggagatccaatatccgaaaagggatctgtcgcccgtgcttttcatcgccgtctggctgctcttgttcgtcggtgccggccttgccgtcatgaactttcatgaagatgtcagcatgagggaagtgcacatcctgctttacgaaatggtgacgggcaggttgaaccgctatccataccttttgcaggtcccgtacagcatcgggtcttgggcctcggcatgatctttgttttttaatcatttatttaaaaaacgggttttaacgaggagcccagccc

SEQ ID NO: 3019 - DNA, 435 bp, Bacillus licheniformis
atgatgatcattaaaacaaagtatcacggagaaacgcaaattcaagaagaccagacaatcgtgtttaaaaacggcctgcctggatttacaggggagaagaagttcgtcatcctgccgctttccgaggattcgccgttcgtcgtccttcagtcggtgcagtcggaagagctggcattcattgtcgccagtccgttcgtctttttcaaagattatggctttgatcttgatgaaacgacggttgaacttcttgaaatcgaatctgccgaagacgttgaagtaatggcgattttaacgatcgaagagccattcgagaaatcaacggccaatttgatggcgccgatagtggtgaaccgcagaaagatgcttgccaagcaagtgattttgcatgactcttcttatctgacaaagcagccgataggaggggaagcatgctag

SEQ ID NO: 3020 - DNA, 451 bp, Bacillus licheniformis
atgatactggtaagttcatgtctggccggagtggaatgccgctataacggttcgcacagctatgtcgaaaaaatcaataagctcgttgaagaaaaaaaagcggtgatggcttgtcccgagctgctcggcggatttcaaacaccaagggaaccggccgaaattataggcgggacgggagaagacgttttagacggcaaagcggtgatcaagacacaatcgggaaatgacgtaacagacctatatgtaaaaggggcatatcaaacattggagatggcaaggcaaatcaaggctgatacgatcgtgctgaaggaaaacagcccgtcttgcggcagcagccatatatacgatggaagtttctcaagcaaaaaaatagccggcaacggccttacggcggcacttctgaaaaaagaaggcttccgtgtgatttccgaacatcaaatagacgagctgt

SEQ ID NO: 3021 - DNA, 354 bp, Bacillus licheniformis
atgagcaatttggcttataaagtagaaaaacagcaaagacagacagacagtgcagaacaatccgttatcatccggagaagagcatcgattacgctgggggaaaaggtattgattgtgcttttcgccctggctgtgctcagcgcttcactttttatgatttcaaaggcttttgccgcgtatcagaccaatattgaaattcaaaagctcgaaaagaaggttgaaacggaaagcagcagagttgatgacctcgaaaaagaagccgatatgctgaaagagccggaccgtatcatggacatcgcccggaaaaaaggccttaaattgggtgataaaaaagtgaaagacatacaggaatga

SEQ ID NO: 3022 - DNA, 359 bp, Bacillus licheniformis
gtgtccattgaattccgaacaaaatacggacagattgatatatcaaacgaagtggtcgccatggttgcaggaggcgcagcgatcgactgctacgggatcgtaggtatggcatccaagaaccaaattaaagacggactgactgaaatcctcagaaaagaaaactttgcaagaggcgtcatcgtccgccaggaagaggatcgtattcatattgacatgtacatcattgtcagctacggaacaaaaatttcagaagtggcacataatgttcaaacaaaagtcaaatatacgctcgaccatacagtgggtcttgcagtggattccgtaaatatttacgttcaaggagtacgagtgacgaaccc

SEQ ID NO: 3023 - DNA, 428 bp, Bacillus licheniformis
atgaaaaaacagcactttattaagatgcaggatatgggagctgtcaccattccgaatctgctctttatgaactatcgggagcttggcttaaacgagacagaattcatgctgctcttaaacattaaaatgcatgttgaaagaggttctttttttccgacgccggaggaattaagcaagacgatgtcgattgaaaccgaagaatgcatgaatatgctgagaatgttcattcaaaaaggcttcatctatatagaagaatgcgaagaccagaacggcattaaatttgaaaaatattcgctcgaacctctctggggcaagctgtttgagcttttagaaatggccgagcagaaaaaactcgccgaacagaatgaaggcgaacagaagagcctttatacaatctttgaagaagagtttgcacgaccgctttctcc

SEQ ID NO: 3024 - DNA, 549 bp, Bacillus licheniformis
  misc_feature (1)...(549): n = A,T,C or G
tcggtgcaaaaatgatgctgattgcggtcagaatcaatgccaagtcttatcaggagctgaataaatatttattcggccatacgcttgggaaatttgtcaatgtcttcatgctcgtggttttgctcggcgtgacgtccgtcatgctgtccggagcgggggcgatatttgaagaacagctcggcttttcaaaccaagcggggatgattgcgacgattgccttgagtctgtttgtcatgatgaagggcgttaaagggatattcggcgtcaatgtcattgtcgttccgctgctgcttctgttcacagttgtcgtcctgtttgactcgtttattttcagagggccggagatacacaatttggcggcattttcggcaaaccccgattggattttatccgctgtctcgtacggcgcttttaatttgtcgctcgcacaggctgttctcgtgccgatcgcttctgaactgaaatccgaacgcctgattataaaaggagcattaatcnggaggggttctgcttacccttgtgttggtcgcaagctttctgtctctttca

SEQ ID NO: 3025 - DNA, 360 bp, Bacillus licheniformis
atgttcgtaatctatacaaagtgattcatgcagacggcattcaaagctgccagctgatgatgggcattacgtttcttgaacctaataacacatggaacacaatgcctgcgcatgtccacgaccggcggatggaggtttacctgtatcttgatcttgctgaggatgcaaaggtgtttcatttcatgggcgaaccgacggagacccggcatcttgtcgtcgggaacgaacaggctgtcatttcacccgcgtggtctgtccactcgggctccggcacatccaactactgctttatatgggcgatggccggagaaaactacacatttaaggacatggatgctgtcccgatgaatgtcattcggt

SEQ ID NO: 3026 - DNA, 419 bp, Bacillus licheniformis
atgagccaatatacttatccgatcatcttgggaattgtcgcaggtattgttgtcagagtatatatgctccgaaccgactaccgccagtaccccacttatcttcatgggaaaacgatacatattgcgctggctttgatcgctgccagcattggcgcgatcattattccgtcaatcttgaaatcggattatacagcgattacgtttttaacgctggctgcaacccaattcagggatgtccggaacatggaacgggaaacattgacgcagcttgacggctatgaactcgtttcaagaggcagcacgtatatcgaaggaatcgcgatcgcctttgaaagcaggaattacattgtcatttttacatcgctcctgacgaccctcgcatacattctgttttcatcggtagggcaggcctgctgcgc

SEQ ID NO: 3027 - DNA, 737 bp, Bacillus licheniformis
atgaaagtctacgaagcggaaaccctaatttcagctatgaagcaaagatctgatgaatataaaaatttgagagaacagctcgtcagcttaaaaaaagcgttaaacagcgtcgcagaacttgatgagtttcaaggaaaaggcgccgatgccattaaagcgttttacagagacctatcaggagtcgtagacggctggctggatttaaccgatatgcagattcagtttctgaatggtgtatcttctgctgccgaaaatgccggactttcagaggatacgttcgttgatgttcaatttcttgaacaggagcttgcaaatgtccacattcactctcaaaacatggtctccgcacagcagcaagagctgtcgaatattttaggacagatagatgatttaatatcgctacagccgttctcatccgatgaaatcaaacagcagcttgacgctgcaaaccaaaacagaaaagacacaatcaaggctgtcgaagatcttgatggactgctcaaaagagaatactcggcctctgaacatattcagcaaatgatccagaccgactattccgccttaatcgacgcaacaggaaaagggaaaaatgcgtctccgttaaactacaattcacatatctatcaaaacagtgaagtctataaaatgaaacatcgcatgcatcaagaggcaagaagctacatcgcaaataaacaaaaacagtatgaaacaggaaaagccgaaaaagcagaggaact

SEQ ID NO: 3028 - DNA, 476 bp, Bacillus licheniformis
atgagcatttttaatgaagcgagaaaagaactttggagcgagattcaaggcctatcagacgaaatgctgaataaaaggccggcggaagacgaatggagcattcaagaagtgatcgaccacctgaaaaaaatcgatctgatggcacttcaaatcttgaaggaacaaatcaaacatgcaccggttaaatcaatcgaagataaaccggttcatcagttggaagacagaagctccaaacgaaaggcgcctccatatgcggagccggaaagaaaaacagcggatgctttaaccctcaaagctgagctcgacaatgtcagaacacaattaacttcagtcatcgccgcctttcacaatgaagattttcaaagggtgctgccgcatccgattttcgaagagcttacggtcaggcagtggctcgacttcatcggccatcatgaaagaagacatattaaacagatcaaagaagtcaagcagaaact

SEQ ID NO: 3029 - DNA, 515 bp, Bacillus licheniformis
atgaactttcaactcgaggaagccatcgaaatcctggagcgcacaccacaaacattgagtcagctgctgaccggattatcaaacccctggatcagctgcgatgaaggcgaagacacttggaacgcctttgatgtagtcggccatctgattgagggagaaaaaaacaactggttgccccgaatcaaaatgatcgtgacaaaaggagcaacggaaacttttccgccgttcgaccgcttcagccagttgaatcaaaacgacgggaaaacgattgaacagctgcttaacgaatttgctgaaatcagacgggcgaatctgaaaacattgcggcagattcttgatcctgaaaccgacttcgaacaaacggggatgcacccggagtttggaatcgtcaagcttagagaatagatctcaacttgggttgcccacgatctcactcacctctcgcaaatcgcaagagtgctggcgaagcggtatcaggatgatgtcggaccttggaaagcttatttgcggatttt

SEQ ID NO: 3030 - DNA, 585 bp, Bacillus licheniformis
atgtgaaaaatccacatatgctgaaagagctgcttgatgatcaaaataaaactgtgccttttaaaacctatagtgggataaaacctgtaaaagcaaatgttcatgcatttcatacagcaaaatcgagacaccattatacaagattaaatcttaaaacagaatgcaaaccaaacgtcgactatgaaacagaacagggctatacgtgaaatacggatcaaaacggtctaattaatagtgtaaatgccgatttgcaacttggaaaagcaaaaagaaatctgtatgctcaatctaacgttggtaaaccagatagactgccagatgatgacggaggacatttaattgcttctcaatttaaaggttcaggggacatagataatcttgtgcctatgaattctcaggttaatagaagaggcggaaagtggtatgagatggaacaagaatggaggaacgctttaaaagaagttcccccaaaaaaagttaaggtcaagatcagccctatatataaaaatgactctttaagaccggattattttaaagtcgaatataaaattgggaatgaaaaaatcaaaaaaataagaattaaaa

SEQ ID NO: 3031 - DNA, 1077 bp, Bacillus licheniformis
atgcctgcagacagggggatcggaatgcggccatcaagcttgccgaggaaaactggctcagtctcggagatcgattggccggacatcaggaaaaggagtgaagggattgtgaggccgattatactgggcgtttttgcagccttcttttttgcttttacattcgttttaaacagggcgatggagcttgaagggggaagctggatctggagcgcttcgctgagatttatcttcatggcgcctcttttatttgccatcgtttggcttagggggaatgtgaaagagctttttcaggaaattaaaaaagcgccgggcatttgggtgagatggagcatcatcggcttcggtctcttttatgcgccgctctgttttgcggcggcttacggaccgggctggctgatcgcgggaacatggcaaatcacgatcatttccggttccctcttggcgccgcttttttatgaaaccgttcaaacaaaaacaggtcccgtacagataagaggcaaaattccttataaggggctcacgatgtcgttcatcattttaatcggggtggcgctgatgcaagctgagcacgcggcacagctttctttgcacgagatgctgctgtgcatcgcgccggttatattggcttcatttgcttatccgcttgggaacagaaaaatgatggaagtttgcgccgggcgcctcgatgcttatcagcgggtattggggatgacgctggcaagccttccgttttggctgatcctctcgctgtacgggctggcatcggcaggtgcgcccagccggggacaagtcattcagtcaggattggtggctgtattttccggaatatgcgcgactgtgctgttctttgccgcaacagatcttgtaaaaggggatatgcgcaaattagcggctgttgaggccacacaatcgtttgaagtgctgtttgcggccgctggtgaaattttaatcctatcgagtccgcttcccggtgccatctcatggagcggaatggctcttgtgattatcggaatggtgttgaacagccatgcatcgaatcaaaagccggcggttcaaagtaaagctgcaaaagcataa

SEQ ID NO: 3032 - DNA, 825 bp, Bacillus licheniformis
taaaataaaaaaagttttaaactcgagtgtggtactggctgtagatcagaaccgacaggagatggttttatgcggcaggggcatcggttacggacgaaaacctgggaatatgattgaagaaaaacaggctgatcaagtctttatgccagtagacaatatgaaggcaaaggaatttctccaactgttggattcaattccgcaagaatttattgaattgacccagcaaattgttcagcatgcagaagaaagattaaaaacaaagctaaattccggtgtatacttcacattaatggatcacttgaattttgcagtagagcgctataaaaagaacatcaatattacgaatcgcgtctactgggaaattaaaaactactatacggaagagtttgaggcagggaattatgcgcttcagctcatcaatgaaacatttgggatccaattgccgaaagaggaagcggcaaatattgcgttccacttaatcaatgcattaggtgaagagacagagtcaaaagatggaatgaaaaatgcaaaaatgatcgggagcattgtcaaccttgtccgttacacattaaacatgaaattagatcaagaaaatatccactacagccgatttatcacacacgttaaatttttcgttgaaagattttacgctgataaattgctggcaaatcaggagaatgaattatttgagcaaattgctaatttatatccgcaagcaatggatgtagctttcaaaatcaaggattatatcaagcaggtgcacggaaacgtcattccgaatgatgaactgacatacttggcagtccatattcatcgattgatttc

SEQ ID NO: 3033 - DNA, 338 bp, Bacillus licheniformis
aattttaaaaattgccgcagaggcctgcgatgataaacgggcggaagatattatcgccttgaatatgcaggggatttccctcgtggctgactattttctgatttgccatgggaactctgacaaacaggttcaggccattgcccgggaaattaaggatcaagctgaagaaaatggaattgatgtgaagaaaatggagggctttgacgaagccagatgggttttaatcgatttgggcgacgtcgttgtccacgttttccacaaagaggaacgaggctattacaaccttgaaaagctgtggggagacgcgccgattgaagacctttcgttcggagttaatg

SEQ ID NO: 3034 - DNA, 450 bp, Bacillus licheniformis
tgtgctaaaatacttgaaaaagcgggaagcgccgcctgttttccacgagctgcaccaccatatgctgtggctgatggatgccgccggacatgccggcgcgattgccgatgacttggatgcggttgaaaaacgattgaaagaaaagagccgggagtttgtcaaacactttgaacagttctacattaaatccgttgaattgacgggatatctcagagcgaatgttgaatcttttcccgctctcagaaggatgaacaaagacgtgaagcttgagatcgaactgttccgtacatttttgaaagaagtggaggaattggagcttacagatcagatgctcggtacgttctccgcactgatggcagaccatatgatgagggaagaatgctattatttaatgaaaatcgccgaatcgacaaatacgcaagaacctgcgtgcgaccctgcaaaaccgag

SEQ ID NO: 3035 - DNA, 518 bp, Bacillus licheniformis
atgataaaaaatacttctcaccgcccttttccactgcctgaaggaccgtggatgatgacgcaaacatggaatcatgtattatttgcccattgggctgtcgatcctgaagccattcgcggacaaataccggcggccttggaattggagacattcaacggaaaagcgtggatcggtatcttgccttttctgctgacaaatatgcgtccccgttttttgccgccctttcctttcatcagcagatttcccgagctgaatgtccggacatatgtagcatataaaggcgtcccgggcatttattttttcagtcttgacgccgcttcgcgcttggccgtcgccggcgcgcgctcaatgttccacttgccttatttttacgccgggatgcgctttgcacaacataaagaccgctttcagctgacaagcaggagaaaacgttcacaagcagagttttatgcagaatatcaaccggtttcggagcctttctcagctgataaaggaacgcttgaatactggcttgctga

SEQ ID NO: 3036 - DNA, 489 bp, Bacillus licheniformis
atgaaaatcaaaggattgaaacagctgtcgcagacgctggaaaaagcagggcagagcggctttcgaaatgaagctgccaagtggcttgaacaggcgggaaccgattttttggacctggtctgtgacgaaatcgtgcgcgccggatcgattgataccggcagccttttgcgctctttcaagcggggagccgaagggaacaggtgggaaatcgaaaaaggcggactcacgcttgaagtcgggacggagttagagtacgcctcatttgtaaatgacggccattggacaggcggaaaagacgaagtcaggtgggttccgggacaatggcacggcggccggtttcaatatgatcccggttcatcgtccggcatggccttaaaacggcaatgggtaaagggaacaggctattgggagcatgcgctttacatatttgagcgtttatttgaaaaacgcctgaatgaaaggctgcaaaaatggctgaattccctttaa

SEQ ID NO: 3037 - DNA, 482 bp, Bacillus licheniformis
atggaagatttgcttttcgaatataaaagagcgctgaaaaacacgaaaaaattgtataagccctatcaagatgaacaagggctgacggctgaacagctgaatgataaaaaactgatcagaaacatgatgaccgatttggaatatgtgatcgactggcttgaaaacggaagagaacctggaatcagacgggcgattgacaggcgcgactcttataagcggatgctcctgaaagatccgcggatcatcgacacgttttcagaacagagtgcatttgaaccggctcaggaagtgtcagcatacgataaagcccggattgaatcagcgctgtctgcccttacggcacgcgaaaaagaaatcttcattttacataaggtcgaacagttttcctatgagcggattgccgccatgctcggcatcaaaaagtctactgttcaaaccaatgtgaaacgggcgcagctgaaaatcgcgaaacagatcgaaaa

SEQ ID NO: 3038 - DNA, 417 bp, Bacillus licheniformis
gagggatgcagatggggcagagaaatatcgcattggcgaattagcagctgctgcaggcgtaacaaaacggactgtcgattattatacgaatctcgggctgttaacgcctgacagatcatgttcaaactaccgttattacgatgaagccgctctcaaacggctgaagtttattatggactgcaagcagcagagattggccctgtccgacattaaagaaaggctggaaaaccagtttccctcttcaactgtgaatgatgatgaaattggaagcctgacaacggaaatcgatcatgtcaatgacaatatctccgtgatcataaacagattgaaacggctgaatcccgatgaacggaagattctgaaaagccgtctttctcctgaaaaaatgacggtcatccagtcatttttgctgctgct

SEQ ID NO: 3039 - DNA, 339 bp, Bacillus licheniformis
atcacagcgaaatgctgaagacttataagagcatcgccaacagcttaccgaatttaaagaaaaagagtttcatgaagccgacaccatttattaatgagaagaccaagacgggagcaacagcggatatcgtattagtagatgaagctcacctgcttctgacaaaggaagattcctataaccatttccgctaccaaaaccagctgtatgaaatcattaagcgaagtaaaatcactgtggtgatctttgacccaaaacaagtcttaaagattaaaagttattggaacgaaagattgctcgaggaaatcattaatcagtatgatgcgaaaaccgtaaaactga

SEQ ID NO: 3040 - DNA, 388 bp, Bacillus licheniformis
atgtttgccacaatggaatcgttgcggcttcaaaatgaagcatatgatttggccaacatgattcttcaatcagaggcggctgaacattacagaaaatgctacaagcatctccgcgaagatgaagaggccggacgtattatcgattagtttacgaaaataaaagaacagtacgaggatgtgcagcgctttggcaagtatcatcctgattataaagagatatccaagaaaatgagggaaatcaaacgggagcttgaccttcacgatacagtagccgaatttaaaaaggcggaaaccgagctgcaatccattcttgatgaagtcagcgtggaaatcggtcatgctgtgtcaaaacatatcaaagtaccgactggaaacccttatttagaga

SEQ ID NO: 3041 - DNA, 1065 bp, Bacillus licheniformis
atgggcgtcaatcaattcggagagtttgacggcacccctaatcaaaacgtttatatcgcccataatcattttggtaaatctgagctgttgggcggctggggttctgcgataggaaatcactatgctgtttatgatattttccaaaaaaacatcacaatctttgacaatacgattgaggactgtggttttgcaggagtaagaacgtttaaatggggcgaagttaagattttaaacaatcgatttaagcgcaataatgaatgtattcgaatttcccaagcagccggaggaattgaaagttctaaaaatgttgaaggagtccaaatgaatcgcccccaaaatgcacaaaacgtcttgattcagggaaatgatttttatgattacaagtcatacggaatcttatcgtttgggcaaatatataacaacgaagtcgcctggagcgatggcattcgtatttttgggaactactttaaattaaaggcaaaagagattggtgaatatgacgatgagcaagccataaaattagtctttgcaagaaatgctttcatctctgataaccggatttttgggggaagaatatggatgtggatagaaggctgttacaacacctttattgatcgaaattatgtttcctgtgttgatacagaaagcatctacgtcgaaaaaagcagagacaaaacttctaccgtgccgaaatcatatcacctttctattgatcgaaacgaaattaacactactggccgcaacggtattttcattcaaaactgcgatcactttgatgtgagagataataatgtgatgaataccaataaagagcaaagcagtacgagagggcgcggcggcatttatgtggaaaacggatacgacggacgaattgaaaatagccggatacgaggcgtcgagaaggcgtttgcgattttagtaaaagacgctgcaacagaggtgaatgtcaccaacacaaaagggactggccgcgtcatcgttcaaggagattccaattttaacgggtattatgggacaacaaaagatgactatattagaaaaatcattacaaaaagcagcagctaa

SEQ ID NO: 3042 - DNA, 1059 bp, Bacillus licheniformis
atggccaatggtctgtgtgaaaggccttggcagaactgccttcaaaaaaaaacaccattataccaatcaggagggcaaaaagtgttttttgcaaagatcatcgatcgtttagccttatatgatttgcacagaaaaagaagtaaagatgaacatttttccgctttttcattgaatccgattgacagagacgaattttataaagcaaaagcggctgatgtcgccattatgctttatgaatcaagaaaaaaccatttggccggacatttcagctatgaatctttaattccatccggggaccctgtcaacgatgctttaaaaggcgaggtttttttaaataaaaatgatatagatcagcctaatgttatttttgtgcacggctggcgaatggattcatacgacagaataaaaaagatatttcatgatcgtattatgaacgaattaggctggaacttgtattactattctcttccatatcattttgaaagagagccggaacattcgctttacagcggagaattgatgataagcgcgaatttgaatcgtacggttgattcgacgagacaagctatcgtcgatttacgggctcttattcattggatcaaagcaaataaaaacggccctgttattatagtgggcgtcagtttaggcgggtggatgacaaatttactggctacccttgagactcaaatcgacatagtggtatcgatattttatgctaatcgtctttcttatgcgatatggaataccatcccgggtaaattcataagagaagaattagaacagcacggtgtgacatatgaggatttaaaaacatattgggaaatcacagatcccagccaagctgcgccgaaaattaacaaagataacattttgctgatttccgccgtgcatgaccaatatgttcacttagaggatgctgataagttgtgggaaagctgggggaaacccgaaagacatctctacaactgcggccatgccggaattgttctttgtcgcaaaaaactggcattagatacaatttctttcatccgaaaaaaattaaagcagcttcataagtaa

SEQ ID NO: 3043 - DNA, 439 bp, Bacillus licheniformis
atgccatggtcaatggaagactatcctgcttcattgaaacatttggacaaaccggtgaaaaagaaagctattgaaattgcgaatgcgatggttgacgaaggatacgacgaaagccgggcaattccgattgcgacgagtcaggcgaaggaatgggcggataacagaagcaaaagcgagcttaaatcctatgcagaaaaagccgatgaaacaaaacgtggtgacagcggttcgagcagcaggccgaggctgcggaaaaagtgcgagcatgtcatcaaacatgaaaaaggctgggcagtcaaagccgaagacgctaagcgggccagcgaagtaaaggatacaaaagcagaagccgtcgaacgggcgaaagaaatcgccgaaaataaaggaaccgccgtcgtcgtccataaaaaagacggcagtgttgagcggaagatcagga

SEQ ID NO: 3044 - DNA, 415 bp, Bacillus licheniformis
atgatcattagcgtgatatttatcatctttctcggactcgcaggaggggttgctgttggatccggctttgtcgcttttcttaccgtgcttggcattatcccgaggctgactcagctgacgaaaacaaaaggatttatccaggcgtatgaatgggctgtcattttaggcgcggttttcggaggatgggaatcgctgaacatgtcccgcttttttttatccaaatggctgcttgttccgatcggcctttttgcgggcgttttcattggaatgcttgcagcggcgctaacagaagtcttgaacgtgctgccgatactggcgaaacgcatcgggatgggagaccggattttgatacttttaatggccattgttttcggcaagattctcggatcgatgttccaatggctcatttttgttc

SEQ ID NO: 3045 - DNA, 789 bp, Bacillus licheniformis
tatttgcacgacgtgcggcgttcaatataacgctgcttcgaaagagccggcagaatgcattatttgcaatgaagaaagacagtatgtcagtttatcagggcaaacctggacaacactggaagaaatgaagcaaagcgggaggtttcaaaacgagatcacctttgtagaggagcgcctatacagtttgacgacaacacccgaattcggcatcggtcaatcggcgtacctgattcaggagcccggctttaacttgctgtgggattgtattacatacctggatcagcgtacgactgagaacatcgagcagatgggcggaatccaggcgattgctttatcacatccgcattattattctgcacaggcggaatgggctgaaatgtttgatgctccgatctatattcatgaagatgacaaacaatgggtgcagcggccgagcagccggattgttttttggtccggcgaaactctcaagctatcaagcgggttgaccttgcacaggcttggcggccattttaaagggggagcggtctgccattgggcaaacgggaacgcaggcaagggaatcctcctttcaggagacattatccaagttgttcaagatcgcaggtgggtgagttttatgtacagctatccgaatttgattcctcttcccgccggcaaagtgcagcaaatggctgatcaaataaaggatgttccattcaacaggctgtacaacgcttttcgccgctcagttgaaaaaaacgccggagaatgtgtgcagaggtctgctgcaagatatgtagaagcgct

SEQ ID NO: 3046 - DNA, 474 bp, Bacillus licheniformis
gaaaaacaatattagactcaagcggctgctgatgatcagcgcaattttgcttttaatcgtcgggggatatgtcagtgcaatgatctttggaaagaaagtggtgtatgaaggaacgggagaaagcggtctgtggcatgcttcgattgagaaatcggataaaacgtcaatcgggcctaattattttttgaatttatattggaatggcacggaagaagatgcgaaaagaacgatcgtgaaaacaatcaccttatacatagatggcaaaaagtatgatgacagaggagaatacgatctttccgagtatacgggagaggaaatggatggcggaggccatatggaagatcatatcgcgacttttgattttatgcctgaagaggatgttatcgggcatgcattatcagttaaagtggaatggaaaaccggagatgaagaaaacgcggaaacaatgaaattaaacaagattccgtggtataa

SEQ ID NO: 3047 - DNA, 359 bp, Bacillus licheniformis
ttggataaaaaagaattgtttgatacagtgataagtttagaagaacaaatcgggtccctttaccgccagcttggagatctcaagcagcatatcggggaaatgattgaagaaaacaatcatttacagcttgaaaacgagcatttgcgcaagaggctggaagagacggatcaaaggctaaaaagcgtaaaatccgatgaaaaagagataaaagcagaaaagacagggcatgctgatattggagagggccatgataatttggctcgcctgtatcaggagggcttccatatttgcaacatccattacggaagtgttcgcaaagaaggagactgtctgttctgcctctcgtttttaaataaaaa

SEQ ID NO: 3048 - DNA, 429 bp, Bacillus licheniformis
atgatcaaaaaatgggcggttcatctgctgttttccgcattggtactgcttgggctttcgggaggcgccgcatattctcctcagcatgccgaaggtgctgcaaggtatgacgacatattgtattttccggcatcacgctatcccgaaaccggcgctcatatcagcgacgcaatcaaagcagggcattcagatgtctgcacgattgaaagatcgggagcggataagcgccgccaggaatcactgaaggggattccgactaagccgggctttgaccgtgacgaatggccgatggccatgtgtgaagaagggggcaaaggagcgtctgtcagatatgtcagctcatcggataaccgcggagccggctcctgggtcgggaacaggctgagcggtttcgccgacgggacgagaattttgtttatcgttcaataa

SEQ ID NO: 3049 - DNA, 603 bp, Bacillus licheniformis
ttcgtttgcaaattgcgcctgctattttaaaccgtattccttcatttaaggttggcgctgtgttatatcaaggtattgagatcaacggctccccgcaaatgcttaaaggccggctccgcctttttcaggaatcgctgttttttgactatgccgaccgcagtatcgaagatgaatcggccgtaaaagaatggcatgatgccttcagggagctgaatccgtctttttcaggccgggaaagcggactcgaacggatgctggaagacatcaaagagcagcgctttgtcgagccgaaaaattcggcggttgatctgagccgttttttctctctcaaatatttgattccggttcatatatatgacgcccggaatttgaagggtccgatcaaaatcgaacccggcggcccggacgagatcatcacgttctccgatgatgcgggagcattcggcacgatcaccgaaaacctcagtcttcatcatgcaggagcggacacaaaagatgccttgcagctcgtctttttcaggccgtcattatctaaagaagaagccagccggctgctcgattctttgacaaaaatgtttgaacaaattcacggcggcaggcaca

SEQ ID NO: 3050 - DNA, 503 bp, Bacillus licheniformis
atgcaacgatattttatcgaacaatcaaaacaagaggtcacagccgcacccgcattctcgatcaaaggcgaagacgttcatcacattgcgactgtgatgaggatgtctcccggagatgaggtcatttgctgtgcaaaagacggccatgaagcgaaatgccggatcgagtccgtcactaaagaagaggttttattgagcgttatcgaatggacgggggaaacacgcgaactgcccgtccagatccatattgcaaacggccttccaaaaggagataagctggaatggatcattcaaaaagggacagagctcggtgcaagctcgtttattccttttcaggcatcgcgctccgttgttaaacttgatgaaaaaaaggcaaagaaaaaacgggaaaaggtgggcgaaaatcgccaaggaagcggcagaacagtcccacagaaacgcgattcccgatgtgggcgccggttcacacgtttcaacgtttgcttgagagcccttgagacttc

SEQ ID NO: 3051 - DNA, 625 bp, Bacillus licheniformis
atgcgaaaaagaaccttggccaaatggacggtaatcgccgtaatcgcggcggccggactatggctgaatgcgaaatacctgaatctgagccctgctcatataagagaaggcgtcttatcctttgggattttcgccccgttgatctatatcggactattgatgatccggccgtttttgctgcttcctgcttccgttttcgccgtcagcggcggcctcgcattcggtccgctgtttggctctttgtattcttttatcggtgcggcaggcggtgcatttttatcattcgctcttgcatacaggctcggcggatactttcagcacatgccgctgaagctcgacagcctgcggacgcttttgcggaaaaacggctttttctgcattttgctcttgaggctggcgccgattcattttgacgcggtcagctatgcggcaggcgtttccaaagtgaagcctctgtcgtttgccctggcgacggccgcgggtatcataccgggcaccattattttaaacgtgctcgggtcaagcctcttgaccggcgacatcctagcgattgcggttacagccgcaatttacctgatattcattacagtgccgcttttgttcagaaaaaaagtgcaggcgctcc

SEQ ID NO: 3052 - DNA, 375 bp, Bacillus licheniformis
atgttaattcgttataaaaagtcattcgaaaagattgcgatggggctcctttcgtttatgccgaatgagaaggacgtcaagcagcttcagcagacaattaaagactatgaaacggacactgaaaggcaactgttcctatggaaagaaggcgaggatattgtcggctgtgtaggagtagagaaaagagaagaagaagtcgagatcaagcatatcagtgtaaatccgtctcaccgtcatcagggaatcggcaaaaaaatggtgtcggctatttcgccaatatttgcacctaaaccgctggttccgaatgaattaactaaaggattctttgagcgctgtcaggatcatgaaaatgaagacatcacatataaccaatga

SEQ ID NO: 3053 - DNA, 414 bp, Bacillus licheniformis
ggctgttggccgctttgcagtctttggaggctgaaatcatgtacgggcatacaccgctccgtcaggcatcaaaacagatcgcacaccagcttaccgagccggtagcctctttgtttcagacatttgcagaacagcttgaaaaaggcagcgcttcagcagggacggcatgggaagacagcctggagaaagtatggcccgaaacggctcttaaaaagaaagaatacgagattttacggcaattcggcgaaacgctgggccgtcatgatctgatttctcagcaaaaacatatcaaactggcgttaacccatttagagacagaggaagctgaagcaaatctcgcccaggcgaaaaatgaaaaaatggtcaaaagccttggatttttgacgggactgctactgattcttctattgatgt

SEQ ID NO: 3054 - DNA, 680 bp, Bacillus licheniformis
  misc_feature (1)...(680): n = A,T,C or G
atgatttacatatggattgcgggagtattcattcttttgccagcattgatgataatgaaaatccgcgtagcgatcgagtatcttcatacagacgatgacgaccggctgaccgtcaaagttcggacggcttttggcattctgcgcattaaaagggagattccggtgattanaatcaaccaggaggatatgaccgttgatgtgaaagaacagacgaattcggctctgaaaaaagataaaaagaggagaaaaatcggctatcgggaagtgttcgatagtacgaagcaaatcaaaaaattggtggaacagatcatcaatatgcagccgatcatccgccggtttatgaagcggattcacgtcacgaagctcgaatggacctctgtcctcggctttcctgacgcggctttaaccgggattgtcacaggcggcgcctggtccctgaaagccggcacggtggctctcttgcatcagcttttttgctttgacagccagccggaatacgaggtgattccagcctttaacagccgttcctccaaaacgcatctgacatgtatattccattttcgggttggacatgctataaccgcagctttcagaatcgtggtgaactggaaagggaaaatgcgcggcttatttaagctgccaaaaaatctgtcaggttcaacaaagaatgattcatcagt

SEQ ID NO: 3055 - DNA, 1032 bp, Bacillus licheniformis
atggtttacggtgtgacaacttttattttactggctgtttttctgatcttttatttaacggaccgaagaaggatcatcaacggttttttattcaatctatttttttgttcatttcttgttctttcctactatctggcatacgttttcggaattggctttttcagacttttcgtcattgtaccgctgctgatctttttctttatcctaacgttcggtctatttgctttaatgatcgggttatttctgaatgcgagaattcttatcaaaagagaaggacgacgattgtctaattgtttgactttaatttccgggctaggcattatcatattttttctattgtcagtgattgaccccgctcgttttttatcgccaaatgttcagccgttgtttgcgggatcatcgcttattgcggtctatttcttctttcatttaacaaatttcttaacagcctattttctatatcaatttaacagaccgaaacttaatcaggattacatcatcgttctcggaagcggattaattaacgatactgtacccccgcttttagcaagcaggatagataaggctgtcgatttttatcggaaacaagcagctgttgctcctccgccgaaaattattttttccggcgggcaaggacctgatgaaaacctttctgaagcagaagccatgcagagatatgctttaaaaaaagggatacctgaagagcacactttcaaagaagaccgttctgtaaatacatatcaaaatatgcttttctccaaacaactgatggactcattatcagacggcaaatacaacagcatcttcacaacaaacaatttccacctgttccgcgccagcctatatgcaaaacgagcaggcttaaagagccaggggatcggttcaaaaaccgctttttattattggccgaacgccatgatccgtgaatatatcgctgttgttgtaatgaatcgtaaacggcatagcattgtcgtaggtactattttaggtttttctataattttgactgctcttaattttttcattgattaa

SEQ ID NO: 3056 - DNA, 726 bp, Bacillus licheniformis
taattggaggatctaagatggagaatttattgataaacggattcggcagttcaggcggaggcgcgtatcaaacggttgagttaaacggcaaaggtacgattaacggcgatattgactgcgaaaggttcagctgcagcggcaccgggactgtaaacggagacgtaaaagcggatgagctgagaatcagcggccatgcaaaactaaacggcgccatcgcagcttcaaaggttagaattgatggttctgcaaaagtggatggcgatgtcgaagcagaaaagcttaaaatcttaggctacgccggcattagcggacatgtgaaaggcgacgaagcgatcgttcgcggaaaaacgtcgatcggcaaagactgccaagtggaacatttttctgcagaaggctattttacaatcgacgggctgttaaacgcggagcaaatcgaaattaaggttcacggcggcgaaagtaaagtgaaagaaatcggctgccggaggatcgtctgcactgcacatcaatcgaagctgttctcgtttttatcggagcttatttctcctccaaggctgtctgccgagctgattgaaggggatcatatcgaacttgccaatacgaccgcaaaagttgtccgcggcaattcggttatcatcggcgaaaattgcgacatcggcctgattgagtataaggaagatatccgggtggccgaaacggcaaaagtcggagagaaaaggaaattat

SEQ ID NO: 3057 - DNA, 624 bp, Bacillus licheniformis
atgttgcgctattgttttttatggatttattcggcctatatgctcatcaagcatatcaagcttctgcaggcgctgcagacacttgatccgcgcctttcgtatgccaatcagatggaagctgtctttgataagccgaaagcttttttgcgagggtgcatcggcttaaccggttcaaccgtttccatccatcagaacggaagatcgccggctggccccgtgctttatgtgcacccaaagctcggcctgtcagagcttgccgtgctgcttggacaccttgacaaaaccgcttcgttttttgctgatccgcgcgcctttcgttatccgctgatcagcggctggctcaataaaatggccgcggtcagaaaaagcgccgacaaggaagcatcgctagaagaagtggaagagattctccggaaaggccaaagctttattatgtctgaagatgacggactcgattacaaatctttatccaaaaggctcggcattccgatcgttgcagtcgaaacagccggtacggaagacatgaaaaaaggcacgttgttcaagaggctgagacctgttgatatcgatttgacgatccacccggcatacgtcatgactgaaaacaaacagcttcgggcataa

SEQ ID NO: 3058 - DNA, 465 bp, Bacillus licheniformis
aaaaacattggcttggcatgaaacgttggagttgcatgaactaatcgcggcacagtctgtcggattggtgaagatcaagaaaagcatgaagaaaatcagcgaccctcagttaagacagctttacagcgtgtcagcaaaagcattggagcattttttaagagagcttcttccctttttgccaaaagctccagcatttcagcgggaggatgaacgggctgacttgtattttgatgcgggtgatctgttggtgctggcgaaaacgaccgttcgaaactatgcgattgcgatcacggaaacggcgacgcccgagctcaggagagtgcttgttaaacaaatcaatgcggccattaagttgcatgaacaagttttttattttatgtaccaaagaggcttatatcccgcctataacctcgtcgacctgctaaaaggcgacgccatgcatgcgcaaaaagcgatatcgatgag

SEQ ID NO: 3059 - DNA, 386 bp, Bacillus licheniformis
atgaatttggaaaccattaaagacgccaaacagctgaatggtttggcgcttgcttacatgggtgatgccgttttggaggtatatgtgaggcatcacctcttaaagcaaggcatgacaaggcccaatgatctgcaccggcagtcgaggcgatatgtctccgccaagtcgcaggcaagcatgctgtttgcgcttgaggagcaggaatttttcaccgaggaagaacaggctgtgctgagaagagggcggaatgccaaatccggaacggtaccgaaaaacacggatgtccaaacatatcgttacagtacggcttttgaggcggtcatcgggtatctttttcttgagaacagggaagataggcttaatgaactcatcaaagcagcgctgga

SEQ ID NO: 3060 - DNA, 348 bp, Bacillus licheniformis
atgaaaccagtagtaagacaatatacaaacgatgaaaaactgatgaaggatgttgaggaactcagggaaatcggagttgcaagagaagatatttacgttttgtcacatgacgacgaccgtactgaaagacttgcagacaacgcggatgccaatacgattggagccgaagagacaggcatcaaaaatgccgtcggcaatatcttcaacaaaaaaggggacgagctccgcaataaaattcatgagatcggcttttcaaaacaagaagcagaacaattcgagaaacagcttgatgaaggaaaagtcctcctcttcgttacggatcatgaaaaagtgaaatcctgggtataa

SEQ ID NO: 3061 - DNA, 405 bp, Bacillus licheniformis
gtaaaactgaatctctccctgttttagctgaattggctgcacaggagatgaagagctaccatcaacagcagcaacagcagccgcaagcatctcaaaagaaccagcagcagacttctccgcaaacctcctcactgcctgccggaattccagatggaacgacaaggcgcacaaggggtacagcacgtccaggctcaaaagctgcaaaattgcgtgaagcggcgattaaaacattaaaacgccgtaatgcggccatcaaaagctccgaacttcggaaagaaatcgaaaaagagagcggacttgagatccctaatatgacaacctgtatgcaaagcctgattaaaatgtacccggaagtcaaaaaaccataccgcggtcaatatatattagacggtgagatttctactg

SEQ ID NO: 3062 - DNA, 394 bp, Bacillus licheniformis
ttggcaaatcaaaacgcgcaatcatccatcaatgaatttaagcaatttataaaacggcatcctaagttgatttccgaagtccggaaacaagaaaaaagctggcaggaagtctatgaaaactgggttttgctcggggaagacgattcgatatgggatccgtacagggaagaagcttcagcggaaaaggagccggacgctggcggcaaaaacgatttcatttcgaaaatggtgacggccgttcgaaagatggatgccaatcaaatgaatgagcagatcaataaaatgagccagtctatttcttcgctgcaaagcttgctcagccagttttcgggcggaagccaaaaacagcagaaacaaagcggcggcgagcatccgttttctttccgaaaagatt

SEQ ID NO: 3063 - DNA, 1005 bp, Bacillus licheniformis
atgctgacgattcaggctgatttggcgattgaaggcctcttgaatgtgagcggtgaagcgggtgaagaagaaccgcgcactatgcctgcggccgtccatccggaagaggagctcgaacctgcctacagatcaccttcaaacgacgaagatcagggtgaagagaaagaatatttgatccagcttgacagaccttacgaagagcaggacgaagaacaggcggaagaacatgataccggtgaggaaacggttccgatttaccagtcgtttctcggaaacgacacagaggaagctaaaccgttttttacagcgtctttgtcggcggcagagcgtacgaagcgcgaaatagaaaatcaaaaagaagcctctcttgaacagccggaagaagaatataagctgaaaagagagaaagtggaagaggaaccggaagaatatgagctgaaaagagagaaagtggaagaggaaccggaagaatatgagctgaaaagagaagaagcggaagaagagccggagctgtcgcacagctcttatcaacctcacgaggaactgaaagagaacccgttctacagtgttcctcctcttctgaaggaagaccagaatgacagggagcctgaggcttttgaggttgaggtgacacaggaagcagaagcgattgatgaagaagaggaagccgggcatacgattgaaatcccggaatattcgtttcatgagcagacggagcccgaagaagaaagagatgaaatgcaggcagcggatgaacaggaagtgtcagcaaaggaaaacgacaacgcactctatttgacaaagctgtttacaaagcagggagaggaggagtttactcgaatgaggatgtgcatcgttcagcaaaatgatacgattgatcttctgtgcgagcgctatgatattaacgtccagcagctcatccggatgaattccctttcccttgacgaggaattaaaagagggacagatcctttatataccggattatcaaaacagccatgcctaa

SEQ ID NO: 3064 - DNA, 1002 bp, Bacillus licheniformis
atggctcagtggaagaaactcgcagatcaagttgcgattgtgtttgcgacagacgttgacgagatgaaccacatggagccgctgattggtaaactggtaaaggatgcggaatcgcttgataaggtagctttttcctacacatatactcaagaaatgccaatgccagccgattttggagagtactcggccatctcttacgtgaaccagcgttggcttgatatggtgaccatggatgcaccacagcctgctgttacaaaggtgccttatcatagcattccaaaagggcttgtcaaaatgattcgagaagaggccgagcttttgtcgaggaaagagctttccgatgagcagttcggtaagttcaagttcttgcggccgatcgacggattccggttgccggtagcccaaggaggaggaggggaaagacttcactttgcggacgatgtcctagttgttgtcgtgccctcgctctacgatacttataacgattctgctttgacttccatggtctcaggtagcaacatcgtattcactggtgtaactgctacgcaggaattgttagggaaacacggccttgacgtgaaggcactgcgtgatcgagatatcaacggtgaactgaaagttgtctatgttgccgaagaggggattctccgcgcgcagttcgcagcgtacgttgtatggttgttgaatcttgcgctgattgcattagttattgctttcactgtcgctgctgcgattagtgcattgataaccgcgctgctgcaggcgaagcgtgactttccgctgcgggtggcaggccagtcatgggtacggattctccggagccgtgtagccaaagaaatgcttgttggggtcggccttgtgggcgttgttgttttgctccaaaggcctgatgagataggggctgtactagtggccgcggtgtatgggttgcttgttgtgccgctgagtcatctgtttgctgtacgttggtgttttgatagagccagcaaacggcgaatttga

SEQ ID NO: 3065 - DNA, 375 bp, Bacillus licheniformis
tactggagagctccggcgacaactttttatggtttgctttggtgagaaccggaacggttattttgggcgtgttgtctgcgttcttggtcaacctgatttttctgccgcctaaatatgaaacgaagctcgtcagccatattgttgaaaatacagatgaagtcattaaatggatcagattgttgacgcggaagacaacggaacattccatgctgaaagaagacattgaaaaactgaaagaaaaaatgatgaaggttgaccacctttacttgctctacaaagaagaaagaagctatttaaaacgttccacatatgtaaaacagcgaaagctcgtgctgttcagacaggcgatcattgcatccaaccgtgcgcttgatg

SEQ ID NO: 3066 - DNA, 382 bp, Bacillus licheniformis
atgatgatgcgcggtattcggggagcgacgaccattgaccgggatacagaaaaagacattacggagcggacgaagcagctgatcggaaaaatgatcgatgaaaatcgactcaaacctgaacaagtcgtacagatcttaatttctgctacttccgatatacacgctgcttttcccgcgaaggtcgtcagaacgtttgacggctggcagcatgtgcccgtcatgtgcatgcaggaaatggatgttgaacacggccttaaaaaatgcatcagagtgatgatgacggtacagacggatatgcggcaggatgaagtccgccatgtttatttggaaaatgcagtaacgctcagacctgatttatcattgacaaaaaatactgaattgt

SEQ ID NO: 3067 - DNA, 431 bp, Bacillus licheniformis
atgtattttgtcgatcgacacaaaatcgaaaacacgctcaacttcctggaagaggagctgcggctttatcaaatgcaggaagaatggacttccgacgtcgaaaaaaaagcgcttgaacgaatcggccacacgctgatcgaatgtatattggatatagggaacgatatgattgacggctttattatgagagatccgggaagctatgacgacattatggatatactgaccgatgaaaaggttgtcagccaagcggaaggcgacagtttgaaacatttgatcgcctatcggaagacattggtccaagactacctgaacgtcaaccatgaagaattggaagagctgctcagcaggcatgcggaaacgctcgagaaatttccggcgcggatccgcgattatttaaaccatgaactcggtccggtatccgcattcaa

SEQ ID NO: 3068 - DNA, 369 bp, Bacillus licheniformis
aacagctatcttttctcgatgatgtggacgaaaaagccgtccggaaaatagtcatcaaagaattgaaaaattaccgcgcgctcaaagtccaattagagaataaaaaagaatgttcatctgccggctttaacattttcccttccctccgggattcatttaccgttaatgaactcaaagtcaaacagatggaacgggctttacaaaacagcttggacgatgaagaacgtttgattatcgaaaagaaatacctgacggctgccagggtgaaagacatcaatatttatatggaactcggcatgaaaaaggatacctattatgaaataaagcagcgggcaatctgccgtattgcaacagcactcggaattatct

SEQ ID NO: 3069 - DNA, 684 bp, Bacillus licheniformis
agaaacacgacttgaaaatacacggatccggaagcgcggggggcggatcattccatcgtgttctcattagaggtgaaggaatgatcacgggaaacattgattgcgaaaaattcagtacacacggtacaagcgaactgtcaggcgacgcgaaaattaaaagctttagtgtacacggggaaacagagatccgggggaggctgaaagctgacaaagccagagtatacggcacggcggatgtttctgagaacgccgagatcagcgatgcagccgtgaaaggcatcatcaatatcgggggaaatatgacggctgacacttgcgatgtcaaaggcgccctgaacgtaagaggcgattgcgaggcagaggattttaaactgacgggcagcctggatgtaaagggcctcctgaacgcaggtgtgattgacatcggcttaaagtacggaaacagttcgattggcgatatcggcggtacggatattaagatcgtcaataaacgcgggctgttgtttaatagaaacggaggtactctctcggcagggacgattgaaggagacgatatttacctggaaaacacggcggcccgaatggtcagaggaaaccgcgtgcatataggaccgggatgcaagattgagaaagttgaatacaagagcagctaccgggtatctccgaagtctgaggtaaatgagg

SEQ ID NO: 3070 - DNA, 272 bp, Bacillus licheniformis
atgcagacccctgtttctgtcaatgaaaaaaaagattttatccgctggtttctcaaccattatcagctgaaacgaagagagtgtgtatggattctgaattatttaatgagccatgactcgctgatggaaaaagtgcattttgtcgagcaggccgaattttgtccgaggggcattatcatgtctacccactgcgttgaggaagtgccttttcgtttttataaagaaaatgtcatgacgaccgatgcagaaaaatcatttcatgatatcaggct

SEQ ID NO: 3071 - DNA, 672 bp, Bacillus licheniformis
atgagaattgaaatgaaaaagctgaagctgggatggtatatacgcggagccgtctttgccaatttcatcatttttggttttctgtggatggtgacctgcacagaaggcaaggagacgttccaaacgattgatgaaacttttctattgatcggcacttttgttagagccgtttttatcgtattcggcgctgtgctgatctcaaaattagtgatttcagagtttaaaaacaagacaatactggtgatgttcacgtatccgatcaatcgaaagaaactgctggctgctaaactgctgatcgcaggcgggctgaccttcgttacgatattgatatcaaacgcatgcgttgcagttggtttttttctgctgaactcaatctatgggatcatccccggcgaattaacagcttctatcgcgtctcagcaggctctgaaaatgatcgtttttgcttttggcgccgcaggaacgagtttagtacccatcttttttggaatgagaaagtactccactgcggcaacgatcatctcatctgttgtaatcatcatgccgatcagttccacaggccctggcttttctatttcttcaattgtgtatatacctttatctcttgccgcagtcggtctgtttttttcctttttggctgtaaggcgtattgaaaaaatagatgttttttaa

SEQ ID NO: 3072 - DNA, 555 bp, Bacillus licheniformis
cggattgctgtggatgtccatcgttcctcagcaggccttcgctcatggttttatcgaaaaaccggggagcagagcggctctgtgcagtgaggctttcggatttctcaatctgaattgtggaagcgtgatgtatgagccgcaaagcctggaagcgaaaaaagggtttccgcatagcggcccggcagatggacaaattgcatccgcaggcgggctgttcggcggaattcttgatcagcagtcggaaaatcgctggtttaaacatatcatgaccggcggagaacacacctttacctggacatataccgccccccacaatacgagccaatggcactactatatcaccaaaaaaggctgggatcctgacaaaccgcttaagcgcgcagactttgaactgattggcgccgttccgcatgacggttcccctgcatctcgcaatttatctcaccacatttatattcctgaagaccgcctcgggtatcatgtcatacttgccgtttgggatgtggctgatactgaaaacgctttctatcaagtgattgatgttgatctagtgaa

SEQ ID NO: 3073 - DNA, 420 bp, Bacillus licheniformis
atgagtcaattggcgaattgtccaagatgtaacgcattgtttatgaaaagcagttttcaaaccgtttgcgcttcatgcttgaaagaagaagagcgcgcgtatgaaattgtttataaatttctgaaaaaacaggaaaaccggcagtccacgatgtttcagatcgtagaaaaaacaggtgtcgaagaagagttaatattgaagtttattagacagaaacgcattcaaatctctaatttcccgaatctcggctatccgtgcgaaaggtgcggcacgcttattcgggaaggacgttattgcatgtcatgcgagcaagatttggcatcgcaaatgagtcaattagaccagctggagcaccttgaagtagagagaaatcatcgttctaaaggcacgtactatacctttaagcccaaaaatgactga

SEQ ID NO: 3074 - DNA, 984 bp, Bacillus licheniformis
atggagcagaattgggcgatgtctataaagaatatttataatattttcaagaaagagcttgcatttcaatcgtattctaaattgctcatcattttattgcttcctctattattcatttcatccggatacatatatgttcactataaaaatacaatggacagctaccagcagttcaaaaagactgaaaatgaatataaagaactcggcatcgatattaagcaggcgctggagtcgcccgtcaaggtgaaggaaggtgagctgaaaagcgaggatggcgacggagagatcgtcgaaaatattttaaggttcgactatgagaatttcgtcttgtccctccatcacctggagccgaaacagtcagtcactatgacgcttgagctgatgggcttcatcatttttcccttggctttcacgctgtatgccatctatatctcctcatacgacatcagattcaagacgatgaaagtgaaagcggtcagccatgattggaaatccgttctgtttgccaaacagtgttcggtttacatggtgatggctgccgccgtgatcgccgttgtatgtacggcatatgtgtcaagcctcgtcttttattcccttgcttcaagggatataccggtcggcgagttcacaatacccgctgtttcaaaaagcaatatcctgcttcagctcgctgtcgttctggcggtcagcttcatcttttcgacgatcggattttatttgggcgtcctcttcagaagctttattacgcctgctttgctttatgtcgtttacagcctgctgatccctgctttgggcaggttcgatttaaaaaacctgctgtctaatctcgggcatgcggttttcagtttcagcggcggctttaaactgtttacaccggtgaaggtggacatgattccggtcatcatcattttagccgcatccgtcggcttgctgtctgcggtcacttattacatggcgcacaggcaaagcaaatatgtcgtttga

SEQ ID NO: 3075 - DNA, 612 bp, Bacillus licheniformis
gacggtggaacaattaaagcaacaatcggaagaaatcgtcaacattaaaaaaagcgtggaaggtatcacgtcgctcaaggatgccttaaaaggaaaagtcgccgacgcaatacggaatttttataaagagtgtcacaccccattccttcaattttttgaaacttttatcgaggaatatcaatcagcattgaagaaaatcaaaagtgcattgaattccctggagccacaacacaatggatatatttcgcaagccttcctcgataatgagctggaacaaggagtgaaagatgccgatcgcaccacgaagcgtttggtttctaaaacgaatgctacaatcgctaaagtcagccatatagtcgatttgccggaattagatgacagtaattttcacgagaattactcgaaagctttaaaagaaatcaatcagacaattgaaaaattacatacattcgacagggagcagacgaacaccatcaaagccgctgaaaacgacttagaaacaatgcaaagatacatcgctaggcttgaaaaaatgtacacaggccctaaaattgaaatcaccggctatcagaaaggttctattttaaaacaggataaaatggataccttgag

SEQ ID NO: 3076 - DNA, 371 bp, Bacillus licheniformis
atgaagaagatacttttttctgtttttgttttggcaggcagcttgctattggcttttaattttgccggtgaagcgagtgctaaaacgaaaaaagtcagcggctatatcacttggtacaacggagtgggcaaaatcggcgctgacggcaagaggctcggccattgggactgcgccacaaagatgggcttcgatgttccgagaaaaggcacaaaaataagagcctattcaaaagcaaaaccgcacaaagtcattacagtctataaatatgatgtcggcagaatgccgggcgctgttttggatgtaagcccgaaagcttttagagctttgggatttccgacaagcaaaggaaaggtagccggacattatacata

SEQ ID NO: 3077 - DNA, 567 bp, Bacillus licheniformis
atggcatttgtattggaaacattgtttctcatcttaacgggcattgttctgctgagaatttcgggaagaaaatcaatttcgcagatgacaattgccaccaccgtcgtcatgatatccatcggaacgatcatcgttcagccgattatagaagacagcatttttaaaacggtggcagctgcatcgatctttatcatcgtccttctgttgatcgagtacttgaaaatgaaatttgatttttttgaaagcctgattgcggggaaagccgttgtattgatcgaaaacggggagctccaggagcagaatttaaaaaagcaccgcctgaccgtcgaccagctggaaatgaggctccggacacaggggatttcaaagttagcggatgtgaaaaacgtaacgctcgaatcaaacggccagatcggctacgagttatcggatgatgccaagcctttcactatgggagagtataaaaaattcctgcgcatgcaaaacaacctgcagcagccggaggacaacctgtttaaagaaatcaccgaaggccatctgaacgaacctgataagcaattgcgctaa

SEQ ID NO: 3078 - DNA, 978 bp, Bacillus licheniformis
atgcggagatgcttgaaaatattagttctgattaaaacgttttggaagaccatgcccaaacatgaagtaaagtataaaatgatgaaatctcttgaggagtttgccgaagtcatgtactggcatacggacggctatcttccggatatattggacaaaatccaatttcgtcctgatttcattttccactacgacattgcctacggcttctcattgtccccaaacattagggggctcaaagatacaaacatccccaccggcgcgtttgtgatcgattctcattttaataaacagatcagaagcagctatttcgaagacaaccaaattgatttaattttttcagtgacaaaagagcattttttaaatgaatacccccagtacaaagacaaattcagatgggttccatgggcagttgatccagaaatattcaaggactggaagttgaagaaaacgatagactatttgctcatggggcttgtacatgaaggaaacaaaagatatcccccaaaaggaaaatacctttttagggaggctgtattgcagaccatgaagcatgaagaagggtttgttcaccacccccatcccggcaatgtcataactgacgaagaagaaatcaagcaggcttttttgaatgaaaaatatgcccaggaattgaacagagcaaagatatttttcacatgcggaagcgccctccgctacccgttgttaaaattttatgaagcccctgcctgcagaacgctgttgctggcggagccaaatcaagatattttcgatcttggctttaaagacggcacccatttcattgcttgtgaagttgaagacttttatgacaaagcaaaatactatcttcaaaataaaaaagaaaggcagcgtatcacagacaacggctaccgtctcgttcattcacagcatacctatcatgcgcgtgcacaagaaatagtagacacaataatagattttttagagcagcaggaacaatga

SEQ ID NO: 3079 - DNA, 468 bp, Bacillus licheniformis
atggaccggtttgactacttattgtttctgaaaaatcttcctatgtttttcggagtaccccttccgatcatcaaaaagctgctgaagaacggtaaggtgatagatatccaaccgtctcagcattcgcgatcgttccttcattcgcaatccgtctattttgttttaaaaggagaagtgcatttttccgacagaaggcttccggaagaatcacggacgatcgccgagtgggaaaaaggcgatgtttttcctattgatcaaaaaggcgaacctttcttatctccgtttatttcagtcaatactgcctctgaaaccgccgtacttgaaataccgtttcataatttcaaaaaaatgatgacttataaccgccaattacagacgaactttctcatgttgctccagcagaatttatttttttcataccagctttttttgcgctacctcaactcctccgcagaagacgacgtgtga

SEQ ID NO: 3080 - DNA, 437 bp, Bacillus licheniformis
ttgaacgacgaaacgggatctgtcatgaatttcttttatcaagtctttcctgtcgtctgttatgaaaaggaaatacccgaccactttcaaataccgtcgctgtattttcctcccccttctgtttttgatgagaatgatacggtttcaacatttaaaaaagtcttcaccctgaatgtgaaactgtttcaccacgattcgcagcaggcccatgatcatgccgagcgcattgcagacgccgtaagggaagcgaggcacatcataccgctcattgaccgatcgggtaaaggcacaggggacagcttgaggatcagccggatcgagacgagaataggggattccggcaccgcgtccattattattcaatggaacagccgctactggtacaaacgggaaagcgaactttctctggaaacaattgattttacaaacggggtgaa

SEQ ID NO: 3081 - DNA, 356 bp, Bacillus licheniformis
atgtctaaaaaaatccatgaattcaacgatatgattcgcaagcttcgaaaagagctgtttggcaaggggcctgaacggatacgaacggtctttgtcgacaatatggcagtttcgacactgtacggcaatttgacggcgagcgagcagtttatcgcaagcacgccggagggaagggaaatggtgcatgcggcaaggacgaccctgattcagaaacactactccaatcacgtgccggaaggaatggaggagcttatcggagcgaagctagagcacctttttacggacatcaaaattcaggaggatattgcagtgtctgtttttatctttgaccgcaatattgaaggcgtcgccgaatc

SEQ ID NO: 3082 - DNA, 377 bp, Bacillus licheniformis
atctatatccatcagcatttggcaaagtcgatgacagcggccggatttgtgctgatgctgaactcaggggcaaatgtgctgggcaacctgttcgggggatatctattcgataaaatcggcggatttaaaacggttgttcttgcaattgtgatcacgtaagcgagcctttctggcatcgtcttttttcacgattggttccagtacattcttttcttaacgttggccggttttggatcagggatcgtttttccggcatgctatgcaatggccggatcagtttggccgaaagacggcagaaagccgttcaactctgtatacgtggcccaaaacgcaggtgtggcagttggctcagcgctagaaaaaattgtcgctttttt

SEQ ID NO: 3083 - DNA, 498 bp, Bacillus licheniformis
tggaagcgtacggcacactggatgaagcaaacagtttcatcgggctggctcagtcttatttaaaagcagaagaggcgctctttcatgatattttgtcagagttgaccgccatccagcatgagctgttcgactgcggcagtgatttggcgcatgtcaatgttcaggaagaaggcaagctcaaggctgaatcaatcaccatgcttgaagaacgaattgatgcctatgtcgaggaagcgccgcagctgaccaagtttattcttccgggcggaacagaagcggcatcatttttgcatgcggcgagaacggtcatcagaagagctgaacgaaagattgtcgctttggccaaagaagaagacattccgccgcttgcgctgccatacgtcaaccggctgtccgattatttatttgcggcggcgcgcattgtcaatcaccgtctcggggaagtggatgtcgaatatgaacgaagcgctgatgtattccggacaaagaaaaaatcat

SEQ ID NO: 3084 - DNA, 319 bp, Bacillus licheniformis
atgaaaagccacgaaatgacttgaagagggggaattttgatgcattacataacggcatgcttaaacatcatcagcgataaagaccttaatgaaataatgaaggaattcaaaacacttgaggaaaaaacgaacaaagaagaagggtgtattcaattccatgcttatccgcttgaaccgtcggagcgcaaaataatgctctgggagatttgggaaaacgaagaagctgttaaagcccatttcacgaaaaaacacacaaaagatgttcaaaatcaacaattaacagaagtagaatggttaatcaaaagcaatgtgaatgatt

SEQ ID NO: 3085 - DNA, 789 bp, Bacillus licheniformis
cgatcggtttgtctgaagagacgattatttttattccgatcggaatcgctgttgcgagagcgcttggctatgattcaatgacagggctggcgatgatttctctaggcgcggctgcagggttcaccggcggcatgttgaatccgttcacagtcggaattgcacagacaattgcggaagtcccggtgtttagcgccttcggttatagactggccgtttatgccgccatgctcggtttctccattttttatgtcatgcgttatgctcaacaagtcaaagcgcacccgaataccggtttgatgtatggaagcgaaacagagataaatgaagagacagccgcaggacacgctgatctttccttcaccggaagacacggcctcgtcctgctgattacagcattgggcttcggcatcaatatgttcggtgtttttcaatggggatggtttttaagcgagctgtcggccggctttctcatcatcggctttgccgccggtcttgcgggaggacgcggcatcaacaacaccttccattcgtttgtcgacggcatgaaacaggttgtatacggagcgctgatcgtcggcttcgcccgtgccatcgtcatcgtattggaaaacggacatattatcgatacgatcatcaacagccttgcttcagcaatcagctcgcttccgaatgaaatcagcgccatcggcatgttcgccgtacaaatcgcgattaacacgtttattccatccggaagcggacaggcagccacaacgatgccgcttatggcgcctctggccgatttattgg

SEQ ID NO: 3086 - DNA, 717 bp, Bacillus licheniformis
gattatcaatgctgatgattttggatattcaagaggtgtgaactacggaattattgatgcctataagctcggaattttaacatcagcgacctttatgacgaatatgccgggcgctggtcacgcggcccggctggctcgcgaatcgcccggacttgggatcggcgtacatttggtgctgacctgcggaaggccgcttttgtctgaccaccggacgattgtcgattcaaagggaagttttcgcaatctcgcattttatcaaggtgcttttacaatagatgccgatgaagtataccgcgagtggaaaacgcagattgaaacatgcatcaacatgggcttgaaacccgatcatttggacagccaccatcacatcaatgcttatccgggcatctctgacgtatttttgtcgctcgccaaggagtatcgcctgcctgtcagacgtaatatggagagcgccataataacggaaaaaggagtgaaaacgacagactctttctcacctgtccttgaagcggccttaaagggtgaagaagccgtctctgaactgtttgaaaaacataataccgtggaggtcatgacccacccggcatacctcgataaggagcttttgacgaactcttcatatacttatccaagagtcgatgaacttgagtttttaaccgatccggacgttgtcatccgcttgaacaagcttgcggatgtccagcttgtatcatttag

SEQ ID NO: 3087 - DNA, 531 bp, Bacillus licheniformis
atgctgaagaaacgggaactgaccgactgctatgcactttttgaactgatgattcatccggatgtcttcccttttgtcagaaataaagcggagacgattgaagagtatatgtttcatgtcaaaaacatgattgaagaggaagaacagggaaagctgatatcgcgaacaatacttgatgaatgggaaaacccgatcggctgcatcagcttgtatgaaatcgaagagcaaaaaggcttcctcggcacatggctcggcaagccttaccatggaaaaggctataaccagcgggcgaaagacgcgtttttttgcgagcttttttatgaaaagcaaattgaagccgtttttatgaaaatcagaaaaacaaatatgcgctccctcaaagccgcggaaaagctcccatatgccgtcaagactgatcttgactgggccggcagcgatacatttcacctgtatgaaatcccgaaagatttgtacacgctgtacagcatgagaacattcgaggaggaaaacagccggttaaaagaagcttaa

SEQ ID NO: 3088 - DNA, 449 bp, Bacillus licheniformis
atgaacattcggagattgcatccagaacatgagccgccgcttgatttgctgttgacggcagacccttccgaaaaactggttaacgattacctcgaacggggacagtgctatacagccgaaatcgaccgccggattgccggtgtctatgtgctgctgccgacgaggcctgaaacggcagagctcgtcaatatcgccgtcaaagaagatctgcagggaaaaggaatcggcagacaattggttatgcatgcgattgaaacagcgaaagctcaaggatttaagacgattgaaatcggaaccgggaattcaagcatcggtcagctggcgctctatcaaaaatgcggatttagaatcaccggcatcgaccggaactttttcctgagacattacgagaagccgatatacgaaaacggcatgcgctgcatcgatatgatccgcttatcgctcgacct

SEQ ID NO: 3089 - DNA, 385 bp, Bacillus licheniformis
atgttgaaaatttggatgactggacttttactattagcgcagcccgcggggcattctgacagcttaacgatcactcagcaagggaagaaagtggccgttgtgaaccgcgaagattttacaatgccgcttcccggaacaccgatgattgatgataaaaaatacaacgaattcgttgacaggcttgaacggaaagtacacaaggatcctgtcaacgccgtgatcaacgatcagggaaggatcgttcccggcaaggttggctacagcctttcccggaaggggtttaaggagcagttttacgcgtatttttatggggatggcccgtccacaatagaagtgcctgaattgaatgtttacccgaaagttgacagcgaactgctttcccata

SEQ ID NO: 3090 - DNA, 459 bp, Bacillus licheniformis
tattgcttattggaagtctgctggccgcgctcagctttcacctggaggccttggccgaaaagccggctaaagttcaaatccagcttgaaaaggtttatctggacggagacgttggaattgagaataaagtagaggccgctcgcacactggaagactttaaagctgcttataaagggtggcagctcatcgatcagaaaaaggggtttattctgtttcgcaaacaggtggacgacatttctcccctcagcaaaacaaacggttatatcggagtgactgaagatggcgtgatttcgacttttcacggtcgcccgggcatcttatcagaacccattcaatcgttttttcagattgatataaagcggctggaaagccggatggcggatgatctgcgcaaagggataccataccgcacgaaaaaggaatttgaacatgtcattgaagccgtaaaatcatccggaa

SEQ ID NO: 3091 - DNA, 463 bp, Bacillus licheniformis
atgcttgaatttgtatggacttttttagccaagcctgctttagtgttctctatagcttatattcttttccgaatcgcagggaagaaagccgtttcgcaaatgacgaacttcgaccttttgctgacatttgcgattggaacgatcatcagcgaaccgattcttacttctaaaatttcaatgtccatttattacgcgcttacctttctgatcttctattgggtgattgaaaagctgtcattacacaataaatggcgatggtttcttgtcgtcagtccgaccgtgctgatccgaaacggcaatattgataaaggaggattacaaagagaccggctgactgctaatgaactgctcgcggagattgcgcgaacaaggctatgccgacccaaaagatatccgacctcgccctgattgaagaatcggggccatttcagcctgattcccaattcggaagcagggcctgtca

SEQ ID NO: 3092 - DNA, 558 bp, Bacillus licheniformis
acaccgtcctgttctgcccttgatgttcttgtcggttcccgtcagcctgttctatgctcagctggagtccaactaccgcctttatctcgaaactctttttgacgatttcctattcaccttgactgtttatacagtgtgccgcgcccttcttagcattacgatgcaaattccgctcgtcaaatggacggaaggactgaacatcaaaacgatcgtttccatatcatacgtatgctacgctgtggcagcgattggtttcgctttttcttcatcgatcttttggctgctttcgactgcggttttatttacggcggcagaaagcatgcttctgaatcacatgcaaacctttgtctcgcgccttgctcccaatcatatacggggcggatattttgcatttttcggcccgcattgggatatttcccggacaattggaccttttttaggcgggatgatcttcatcaagttcggcggggcagcgctttttcttgccattgcagggatcatggctctcggggggattgcacaatatcgagcagtgtcccggttaaaaaaactagtcct

SEQ ID NO: 3093 - DNA, 468 bp, Bacillus licheniformis
cccggcctgcactagccgcgtctccttttgttgagacagccggaacatcgttcactttaaatgggaaagaattttattttgccgggacgaataactattattttcattataaatctaaaaaaatggtcgatgatgtgttcgaagatatgaaagcgatgaatttgaaagtgatccgcatctggggatttcttgacggccagccgcaggaaaatacagtcatgcagccaaggccgggcatatatgatgaatcaggcttttcaaagcttgactatgccatttataaagcggggcagacagggataaaactagtcatcccttttgtgaacaactgggatgatttcggcggaatgaatcaatatgtcaggtggtttcaggcggatggacatgacgccttttatactcatccggacattaaagaggcgtataaaaattatgtatcctatatgctgaaccgagtcaacacatata

SEQ ID NO: 3094 - DNA, 474 bp, Bacillus licheniformis
  misc_feature (1)...(474): n = A,T,C or G
aaaatcaaacatcagggatttaacaaataagcaagtcatgcaattaancctgcaggcacnggagcactttggaatacgatgagcggccacaatccaaaagcgaaaaactcaaccttgcccatccaaaacatttgaatacngcggtcttccatatacgtatatgtgcagtgaattcagcacaaaagcaaaattaacagactacttgacgccggttttcacaaaagacgccattaaaaaaggcttggaaaaatacaacatcatttcttataaaggaaaaatggccgtgcctgtcggcgatggggacaacctcttaggatgggacaaggcaaaaatcaaactgatctctcaaaaaaacaatacccgcacttatgaattttccgtaccggcattggatggatcggtgactgcgaaaagaaagatcacgtttgtgaaagaaaacaacaaatggaaaatcaatcagctcgatgctgccat

SEQ ID NO: 3095 - DNA, 384 bp, Bacillus licheniformis
tttaggagggagcagcatggaagtctttgaagaatatttagcgggaattgatcatccggaacatcgtgcccggatggaagaagtattgggttgggtagcggagacatttccaaatttaacgccgaaaatcgcttggaatcagccgatgtttactgatcacggcacatttattatcggctttagcgtcgcgaaaaatcatttggctgtcgcccctgaaagcgctgggatcgatcgtttttctgaggaaattgtgcaggccggctatgatcatacgaagcagcttgtccgtttccgctgggatcgtccggtggatttttcattgcttgagaaaatgatcgagtttaatattgcggataaggcggactgctcgactttttggcggaa

SEQ ID NO: 3096 - DNA, 480 bp, Bacillus licheniformis
acaaagcgatgaggagagggtgccgacaccaatgggaaaatctatggcaagagcccaaaccgagcaggcaggcgaatttttagcacagaccgttcagacgctgtgcgattatttaaacgaaacgacgctttcatcccttgaagccgaagagcccgggagaagagattattatcgcgatgtcctcagcaacttgagaaaactggcggtttactgtgaagaagggcttgcggcctgccgaatcaggctgcagcaggatccttttcaggaggctgcagccgaaaggacgctctatcaggtctatcatcgatgcatagaagaattttttacaccgaaaaaagatacttggtacgaagacagcagagcggcctacacgggaaaaaacgccatttgctttcacgaaccagcgccggcctcattaaaaaatttgatggcttcgcttgaaacaggatatcaatcgatgagagaagaattggaatacta

SEQ ID NO: 3097 - DNA, 414 bp, Bacillus licheniformis
atggctcgtcgattttttaattccaaaaggggcattcgaaatacaaaggtataccagcccattatcgtaatcggcatgagccttggatttgcctttctggggagctgttttcacgcacaacatcacgattgcgatcatttgcatttccgtcggcttagccggaatatctgcgaccgcgcctatcggctggtcgatatcagccgatattgcaccggttggttccatctctctgctcagttcaatggtcaatttggcaaataacttattcggagggattatcgcggtttcattaacgggctatctggtcgatgtgaccggttcatttacgctcagctttttagtagccggatttgtattactgctcgggctcgtgttctacctcgcagtcctcggcgatataaagcgaattcgtat

SEQ ID NO: 3098 - DNA, 622 bp, Bacillus licheniformis
atggcgtacacgatcgattcggttccgagaggagaccaccgtttagcaaaaatcagagtccgtacaggtgatccgctcggcctgctggaaagggaatgcgagattcaattggaagcttcctttctcgttttgccttcctatcaggagatcgcttaccgcgccagcggaggctcttatgacgagcatgcaggccgcgtttcagagcttcgccgcaaggacagtacactggcgtcaggtatcagagaatatcagccgggcgaccgttttgcatgggtcgactggaagacgtcagcccgccgcagccagctgatgacgaaggaatttgagcagacgaaaggggatgacctgctcgtctttatggatcagtccccgtctgaggcttttgaagagatcgtcacgtttaccgcttccatcattcgttcggcaatgcggagcgggacgaatgcagggcttgtttccattggtaaggagcggaatgtcttcccggttcggcagggggaagagcagctgagaaagctgttctactacttggcgattgccgactgcaatgcagtccagccgtttcacagtctgatagaggggggaattgggacattccgatatgagaaaagccgtcaaatat

SEQ ID NO: 3099 - DNA, 267 bp, Bacillus licheniformis
ccactatgaaatcgcgtagaggctttgctattcagcgtttgatgaatgcaatgcgacaggctcatgctgatggttggtttatcgtttttgacactctcacgttggctgacgaccgattagaggcgttttatgataatcccaatgctttgcgtgactattttcgtgatattggtcgtatggttcttgctgccgagggtcgcaaggctaatgattcacacgccgactgctatcagtatttttgtgtgcctgagtatggtacagctaatg

SEQ ID NO: 3100 - DNA, 698 bp, Bacillus licheniformis
atgagagatcatatcggctttaaagatgtgttcatcgttttgaaaaaaagattcgttctgatcgcactgatcaccattgcggctgctttgtccagcgctgccgtcaacttttattggctcaaacccgtctatcaggcatccgcccaaatcctcatcaacggccgtcaaacgtcgaacttcaccgacatccagaccaaccttgaacttatcaacacatacaacgtcattatgaaaagcccgatcattttaaataaggttaaagacgaacttaacctttcggaaacggctgaagacctgaagcaaaaaatcacggttatcagcgaaaatgaatcgcagattgtcagtatctccgcgactgacaaggattattccaaggcggcggatatcgcgaatacagtcgccgccgtatttcaaagagacattggcgatattatgggtgaaaatgccgaaatcagccttgttgcgaaagccaatcccgatcattcacctgttcccgtcagcccgaacaagaagttcaacatcgctctttttacagggttcggccttctgtttggcgctgggctagcatttttgctcgagcttttgaaaaataccgttcgaaatgaagaagacatcgaaaaagatctgaatgttcacgtgttgggaaatattctgtatgtaaaaccgaaaaaaggacaggccaggaagctggaaagctt

SEQ ID NO: 3101 - DNA, 392 bp, Bacillus licheniformis
atgaatattgaacagatgctgtatgacaccgcagtcgaattgatcaaaaagaggtatccgaccggatggggcggggcagccgccatgtataccgaggacggaagaatcttaacgagcgtagccccggaagtaatcaacgcttcaacagaattatgcattgaaacgggcgccattctcgaagcccataagtatcaggcgaaaataacgcactctgtttgtgttgcaagagacgacgaacattccgaatgcaaggtattaacgccgtgcggggtatgccaggaaagacttttttattggggtcctgatcttaaagcagctgtaactgtaccggatgggcgcctggtttataaaactttaaaggaaatacagccataccattggtttgccgcgta

SEQ ID NO: 3102 - DNA, 351 bp, Bacillus licheniformis
atgaaagcaataaaaaaagaagatgtgcaggcttctttggaaacatttttaaatcagcctgtttacattcatttggaaacgacaaccggatcgtattccgcgcataaagatgagcagaacatgaccgtggtggcatatatcagaaacgcgaaggtagcctgctcccgggccaaaatcacgggcgagggaccatttcgcgccggtttgaaaaccgaagacggctggatctacgccgaaggcctgacggattatacggttgacgatgaaggaaggttgcttcttgccggctatttgccgggcggcaaactcgccatttcgcttcaaatcagcaaaaagccatttgcagtctaa

SEQ ID NO: 3103 - DNA, 327 bp, Bacillus licheniformis
agagaaaaaatactatgaattagtggagcagttaaaagttcgatcacaagacgttacgttttccgctacaaaggcagtaggattgcttatgctgttcagcagatacctcgtgaactacacttcggtcgaaagtgtggaagatattaatgaggattgcgcggaactttatttcaactacttgatggacaaccacaagcggctcggcatcaatctgaccgacatcaagcggtcaatgcagctgataggagatattcttgatgtcgaggtcaatcattacctgaaagatttttctttgtcgaatgtgacgctttggatgagccaggagaa

SEQ ID NO: 3104 - DNA, 721 bp, Bacillus licheniformis
atgttccgattatctcgaactaggagatgccgaaaaagagccggaaaaaacattatcgtttttcaaacgctgctgatcatatacctgttaattggattggggagtcagctgtcacagcatacaaacgcatcatttcatgatgtggaaacatacagcatgacaatgaaagcggcctcaacttttcctcaagatgagaagcagtgggacgggagcgatttgaagcttcaaaagcagacgaagacgaaaggaacggtctgtgcaccgctgacattgtttgcagaatataaaaaccgcggcagtcaaatcgccgactctgaatggaagtgggagcttcataaactcggtcattccaaaaagccgctagaggacgggactgtgatcgataaaggcgtgttcaaaaaagaagccgaaagcagcatctaccggatagagtcaaagcgggcagcaaaaggagggctatacgcttttaaattgatcagacctgaaggccatccagatgttaaaaagggcaaacctttcatttggtcaaatgtaatggagcttcaagactgcaatgaagaaacaccgaagcctcctaaaaaagcttcagcaaaaccaaagcaaactgaacagactcaaacaacgcaaaagtctgaacaggatatagaggaaacaccaaaggacagtgaatccgtagataaagaaaatagaaaagaagataattcattagaaagcggggaag

SEQ ID NO: 3105 - DNA, 543 bp, Bacillus licheniformis
atcgttgtttggtgccgacggggaagtcaaatatgcaggagctgttgccattaacggaaaaacaaataagctccttggttttttagatgaaaaagatttagacgggatcatgtggatcaaaggacaaggggtagggggcactgtcaaaaactatgatcaaaaaacaaaaaaattgacggccatgtcagtcgatcaccttaagagtgagatcaagccagtcttcaaaggaaaccgcctctcatttaaagtgaatattaattcagaggcacacctggctgaaaactggaatacaaccgaaacggcaattgacaaaaaatatttgaaaagaaaggaagaaagtgcgtcacaaacagtgaaacagctggtagagcagatcacagaaaaaatgcagaaggaatataaagccgaccttgccggcttcggtgatgaagtgaggatccactatccctttctttggagaaagctgaagaaaaattgggatgaagtattcacagaaacccccattcaatatgatgtgaacatcacgattgaagaatttggatc

SEQ ID NO: 3106 - DNA, 945 bp, Bacillus licheniformis
atgcattctcaattcgaaacccgagccgagcatttgacgaaacatgcccgttttttcgagtataccactgcctctgacccgattggaagcggaataatcagcccggttcctgtgaaagagttcgggcctgaattgtatgagacaggtgaaacgcggatcatcccgctggacatttccgaagaactgaagacggattatcccgcttcaagcccttcccttctcgcccacttcatcaagattcgttcaggcgacacgatacacactgccccccgtgcgacaagcgaactatattacattgtcagcggcgcagggaaaaccgaaacgggcgaagatacgattcactggcagaaaggcgattttttgactttgcctgccggttcaggcagccggcataccgcagcagaagatgcagccatttattacatcaccgattcacctctcctgaattatttgggcgtaaagccgtcggaatcccgctttcaaccaactctctacaccgctgaacagtcaaaagcaaaattggctgaagcggccgccgctcctgacgcccgttatcgcaaccgcatttccgttctcttgaacaatgaaatattcgatcaaacgctgacgatcacccatgtattgtgggcaatgttcggcatcgtgcctcccggctccaatcaagctcctcacagccacaagtcggtggctctcgattttgtcgcctatgccgcacccggcacgtatacattagtcggaagcaaaatcgatccggccacaaaggaaatcattgatccgaaacgaattgactgggtaaccggaaaagccttcattacaccgccgggattatggcattcccaccataatgagtcagatgaagccgcctatatcatccccatccaagatgcgggcctgcaaacgtacctccggacactggatattcaatttcagcattatgaaaaatga

SEQ ID NO: 3107 - DNA, 471 bp, Bacillus licheniformis
atttttcaaggaaaaaaagcagcttgaagcgcttttccggaatgaagtcttgcatattcaccacatcggaagcacgtcaattccgggaatgagcgccaagcctatcattgacatactgatcgaagtgaaagatctcggctccgccgccggcttcgaaaaggggatgaaaatgctcggctatgaaccgaagggggaaaacggaattccgggaagaagattctatcaaaaagggagacggaagcgtacacaccatgtccatctgtatgaaagcgggcatcccgatatcagacggcatctcgcgtttcgggattatttaatctcccatccggagcgggccgaagaatatgctgcactgaagatgaagctggcggagatgtttccgcttgacatagcaggctatattgacggcaaaagcggctggataaaagagactgagcgcttggctgaacaatgggaaaaggcggaggagga

SEQ ID NO: 3108 - DNA, 346 bp, Bacillus licheniformis
atggagcatatatcctggcttacatttacgatgctgattctcgccagttaccggttaactcatttgattgtttttgataagatcacggagtttatccggaaaccgttcatgaagaagaagcagacgattgatgaacaagggcatgtagaaacgaaaaaagtgccgaaatcaaacttcggctatttgctgaattgctattggtgcgcagggatatggtgcgcgttgatcattgctgtcggatatctgattgccccaaaagcgatattcccgttgattttgattttgtcggtcgccggggggcaggcgattcttgaaacgtttgtcggtgtcgccacaaaacttgtcg

SEQ ID NO: 3109 - DNA, 312 bp, Bacillus licheniformis
gaacgcgtttcctatgtgatgtcattaagctccggtatcgcgacaaaaattacttagatgatgaacacgaagtcattgcgaaagtgcttcagcagccgaactgccttgaagtgaccatttctccgaacggaaacaaagtggttgtacaggcggaaagagaatttttagcagaggtcgtcggcgagacgaaggtcgtcgttgaggtcaattctgattggacggaaagcgatgaagaagaagcgtgggaagaagagcttgatgaagaacttgaggatatcaatcccgagtttttggttggagatccagaagaat

SEQ ID NO: 3110 - DNA, 450 bp, Bacillus licheniformis
ctgaaggaggaatcatatgattgaagtcaaaccaataaacgcggaagatacgtatgagatcaggcaccgcattctccggccgaatcagccgcttgaagcatgtatgtatgaaaccgatttgctcgggggtgcgtttcacctcggtggatattaccggggcaagctgatcagcatcgcttcctttcataaagccgaacattcagagcttgaaggcgaagaacagtatcagctgagagggatggcgacgcttgaaggataccgtgagcaaaaagcgggaagcacgctcatccgccatgccgaagagcttcttcggaaaaagggggcagaccttttatggtgcaatgccaggacatctgtgagcggctactatgaaaagctcggcttcagcgaacagggcgaagtctacgacataccgccgatcggacctcatattttgatgtataagaaatt

SEQ ID NO: 3111 - DNA, 936 bp, Bacillus licheniformis
atgattgacgaagccgttgatttagcagaaaaacaagacgatccgacaatgatgggcagaatcgctgaatggcttgatttaatcggaacaggaaacggcgcgttggccgtaacaaaaggcgtcatagccgtgaatgtactggcgacgaaaatgcttgagcttgaaaaagacggaaaaggaaacttccgtgtgaaagcctctccgaaatggacgcaaggagctaacggaaaatacgattccaaggtggctcagtttgtttacaacatcctgaaaaaaggcgatccaaactcaagcaaaccaataaaaaaatggctcggcaaatttcaaaataaaccaagcggccttttgagaaagattgttggattggggcctaacacaacaaggatctcctacaagaaaattttggagagccaaagtttcctaaagcataagccagaggaactgaagagttataagactaaggttgatgtgaaagggactgttgggaagtttaaggatgaagctagtattacaaaactcgccaaaaaaataccttatgctggaacaatattctccttgactacaaatggagctgagttttttagtgatgataataaagataaatcttggttcgaaaaatttggccgattttcagcagggattggaatggatgctggagttggagcgttgaccgctagcggagctggactgggttcattagtatgtccaggtcctggcacccttattggaggagcaattggagctggtattggtataactggatccataattgcgggagatcaagtaaaagaatggggagaagatgctgcaggttggatagaagataaaggtaaggaagctggtgaatggttaagtcaaaaggcctctgaaactacagatacaatttcagacggactctcaggtgcaaaggaatttgtcactagctggttcaggtaa

SEQ ID NO: 3112 - DNA, 936 bp, Bacillus licheniformis
  misc_feature (1)...(936): n = A,T,C or G
atgcgcgctttggagctgaatgaaacgtatcactttaaaacgattattgcatcctcggaatttgatatgctgagggcggggaagctgaggtcgcttttggggataaaagggcagtcttacaaaagtgctctgctgttccgcaacaaaatattaatgaaagagcaagtaagaaaagccggtgtgaaggttccagattttaagaaaatcgactcggcggccgacttatatacgtttgttcaaactttcggttttcctgtggtcgttaagcctatttacggatcggggtctgttgatacaaccgttttaaggaatcggcaggacgtgtggaatgttcttgcgaaaggtcttcccgatcatctggaagttgagtcgtttatcgaaggggatatgtatcatatagacggcctcatccttgatgaagaaattgtcctcagctggccgtcgcgttatatcaacgggtgtctagcgtttcaagatcatcagtttttaggcagcctccagcttgaattgaaaaatccgcttacccggcggttgactgattttgttcaaaaagcgcttgctgcccttcctgttccgaataccacaacattccatgctgaagtgtttcatacaccagatgatgaactggtgttttgtgaagtggccagtagaaccggcggcgctatggtccgtgaagcaactgtgcagactttcggttttgatatcaatgaagtgtgtgttaaagcgcaatgcggcctggaatttcatataccggaggtggacaacaatccggaccgcctaagcggctggctgttgattccgccgaaagacggcgtgctgaaagaaatcaagcctgcgccagccgcagactggatagcgaaacaaaatatatccgctcaagccggagacaggttccacggctcgtcttccagtgtagacgcaattgcgangttctaa

SEQ ID NO: 3113 - DNA, 419 bp, Bacillus licheniformis
atgaatacatataacccctttcgtcttgatgctccgtcaatgcttttgattgaggaatggaatcagacggcggaaaccggcggagccgtcacagccggatttacgacaaaaaacggcggagaaagcgaaccgccttttcactcattgaatacagggctgcacgttcaggatcatgaacagcatgtcatcaataacagaaaaaaggttgccgacatcctaaaaacagatctgcacgactgggtatttgctgatcagacgcatgaagaccggattcataaagtgacggatggcgatcgcgccagcggcgctttccgatacgatacggcgctgaaggctacggacggactttatacagacaggccaaacctgtttttggcgctttgctttgccgactgcgttccacgtttatttttacgacc

SEQ ID NO: 3114 - DNA, 395 bp, Bacillus licheniformis
atgaaaagactttgcatcatcccgtgcggggcgaaaaaaatctgggatgttgatccggacatcggcccgtccgccgcaaaggatgtctatctaagcccatttcaccgggcgtgccgcgcatatgcgcagacattttttacggattgggtgattctttcagcaaaacacggttttttaaaacctgaagatatcgttcctgaaaactatgacgtcacatttgggatgcgccacccagagattatgccggatggcgggctgaaggctcaaggtgaacggaaaaacctgatggattgcgatgaaatcgtcatgctcggcggaaaaaaatacaggcctgtactgaggaacgtgtttggcagcggacagcagatcatatacccgctggcgggataccgggg

SEQ ID NO: 3115 - DNA, 432 bp, Bacillus licheniformis
cggttactttgcttattacgggtctggcattgtttcttattcgaaatttgcgcggccggaaaagcgacggcgaaatcaggctgagagacgccgtgatcatcggcttttcgcaaatggttgcacttgttcccggcatcagccgttcgggagcgacgatcgttcctgcgatggcgctcggcctcaaatctgaaaccgcgctcaggttttcatttttgctttacataccggtcagccttggcggaaccattttaagcattaccgatatttttcatgatccgcgtttaggagagctttttcttccttatttattcgcgttcatcgcatctgttatagctacatacttctcattgcgctggttcatgaatattatggcgaaaggaaacttggtttatttctcgatttactgctttgtcatcggcatcgccgttttga

SEQ ID NO: 3116 - DNA, 528 bp, Bacillus licheniformis
ttggtttattgattttagcttgtgaaatcggcttttggatttttattctgcttggacttatttttcgctatatggcaggctggaaaaaggctggtttgatcatgtttgcatgcacaccggttttggatttactgcttttggctgcaacgtcgcttgatctgcacaatggggcgcaagcggatgttttgcacggcatcgccgccgtttatatcggcgtcagcatcgcgttcgggagccgcatgatcaaatgggcggatgaaaggtttgcctatcgctttgccggaggtccgaagcctgacaaaggcccgcagtacggcagggaacacgccaaaaaagagcgtgaaggctggtttcgccatttcatcgcatggctgatcggagcggctctgctggccgggatgcacctgttcatcggcgacccggaaagaacggaaccattaatccgcatcgcttctttatggtcgatcatccttgtcatcgattttttgtacagtttcagctttaccctttttccgaggaaagcccgtt

SEQ ID NO: 3117 - DNA, 338 bp, Bacillus licheniformis
ttggataagaaagatattaagttcctcgaggagctgctttataatacagataaagacgatctagtaagagtgacgagaaatattgaaaaccctgtgattcttcaagtttttgcagcgaattataattggaatagtggttttgatgttccaaaagcaattcttgagaatgagaattgcgattatggtacggggttattaatgttccattatgcagatggttatcgtatgctcgaaagcccagacaatgtttcagcatctgctttagaagaatggaaagattttttaatccaaacatatcaaaagcttataaatttgcagtttaaatctcaaaatatatc

SEQ ID NO: 3118 - DNA, 459 bp, Bacillus licheniformis
tatccgtgaaaaaaatattatcaactcttgcgcttgggtttgttctcgcgctgggctttctggcggggaacctttttacaagctcagctgaagggccgcaggcagaaaaaggcggcaccgttcagtcaaatgaagtcatcaatacatttgaaggtgttgccgactatattgtgaaatacggcaggctgcctgacaacttcatcacaaaagccgaggcgtcaaaattaggctgggatccgcaaaaaggcaatctggcagaagtagcgcctggaaaaagcatcggcggcgatatctttcaaaacagggaaaagctgcttccagatgcatccggacgcgtatggagagaagccgacatcaactatacatcgggattccgggggtcagaccggatcgtctattctaacgacagactggtttataaaacgactgaccactataaaacgtttacgagaatgagat

SEQ ID NO: 3119 - DNA, 350 bp, Bacillus licheniformis
aaaaaaggcaccggtttgtaagttcagacacacaatatcagcagaattacagatgagatgtatttgaacgcgatgatgacggccggtgtaaaagacgccaaagtttatgtcaccgctccgtttgaagtgtcaggcacagccgctttaaccggattgatgaaagcgtatgaaacgacttcgggagaaaaaatttccgaagatgtgaaaaaggtcgcgaatgaagagcttgtcaccacttcagagcttggcgagaaaatcggcagtgaaaacgcgtcagcgctgatggccaaagtcaaggaagaaatctcgaaaaacggagttcccgagtcaaaagaggaatggagaaaacg

SEQ ID NO: 3120 - DNA, 354 bp, Bacillus licheniformis
ggacaagccttgggagcatgcggaagaatgggtcccgcttctgtttgcagaatgggaacgcacaaaagaaaagcttctgcccgtctttaaaacgagaaaatcaaggtgcagccaggatgacatgctcaacggggtgtgctgcttgatcgcaagccttcactggacgatgggggagcctgtcaaaagtctcaactgggagatcatcacccggaaggattttggagcaaagccgatgaactggacggaacggctcgagttcatcctgctgaaaccgacgcagtaccattgttttatccagcttgacgaattgtttacggaaatgaaaaagcaattttataaatatgttgccatgaa

SEQ ID NO: 3121 - DNA, 360 bp, Bacillus licheniformis
atgatgagatggattataaacgttcttgtcaatgccttattattaattgtcattgccggttactttgatgcggttcacgtcagaagcatcggagcagccattacggcaagcttgattttatccatcttaaatatgtttgtgaagcccgtgctggtgattttgacgctgcccgtcacagtaattacgctaggtttatttttgtttatcatcaatgcgatcactctttatatgaccgcgtccattatgggggacagttttgacctggacggctttgggacagccatttttgcgtcgatcgtcctgtcggtttttcacttgctcattcaaaaagcaattatcgaaccgatgtccagaaaataa

SEQ ID NO: 3122 - DNA, 402 bp, Bacillus licheniformis
atgattgtcatcatattgagactggctttgctggcgcttttggtctacgtcgtgtacagggccgttcaatttttggggagcccggacagaaggctgaaatcagcacaggcaaaaaagcacttttatgttttggacgaacaaaagaatacacgcaaaaatctcaagctgacatttaaaggcgtgcttttcgaaggagaaaaacacattccttcaaaagaccatccgctgttcatccatacgatttttgtatggacggaagcgcctgaagaaaagctcagctcttttacggaagaagacttcgcggaacttgaagaaaatattaaagagcactatcccgattgcaaaatcgactgggattcgaacatccaaaagtggaaaaacaaaaaagcagaagagcaataa

SEQ ID NO: 3123 - DNA, 469 bp, Bacillus licheniformis
atgggtaaaacgatcatcaacaagccttttacggccgcccctgaagatgaagtcgttgtatttgtgatcgggatgagagtaaacaagtggcatgctgttcataaatggtggccggtttttaccgccatgccccctatgataaaggagctttatcaaaacaaaaacctcggctttttagcaatggaatcattcatcaatttcaggacgatttgtcttattcaatattggcgttctttcgaagatttgacagcatatgcaaagggtgataaacatatggcggcttggcgccgtttttatcagaaaacagccgcatcaggcgctgtcggcatctatcatgaaacgtattcggttccaaaagggcgctatgaggctttttaccataacatgccggtgttcggcttggcaaaagcgtacggacatcaacctgtcacccgcggaaccaaaactgctgaacagcgaatgcggggaa

SEQ ID NO: 3124 - DNA, 396 bp, Bacillus licheniformis
ttgcctgtatttatagcaggagattgatggagggatggagaattagtcttcttgaaaaagaaaggacgatttttgtcgatgcagacgcatgcccggtgaaagatgaagtgctcaaaacagcggcggatttcgacgtaaaggtggtattcgtggcttcattcgagcattttcaaatcacaaggaaagaagaagagaattggacatatgtcgatccgcacaaagaagcagcggatctgtacattgccaaccatgttcgacctggtgatgtcgtcgtcacacaagatatcgggctggaatcgcttttgcttggcaaaaaggtctatgtgatgccggacagaggctatattttcgaacacaactgcgtcgatgatgctattttgcgccgacccgtttccc

SEQ ID NO: 3125 - DNA, 909 bp, Bacillus licheniformis
tgacggtttcgaaggatggagacggcgaatttcaaaccgttcaagaggcgatcgatgctttgcctgagtacagtcgggaacagaaagtgatattcattaaaaaaggagtttacaaagaagtcgttcatattccggctacaaagccgtttgtgaagctgatcggcgaaaatcgttacgagactgtgattacgtatgacaactatgccggaaaagaaaaggaaggaggagggaaatacggcacgaccggaagttcaagcgtgtttatttatgcggatcatgttgaagccgaaaatttgacgtttgaaaactcgttcgaccgcacgaaagtcgacacgaccgatacgcaagcggtggcggtttatgcgaaaggaaacaggatgacgttcaaatatgtcaggtttataggcagacaagatacactgtttgtcaatgacggtacacaatatttttatcaatgctatatagaaggcgatgtcgatttcattttcggaggagcaagagctgtgtttgaagagtgccagatccatagcgctgaccgcgggtccgctacaaacaacggttatgtgacagctgcgagcacgcatatcgcaaagccgttcggtttattgataacaaactgcagagtgacaagcgatgccgcagatggaacggtatacctcgggcgcccatggcatccgggaggagaccccgacgccatcgccagtgtgctatatcaccgctgcgatttaggcgcacacatcaagcctgaaggatggacggatatgtcgggcttttctgcggccgatgccagattgtacgaatacgggaatacgggtccgggtgcgatttcgcatgaggcccgaaggcagcttgccgatcatgaggctgagaaatggacaattgaaaacgtattggacggctggaatccta

SEQ ID NO: 3126 - DNA, 366 bp, Bacillus licheniformis
ttcaagtcggagatcgcgtaaagggcttttataaaacaggcgtctacatcggcgaaattacggatgttaaaccgatgcactacctggtcaaaatcctcgccgtgctgacccatccgaagcagggcgaccttcatcatcccaatcgggcagacgtccctttttttcatgaacgaaaagcgctcgcttacggtgaacagacgaatatcccgcaccgcatggtgaagccgttcgatgaagctgtaccggattatgcggattcgctccgctcagctttgagccgcttaaaaacggatctgcaaaacgattcgtccgaatacgcggcaaaatcgcttgagcttattcatgggcttgaaaaagaatatttcc

SEQ ID NO: 3127 - DNA, 498 bp, Bacillus licheniformis
tggaagggcgtcccgttatgcccggctgccccggtgcgttagcttaaacgttatggaataaccgaatccggcctattaaaccttgaagacaaatgcaccaccttatttcccagtgcataagggccggagatgcgccgatgcgcggctatccgaacagaggcaaggggctggtggatgcaaaaccaattcctggagctacagctggactgtcgctcattcgctcagaccctttttgaagcattcaagagccggtctccgagcggttcaaaagccggctgcgaaagagctgatcgaaggcgatgtcatctgctatgattttaacggagacggcagatttgaccacgtggcccttgtgacagcgaaggataaaagcaatatgccgctggtgaacgcgcaaacgcacgactgccggatgaggtactggtcttacgaagattcgcctgcttatacttcatcgattcgatatgcgttttttcatatatcagatgatacgacaaa

SEQ ID NO: 3128 - DNA, 906 bp, Bacillus licheniformis
atgcatgcaagggctcccgcctcaacatacaggtatcagccgaaaaaaggggaaagtccgaccgcgtttttcaaaaaagcagaccccactcccggagtaccgggcgtcaaccaaatggtcaagccgccgagctttcctaaaatcactctggcggcgcccgacggcgtgcatgtgagctcgcccggacgaaatgtaaatgaagaaaacaacgctgtgtctgcctggcaaaatacacttagaccgcctgaaccgcggcaaaaaaccgacggccaaaccatcaggcgcggcaggcgcgtttttgaacaagcaggctgcatatcctgtcatgccggccggtatttgacgaacaacaaggtcatctcggctgaaacgatcgggaccgagccgacaagggcgcagtcttttaagaaagcagaaagcatattcgggaaaagccttgtccattcgcctgacacaccggtgcctctgccgcgcaagccggaggttctgaaagtcccgacagccggatttgaccccgaacagatcaagctttcgtgggcgcagggtgattccaaaggcgggtataaagtgccgagtctgattggcgtttactggcgcgctccttatttgcacgacggaggggttgcagttgggagctcattgaaagaaacaggcataccaaagacgattatcaaaggtaagccggcgaacccttataacagtttattggcgatgatcgacagagacttaagacagaaggtcatcaaaagcaattcggaatcgcccgacttaaaagcagtcagagtaaccggcaaagggcatgaattttggatcgacgccaaaagcggcttttccaaacaggagcaaaaagcgttgatccattatttaatccatgccgatatgcctgaaaagcaagaaataaaatga

SEQ ID NO: 3129 - DNA, 903 bp, Bacillus licheniformis
atggcttttcacctgccgccatacttgatggaaatccgggaaattcaagaaattataacggctgaagcgcctgaatttgagaggcaaaatcaagagattttcgatatgacggaccagcttttcgtcacgacggccacatgggggctggacaggtgggaaaagattttgaatgtcagacgcgaggcttcggacggcgtcgatattcgaagggcccgtctgttaaccaagatgtccaatattccgccgattacaagccgctcgatcgagcgcgcggttaatgcttttttaaaacagccgtccgcatccgtcagactgacggccggacggtatcattttttgctgagtgtaaacggagaggatctgcagtttataccttcaatcattcaaaccgtcaatcatatgaagcccgcccatttggcttatacattccggggcgggtttcattatgaatgtcggccgccgaaaagcgttcatgacaggctcgttttaagaagcaaaaacggctttttcggtacgataccggtctatttggacggacagtatctgcttgatgatgcattctacttgaacggttttcgagaaatcgacggactgccccgcaggtttaaacagcagctcacactgcgccacaagaagcggcaatacattcggtccgcctccagctttacgataaagacggccgctgaaaaccggcggaaacagcaaacaaaagctggcatgaaaaccggcattaccaatcaaaacaaaaaggtccaatccttcaaaatcagctgcaaatgcgaacatgaatttaagcaagcaggcgcgcttgaaatgagagagaagtggtggacgctaaacggcgcatttttgctcgacggtacaaagcagctggcagcagcggcgcaaaaaatcgcattgtaa

SEQ ID NO: 3130 - DNA, 903 bp, Bacillus licheniformis
atgtatctcatctataatgaaggaatcaactcgccaccttcatcaaatcggatatttttgcttgtcatgagtttcggcaataccttggttcaggcagcttatgaatcgtacaaagggacacagtcgtattttagattcagaaaatccgattcaacaacatggacgccatggcagacccaggaaacgaccagtggagcacaggccaaggttgatgctcatgaacaaaatacgaatctccatgtgaatgaagatgaacgggaaaaatggaacaatgcacagttatataaaattactgataataatggaacgcgcacaaaactgccggatggaacggatttattaacgctgccgacaggtttttattatgctatgggccatgttgttcaaaacaaccctgtagaaaacgacagctcctggtttaattacgatgtaattgaaactggcgctggaagaaagaccatccatgcgtggcggagctatgataatactttatggcatggaacagttcacacagatggacagtttcgagaatggaaaagagtagtcacaaacgccgatttaaacgttgcttggcagactccaacgttgacaaatggatggaaacagtatgggtcgcacaaagtccggttttgtaaaaatatgcttggagaagtcgaaattatcggatcaataacgggcgggacgattggctttgatattcctgcgtttacgctgcctgaggggttccgcccgattcaagcgatgtactttataggtgttgcatcaagtataggtactgggtcaataccgcaaatccaccggacactgatcgatactgacggaagggtatgcattcaatccagttcaaatacagtaaatccaaacgagtttattactttcgggtttaagtttagagctgcatag

SEQ ID NO: 3131 - DNA, 486 bp, Bacillus licheniformis
ccttgtgcaggcttttgccccagacaggaagcatctgaataacggcgagggattcgccgtcttcctgtacaaacgggtgctggtgcatgagtatacccattatgcttttcacgtcaagctgagagaactgaatgccgacccgggaacttatccgctctggtttcacgaaggagtagctgaatgggcttctgctcatgccgcgatagaaatccggactttgccttcagtcgtccccttgagcaagctgaagaccgaccggcaatggcaaaaagcccggactggatatgaaaccgatatttatttgcaaagttattatttgatcgaagagcttgcggagaaaaaaggaaggggcgtcatcctcgacattatcgaggaaacggctgagcggggaagttttgcagacggatttaaggccgccgtcggccagtcgttgacaggttttgagaaagaatttaaacgaaaatacgaagcgaaaaaaacggcgtt

SEQ ID NO: 3132 - DNA, 531 bp, Bacillus licheniformis
agcaggctcaaatatgttggaaggagataaaatcccaaatagaagggtgcgaacttctaaacaaacctgagcaaaaatacaggattgcatacagcaccattgaacacccaaaaacaaattcaaccatcaaagctttatctaaagatgcagggaagaccggtgacggatttaacccgcaatgcggcataatcgatgaatatcatgctcataaaacgtcagagatttacgatatcctggagtcggggatgggcgcaagaacgcagccgatcatggttattatcacgacagcggggcacgagttaaacaatccggcctatcgtgtggagtatgattatgtttcacgtcttctcgatccaaacaaagtagagacaaatgaacagtattttgtcatggtgaacgaaatagataaagacgatgacataaaggatgaaaggaattggataaaggctaatccgatattagcttctcatgaagttgggaaaaaatatttgcgagatcgtcttgaaatggctctggctgttcctgaaaaat

SEQ ID NO: 3133 - DNA, 286 bp, Bacillus licheniformis
atgaagttaattatcgctgttgttcaagaccaagacagcaaccggcttttaaaggctttgaccgatcacaattttcgcgtgaccaaactggcgtcgaccggcggctttctgaaatcgggaaacacaaccttcatgttgggtgtagatgatattcgagtagacaaagctttaagcttgataaaagaaaacggaagcaagcgggatcagctgattgcccctgtttctccaatgggcggaaatgctgattcatatgttccttatcctgttgaggttgaagtgggcggac

SEQ ID NO: 3134 - DNA, 324 bp, Bacillus licheniformis
cccgcaaatctactggagcatcggctttgccccagcttcctacgacatcttagtggactggtggaaaaatgaagtcagccatcgccccgttcatttatacattggacaagcagcctataaaatcaatcaaaactcagatcccgcctggtcagaccctgaagaatatccgcggcagatcgcattaaaccgcgcctcaaatgtgatgggaagcatccatttcagcctgaaagatttaaaccggaatccgctcggcattaaagacagactgatccaggacttgtacaaaaaaccggcagctgttcccgatatgccttggcttggcag

SEQ ID NO: 3135 - DNA, 426 bp, Bacillus licheniformis
aaaattgaagaaaatttttcttcagccttttatggggcaagttgaaggagtattttcagtttgcaaaggattccaacacgggaagggaaagccggagggggaaccaaaaagccttaataccatttttggagaagagttggcaagaccttattcgccttatggagtgtgaaacgctggcgattctgccaggaccagggatcagcatgacgcacaactgatcaaacacgcgttaaaagaggctgtactatcaggaaaattcagtttccgtaacattgaccggattttgtttgaatggaagaaaaatgggcttaaaactgtggagcaggcaaaaatacacagccaaaaattcgggcgtgtacaagcaaagcagaatgaaccgcaaaaagagtataaaaggcaggttcttttttacaattggcttgaaca

SEQ ID NO: 3136 - DNA, 899 bp, Bacillus licheniformis
atgtccgggaaattaaaagaggcaaaaaaaattcatcaaaacaatttagaacgtgaattaaaaaatctagagcaaacatatcaagatcacctggtgcaagctcataaagaggcttccgctgctttacaacaagctgaagtcatgaatattaatcaaaaaaatgaattcttaaatgaaaacgattttctgaagaacaagattgtaaagatggatgaatatataaacaatcttaaaaagtattcaagaaatagcggtgaagttattacccacactattttaacggaattaaaagaaaagcttatttctgaggggaaaataaatgaaaacgagatggttataatgggaaacgtatttgtaccctatgaagaaaatggggagacaaaaaccaggcaaattgatcatttagttattttgccatcagatatctatattatagaaaccaagtattggcgtggaacagttatccatgggattaatcgtaaaaatgcggaatcaattgcaaatgatttttcatttgtctttgaacaattatttccgaaagcgaatagtgatacagagaagacaatcatttttatgaaaaatagcaatatagataaggattccgagcaaaaaaattctataaatatttcttattatgataacccgagaaatcaagtcatggacacaatgtataaactcaggaattttctcataacctataataataaattcaactatgttgagcctatagtctattttggttatccggaggacaaagaaaatcgtgtaatagattattctacaaaagataagaatagatttacctcaaaagcaagtttgtgcgagtattttaagaatgaggttttaaagcctgctaaatatacagtcgatagaatacaacaaataaaaaggctatcaag

SEQ ID NO: 3137 - DNA, 459 bp, Bacillus licheniformis
acacgccaaacaagaaatatttgacctgtacatcaggctcattcatcagcaggagcagcaagaaaccgtcatgaaagagcgcatctccgcagaaatgaaaaagatggagcgcgaattcggagctgaaatgagactcaatatgtctgacatccatacgatcagctgcattggcgaccacgaaccgatcaacgtcacctcgatttccgagaagatggaattttcaaaagcgacggtctcaaggatcaccgcaaagctgaccgaaaaagggctcgtcagcaaaacacagctcagcgataataaaaaagaaatctacttccgtttaagccataaagggagaagcatccatcaccttcaccagcgggagcacgataaaatcgaacaaagatttaaacgatttttaagccggtattcatttgatgagatcctttttgccagggctttgtttcgggacttattaac

SEQ ID NO: 3138 - DNA, 897 bp, Bacillus licheniformis
atgaagaatgaagttgaacgaaattatggcatcaccattcgcaaaatcggttctattggaatttctgcaatgatgcatgggtatatggcttttgacaaaacaggggagctgcttgttccgtttcgaacttggcgtaactcaacaaccggtgctgcagcaaaagaattaactgatcaatttcaattcaatatccccgaacggtggagtattgctcacctttatcaagcgatattaaatgaagagaagcatttgcctcgcattgactatatcaccaccttagccgggtacattcactggttactgactggtaataaagcaattggcattggagatgcttcgggcatgttcccgattgatgaatcaacgcaaaattacaatgaatcgatggtcaagcagtttgatgaactgatttcgaacaaaggctacccttggaagctgaaggatattcttcctaaagtttatatttcaggcgagcaggctggtgaattaaccgaaattggtgcaaaaattctggatcagtcaaaaaatttacaaccaggcattccaatttgtccaccggaaggcgatgctggaacaggaatggttgctacgaatagtgtgaggaaacgcactggaaacatttcggtgggaacttcagtttttgccatgattgtattagaaaaagaactttcaaaagtatatccagaaattgatttggtcacaacgccaaacggcagtccggttggaatggttcatgcgaataactgctcaagcgatattaatgcttggctaggattgtttcgtgaattttttgaagcaatgggacaaaagattgaaacgaataaattattcgaagtgatgttaaataaagctttggaagctgactcagatggcggcggtttgctaagctacggctaa

SEQ ID NO: 3139 - DNA, 637 bp, Bacillus licheniformis
atgtttcagcaacagccgatgagaaatcagccaagaccgcaggcgccgcaaaggcccggcagagccttgatgccgagacatccggggatgggaatgcagccccctcaagcgcagcagcgtggcctgcagcagatgtttcagccaatgggcgccgcccagcagcaagcaggcgcgcgaggaggagggattcaggggttgctctcgaaatttcttcccggatctgccgcatccgggggaacaggagcgggtctcggcggaaccggaagcggccttggaggcattcagggtctggccaatccgtctaccatttcaaatatgctcggcaatgttcaaaaagcgctcggcgtagcccagcaagtaacaccgatgattcagcaatacggaccgctcgtccgcaatctccccggaatggtgaaaatgttcagacagctgaattccgatgatacggaagcagaagacggcgaacaacaaaaagacgaaccggaacacaagaccgaaacgagcggcgaaaagaaagaagaaattaaagtgtcatccaaaaaacccgaaaaatccaaacccgaagaaatcagaaaaaaacagagccgttcagcccctccgtctgcaaaaagaaaaaccggaggatctaaacctaaac

SEQ ID NO: 3140 - DNA, 402 bp, Bacillus licheniformis
tttttccgatttttccgccgtacaggtcagaatcgcccggcctacagaccgttttgacgaaatcgttgcattttacgaaaaggggctggggctgaaaaagcttggcggtttttccggccaccacgggtataatggcgtcatgttcggcctgccgaatgtccaataccaccttgaattcacctcacatatcgaaggaagcccttgtccggcaccgactaaagacaatctgctcgttttttatattcctgatccggaggaaatcaggagcatattaaataggctcgctgacatgggctatgacgaagtgccgcctgaaaatccgtattggaaggaaaaaggggcaacggtggaagatccggacggctggcggatcgtgctgatgaataccgaaggcatataggg

SEQ ID NO: 3141 - DNA, 414 bp, Bacillus licheniformis
atgaaagtggcggatatgcccgatcgaatcgttctgtttgacggcgtgtgcaacttttgcgacggagccgtgcaattcattatcaaacatgatcctgaaggcttattttcattcgcttccctgcaatctgacgccggagggaatctgctcaagcaatatcacctcccttccgatcattttaacagctttattttgatcgaaaacggccgggtatatcaaaagtcaacggccgccttgcacgtggtgaaaagcctcccgggcctttggcgggccgcttccgccctcttgatcattccccggccgcttcgggacgccgtctacagtgtcattgcgaaaaaccgctacaaatggttcgggcaaaaaagcgagtgcaccgttcccggtcctgagatcagaaaacgatttttatcataa

SEQ ID NO: 3142 - DNA, 309 bp, Bacillus licheniformis
cgaatgccgtcatcgtcaacggagaaaacgccgcacacggaaaaggcattaccgaaaaaatatatcaccagctcattcaagctggagccgacgttctcacgatgggaaaccacacatgggataaaagggaaatatttgattttattgatgatgcgccgcaaatcgtcagacccgccaattttcccgagggcacgcctggaaaaggcatgacatacataaaaacaaacggttcgaaggaactggctgtgatcaatatgcaaggtcgaacttttctgactgcgatcgattgcccatttagaaaagctgatg

SEQ ID NO: 3143 - DNA, 324 bp, Bacillus licheniformis
atgacgcttgaaaaaacaacgagaatgaattacttattcgatttctatcagacgttgttgacatcaaaacaaaaaagctacatgtcgctttactacttagacgatttctcccttggcgaaatagctgaagaatatcatgtctcaaggcaggcggtctatgacaatatcaaacggaccgaagccatgcttgagcaatatgaagaaaagctacttttgtttaaaaaatttcaagagcgcaaaaagatttttgaagcgctgagaaagctgactgacggtcagcctgaggcggagtccctgattgatgcgcttgagaaattagattag

SEQ ID NO: 3144 - DNA, 351 bp, Bacillus licheniformis
  misc_feature (1)...(351): n = A,T,C or G
aaagaattctaccaagagatcggtcaaaaaggcggagaagctacaagccaaaaccatgacaaagaattctacncaggaaatcggcgaaaaaggcggggaagccacaagccgcaaccatgacaaagagttctaccaggaaatcggcgaaaaaggcggagaagccacaagccgcaaccatgataaagaattctaccaagaaatcggtgaaaagggcggagaagccacaagcaaaaaccatgacaaagaattctaacaggagatcggtaaaaaaggcggagaagccacaagccgcaaccatgacaaggagttctatcaagaaaacggcgaaaaagccggacgccaaagaagaag

SEQ ID NO: 3145 - DNA, 273 bp, Bacillus licheniformis
aatgattgtcgttcagaacgctgcatttgaagtcgtcaaagatgtgaaaaacggttttaacgaagaagcgtttaaagccagatactccgacattttaaataaatacgactacatcgtcggggattggggatacagccagctgaggctgaaaggcttttttgacgatcaaaatcaaaaggccacatttgatacgaagatcagcacgcttgatgaatatatttacgagtactgcaatttcggatgtgcctactttgttttaaaacgtctgcgaaa

SEQ ID NO: 3146 - DNA, 558 bp, Bacillus licheniformis
aagaaaaaaaagccggtaaatttcagacatttttgtttgtcatcgtcattccgctgatctttttaatcgttgtagcgttcgtcggcatgtggcttttgggcgtcaattttcaggatgcagcctcaaaaattcccgtcgtaaaagagcttgtgaaaaacggcgaggatcaggacatagatcacgcaactaaacagcaggagaacaaagcagaaaagctccaaaagacgatcgatgaacaaaaaagcgaaatcgaaacgctgacgagtgacttaaaaacgagtgatcaagagattaaaaggctgaaacaaaaaatcagctcgctcgaaaaaacggaaaaagatgaaaaagagcaggataaaaagaacgccgaaggtcaaggagacggaaaagtcgtcaaaatttatgaaagcatgcaaagcaataaagctgcaaaaattttaagcgaattaaaagaggaagaggcaatcaatattttagattctttaagcaaaaagaaagtgactgagatcctctcaaaaatgtctcctgataaagcggctgtattcacagaaaagcttg

SEQ ID NO: 3147 - DNA, 266 bp, Bacillus licheniformis
atgccggaagcaccagaactggatatattccaaaaagaagttcaggagatgaaagctgatcaaaaatcactcgaacagcgcgtcagtacactcgaaagaacatcagaccgccacgatcagcaaatcatctcgattaacgaaaagctgaacaaaatcgaagagaatacaacctggattaagcgcagcatcacaggcgcgataattacagcggtcagcaccggcatcatcggcggcgcgatcgctgttttttataatttattgcagaa

SEQ ID NO: 3148 - DNA, 841 bp, Bacillus licheniformis
ttgacaagcattaaaattgtaacggactcgaccgctgacttgagcgaagaactgctcagaaaatatcatatttccgttcttccgctctcgatatcgatcgacggcactgtatacagagacagattcgatattcagccggacgaatttattgagaaaatggagagcgccgcagaactcccgaaaagttcacagccgcctctaggcgcttttatcgaactgtatgaagagctgaccgctgacggaagcgaagtgatcagcatccatctctcaagcgaattgagcgggacataccagactgctgtaagcgcttcaaatatggtcggcgggaacattacggtgattgattccatgtatatttcaaaaggcctcggttttcaggtcgtgcgggccgccttgctggccgaagagggcatgacggccgaagcgattgtaaaagacttggagaacttgcgcgaccggacttccctctatgtgacaattgatcattttgacaacttgatcaaaggcggccgcatcgggaggggaaaagcgctgctcggctcattgctcaaggttaagccgatcgcgaggcttgaggacggaatctatacgcctgaaaaaaatgtccggagcagcagtcagcttatccgttatttaactggtcaatttgtttcagcggttaagggaaggacggtacaggcgatcggaatcgcccatgccgatgcgctcgatctcgcccatcggctgaaagactccttgcttgaacatatcccgggaatcgatattgatattgactacaccacaccgattatctcggttcataccggaaaatgagcgatcggttttaccttttacaccgatt

SEQ ID NO: 3149 - DNA, 477 bp, Bacillus licheniformis
gtgaaacgggtgattgaagagctggagcgcttatgcgtgctgcatgaacatctgctgtctctgtcggaacaaaaaacggaggcgctgaagacgaacgaaataaaggcactttcagaaatcgtgacgaaagaacaaaagtatgtgcaggccattgaacaaacggagcagtcccgcattgaagcaactaaaagctgtatcggcagctcggacgcgacgatcagcgcatgtatcaacgaagctgcgggcggcgagaaaaaggtgctggaacagctgtatgccaagctctcacagctcgtcacccgtttgaaggatgtgaacgatttgaacaagcagctgacttttcagtcgcttcaatttatctcgcttacatttgatatgctccttccgaatgaaggcggttcgaattacggaaaagagcagcagccaaaccagacaggcggggtgaaacggctttctttattcgattcaaaagcttag

SEQ ID NO: 3150 - DNA, 317 bp, Bacillus licheniformis
ttgattagtttaccagttgtcatcatttcagttgtcttatttttcgtcctgtttttcggcatcggttttctgctgaatatgctgctcagaatgtcatggatcatggctgtcatttatccaattgtatgccttttcattgtgaataaagaaaagctgattcgctatgtagaggcgccgggagaggcattttccggcctttttgacagagtggcttctttggctgctgccgatatcatcattttagccagcggaatggccggagccctgttgtcgggcgttacgatcaaagcgctgcgaaaaaggggatatcaaatgtt

SEQ ID NO: 3151 - DNA, 465 bp, Bacillus licheniformis
  misc_feature (1)...(465): n = A,T,C or G
gatccaggccgtttatgtagagcaatatatggcgctacaagcatctgcctgagggagtacagcgaggcattgcccanagcggtttcccaggatgtgcaaaagcccgaagatgctggctttgaacaatgaaaagacagccgatgtacagctgtatttgtttacccaagcggtacagcttccggcagcgctattgaatatgattcagacatttgactattcacagaccgtgccgaagctgatcttgtatcacacggaacagacggggacactcacccggtcggacgcggccgccttgcttttgttaaatgaaatcggcattgacattatcatctataatccgccgggccataagtgtattgaccactatatcgacaggcagcactttgatacccattggcttgatgaaatgtccttcaaccaggagtttaaagagccgtcaatcgtccggaagttcatcaataaaat

SEQ ID NO: 3152 - DNA, 741 bp, Bacillus licheniformis
tgaactgaaatcgagtgaaaaacgaaaagcaaaggctttgttagcggaagaaagcccgacattcgcgcatgcgatagccgaaggaatcatcgaaggaaacgtctatgtcgatgatttcctcacaccggccactgctctttttcgaacatcttccgggatttattatgtcgctggaaaccctccggacagcggaagaagcgagtggctccattatttaaatgaacagaggagcggagcgcgctttaccgtgttttcggcttctgaagagtgggacgcttttttaatcggggggcttggcgatcctctgcagcaaatggagcgcgtgtcatttttcctcggaaaagaggagcgtgattgcggcgcagcatttgccggggttgaaagatttactgaagatgaccttcaaaaaagcgcgaattttactgaaaaatacgctgatgagtattggggaggggccagccgttttttgaagaacggtttcgggtttaaagtgttgcatggaggtgtggtcgcaagcgaatgtgtcaccattttttgttcggaacgctttgccgaagttgatatcgcaacacacccggattacagggggcggggatttgcagtcagctgcgccagcgcctttatcgcacatgcaataaagaaccgtttgaaaccgcgttgggattgcgaccggcaaaaccgcgcatcgatccgcctcgctgaaaaattaggttttcgacctgtcaaaacttattctttatt

SEQ ID NO: 3153 - DNA, 345 bp, Bacillus licheniformis
atgatgaatcagcaaaaccaacagaaaatcggcaatcaggaaacccctgtcccaaagacgagcgcgatgaacgacagggattttgtcaacgaactgctgacaaccgaaaaatatatgacgtcagcatactcgacggcgcttaatgaactaagccatgaatcgctttaccaggccgtacagccgctgtttaacgaggcgcaaaacgctcagcgcagattgtaccaggtaatgtttcaaaacggatggtacaaggtggaggcagaagatgcccaaaaaatccagcagtcctatcagcagttccattctacactgcaagaccagtcgccttatcagcaaaatcaataa

SEQ ID NO: 3154 - DNA, 319 bp, Bacillus licheniformis
atgaaaaagtttattacggcgttgccgattgtattgctgctgtcattttcatttgtttcttttgcctttaactttgatcatctcgtatattttagacttgcgctcggactattttcgcttgcaggtttgtttctgttatataaattgaaaaacggcgtccgcctctttatggcatacctttatggaagctggatcgtgctggccggaatcgccgcatatgaagaaccgcttttttccgatttcttcttcggcggcctcacgatcacgatgggctacttaacctacatgctgatttatctcggtatgaaggttgaccgcc

SEQ ID NO: 3155 - DNA, 366 bp, Bacillus licheniformis
aaaaaaacatccccacactcgttcgtttcgggacagtcggagccgggaacacactcgttgatttcgtcgtgtttttcctccttacgtcgctccacgtcccctacctggccgcacagttgttttcctattcggcaggcgtggcaaacagctatatctggaatcggacatggacgtttcaagtaaaagaaaaagcgcatggcgcggaaatcgtccggtttatcatgatcaatcttgcagcagcgggcgctacatttgtccttctgtacatttttcaaaaagccggcctgtccctttttatcagcaagatgtccgcaacagtcgcaggaatggccatcaactttaccggaaacaagctttgggtgtttc

SEQ ID NO: 3156 - DNA, 864 bp, Bacillus licheniformis
atgaaaaaaccggttggaaacctgctgatcatcgccggcattctcatccttgcaggcatgatgtttaatgggcgtgaaggcttttctttgttcggcttcgatgaagagtcagcccgcacatatcatgcacaggcggaagacatcgataaaattgacattgatgcaaagagtataacagtcaacattcaagctgaaaaccgcgatgatataaaagccgagatttcaggaaaaaacgtccggcttgattcgtccgaacaggggcgtactcttcagctttccgctcattcgaaaggcttttggccgtttttctggaagaaaaatgagctgattgtcaagatcccttctgaatataaagatgatctgtcgatttcttctggaagcggaaatgtcaaactgtccggcggcggtctgcatttgcgaaatgtagccttaaagtcgggaagcggcagcctcaaggccgatgaccttcaggcggaagacctttctgtaaaagggacgtcaggatcggtcaggctggaaaacgttcaaacggcagctgctgatatccgctccacatccggtaatacaaaacttgaaaatgtcaccggcaaactcagcatcaaacagacttcgggcaatttgcgcgcttcctttacagagatcaacgattctctgagcatcaaacagacatccggaaacaccaagctcagcctgcccgatgatgccgacatcagtcttgaagccgagtcgacaagcggaaacatcagtcattcctattcatttgaccaagtcgccaatgagaagcggacgctgactggaaaaaaaggaaatggaaaaaataaaatcgacatctcaattacgagcgggaatgtctcaattgagtaa

SEQ ID NO: 3157 - DNA, 357 bp, Bacillus licheniformis
atgaacgtggaaattgctatcattgcgctgctcgttgtcagtattgcgctgattgcattctcatattttcaaagagaaccgatcaaggaagttgaacaggagttggaaacccttcagctgtccgccatgcaggaaatctataaactgaaaaagaagatgaccgtgcttgaggaagagctcctcgattcaaatgtggtcgtccgcagaccgaatgccggaatcagccagcatattgcgaagcagattctttcaaaatatcaaaacggcatgtctgtagacgccatcgcaaaagctgagcacgtatctgtcgaagatgtcaaagcgatcattaaagactatgagagggtgcttgtatga

SEQ ID NO: 3158 - DNA, 353 bp, Bacillus licheniformis
atgaaacgtgcacgaatcatatacaatccgacttccggacgagaaatcttcaaaaaaaaccttgcccaagttctgcagaagttcgagcaggcaggctatgaaacgtcatgccatgcgacaacaggggaaggggatgccgtacaggccgccagacacgccgctgagcgggaatttgacttgattgttgcggccggaggagacggcacattaaatgaagtcatcaacggactggcgccgttggaacaccgtcccaagctcggagtcattacggtcggaacgacgaatgactttgttatagctctctgtttttcttgcgaggatatttcataggttgctgtttcttttctacacgg

SEQ ID NO: 3159 - DNA, 321 bp, Bacillus licheniformis
gggtttcagcacgaatttcaccattccggatgagtactcaaattatttgtccctggcgattctggcatcgctcgatacgttgatcgggggaataagggcccatttggaaagtgtatacgatgaactagtttttgtgacaggctttttcttcaatattattcttgccataagtttggcttttctgggcgttcatcttggtgtagacttgtatttagtcggtatgtttgcatttggcgtgaggctttttcaaaacatcgcggtcatcagaagaatactgctcgccaaatggacggcatcgaggagaaaaaattaaaaaaaatc

SEQ ID NO: 3160 - DNA, 360 bp, Bacillus licheniformis
ttacggcttgtctcatgctgtctcacagcttccttcgtatttaacggttacggcgatgctctttacacagatgctgtttaacttttttgttccaagcggaagcggacaggctttaataatgatgccgattatggcgcctttggctgatatcgtcggaattacgcggcagacggcgattctggccttccaattcggagacggtttttcaaacatcgtctttccgacatcgggatattttatggcgacgcttgcgatcagccggattgcctggaacaaatggctgcgattcatccttccgctgttttgcctctggatgggagcggccgtgcttttcctgatgtttgctaacgctgtcggctg

SEQ ID NO: 3161 - DNA, 861 bp, Bacillus licheniformis
atgtgcgtcgaccgcaataacaatgtgatctacgctgcaaaattgaataacacgaatcacacgacgcagttattctctgtgaaaatgagcggtacggcaagcaatagaaccgttgcacttcttaaaaattcggataccaatactacgagctatgatttagggcacgccaatgacttggctgtcaaagcatctgcgggcgataaaagcgtcagcgtttatgtggcgccgatgtctgacggcactaagtatgccaataaaatcgtgaagctcagcgtcgatacaacgaaaaatacttataaagtggctaaaacatatgtgctgaattatcaaggttcgaatttgtcgattggcggtatcacatactcggttgggacggataaatttatcgtaagatcgggaaaaaggttctttattgggacattcaatgatacaaccggaaaattcgactatgaagcaacgtttaaattaaactattcgaaagctgttgtgaatcatcagacaatggatgtttcgcatttcattcagcaaggaatttccttttaccaggggacattgtatgtgccgcttacaaaaccggacagcaatggcaatgcttcaaatgtgagcattatattgacgtaccctttaaatatcaatgaaatgattaaagagcaaaaaacaaacccgattcaggacttttcgaaggaattgtttactcgcagcgatttatctttcagaattaccagcagtgcatacacgctttttgaaatagaggctgtcgattttgatgacgggacgctttactttaatacgaatcgcggaaaaagcgggacgcaaaacgatatgatcgcgacatttaatgattataattattataagtaa

SEQ ID NO: 3162 - DNA, 264 bp, Bacillus licheniformis
atgaaacatatcgacaaaggcacggtcgtcaggacggtgcttctttttattgcgctggtcaatcacacgttgatcatgtttggaaagccggttttgccggtcgctgaagatcagattcatacattggcggatgccctgtattcggccggatctgcggcttttacgatcgctgcatcgctcgttgcctggtataagaacaactatgtgacgagcaaagggaaaatgcaaaaagaagttttacagaaaaaaggtttaacgaaataa

SEQ ID NO: 3163 - DNA, 852 bp, Bacillus licheniformis
atgcctcccgacagaaaactaattaatgacattcacaaggcaattaacggagagcatagcgccattctctgctataagcaaatagccgaaaatgcccccacagaagatataagaaaacaaatacttgaaattagacaagatgagcaacgacattttgaagagtttagcagaattttcactaacctgacaggcaaaaagccaatccccataatcatagaagaatgccctaaaaagtatagaacaagtctagagtctgcttttaaagatgagcaggagacagtcgatttttatttagatttagcagaccgaatacaaaatcagtcaattaaaaaggtttttcagcgtgcagcagctgatgaacaaaatcatgctgtatggttcttattttttttaaatacatcgtctacacaacaaacacgtcaagttaattatggggcaaaaggagcgttaaattccggtaggctcaccttacctcaaatgcttacctttgccattcaggatgagtacttagctcaagcaagatacaatgaaattctaagaaacttcggggatattcgaacctttgtccaaattaaagaagccgaattacggcatatcaatgcattactttctctttttgaacgataccaagtacagatacctaaagacacctctcaattatatgtcactacaccagtaacccttaaggatgcatatgcttctggggtacaaggagaaattgataatatcgccatgtataacaagtttctaacttttgatcttccagcagatgcaagaacagtttttactcaattacgcaacgcatcactaaatcatttagaggctttccgaagaggtcttgagagaaattaa

SEQ ID NO: 3164 - DNA, 333 bp, Bacillus licheniformis
atatgctcagcgtcacagccggctggggcattccatttgtgatcattatcatgattccgaatatccgccacagagtctggcgctacgaagtccatgagaacgaaattgatattcagcacggcatctttgtggtgacccgcgtgatcgttccgatggtcagagtccagcatgttgatacatcgcagggccccatcctcagaaaatataatctcgcctccgtgcaaatttcaacagcagcgacgacccattccattcccgctttggatgttgaagaggccgatcagctcagagattccatttccaggctggcaagggtgactgaagatgatgtct

SEQ ID NO: 3165 - DNA, 475 bp, Bacillus licheniformis
atggagttggcaaaagaattgatttcccaatacgggtatttcgcgatattcgggatgcttgtcctcggaattgtaggcctgccgatacccgatgaagtcatgatgacatttgtcgggtatctgtcttctattcatatattaaactatgagatgtgccttttgatcagtttttcaggtgcgatatcagggatgctcatcagttattttctagggaagaaaatcggtaaaccgctgctcgataagttcgggaaatggatcggtctgacgccgaaaagactggacaccgtgcaccgctggtttgaaaaatacggcccgtggacgattcttttcggctattttgtccccggaatccgccatgtgacatgctatctgtccggcatgaacgagatggacatgaaaaggttcctgatttatgccggatcaggagcttttatttggtgtcttgtttttattacgatcggatacacaatcggcg

SEQ ID NO: 3166 - DNA, 300 bp, Bacillus licheniformis
agcgggacagcgggcgtacccgatgcttgaagttttgaagaaacgcaaccttaaagatacatgcgccgttgtgacgagatatttcggcggcattaaactcggcgcaggaggattgataagggcttacggaaaatccgtgtcagaggggctgaaccatgtcggcgttgtcgaactaaagctgatgcgggtcatgcacaccactgtgaactatacatggatcggcaagcttgaaaacgagcttcgcgagtccccttatcaaataaaagacgttcactatgcagacgatgtcgaatttgaaac

SEQ ID NO: 3167 - DNA, 309 bp, Bacillus licheniformis
ccttatttactgccgcgccgacagggtagacagaacacagcagtttgcggaagatgtccttccttatattgaagcaagtgaacttgtgctgattggagaaacaacagagccgatcgtcaaagcatatgaagcaggcaaaattcctgcggacaagctgtttgattttgagcacaaatcaacggaagaaatcatgttcatgctgaaaaacaagcttgagggccgcgttatttacggagtcggaaatatccacggagcagcggagcctctcattgaaaaaatgcaagattacaagattaagcagttcgttag

SEQ ID NO: 3168 - DNA, 387 bp, Bacillus licheniformis
atggttatggaacatgtgaaagcccttgccatcaaaggcatcatgacgattgtgattctgtaccttgttctagggctcgggtttagttttagttttgaaaacaccctattcatcacgattgttcttggcgcagtatcctatttgctgggtgatttgtttattctgccgaaaaccaacaacatcacggccactttagccgatttaggcgtcgcttttcttgtcgtttggctgatggctcttgcgatgggaacggctgccaacaccgctgcattggccgcgttttttgcagctgtcgctatggcgatcggtgaatacattttccatttttacttgatgaataaaggccttggctcgcccaaccgcagaatggaaacgagaacggaataa

SEQ ID NO: 3169 - DNA, 849 bp, Bacillus licheniformis
atgaatcaaaaccttcgtcgtgtaattcactttgctcaaaagaagaccctggcttccgaaataagtggtagaaactcatggtttttgattagtaaaacagttggtttctcattaggaccactcatgtatcattggcttaatgcatactcattaattatcaatctattaactatattgattgcaataacattaatattaacaataaaagatttaggttatgtaaataataaaaagaaaaaagagagcattttttcttcgttcaaagaagtttataaaaatcaattattaaaaaggctaaatataatagaaattttaaatggtttaacttttcctgttttaacaagcttatcgatatatattcttgaaaagaatttaaatgcttcttctcttataatttctttgttttggttgataggaggagtaggagcgattacggctaacttgatgctttcgagacttaaattatttaaattacagtatattcatcaatttataataagttttgttctcgtagttggtggattgttgttaatgacgatagctagctattcttttgtctatttaataggattttctttatttactttaggtacccctataataaataatttattaaggtcaaaagtgtttattttcgccccaagtcatatgaaaggaaaagtaacatcagttataacgtcttcatcagatttaggcactattatagccttatcattgtcttggattgttgttgaaaaattcggggtattaatttttatgtcttttgttattttaacaagtgtaagtcgaatatgcctttttttctacactctacataaagtagaaaataaagttgatgtggagggataa

SEQ ID NO: 3170 - DNA, 353 bp, Bacillus licheniformis
ctgtcaaaaggccgatctttagcagctggactgattgtaggcggtgttatcggcggtgttgcagcattgctgaccgcgccgacttcaggaaaaaacttgagaggacagcttaaagccaactgcggtaaatgggaagacaccgtcaaaaggctgaaaaacgacggaatcgcattaaaagagcaattcgtcaaaaccgccatagaaggcgcggaaatcattaaagacgtcggcagcgaactgcaaacgtccatccaggaatggcgcgaggaaatcaaacctcatcagcaggacttaaaaaaggaaatcgctgagatcgaagaaaagataaaacagctggagaaaaccttacaaaa

SEQ ID NO: 3171 - DNA, 843 bp, Bacillus licheniformis
atgataaagtcttttttaatgttggggcagtcgaatatggcaggccgtggatttttgaatgaagtagaccctatctataatgaaaaaataaaaatgctgcgcaatgggcagtggcagatgatgacagagccgattaattacgaccgtccggtttccggcgttggcctggcggcatcttttgcagatgcatggtcgaaagctcatcccgatgaagaaattggcttgatcccttgtgcggaaggtggcagttcattgaatgactggcatccggaaggcatcctttttcagcatgctttggccgaagcccgcttcgccctccgctccagtcaaatttgtggaatcctttggcaccagggtgagagtgacagttatcgttcgctacatgaaacttattacgagaaattaacccttatcatcgagacgctaagaaacgagttgaaacttgatgaggtaccgttgattattggagggcttggtgactttcttgggaagaccggttttggacagcacgcgaccgaatttcgacaggttaatgaacaattgctgcgttttgctaatgaacaacagaattgttattttgttgctgcggcaggtttgactgcgaatcctgatggcattcatttagacgcagcttcacaacgcaaattcggttaccgctatttcgaggctttttcgaaaaagtaccatatcctgaaacccatttcgggagaggagcaatcactgaaagtgaatggtgactattctaaaacagaacagatttaccttcacagcatggatttggcttcgggtaaaatcacgtacgcggaattcgaggcgcggatggcgatggtgatgaaaccataa

SEQ ID NO: 3172 - DNA, 843 bp, Bacillus licheniformis
atgaaaggagctcccatgaatattagagacagggtaaaactttcgctttattccgagcagctgatgaagccggccgccgcgaatgtgccggcaaagactaaaggctccaaaaggatgcccgccagccaaacagacactctctccatcagcaaacaggctgaatcagcccaaaaaaatgcaccgtcattacggtcacaaatgaacggcgttcaatttgagatctataatctttatgtggacaggcagcgtttgaacagccagatcgaaggggcgctgcgggagagcggaatttccctttccgaaagcgaacatctgacattgcatgttgacggacataaccggattacagttgaaggcatcgaagacgaacaaaaaagaacccgtatcgaagctgttttaaacgacagcgataaacggttcggtgcgcgtctgttgggccacgcagaactgatcggtgaacaaaacggaacgccgctggataaacaggcttacgaaaaatggcatgtgaatgagtttttgaaaacggtcgccgggctgtctttggctgatgtcagtttggatgaaagaggagagcttgaaggcggaaatgagaagctcacccgagtgattgaatcagccaaagacccgaaaagcgacttggagaagagttttcaaaacattctgaagaagctgaagaatgtcctggcgaaagggccggacaccattctggacaggtcggcttctttcggctatgccggcggaacgcttatcgatctcaatgtatcaaaaggattctccgcgggccagctgaacgagtggctggatgatccgtttcttagagaagtcctgctgaacaatttttaa

SEQ ID NO: 3173 - DNA, 365 bp, Bacillus licheniformis
atgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatca

SEQ ID NO: 3174 - DNA, 723 bp, Bacillus licheniformis
tctaatcataaatgcagatgattttggattttcaaggggagtcaaccttggcattattgaagctttccagcacggggtcctcacatcgactaccctcatggtcaatatgcaagaagcggatcatgccgtcgaactcgcacggcaaaatccagaactcggagtcgggatccacttgacattgacggccgggcgtccgattcttggcggactgcatacgataacagatgaagaagggaattttcgcaagcttttgtattaccaaggttttttcgacattgatcttgaggaagtatatcgagagtggaaagcgcaaatagagaaggctttgtcctgcggtttaaatccgacacatatcgacagccatcatcatattcatacatacggaaatctccctgaggtgtttgtagaggttgcgaaagagtatgatctgccttgcagaaaggtcaatcatgaccatccttcactgtggaagggtgtaaggtctaacgatgcttttgagctgaaagtcgaccgattgaaggatctatcgagcttctttaatgattatcaagacgcagctgtgattgaagtgatgtgccatccggcttatgtcgataaatgtctgcttgaaaaatcgtccttccattatcctcgggcatatgaactttcactgctgacggaaccttctctcaaagccgctttacaacactgtccggatattcgcctcacgtcttacgccggtct

SEQ ID NO: 3175 - DNA, 439 bp, Bacillus licheniformis
atgttctaccaattgaggttagcggaaacgaaagacatgaatgcgatcgaagcatttttaaaaaaggcggggactatccataagggtcttgaggaagcgaatagccagtttatcatgatggaagaccctcccgatgaaatcgtctcctgcctcggaatggaggaatttgaaaacaaaaaaggactgctgcgctcgcttgtcgtgtctgacaagctcagccaaggccacatcgtttccttgtttcaaagcatgcaggtattgtgcgaaaagcgaggaatccaaaccctttatttagtagccaataagcgaacatcgatggatttccttgaagtgctcggttttaaacaagctgcggcaattcctgatgagctggatgaatccgagcatgtttcagactcactgaacgtaaacggagcggttttaatggagaaaacgtcaa

SEQ ID NO: 3176 - DNA, 286 bp, Bacillus licheniformis
gtgaatttgaaaattaatgaagaggcgcttaaatggtataagaacgagcttgatttaaaagaaggtgatcaggttcgcttctttgtccgctacggaggatgcagcaatgttcaaaaaggcttctcccttggggtctcaaaagatgagccgcagcaaatcggtgtaagtgcggaaaaagacggcattacgtttttcgttgaagaaagcgatgtatggtatttcgacggccatgatctgcttgtcacctataacgaatctgcggaagaacctgtttttgaatatcagt

SEQ ID NO: 3177 - DNA, 279 bp, Bacillus licheniformis
atggcgcaaagaaaaaaccgcatcaaagcgtggctgacaagaacactggaaattccccctgatgtcatgatggatcttccgagaattacgatgataggaagacttcacatatatattgaaaaccacagagggcttttgcttttcagcgatacggaagtaaggctgatgctcaaacaggggcagtgcatcattcaaggcaaagactttgtcatcaaaacgattttgcctgaggaaattctgcttgaaggcacgattgagtttgtccgctatatcgattaa

SEQ ID NO: 3178 - DNA, 410 bp, Bacillus licheniformis
atgaaaacctttaggcttattgatttaaaaattgtccgccaggatgacacttcaaagcggcttgaggagttcccgctgatcgacggccttatcattaataaggaagacggagaaaaccactggatggttgaaggtctggtttctaaagaataccggtattttttcgaatatctccttcaggaaggcaaagaagtgaaagcatatgtaacgatcacgaaaaaaagcaaccgcccagcacagctgttagcgaaggtcaaaaacatcacggtgctcggcgagcatgtttccgtcttattggacggcaaaatggtcagctcaaagctgaggaaaggctccgacaagattttggaagatttaatgaaagaaggatattccggagatcggcttcttgaagcatttaagcaaaatat

SEQ ID NO: 3179 - DNA, 384 bp, Bacillus licheniformis
ggcagatgacgagggctgttaattcgttcagtgaccgggtgcatgatcgagtgaagcggatcattgctgaaactgcggaaattattgctggtcaagcggtggccgcggcgccagtagatgacggaaaccttaaaaattcgatagaggtcaattactctcatggtggtttcaaggcgaaaatcaccgtcggggcttcttatgccgtttacgttgaatttggcacgggcatatacgccgaagatggaacgggccgcaaaacgccttgggtgtactttgacgagaaattagggcgatatgtgttcacacgcggaatgcgcgcgcaaccgttctttttccctgctgtggaagcgggcgcccgttatttcgaaaggaagatgaaccggc

SEQ ID NO: 3180 - DNA, 483 bp, Bacillus licheniformis
tttgaaaaagaaatctgttttgcttccattgctgttgatagccgttgctgtctacgcctttttgcggtcgggccggatcagcctgtttgacggccaggaagaatggtctgtacttgcaggtctcgtcggactggctcttttttatcagggacagaaggaagccgattccgcccattcctttgcagggctcttaatgacagcgatcggcgtttatttcacatttaaagaggactatttcagccgcgcggatgattttgcggtcatcgtgctgatcttcggtgcggcgctgcttgtcaaatcgtttaagacaaaagaatatcaatatgaaagtctgctgatgatcgcggtcgccctctatctttactttttccggcaaattgccgcctggctgaagtcggtgaatatcgagacggcatatgtagaagcttattggccggccgcttttatcgcggttagtctgctcttattattcttaaaaagaaa

SEQ ID NO: 3181 - DNA, 525 bp, Bacillus licheniformis
atgagtcgcggcgcaacagcagatcataagagtgttcgtaaaaaggtggttgatcacactttgagaacatgcaatgagctggaaggactcaatgtttacgacagacagtcttctctcccgcttggggtggtaacggatatctgtttttctcacgaagggacatgtctcggattgattatggaagagaagcggcgcttttacaatccccgttcgcttcttccgcttcccgcggtcaccgaaatcggacgtgacggcgtatacgttgatttcaccgagttcaagccgatgcaagttccgaagcagagtctttcttatgaccagatgaagcaaaaaatggtcaaaaacggagcaggagatacgctgggcatgctggaagatgtatacttttcttccgacacgggcataatcgtagcatatgaactatcagacggtttttttgccgatttgtcaggcgacaaaaagcagattcactcatctggggaaccgcttgaagtaggcagaagcacaatcgtcttgaacgaataa

SEQ ID NO: 3182 - DNA, 528 bp, Bacillus licheniformis
  misc_feature (1)...(528): n = A,T,C or G
agacaagaaccctcaatatcnggaaaagttcagaaatgacaaccgaaaaggcagattcggatatgcgcgccatcaggcaacacccagtcgcaaacaaggaagaaatgcaggcgccccaaatcgaccgggaagaaatggcgcatattatatctagtttaacggttcagcttcccaatattcaagatgcgtcggcgcttgtgacagacgaagaggcgctagtcgtgtacaaaacggactccgggcagcgcaaacagacggctgatcaagtcaaaaagacggcggcatccgtcgttccgagatattaccatatctatatttccgatgatccggacatgatgcaatccgtcgctaatttcagccggcttggagccaattcaagaaacgtcgatcagctgatggccgatacaattaaggaaatgcaaaaatcgccgcaaggcaaaaccacgacaggtacagatgaaaacggaaacgaccttgacggaaaaggaaaggcgaccgaatcttgacctgaaaataagaaaaacgcca

SEQ ID NO: 3183 - DNA, 729 bp, Bacillus licheniformis
attggatcaaattcaacggttacaccctgacggatcactttttcgtgatcaacgacagggggcgcggcattgttggcagggaactgaatttagtttccttgccgggtgtcgatggcgctaaattaaagggcgtaagatacacggaacgcactatcgagattgacaccttatttatagcggccaacgatgcggaattacgaaagatattagaagaaataaattatatccttgcgacagacaaggaagaagcgttgatcttttcagatgagccagaccgaacatattacgccgtattcagtacagcgcaagagagtgaagggcaaaacggcgtctataaagtgacactgacatttgtatgcccgaaccccgaaaaggaagcggctgaaacggttgtcacaactgaaacaaatagccctacagtggtaaaaaacgatgggaaaagggcggttacaccgactattacatgcgttttcgagtcggacgcatctacctatgaaattcagttgttgaaagaagacgaaacaatcgaaaagcggataaaagtaaatttcaacttcattaaaggggacacccttgtaattgattttgaaaagagaaaagtgatcatcaacggcaaagtaaacatgaatgcgctgcttatgctctcaagatggtttaatatcccggtcggagaaatcaccgtgaacacaacacacaaaagcagtatttcatttaacaaggcgtatatgt

SEQ ID NO: 3184 - DNA, 408 bp, Bacillus licheniformis
gcgatataaaagatttgatggggcatccggaactcggcaaaaaatattccatcgaccaagccgtcatccttctcattgtacgagacttaaaatcggtttatgacttcgaaacgatccgtccgatcttaacaacgatttttaatacgattacagaccgctccgatgatgtagtgagtccgctgcgcttttatgaagggtatgcgcgggtccttgatcatgtgtaccagatcaaagactatacgctcaataaatcggcgcttgaaaaaatcgtcattgagcagactggacagctccgcgatttttataaagatctggccgatcccgaatggaacaaagcgagagacatcaccgcagtcactgtgctgtccgtcatcgcttcgcacattcaggcgaccgcacattccatga

SEQ ID NO: 3185 - DNA, 324 bp, Bacillus licheniformis
tattttctatcgcggtatttcggctgacgaggctgattgtgttcgacacgatcatggcgccgtttagaagcctgtttcatgaagaggttgaagaaaaaaacgaaaaaacgggagagaccgaaacgtatcttgtcatgaaaggaaaaggcgtgagagcgtgggtcggcgagctgctgagctgctattggtgcacgggcgtgtggtgtaccgcgtttttgcttgttttttacgcatttgttccggtcattgctgaatggctgattcttctgctttcgatcgccggcctggctggagtattggaaacgatcgtttccaaatggctcg

SEQ ID NO: 3186 - DNA, 330 bp, Bacillus licheniformis
  misc_feature (1)...(330): n = A,T,C or G
aaacggattntctcggaacgtttatcagcatactcttgatcggagtgatttccatcggggctgccttgctttactacggcactttgaagcaggtcagaggcatgtgggcaggcattgtctatggagccgttttgtgggctgtcgtgttttacctgttcaatccgatgtttcccgatgttcagacagtggctgaattaaagagggaaacgattgtgacgacgctgtgcatttatctgctttacggtttattcgtcggctattccatttcgtttgaatacaatgagctcaattctgaaaaactgacgcgcgcccttggagaaacaagagaat

SEQ ID NO: 3187 - DNA, 822 bp, Bacillus licheniformis
atgatgcaaaacaatatcgttcacattgccttcggcgagtctgccggcggcagtataaacatgatgctcaaacagtcgggaggaacccatgaaaagagtctgatcgttctgcctgaattattttccatcggaccgcttcaaaagctggaagccaaagaaggcagggtcaatcgttatgaatggttgaaaacatatctgaatgaccgatttcacgagtctggaaagagatacagccgttttgaagtggcggtttctgcattgtccggcattcctgagcaagcctctgtctttatatggacaggagatcatgcacacgaacagactggactgaggtttgtacaccatatcctccgacaaatgaacctggctgttttccatttgaatacgacgaagttcttcccccatacccggagttctggtgaattgaatgatgaaaacctgagattcatttatgaacaaggggatcaggcggctgtgacagccgctgaaggacggcgccttgcagaggaatggacagcgctgtctcagcagacaagcgtgttgcgggtatgggaagacggtagaatcaaaagcgtgaaggaggatttttttgattcgttcataatcgaaaaactggctcagcttcaaaaaaaccgttcagccaacacctttatcaactgtctcagcttgatcggcgaagtcattggccatctggaggagaacatcggagatgaatttatcgagtaccgcattttagagctgatccgcaaaggtatttttgagatgaaaggcacaacaaaaggaatgagatattttaatgtcaggttaaaaaatgtcatgtaa

SEQ ID NO: 3188 - DNA, 270 bp, Bacillus licheniformis
gaaacccaaagaccttgccgaaaaatacggggtgtcagtgaacaccatcaaatcgtggaaacagcggcacggttggaaaaaaaaaaaaggtgcacccattgaaaaaggtgtgcacacaaaaaaaccgggtgcgccaaagggaaatataaacgcactcgggaacaacggcggggcaccaaagggaaaccaaaacgcgaagattcacggattttattctaagtttctcccggaggaaacgcttgaaatcatggaagagattcaggaacgttc

SEQ ID NO: 3189 - DNA, 822 bp, Bacillus licheniformis
atggcgtatcttacgattataaaaaacggtgaaaccattgatcaccgtaaatacggcttaaagcttttgagttttcgcaaggaatcgctaacacaccgaactaactttgaagaaataggaggcaggcatggcgcaatagatacgggaacgactttcggtgagcgaaaacttaaagcgacgtttttaatgcaaggcgtagaccatcttgattatcagttgatgatcgatgaggtctacgctttatttgcgtgcgaagattcaatcgaattaatagattcgagacagcccggtaaagtatggacagtaaaaccaagtagcacatttgagcctgacgatttaaacccgaggagcggtaaatttgagatcgaatttacgtctccgttaccgttcgcgagttcgtatggttctactcttgatccgttcacattcggcgaagaagtttggcaaatcgggcaagggctgattccttcagatagcctagtttacagacatcgaactactcgattcagtattttcaatgctggaaatgtagaggttgatccttgccttgaaatgccgttgaatatcgtttataaaggcgcatcctcaaatttttcgatcaaaaacaaaacgaccgggcagacgatttcatataacgggacctctaagtcgaccgattctataaaactcgaagggctgcgccatctgaagaacggtattagcatttacggaaataccaatcgcggatacgtttcattaaagccaggatggaatgacttcgaacttaccggcacatctggaagtttcgaaattacatttgattttttctttttctataagtag

SEQ ID NO: 3190 - DNA, 371 bp, Bacillus licheniformis
atggaggaacaaaacgtgaatcagcatgaatcagaaggcattatcgaatccgcactgcacgaatataaggcggggatcggcatcttttccgaaaaaatgcccggaattgccgccaaatacaacgaatttaccgaagagtgctttaaaaaaggcgtgctcagcgaaaaggataagcagctgatcgcactgggcatcagtgtcaatacgcaggatgaatattgcattatttatcacatcaagggctgcctggattgcggagcatcggaggaagaaattcttgaggcagtcggtgtaactgctgcatttggcggaggcgcagccatgagccaagccgtcacgctcgttttgcaggcgatggaagaattccagca

SEQ ID NO: 3191 - DNA, 486 bp, Bacillus licheniformis
cgaatacacccattgctgagaattctttgcaacacgctcaaaataaactccattttgcaatccatggacatactgcttcggaactgataatgaaacgagcggatgcaacaaagccaaacatgggcttaacgagttggaaaggtgacaaagtgcgtaaacatgatgtcactgtggcgaaaaattatttaacacaagaagaactcagcgatttaaaccgtatcgtgacaatgtatttagactatgcagaaacacaagcgaaaaagaaaaagccgatgtacatgaaggattgggcagaaaaattagatgcatttttagagtttaatgaacatgaaatattaactaacgctgggaaaattaaagccaaagtagcggaacaatttgcaaacgaacaatatgaagtgtttcatcaacaacgattagcagaaccgaagaaagatgattttgatcaatttttggaacaaaggaagcagttagacagtgaaaaat

SEQ ID NO: 3192 - DNA, 316 bp, Bacillus licheniformis
atgaaaaaacaagccgagctttttgtttacggtgccgacgttctttgtccaagctgtgtgaaccttccgtcatcaaaagaaacgtatgagtggctagaagccgccctgaaaagaaaatatcccgaccagcctttctcaatcacgtacattgatatccatcagccgccggaaaacgaccctgaaaaacaggaaatctccgaaaaaatcctgaacgacgaatatttttatccgctcgtcatggtcggtgatcaagtggtcggcgaaggaaatccgaagctgaaagacgtgtataaagaaatggaaaagcaaggatata

SEQ ID NO: 3193 - DNA, 270 bp, Bacillus licheniformis
cggagaaaaaaacattacaattgtagacgataaagggaatgaacagctgtgtgaagtgctctttacatttgacagcgatcagtttaacaagtcatacgtgctttattatccgattgaagcacaggacgatgaagagatcgagatccatgcttcaagcttcgtaccgaatgaagcaggagaagacggcgaactgatgccgattgaaacagaagaagagtgggatatgattgaggagacgctgaacacgtttttagcggatgaagacgaaga

SEQ ID NO: 3194 - DNA, 492 bp, Bacillus licheniformis
atgaatctaattttctaatgtaccaaaccgaaaatggcgatacgaaaattcaagtccgtttagaaggtgaaaccgtctggatgacgcaaaaggcaatggcagagctgtttcaaaagggtgttccaacaataaatgagcatattaaaaatatatatgctgaaggtgagttaacagaggaggcaactattcggaaaaaccgaatagttcaagttgagggatctcgtgaagttgaacgtgaagtgaccttttacaaccttgaagttatcattgcagtcggctatcgtgttcgatctcatcgtggtacacaattccgtcaatgggcaacagagcgtttaaatgaatacatggtaaaaggttttacgatggatgatgaacgcttaaaagaaatgcggaatattggggcagattattttgatgaattattggaacgtattcgtgatattcgtgcttccgaaagacgtttttattacaaaatacgagatatgtatgcta

SEQ ID NO: 3195 - DNA, 517 bp, Bacillus licheniformis
atgaatttaatcaaacgtattgctggtagagtgaaaaagtttattgtggcgattattgcgcttcctcttattcttggtcttgtcggctattttatgccgaagggaagcgttgctccatctaattacacggctactgtaacgatatcaaccgggaactatggagaagcgaagtacaacaatgcaaagcaagtgccgctgctgttgaaaaacgaagcttttttaaaggacattttcccggatatgccggaagaggatctggcgcaattgaaagacgatctggcgattgaaatcagaacggattcacttttcaacttaagctacacagggcctgataaacaggaaacattggatactttaggaaaaattaaagatgcctatatgaaaggcgataaggcgctgttctcaaaaagagaagaagtcattgaaaagaatattaaggcgcttgaagacgaaacagtcagcgctgattccaaagttgacaaacagcggtttttgtatgagcttgtaaacaagcaag

SEQ ID NO: 3196 - DNA, 812 bp, Bacillus licheniformis
  misc_feature (1)...(812): n = A,T,C or G
atggccggtttgagagtttcattattgattattgccgctctgatggccgtggctgcggctggttgcacgccgcagcatcaagaaggatcaaaaagcgttcatcatgaggagccggaagggaaaagagaaagcggtgcagcagtaaaagataaaaaagtgatagcgctgaaggaccggcactttgatgagacggcaggatggcttgataatgaaaccgttatatacaccgcaaccgatccggtcggaggaagtgaaatcaaatcatatgatatatttaaagggacgggcaaaacgatctacaagacagatgacaggctgatagcgtcggaagtcaacagtgaaaaaggcatgattcttatccaaaccgccggaaacggctctgaaatgaagttaactttgcttaatttacaggggaaacagctgtttgcaaaaaaatttcgcacgcatgagttgcaagtggactggaatcgattcgatccttctcttttatatgtcacaacattcacgaaagactggaattatgaatcaagcctaattgatgcaaaagaagagcaaacggaaaaaaacatcgcacaggccgcctttattcattggacttccgccgacacttttgaatatatcaaatggaatgaacgggaccgggaaaagccggctcctgtttattcatacagcacagcggacggacgggaaaagaagctcgcaggcgatgccgtacttctcgatattgtaggcgatatgcggctcatcgtgacgcttcattccgatcagcacagcgcgagtcgaataatnnnaggggccnnncnngcactatc

SEQ ID NO: 3197 - DNA, 624 bp, Bacillus licheniformis
ttatcagaaatgaccaatataattttattaagtttcaaacggacagcctcgtccagggacatgcgaacatcaatgacgaaaacgtccttgacgctttgaagtgcaatgcgctggatcaagtgttcaacctgtttcctgatctcagcagcgatcaaaagtctttgctggagaagctggcagaagtggaagacagcggtgaagcggtgcgctttttagctgaattaaaacttcatgtgattccatttcagaatgtaacggtaaagactgctaaaaagctgttctctaaagtgaaaaaactaaagacgcccgaatttgagcagatggatttcagcggatattcctacctgggatggaacgatgcaggatcaggcaggaaatacatgattgtggacgtcggcggaaagctgaccggaatccacggcaccatcaaatccagcaataaaaaaggaatctgctcgatatgcaacaggaccgaagagatcggactgttcatggcccgcgtgaaaagcgggaaagaaacctatacggacagaggcaattacatttgctgtgacagtgaaaaatgcaatcaaaatttgatgacgctggatcatctgaaccatttcgtcgcacaattaacgaaag

SEQ ID NO: 3198 - DNA, 303 bp, Bacillus licheniformis
atggcagatcatcatgaacacgcgttaaatcccaaaagctctaaaggaaaagaacaaatcacaaaccgcttaaagcggattgaaggacaggtcagaggcattcaaaagatgattgaaaatgaccgctactgcgtcgatattctcgttcaaatctcagctgtgcaagccgcgatgcaaaaggttgctttcagcctgcttgaggatcatacccaccattgcgtcgcaaacgcgattaaaagcggtgagggagaagaagccatcgaggaactgcttgatgtgtttaaacggttttcaaaatcatga

SEQ ID NO: 3199 - DNA, 579 bp, Bacillus licheniformis
gaaaaatccggctcatcttcggaaaaagcgggatgccgcccaaaaaaccggagctgttcccagaatgcttcagattgcgcgaaaaatcggccattacgcggccggcattcaacatatgttgagccattttacggttgaaacgatggaagctgaatcaagcctggaacatacggtcaaacggatttgtggaatcctggaagatcaaggcctggttaaggatgcagggcagatggcggatggactgatgaaaagagaagcacagggtggcctcggaattcccggaacaaccttcgcgctgtttcatttaaaaagtgaagcggccgcggttcccctctttaaagcttatgatctgtccaaaccgttcgagatcaaagggatggacggaagcgccatgaagatgatgcggatgctcatcatgctggcgccggccgatctgtctccggaaggttccgagattctgagcttcatcagctcttcgatgatagaaagtgatgagagcataaaagcataccagaccggagaccgcgagcagctgtacggcatgctgaacgtgctgtttcaccggtttatacaggataa

SEQ ID NO: 3200 - DNA, 360 bp, Bacillus licheniformis
atgaaatttgaagaatccggaattgaaggattgactgccgaccttaaccggttagacgacatcatggaaaacgaagggttcgtaagagctggacaatgggattatgaacgcgtcacatatgaccgcaaattcgatatggtcgaaggaagattctaccttcgcgtgttcggatatgccatcgaaggtgacgtgggcgcccggcgcgcggtaatcaaactgatgacgccgcttttgggcaaatattattatccgcatggagtggaatacggcgaagacgaacattttccgccgcagctcctcaaaacaagcaagacggtgctgaattcgatcaaagaaaaggtttcagcgcttgaagtgtag

SEQ ID NO: 3201 - DNA, 402 bp, Bacillus licheniformis
atgacgaactttggacaccatttacgacaattaagggaacggaaaaaactgaccgtcaatcaactggcgatgtattccggcgtcagttcggcaggcatttcgcgaatcgaaaacggaaagcgcggcgtgccgaagccggcgacgatcagaaaactggcggacgctttgaaagtcccgtatgaggaactgatggcatctgcaggctatatcagcgcgtctacagtccaggaagcaagaagcagctatgattccatttacgacatcgtgtcacagtacgatttagaggacctttctctgtttgacagcgaaaagtggaaggtgctttcaaaaaaagacatcgaaaacctggacaaatatttcgactttctcgtgcaggaagcaagcagccgaaacaaaaactga

SEQ ID NO: 3202 - DNA, 800 bp, Bacillus licheniformis
atgcaacggctgataaaagactatgatcaaacccggaattcccgttatcaagcacaactaagagcagatatgcaaagcatagaaaacagcttgaatgagcaagaaagacagattcaatcgcatcaaacatcaaaaaaagctcatacgtctgatcagattgctcacagcagcgggcttacagtatcccaagaaatcgaaactgccaaagcaagggccagaaatttagtgttaaatgccgacggaacgaacataaaggaagttgttgacgcgcgtgttgatcgtaggggaacaatttacccgactttatgggaccgtctggctgcagatgggcagtatattgaaacgagatttaactttaaaaatgcgcttaactatggtgcggacccgaccggaaaaagcccatctgcctgggccatacaaaaggcgctggatgaaattcgtcgagaaggcggcgggcagcttgtgataccaggcggtatttatttaatcgaaaaaagaatgattgtgtatgaaaatacccgtgtcactatggccgcggattgtgtacttcttagaggatgggccggcggattctttgtcaacggaaggccggatgatagcttcagcggcttttccggaagaagcaacatcattattgaaggcggtattttagacggtaactatgccaatatagacaaatacccgtctactgcgatggactcaatcattttaggtcatgcaaataatatttggattgaccgcgtaactttcaaagacacgattaccgcccatgccattatgcccaatgggatacccgaggg

SEQ ID NO: 3203 - DNA, 391 bp, Bacillus licheniformis
gtgagcgaccaatcattggatcaatatttacagcagggaatgtacggaccacgcgaaacgaagccggatgaacgcagactgtttttaggctcgctgagggaaagggtcatcatcgcattgactaaaggacaagtgctgcgtccgaaggcataccgggaagtcatcgatgcgcttggctcaaaagcggatgcaacattattgcttaacggcgaaatcggctactctcatttatctccttacatcaaggagtccaataagcaaggcgtccctttttcgatcgtgtccgatcagcaatcggacactccccttggacttgttctcgcggcgcgtgaggccgtagagaaagaatcgatttatgttcaggacgatatctttgagcagtcggttttaa

SEQ ID NO: 3204 - DNA, 312 bp, Bacillus licheniformis
atgtttcaactgtttaaaaaaaagctgataccttatgatgtgacgatttttcaaacgccttgctttggtgaagataagggatacgagatggtttacagaacggaaataaacggcagaacccatgaagatgtgctggaacggacgttttccactttcaatgtttatgacacggtgccgaatgattataaggcgagatttcttgcaactggcgacatcgttttaatcgatgaaggaagaaagggaaaaacctattataaactgctgtctacggggtggagcaaaatcaaccgcattttgctgcagtcttcgtaa

SEQ ID NO: 3205 - DNA, 301 bp, Bacillus licheniformis
  misc_feature (1)...(301): n = A,T,C or G
atggctgattcttttcttttttacaatctttctgaagatcaaatgacatttcctgaagtgatcgggagactaaagtcgttcatacgccaagatccgagggcaagctatctgctgtccgtcggaacagactcgcagatccatcagaattgcacaaaatttatcacagctatccatttgcaccgcaaaggcaaaggagcgtggggctgtctngaaaacacggttgtcaacagaccgatacatagccctagggagaaaatatcgcttgaaacagcttacagccaagagattgccgcatatcttt

SEQ ID NO: 3206 - DNA, 307 bp, Bacillus licheniformis
ttgactgatgtaagtgaacggctgtcgttttttgccgctctctataaagtggaccagaatcccgaggcgggaatgtggtggctttatgccaccatcttcgtcctgtctgcggtcgtctttaaactgggtttcgccaaacggctgccgctgttgaaaacggcgatcatttacttttttctggcattaggctgtacgtttttaacttttttcggcgtttttctgccggttggagaagggctgatcgtagctgttttaatcctttcgatttataaaatccgcctgcaccgttcgaaaaaagagcagacgg

SEQ ID NO: 3207 - DNA, 792 bp, Bacillus licheniformis
atgtatgtcttggcaaactttggaagaatatgtcattttaattatcgcatagaactttttaatatttttgagttaatgataaacaatgctgttttttcactcctatccgggggcgaagccaatcaagtcagaatttctgaagttcaatatgacaggttaagtcgcttgttaagtgattgccatgctgataaaagggcaaacttaattaacaatgcatttgatcggttacagcgggatttaaagacggatcaaacaatttctgattatatcaatttgtatcgcaatgaatttattcaaagggtaaataacgctgcggaaattgatggcttcaaaatgttgatcatcagagaaattgaagagagagaaaaaccaatagcgttaatgttaaatgaaaatgatcgcatgagtgatattgaattgcggaaattggtggattgcatcatggaacgaaaaaacacagcagaaaaaatattgctgatccgcgatcattttgtttcactacatgattatttggatttgctaaattcggggtgtctgtttgacgacgaatatgacgcactttttgctacgtttgggaattttgaattggccatttttgcgaaaattgtattttatgaagaattaagagggggaattctcaatttcattgacattgttgctgactgctctgaagcaaagagcgagtgggaaacatattatatgaaatttattaaacaactagaagatgagcgcattgcaactattggacacctgatcaacgatattgactatgaggagatttcgttttattaa

SEQ ID NO: 3208 - DNA, 378 bp, Bacillus licheniformis
  misc_feature (1)...(378): n = A,T,C or G
ttcacgcgaacttaaanaatctgatcgaatcgtccgtttagagaaaggaatcgagaaaaaacacgtatcaaaacgggtaacggccgctgtagaggctgtatttcgatttttggcagaggaccccgatttgactcgcatcggtttttttctcagccctgaagcaggcgaaatgaaaaaagatttaacgctcgccttgaaagaaaacttgaaagcagagcaggagctcggctacttccgatccgacctggaaatggagaccgttgctgaatgtctgacaggcatgattgagcaccttgccgatatctatttgcttgacggatcaaaggacccctcaagtctcgcaaaacaaatcacggatcttttgatccacggaatgct

SEQ ID NO: 3209 - DNA, 555 bp, Bacillus licheniformis
taagaaaggagaccgcccatggacaccgaacgccagaaacgactttatgccgaaaagcgcaaaggatttacggcaaaatttaatggaagacgggatatgcctgattgaaaatgaagaaggagatttgcttttggttgaaagcctgaacagccccggagttttcatcagcatagacggagaatggcaaaaagccgaactgtttgatcaattcgccgtaacggaaaaaccggagaccgtgaagctgacaggaggagaaccgatccgttatctgaaaacggtaaaacaggcattcctcgaatttttgaacgatctggaagacggacagttctattcttttttggatcagctgaacagcctcggcttttccgtctttgactgcgtcttcgcctataacggcctgagcttttggcccgagaaaaaggatgtcaagggcgtttcgttttatcagttttctcatgatatgaaacaatgcgccctgcagcatcattacgaaagaaaagaggagtggaaggacagatttgaatggaccgcttcagatggggaacgaatcgttat

SEQ ID NO: 3210 - DNA, 330 bp, Bacillus licheniformis
ctggccggcgcttgacctcatccgcagttttgaaatgcccggcttaatatttgaacgttttgaatcgctgctccttgtcatctggattatgcagctgtttgcgactttttccgtctcatattacgctgcatccctggggctctcgcaaattttcaagaaaaagagcagaccgatcatgttcggtctgctcccggtgatgtatttgctcgcgatgacgccaaaaaacattgatgatgtattttctctcggcgacatgatcggctatattgcggccgttttattcggcattgtgccgattccgcttttattggtttcgaaaatgagaaaaaa

SEQ ID NO: 3211 - DNA, 783 bp, Bacillus licheniformis
atgatcaacgagaaacgtcctgctcaattgctccaatatttgctgcgtgtcagagaggcgacaatgcatcagctgattgatcattttcaattatcgaaacggcaaatctgctatgacctggacaaaatcaatcattggctgaccggcaagcagctgcctgaaatcgaatataaaagaaagaacaggctggccgttccggaaacattgcttgaattgcggttctccgaagcctgttcagacatcggccgctcgtttatttttacgcaggaagagcggatcaaggccttgtacatgtttctgtttgtccgcagggagccgatttcatccgctcatctgacacagctattgcaggtcagcaaaaatacggtcatgaatgatgtgaaaaaagcgaatgaggcgctgactccgtttttagtggcgatcaaatatacaagacagcgcggctatcatttaataggaagcgagtttgataaaagagttcccgtcatgcaccacctttcttctttcctgcaaaagccttacggcaaagaaatccttcattatattttaaaaatttccggctcgcgcgatcacaaacaacaagaatttaaaagagcggttgaacttgtctcaaaagaatacgggcttcaactcgtcgaagaaaggcttaatgaatttatctactttctgatgatgtattcgatcagagtggccgaaggaaaaattgtccgttttcaccaggaggagggtgagcttttaaagcaaagtccgctgaaaaacgcagcccgtaaggcttgtgaatga

SEQ ID NO: 3212 - DNA, 553 bp, Bacillus licheniformis
atgttcaatatgaaaaaaggcgcgattgctgctttgctccttccgctgctgttcacagccggatgcggcatggcaaaccaaggggcagataacaaccggcgcaatcaggacaatgcgcttcaaaatgtaacaaacagagataacgacgctacgaatgtcaatgacggcagaaatgtcaatgaccgaatgaatgtgacagacaaccgcgatgccaatcgtgaagacaataatatggaagtggcggataaagccgcagataaagtggcggaacttaaagaagtcagtagtgcaaacgtgattacgacaaaccgcaacgcttatgtcgcggtcgttttgaaaggcaatccgaaaggcaacttgacgaatgagctgaaagggaaaatctcgaaaaaggttaaagaaacagacaataacatcaacaatgtgttcgtttcggcaaaccctgactttgtgaccggatgagaaactatggcgacagaattcaaaatggccgaaccgatcgaaggactttttgaagaattggtgaaacgatcaacagaattttttccgaatc

SEQ ID NO: 3213 - DNA, 780 bp, Bacillus licheniformis
atgttagactctaaaattatattaacaacaaatgaactcgttgccgcatttttattgtgtaggtatgaaaaagctgctgaagatattatcaatgatcagcagttgattcaagatgaaaaagatattgagccattttcaattcaagccgaaaatcttttaaaacaaagaggatattgggctgatggcacagaatctaatttacaaaaagggttagaaaacctgattcacttactcattcaatcaaagcgaaaagttcgttgtatccatcggaaaagggtgctgattgtacaccatgttcaaaaagatgaactcattgtgcaggagatcgaaaatcaaaatcatagtttttcgattttaagaagcagagagtcgtttttagaaatgttgaaaacattttatcattcatatacagataaaaaaccagaacatgaaatttttgaaatggatgaagattcatttgatgagtttcacgaggttgaagctgacgttattaaaagaatggcggaagacccgaaaacgcatccgactataagtcaattttcctttgactttttagcaaacaaccaagagctcgataatatttcttttgtagaaagtgactatattcaaaatcaaacaagattagatcaagttgcttttttattaagaagtgataatttcatttggcatttagattatgaaaatattaaaaaaactggctcgctatatcttctaccagtggcagtcgacgaatattttgggaaaatagtggatacaatgaatgaattttatgatttatag

SEQ ID NO: 3214 - DNA, 396 bp, Bacillus licheniformis
tcgaatacgggaaacgtcattacccttacatcgtcgcgatgcatgtttcgtttttcgtatctttgatttgggaaacgaccgcttttcaacgcggaacccttccgatggcgcttgtcgtattgacaggcctcatcttcacgcaggttctccggtattgggcgctcttttcactggggaaatgctggaacacgaaaatccttgtcatccctggaacgaatcttgtccgaaaggggccctatcaatggattaaacatccgaactatttggcggtcgctcttgaatttctgcttttgcccctgctttttcaggcatacgccaccgcacttttatttacggtgctcaacgctgctgtcatgtacatccgcattcgtacggaagaacaggcattagaaaaat

SEQ ID NO: 3215 - DNA, 470 bp, Bacillus licheniformis
atgaaacaggaatacaagcggccggtgcttttcatcgcctcccttttcatggccttttgcgccgtttatttcggcgggaggctgatcggtttttatatggcggaatacccaaaatggaacgggcaaagcgccgacggaaattgggaggccgtgatcaaaaagatagatggccgcgcgctgttcggcggagagctctactggacaggcgaccgcggcaagctggacgatacatatttggaaaaattggtcgtaaagtttggtgatgaaatcgttttgaacgcccaaatcgaaacgccggtgaaagattacgcgggaggcaaattccccggcggagggtcaaaagaacaatccgtttcttttttggaagggcttgaagaagctgaaatcgccggccgcgaggtgacggttcaattggattggagagagggcaaacaagcgtcccatacaggatttacgcttgataaaagctc

SEQ ID NO: 3216 - DNA, 458 bp, Bacillus licheniformis
atgaagacgctggatgttcaagcgctgcacaatgcaattgatcaaacgctggaacaattaaaacaacaatcagatgaattctctaaagtcaaaaaagcagttgagggcatcacatcacttgatgatgctttaaaaggaaaaggcggcgacgcgatccgcgccttttacgaggaatgtcacaccccttttcttcagttttatgatactttcatagaggaatacagttccacgctgaagaaaatgaaaagcgcgctgaattccctggaaccaaaccataacggatttatttcacagtcctttctcgaacacgagttggagaatggcttaaatgccgctgatcgcacaacaaaacatttggtttctaaggccaacgccacgatcgcaaaagtcagccatatcgtcgacttaccggatttgaatgacagcggttttcatgaacaaattcagaatgcggacag

SEQ ID NO: 3217 - DNA, 297 bp, Bacillus licheniformis
  misc_feature (1)...(297): n = A,T,C or G
aagtatttgaagcgcattctttaattgaagcagcgaataaccgcaagaaacaatacgaaacctttgaggatcaactgcaaacgctcaaaaaagcgtttctcggagtcgccgatttaggtgatgattttcaggggaaaggtgcggataacattaaagacttctacaagggacaggccgagatcgttgacagctggttaaagcttgttgaagcgcagattgctttttttaatggtgtatcaggtgacataaaagacaaaaagctgtccgattctatgntggaagtctcttttttggatt

SEQ ID NO: 3218 - DNA, 286 bp, Bacillus licheniformis
atgcgacccgatcagaaaatgggcgaaggcaactacccgctggcaggccatcatatgaagcgggagagcctcttattcggtccccttctcaacattgaaaaaggagataccgttaaaatcacagactttaaaaaagactatatatacgctgtgacgtcgaaacaattcatttctgaaatggacacagatgtgattcaagagacgaaaaaaaaggaaattacactgattacatgtgacaaagctgtgagaaccgaaggacgccttgctgtcaaaggaaagctgattc

SEQ ID NO: 3219 - DNA, 492 bp, Bacillus licheniformis
tggctccccacgggggcgggatcgagccgggcatcagtgaaatgtcaaggcttttgcagagggcgcttcggtttatttattggaaggattgaaaaggcgcggcaataagagccttcatgtgacaagcgctcattttgactgcccgcttgccttgcgaatggctgcaggacaccggtacatactggcttttcacgggtatgaggagcctgctcatcgacatacgctcatcggagggacagatcgaaggcgcgccttgatgtttaaggagacattggagaggcacggattttctgcggagctggcggctgaaaggggctatctttcaggtacaaaccctgcaagcatcaacaatcgctgccaaaccggtttaagcgtgcaatttgaaatcagcacagcccagcggaaggcgatgtttgagcaattcacattaaagggcaggcgaacgtctcaaaatgaggtgttttcccgctatgtcaaagctttgaaggaagg

SEQ ID NO: 3220 - DNA, 274 bp, Bacillus licheniformis
atgctgcaaacgccgattggccgccttcggttgatgggttttattgaaggcatgtcgcttttaatcctgctgttcatcgccatgccgcttaaatattgggcggattacccgatggccgttacgattgtcggatcggttcacggcggattgtttattttgtatttgtttgttctgttgtatgcaacttttgtgctgaggtggtctgtgaaatggccggctgccggtcttgtggccgcatttgttccattcggcaatttcctttagacccggggga

SEQ ID NO: 3221 - DNA, 340 bp, Bacillus licheniformis
atgaactcaatggagcaacgcctcgagcggctggaatattacatcaaactgttattgaacaatgcggatatggaagagtatccgtactataaaatattgatcgaaaagggcttatcagaggaagaagcaaaggaaacggaaaagctgtgcgaagagctctcaaaggagcttgaagcacaaaaagcgcaaggatttgtgatgttcgatcatctcctcacgctttttgccggacagttaaatgaaaaacttgaagtgcacgaaacgattttcgcccttcacagacaaggtctttacaaaccgctgatgagcgaattcatcagcattatcaggcagtacgatc

SEQ ID NO: 3222 - DNA, 390 bp, Bacillus licheniformis
ttttatcggggtgctttatcatcctgcttggctctacagatcaattgcccgtatactactcggctgcatttctttccgggatatgcatcgggccgatcaacacagctcttggcggctggattcccaaaatcgtccatccaaggctgatgggaagggtcagcgggtggaccgatccgctgacaatgctggcgcaatcctcagcgcttggcatgatcgctgtcctattcccgggaatcatcgccgatgtggattatatatattacggcttggcgggaattattctgctggcggcgctgtactactttatcgccctgcttaaattaagcgccgagagtgcggaaatcgacgttcaagcggcgctgaagaggcaaaaaaatacaaccgcgaaaa

SEQ ID NO: 3223 - DNA, 540 bp, Bacillus licheniformis
aaacttctaaggctacatggttagaagcgaaaatgacctctaaaaaactcggggtcattgtcccagtcacaaaagagtttttgaattactccgtgaaagacttctttactcaaatgcggccagcaatcgcggaagcattcgctattaaatttgaccaagcagcactttttggcattgattcaccattcggaaaaggcacttctgtattcgaaagagcagaagcagcaggaaacactgttgttttgaactctctaggcaacctttacgatgagttaaacgcagtcatggcactcactgaggacaatgacaaagacgtgaacggctttactactacacgtcgtttcaaacaaaaactacgcggcactaaggacggcaacgggctgcctatttttaatgatgcaagaggcggcgcgacatcagaggcattaggtttgccgattggctatgtcgattctaagtcttgggattatacaaaagcacatctattggctgccgattgggattttacccgttacggaattcctcaaggtatggaatacc

SEQ ID NO: 3224 - DNA, 250 bp, Bacillus licheniformis
atgcataaatacagaagaagaaacacaacggcctttacggttatgtcatatttcacatttttcgcgggagtctttttatttggtatcgggctatacaatgcggacaatctgcagctcaatgaaaaaggctattacatagccgtgatgattttagtggcggtcggcgcgattttgacccagaaagtgacgagagacaatgccgaggacaatgaaatcattgcggagcaggagagaagacagaatttgtcta

SEQ ID NO: 3225 - DNA, 349 bp, Bacillus licheniformis
atgttaggcggcagactgaagagcctgagaggaaaaaggacacaggaagaagtggcaaagcagatcggtgtatcgcgggcacgctactcccattatgaaaacggaagaagcgagccggcctatgaaacattaaaaaaactcgctgattactataaagtgacgatagactatctgctgacaggcacggaaaagaaaaaagggcatcgaagacgaattcgcagcatccggatcgtgcaaacttgctaaaccgtgcacatgcaggaattttcccccgaaagcagacagcaggccatcgagttcattcaatacttaaaagaaaaagagaagaaacgaaagcccggagataaac

SEQ ID NO: 3226 - DNA, 456 bp, Bacillus licheniformis
taatagcagcagtgcttcttcttacctcatgcggaaaggatggtagccggggaacagacgtattgattttttcggatgcaccggctgaagtaaaggaaaacgtgcagcgcgctgtcgggaaagaacagctcaacatcaccgttttcccggcaaccccggaaaaactccttgttgaaattgcggcgaaagaaggagatctgtttatcgttccagaagacatgtttaaacctttttacgatcctgaaggacttcagccattgaatgctgcttcggaagaaaaagagccgtacagcgctccgggcaaaaacggggaagtacagctgtatgcggctgtcatcgaaaaaggagaaaaacgtttgaacggctatacggttcagttgaatacagatatggcagctttcataccggtttatgcgaagaaaacccctgaagcgacggaactcatcgaagcgcttc

SEQ ID NO: 3227 - DNA, 765 bp, Bacillus licheniformis
atgtttgaagatgagagactgaatcgcttgatttacctttatacccctctttatgctgaggattttccgatcattctgttctggattccaaaaagcggctgcacgacgctgaatcgctggttctttttccaaaacggtctgcttgaagatgtcaatcgaagatgcgccggagaagttcaccactacagaaatgcgatctatacgcagaagccgaattatgtgaaggatcttctgacggatttaagagagggtaaaaaggacacttacaaggttgtacgcaacccttttcggagagcagtcagttcctttctggcagcgatttgctccccgaattttatttgtctgttcaacagtgatataaacacagggctttctttcacgcaatttttgcatcatctaaaagatctcgggacggatatcaatgccattgaccgacaccttggtccccagtatatcgaaggagaagaagagtttgtcaccaattatatttacctcgagcaattcagcgcacaaatcagagagattgaaaacaaatacaaattattgaaatctccgttatcacagctgtcacaatcaccgcaccatctgtcagacattatgattaaaaaagggaagtttgctgacaccgttttgactatgtcaaccttcgactgggcgtttccgacttttgagagcttttacaatgacgaaacaaaagaattggtgcacgacatttttgcgaaggactttgaagtgtacggctttgattcgaagcatatcaagtaa

SEQ ID NO: 3228 - DNA, 762 bp, Bacillus licheniformis
atgatcatttacgaaaacacacgcgttacaatggcggctgattgcgtgctgcttcgaggatggtctggcggattctttgcaaacggtaagcccaccgataatttctccggatattccggaagaggtaacatcgtcattgagggcggtatgttagatgggaattacctgaagatcgaaacatataaaacgaatgcgatggacagcgttattatcggtcacgcgaaaaatatcgttatcgataacgtaacgtttaaagacgtaattaccgaccacgcaatcgatgcgaacggatgtaacggccttcgaatcacaaattgcagatttaccggatttatcgatactagcggaacacgtcctttttctgaagcgattcagctcggagagtttacgaaaggcggcgtcaacattttcggtgccttcgacagcacgccgaacactaacgtctatattgcgcataactacttcggaaagtccgatcttttaggcggttggggatgcgctgtcggaaaccactacgctgtatacgacgtgttccagacgaacataacgatattcgacaatacgattgaggattgcgggtttgctggcattcgtacatttaaatggggcgaagttaaaattattaacaacgtcttcagacggaatcgggagtgcgtccggatttcgcaagtttccggcggaatcgagagctctaaaaatgcctctggcgtacagatgaatcgcccacaaaaacgctcaaaacattctaatccaagggaatga

SEQ ID NO: 3229 - DNA, 719 bp, Bacillus licheniformis
atgactgagcagctttcggaaaaagatcagcaggaactgctggagaaatacgatcctgaagcgggaacgagaaagctcaaaggattgacaggggccattgcatttgccggcctgctcgctttttctttgtttcaattatacacagccatttttggcgtttttccggctcaaattcaaaggtccgttcatttagggtttgcgctcggtctgatttttttgctgtttccggcgacaaaaggtttgcggaagaccggcaaattcaaagtcgcctggtatgacgcaattttagccgtgttaggagcaggcgtcggcgcttattgggtcgccaattatgaaacgattgtgggcgggatcggattgatcacggaaactgacttttatgtcgggctgttggccgtcctgctcgtattggaagcgacgagacgggctgtcggactgccgattacgatcatcgccggcctgtttcttttgtatggcctttacggctcgtatcttccgggctttttgtctcacaacggcctgacgatggaacggctcgttcagacgatgtattttacgacggaaggaatcctgggcacgccgctcgctgtgtcctcgactttcatcttcctgttcatcctgttcggttcttttcttgtcaggacaggagtggggcagtattttaatgaccttgcccgtagcgatcgccggacgaagcacgggcggaccggcaaaagtcg

SEQ ID NO: 3230 - DNA, 477 bp, Bacillus licheniformis
cttcagcatcacggcaacgtcatgtgacaaattgctcgcctgctcaagaaaagaagctcagctgtatccgcttttattatatcgtatcagggtcattcttcgcgcctgagtttagaacacgtttgatgacaaaggacagctgggttattgggaacaaatgcatccgtgctatgcgatttttcatcaggacgaccaaacgttttccgccctctggacggaatactcagacgatttttcgcagttttatcatcaatatcttctggacgccgagcgctttggagacaaaaggggcctttgggctaagccggacatcccgcccaatacgttttcagtttcttctattccatgggtgcgcttttcaaacttcaatttaaaccttgataacagcgaacacttgctgccgattattacaaacgggaaatacttttcagaaggcagggaaacatttttgcccgtttccttgcaagttcaccatgc

SEQ ID NO: 3231 - DNA, 675 bp, Bacillus licheniformis
gaatcaggaaacgattattggattgtctaaaatagagaaaaccttatattggatcattccaccggttttaggagctgttcttggatggtttttgcctgttatagccgattgggtattgaccattccaatcgttccttttaaagggcctttggaatttatcacatcactaaacagtttctgggtttcaattatcgctgcatttatcggaatcgttgccggcctatttttttcacaatatattttcactgaaattcttcaagtgttcatttctgatcaaaacgtgaagctgttgtttaaagagaaagaagaagtgattgagaaaaaagacatttctgcaatttatcttgagaagaaggatcttgttgttcttggtcataagggcactgaattgtaccgtgaacaacttgaatcaaagagagcgctagcagaaagtgcttttaaacatcacggctataaatgggcagacgaagatccctttaagaatgagtatcaacgctgggttgcggatcaccccgattttccctcgcatatcaatacgctacttttagccagagaacgagctttactggataataaacatgaagaggcaaaaattctgcgcaaagacctggcaaagcttggagtggttattcaggatgaagataaacggcaatacgtaaggatggtatcgtaata

SEQ ID NO: 3232 - DNA, 753 bp, Bacillus licheniformis
atgttcagtattaaaaaaatgctgcagaaccattatggaatcgacagtgtgaacatttctcccgagcaaggcgggtggacagcacttgcttatcaagtaaccgacggtgaagcggctttctttttaaaagtgtatgataaaaatagggcatcgacagcgaaatgggcagctttaatcgatgattacatccctgttctggggtggctgggggatcacaccgctctcaacgggaggctgcctgtgccgcttttgacaacagctggagaatacaagtgtgaagatgacgatgcggtgtatatgctttatgaatacattgccggtgaaaccattggagatcagccgctcggcaaagggtgcgtggagaagctcgccggaatcatagcggagctgcaccgatatgatgagacgatcccggtgaagacagaaggaattaaagaaaaatatgatatttcgtttttagatgagatgacacaatggcttgatcacctgccttgtgagctggcgacactcattcaaccctacagcggagcaatccgcgatatgatggagtcagccttatccctggcggatgatttgaaatgcagcggcagaagattggctttgtgccatacagatgttcatggctggaatttgatgaaaacgggcggggaattgattctgatcgattgggagggcttgaaactggcccctgttgaagcggatctgatgttctttgctaaccagccgtatgctcaagagtttttgcgcgtttag

SEQ ID NO: 3233 - DNA, 225 bp, Bacillus licheniformis
atggctaatgaatttcgagtatgcgacgattgccaggccaccaatttaaagacgcttttgccccgtctgaaagaaattgatccggatgcaaaagtggaaatcggctgccagtcttactgcgggccgggacgaaaaaaatcgtttgcgtttgtcaataatcgtccgctgtcagctcctgatgaagacgagctgatcgaaaaagtgaaaaagaaactcaaaaaataa

SEQ ID NO: 3234 - DNA, 411 bp, Bacillus licheniformis
atgacaagaatcaatttttcagacagaggagagacgccgtttcagcggctgctcggacactctgaaagcctgatgtcaagctggacggctttagctgaggagctgtcaggagatggctttttatcaaaggaactgaaggagcaggtgcgccgtgtgctggctcagggaaacgggtgtgaatattgcaaggccaaggggaagcccgagattccgaatcagcagaaaacgagctttgcgatggggtttgcagaggtctttttggcgcagagggagcgcgtgtcagacaggcagtttgatgttttaaaagaagtgttttcagaagaagaaataacggaattgaccgcatttatttgttttacgactgcccagcaatacttcggcgctttaatgaagcttccggcagacgcataa

SEQ ID NO: 3235 - DNA, 560 bp, Bacillus licheniformis
ttggaacatgaaagaagtggccatgacagtcatcttgtctgtggcatgcggcgtcatttatttatggtggtctaccttgtggatccctgtttcagctatcgtcgggcccgtcggagcgaactttatgttcggcatatgggtgatcgccagcccgattgtcgcttatatcatccgtaaaccgggtgcggcgctgattgccgagacggcatctgcggcggtcgaactgctgaccggaagccattgtgggctttcagcattattaatcggtgtgttccacggagccggtgcggaaatcgcgtttgcgatctttcgctataagcgctataacttgtttacccttatgctttccggtgcgctagccgcggtggggagcgcgacatacagcctgatggcaaacggttttgcctactatacgacgcaaacgctgatattgacgcttatcatccaaatcatcagcggcattgtactcggcggctggctggcaaaagccgttgtcgaagcgcttgcgaaaacgggagtcctgaaccagtatgagatcatgaaagaacaccggaagaagg

SEQ ID NO: 3236 - DNA, 456 bp, Bacillus licheniformis
agtgaaaggattgtttcaatataattgggaagttcgacatgcatggtttaagtggtgcctcagccagccgcaagaggagctggtcaagaagcgttcaggcggaatgggaagcattaagaaaaatctgtttcatattgtagatgtggaagtaagctggatctacgccattttagaaaaaccggatattcaacctgattactctcattaccagacgattcagcagatcgctcggttttccgacctgcaccgctcagaaatagaaagtgtaatttttaattattccagcgccttcgaacatctgccggttaaagcggcttggtcagacgaagtctgtacgcaaggcgatattttaaggcatttaatcgcacacgagatccaccatatcggccaaatctccgtctggacgagggaatcgggctctgctccagtatccgcttcatatatagggcggaaaat

SEQ ID NO: 3237 - DNA, 295 bp, Bacillus licheniformis
atgcataagatagcgtatcactcccaaaaaggaggcataggtatggacaatcaatttttcaaaaacatcgaaaagaaaacgggcgtcagcatgaatgacgtcatgcagctcgcaaattcgctgcaaaatgccaacttcaaggatgaaaatacggtccgcagcgtgattaagcgcgtcgctaaattggcgaataaacgggttccgaaggaaatggaagataagattgttgaatccattgtaagcggcaaagaaaaaatggatttcaacacgatcgcgaaaatgatgaacagcaaaa

SEQ ID NO: 3238 - DNA, 310 bp, Bacillus licheniformis
atggagaaaagatacagtgaaatgactgcacacgaactgcaccaggaaattgcgggtctgaccgaaaaggcaagaaaagcagaacaaatggggattgtgaatgaactggccgttcacgaacggaaaatcgcgatggcgaaagcctaccttcttgatccggccgattttaaagccggcaacgtatacgaaatcgaagatgggggcgacgatttccatatccgctatttaaacggcgtattcgcctggggataccgtctttcgtcaccggatcatgaagaggctctgccaatttctttattaaaagaaaagg

SEQ ID NO: 3239 - DNA, 371 bp, Bacillus licheniformis
atgccatttgtcaggatggatcttttaaaaggaagatcaaaggaagagcttcgccggatcagcagatcagttcaccaggcgatgacggaggcgatcgatgttccggaagacgattattttcaggtcatcacccagcacgatgaggaagagttctttttcgatcctagctatatgaacatcaaacggacgaaggatttgatttatattcacatcacaatgaaagagagaccgatcgaaaaaaagctggctctgtaccaacgcattgcagagcgtttgcaaaaaaacgccggcatccgccaagaggacgtcatgatcattgcagccgaaaacgtgaaagagaactggtcgtttgggaatggaacagcacagct

SEQ ID NO: 3240 - DNA, 221 bp, Bacillus licheniformis
atgaatcgcatgttccgtgtgttaggtttctggacaggtatctttgcggtcatgttttatttaggaaatatgaaagatgcatcactgctgttcttcggtcaaactgtattttttgtgttcttatcgtatctcaacttgaccgagcggatgtacatttatattttcggtgcttacttgacaatcttttttgccgcatttacatattattctgtgttcattat

SEQ ID NO: 3241 - DNA, 280 bp, Bacillus licheniformis
atgaagcttttctttggacaagtcaatccgacggttttgacaatggcggcgttaagggtggtatcatctttgatcgaactgacggcggctgttgtgatgcttttgacaaacgacgtcagaaaagctgtggcggtcaacagcgtactggccatggtcgggccgctcatctttattattacaatgacaatcggcatctatcagattgcagggcagctttcttacgcaaagctgattttgatctttatgggagtggttttgatcatcgcggggatctataagt

SEQ ID NO: 3242 - DNA, 375 bp, Bacillus licheniformis
aggaagagcttgacggaaacagcctggtacgatatatgagtgcttatgcgatgtctaacggtgaatggctcgtgtgagaagacgggggactgccggcggctctcagctttcatctcgaatgggcgctttctaatggcaagccttggctcggaacgcttcttgtccatcccgatttccgcaaaaaaggccgggcaaaagaagtgatcaaaacgatcggaaaacgcttgagagaaaaggggcataaagcgttgtttgcggcagtgccttatgagaaagacgaatggttgaacatgctggcccgttcaggatttgaacagctgaaaacggaaaaagatgaaaagggaaaacgatatttgatcatggttttgccccttc

SEQ ID NO: 3243 - DNA, 363 bp, Bacillus licheniformis
gagttcaaaacaatactcttgccttatacggggcgcaacgcatcatgtttgtgcaggataaggacgatatggcaaaagagctgaagaaaacgaaagaatcggatttatcttccgaagaggagtttgaaatacaattcgcatgggatcgtcacgcaaccttcctgaacgctcaatcacgggctatgggcgagcttaggagcttgataaagcaatttgacgcactggcccatgaagaggacgagagacggcttaaacttgatcaaatgcgcttgaacatcgataagacgaaagccgaaatcgagcgactgaacgacgatgaaaacgactcaacatttgaaattatcatcaaggataaaggtgaaa

SEQ ID NO: 3244 - DNA, 259 bp, Bacillus licheniformis
atgaatgaacttgtgtttgaaaagagagaatttactcaagaccatgtgaatgttgtaaaagcaatgcatataaataactatccgattgtttatatcctttataacgagaaaaagaaaccgactgcatatattggacaaacggttcaagctgcacggcgtttgaaaaatcatatagatgatgaaaagcgaaagagtttgaatcgctttattttaatcggccatgagaaatttcatcagtctgcgacatacaatattgaat

SEQ ID NO: 3245 - DNA, 448 bp, Bacillus licheniformis
atggatatgatgtggggctatgtactcgtctttattttggctgcgattccgtggtttgaagtgatcggtgtcgtgccgctagcgatcattgccgggcttaaacctgttccgtccgctattatcgcgctattcggaaatctattaaccgtactgctgcttatttttttaattgacaaagtgaaggtatggctagaaagaagacgcggggagcggagagcggagacggataagttctcaaaaaggaaaagcagggcgaaaaaaatatggctgacctacggcattccgggcctttctttcgtcgggcctttctttatcggctcccacttaaccgcgtttatgtgcatgggctttggggccaagcgcagacaaacggcgctgtggatgacggggagtctcgcagtatggacaacggcgtcggctgtcgctgcctactatggtttcagtttcc

SEQ ID NO: 3246 - DNA, 735 bp, Bacillus licheniformis
atgcaaaacgtattggacgagatgagaatctacttaatgtcttcaggaaaaagcgacaaagaaatcgaaggaatcatgaatgagctaaccgttcatgcctgggaaggagaaaaggacggaaaaaccgtccggcaaatttttggggattctcccaagtcatatgttcaagcgctgtcaaaagagctttcatcaaggccaggggagatcgccaagttgttctttgccattttaatcggcgcaatatcctattttatattcagcgacgccgtgaacgacagcctcgattattctgtctatacgctggcaggctatccgctttatattttgctggcagcggctatgttgccgcttttgggccggattacagcatttaaagggaagaatacggccttcatgtatacgatggtgtacgccgctttgacgttttttccgattttggccattatttttattgaccggcaattcgggacaccggttttttcgtttgatgggggaagccgctggctgattatggccctgtcgtttcttgtgatcgtatgtttgtctttcaggttgaaagccggagccttgtccatattgccgctgcttttagccggaacgcattttttgtttcagtatatgaactgggattcagcaggagccatgatggcagaaacttatattccctatatcgggctgcttctcgtcatgtttattgaaacaaagcgtgccagaaatacggctcaatatgaatga

SEQ ID NO: 3247 - DNA, 352 bp, Bacillus licheniformis
atgagctacaaaaggttattaagcgaccgctgcgatatctatcatttaaaggaagaccaggctgaggaagcaaggtacggcattcctgcgcgagacctgcagccgattcgcacatacggggaaacacctgatcttcaaaacgttccctgctattttacggaaaaaaaccagtcgatcgtccagcaagatcccgaacaggttatttatcattcatatttggcccattttccggcggaggcagatgtgcgccttcacgataaggcggtctggaacggtgtcgcctacacgctgcagcagccgcgcaacatcaaaggccatcacctcgaagtgttagcggtcagggatgaaaaac

SEQ ID NO: 3248 - DNA, 588 bp, Bacillus licheniformis
agccctttatgagtatctggtcaaacaggcggacagaatcacagatgaatggctgtcccgaacagcgtctgaaaaagaaaaaacggcacagcaatacaaggactttatactggctgtttcaaaggtatttgccaaagatgaacaggcgctatgctggaataaagcttccgggtgcgccaaggaaattgcctacgacagggctgtcagccaaattccggttaccgaaagcataaatggttttaaagtgtgccgtgaacttttaatagatgagatcgagcaattttcagatgaacatgcaccagacagttcgaaaaaagatttttttatctggaataaacagcttcacttaatgatggatgaggtcatagagcagtttattcttgaatatgagcatacgacaaagagccaattgaaggcgcagaccgagatgattcgcgaactgagcgcaccggtcataccggtatcagagcacatcggtgtgctgccgctcattggtgaaattgatactcacagggcaacggtgatcattgaatctgcgctcacgcagtgtgctgagcttcatctctcgcatctttttattgatatttc

SEQ ID NO: 3249 - DNA, 373 bp, Bacillus licheniformis
atggatcagttgaaatatccgatcggcaccttttccaaaccgcttgaagcggacgaaagggaactggaaaaatggatcggggatctgaagcaagcgccgcatctcctgagaagcgcggcggcggaactaaatgaagaacagcttgatacgccgtaccggaccggaggctgggctgtccgccaagtcgttcaccatcttgccgacagccatatgaacggctatattcgaagcaaattggcgctgacagaagagacgcctttgatccgcacgtttgacgaacagaattgggccgggcttaccgatgccagaacgctggatccggatttgtcgctggcgcttttagacacgctgcatctgcgctgggctgctcttt

SEQ ID NO: 3250 - DNA, 243 bp, Bacillus licheniformis
atgtcacaattaatgggtatcatcacgagactgcagagcctgcaagagactgcggaggctgccggagaaccgacgcagcgcaattttgaagtgaacggagaaaaaatttgcagcgtaaaatattttgaaaaaaaccaaacgtttgagctgacagtttatcaaaaaggagataagcctaccacatttccgtttgacaacatcgatatgatttcaatcgaaatctttgaactgcttcagcaatag

SEQ ID NO: 3251 - DNA, 399 bp, Bacillus licheniformis
  misc_feature (1)...(399): n = A,T,C or G
gttggaaaacggcaggtttccagagggcttccttccagagacttgcaggaaaaacangaccgactgggaaggggttgaaaatgcccccaaatctctgctgatccaagcggagggcgtcgcacaggaaaacgacatctctggcagccacgacattacgccggtgaaggtggacatcaaatccctcgccgaaactttccaggaagacgcgcggtttctctaatatgacgagaaaccccggaatacaatccgctcttccttcaggctcccgccgctctacaccggtgatgcccatcaatataacagggcgacagccgataccgcccgcaaaatcaccgaagcacaggtttctgaaccgcagcgcccaaacactgctcggcaagctgaatacgctgcctttcc

SEQ ID NO: 3252 - DNA, 731 bp, Bacillus licheniformis
atgttcgacctgaaaaacgaggacttttcaagactgcccgataagctgacagagagggttaagtatgaagggtatgccgatgacttaaggcgcacgctatatgaaaccaagacggtcgtaaaagagtttaaaatgccagacggcggctggtatgccgtaaaaatgatcccttattatacatcgggaaacatggttgaaggcattgttgtcacattcacgaatgtcactgagctgaaaatgacaaacgaggcgctgcatatcagctcacaagctatagatcaaagtccggccaacatattgatcacttcggtcgacggttcggtcacttatgcaaacaaacgcttttgccggatgttcggaaaacatcaggatgacatcatcggcggcaatgtgtttgatatttaccgcaagcattttcactgtgaggatctcactcgcttctggaaacgcgtccttgaaaagaaaccatggtcaggagaacttaattaccaggatgaggagcagcaggacaggtgggagcaaatctcccttgttcctgttgaggacagcgcggggaacgttcagcaggttatgctgatatccgaggacattacaaaccaaaagcgatctgaaaaaatgctcatgaaatcggaaatgctgtcggcggtcggccagctagctgccggaatcgctcatgaaatacggaacccgctcacttctctaaagggtattctccagctattgcatcaagc

SEQ ID NO: 3253 - DNA, 261 bp, Bacillus licheniformis
atggatatgtttttcgcttacttgctgattgcaagcgccactcctttatttttatggctggacaacaaaaaggtcgcaatttcttctattccgcccatcattttaatgtgggtattcttctttttctatatgaccagcagcctttctcctacaggacactctctcatgatcgcactctttattctcaacgttgtcatcgcccatgtcgccgctttcatcatctacggacttccattgatccggaagcacatgagccgataa

SEQ ID NO: 3254 - DNA, 729 bp, Bacillus licheniformis
atgaaggccaaagacgttatttggggagccggtgaattccaattcccgaaatattcgtttcatggtgcagagattggcatccacaacagcaaggttgccagatggagccaatttgaaaaagcccattattacgtggtaggcggctatgagagcgcaatggatgcggcggtacaactggcgtcctatggcagcgatgtgacggttgtgatgccgaattcgctccgcgaaaacgctgaagccgatccgagcaggtcgctttcaccttacacatgggagcgtctagaagatgcgtatgaaaaagggaaggttcagtttttggaaaaagccgttgtagagaaactggcgaaaaacggaccagcctatgatttatatttgtcagacgggaggaagatccgttcggaaacacggccgattatcgcgacaggctttcattccggcgcaaaacaaatcgagcatttgtttgaatggggagagaacggcaagccgcttttaacaaatgaagacatgtcgaccgtgacggacggtctttatttaatcgggccgagcgttcagcatcaaaacgcggtcttttgcttcatttataaattcaggcagcgattcgccgtcatcgccgagcatttgttgaaaaaacgaaggttttcgatcgatgaaaaggtgctgacagaatacagggaaaatcaaatgtttctcacagatttgagctgctgtgaggtgcagtgtgaatgctga

SEQ ID NO: 3255 - DNA, 416 bp, Bacillus licheniformis
atggaaacgagatttctaatggaaaaagtaaatcctgagggatacagaggaatgctggagcttgaaaaagcgcaggcttcttctggcattgaccccattttaaaggaactgatcaaaatccgggcttcacagctgaacggatgtgctttctgcttaaatatgcatacgaaggatgcaagacagaacggggaaacggaacagcggatatatgcgctcaatgcgtggcgggaagcgccttttttcacggaaaaagagcgggctgtattggcgctgactgaagccgttacgcgaatcggcgagcacgggttgccggatgaaatatacaacgaagtcaggacccattttacagaagctgaaacagccgaactgatcatggcagctgtcacaataaatgcctggaacaggattgccatcgc

SEQ ID NO: 3256 - DNA, 234 bp, Bacillus licheniformis
tttgtatttaggaattgtttcaacagcttgtgcttttttattatggaaccgtggattgcaattattaaatgcttcaagtggaggtctctttttcttttttcagcttttagttggaaccttacttggatggcttctgctgggagaaaaaataggcgggacattttggataggttcgtttttaattcttattggtgttttattagttattaaagagaaagaaaaagacgttaattc

SEQ ID NO: 3257 - DNA, 254 bp, Bacillus licheniformis
atgtccgtactggataattgggatcagtggaaaaactttttgggcgaccgtttgaactatgcccaagaacaaggaatgtcaaaagaaaccatctcagatcttgcatatgagatcggcgattatttggccggtgaggttgattcaaaaaaccatcaagaacgagtgctcgcagacctttggagcgtggcttccgaagaagagcagcgcgccattgcgaacgtgatggttaagcttgttgaaaacaacagctcaca

SEQ ID NO: 3258 - DNA, 261 bp, Bacillus licheniformis
cttggtgcaactcgcctttttgccggcgcatgccagtcccttttgaatactgatcagagccggtgcaaatttcgcaagctctccgtccagagtcaacatccatgcgcttgatccggtctatatagtcgcaaaaatcagcttcactccgtttatggaccgcattaacgtctgggaagtgctcagaaataccttgacgagagaaaaggggctcggaggtattgagacgcggggcgtattgcgtattggaatgccatataaaac

SEQ ID NO: 3259 - DNA, 720 bp, Bacillus licheniformis
  misc_feature (1)...(720): n = A,T,C or G
atgagttggactgggatcataccgatcaaacccggccatgtactgaaagatgagagnaataatgggaatggagtcaaattttttaatattacgggggacaatgacaaagcaaaggtatatataagcgccgaagatgactttcaaacgatcctacctcagtataccgggctgatacattttacggcagcctcaggagctataaacggaccaggtgcggccgttcgagggatttggacttgcaacgctttaggtaactatggtcaagcgatcgcgtttgacaatgcaaatagaacctatcggaaaacaatagccgggggcaactggactgactggacagaattaatttccgcggagagtctcgaggcaaagttggcgaacttaacttggcactttccaacgcttttaaacgaatgggttaattatgcggacagcactaaagttcgttatacaaaagatgccacaggtacggtatttgttgaaggtgcaatagcaaaagggaaaattggttttaatatacctgcattcgtattgccgaaaggatatcggccgtcccgcgcttttcagtttgtaggtgtagcatctcaattgggcatgtccaatactccgcagtatcataggctgcaagtgagtgttgatggtaatgtcgtgatcgaaaactgctcaaatacagtaaatccaaatgaatatatcagtttaggatttagttttaaggccgcataa

SEQ ID NO: 3260 - DNA, 341 bp, Bacillus licheniformis
atgaagaaatcaaacattgcctgtatgtatatttttcttttattaataggagcgcttgcaaatctcacgacggaagagactgcccaatcatcaggcgggcagcctgccgtgattcctgatgaagcgattcggctgcggattttggcaaacagcgacagcgggagcgaccagagcgtcaaacgcaaaatcagggatgaggtcaataaacaaattacgaaatgggtggaaaacctgacctcggttgaggaagcgagacaagtcatcaggtcgaagctgcctgaaatccaagaggttgccatggatgtcatgaaacgcgaaaatttcggcaatcgtgtcgtcgt

SEQ ID NO: 3261 - DNA, 305 bp, Bacillus licheniformis
atgggcacaagagtacattacgcagaagaagtaaaatgggaagtaattaaaatgaaacaagctggaatgacaaacaaagaaataatggaacaactggggataaaaaataagactcaaattaaaacatggatgcgatggtacaaaacaggccaaacctatcgattttcgcaacaagttggaaaacaatattcctacggtaaagaatcggaggaaatgagtgagctagaagaattaaaactaaagaataaacagctagaggctcaattggcaattataaaaaagtaccaggagatcgaaaggagttg

SEQ ID NO: 3262 - DNA, 212 bp, Bacillus licheniformis
atgaagagattagcaggtacggttattttgtcaggtttgctcgtatgcgggtttggacaggctctgcctgaaaaagctttggccgccgaggtcgttcacaaaacgatcgtagtcgagaaaggccaaacgtatgacggaaaaggcaagcggctgattgcaggtccggagctcggggacggcagccaacgcgaggatcaaaaaccgattttcaa

SEQ ID NO: 3263 - DNA, 307 bp, Bacillus licheniformis
atgggcacaagagtacattacgcagaagaagtaaaatgggaagtaattaaaatgaaacaagctggaatgacaaacaaagaaataatggaacaactggggataaaaaataagactcaaattaaaacatggatgcgatggtacaaaacaggccaaacctatcgattttcgcaacaagttggaaaacaatattcctacggtaaagaatcggaggaaatgagtgagctagaagaattaaaactaaagaataaacagctagaggctcaattggcaattataaaaaagtaccaggagatcgaaaggagttgga

SEQ ID NO: 3264 - DNA, 305 bp, Bacillus licheniformis; identical to SEQ ID NO: 3261

SEQ ID NO: 3265 - DNA, 385 bp, Bacillus licheniformis
ttgatcaaaaagtgggaagcacaagaaatgacgatgtcataccatcagtttaccgtttatcagaaaggcggaaagccgcccgttatggattggacagacgaggatattaaaagaggatatacaacgggagagcacgcggtctcgtttgaagctctcgaaaacacggcatcttcagtagaagtccgtttgaatgcccaaaaacaggtgccctccttcaacaggcgcgtcaccgttcctttcgaagtgctttatgacggggtagaaattgcaagcgtcctatccaagaaattgacatgcgatattccgcaaggcgcctatcagctgacatgctatacaataatgcctgatcacagcggcactgcacagatcacctatcttctcgatt

SEQ ID NO: 3266 - DNA, 357 bp, Bacillus licheniformis
ggctcttgagcaatatattcaagcaacaaacacacatgagtttgagaatgtcaaagccctccttgaccccggcgctgtgtactggttttcggatcaaacgtgctcgggctttgaggagattcagcgttattttgaaaacgcctggaagcaaatcgaaaatgaagtatacagcgccggtcatgtcagctggatcacggaaacggacgaacaggccgtctgtctttatacatacgaatggaaagggttatataggggcgaaccggttcaaggggcaggccgtgcgacaaacgtatttgtaaaggacgagtcaggacgctggaaactgaagcatgaacatttaagcagtttgcccaagcg

SEQ ID NO: 3267 - DNA, 385 bp, Bacillus licheniformis
atgaaaagaagccggataggccggcttgcgctgacattcgcagcgatggcggcggggcttgcttcaagaaagacggccgatatgctgccggacatcgtgaatgtatatttaggggatgcgctgtgggcgctgatgattttcttcggcgcaggctttctgttcaaaaacgcgaagacggcttccgcggcgctgattgcgctggtgttttgttttatgattgaatgcagccagctgtatcacgctccatggattgacaatatcagagccgctccgctcggagggctcattctcggttatggatttctgtggagcgatttattggcttatgtgctcggcgtttccgcaggcgccgcgggcgaaatgctgttccgcaaacgaaaaaaga

SEQ ID NO: 3268 - DNA, 716 bp, Bacillus licheniformis
atggagaatagtgaaggagtgactcatatgcgggcagtgtgtctgaacgaatttatcagtctttttaaaagcatcaagtcgattattgtcattattattatgttttgggtgagctataagactgcgggattgattgaacaggcgcctgcggatgtcgtgcgggaattggatttaggaagcgatgcaggcgcgatcggaacggccgttatcgtgtttgctctcggtttcctgtttatcgcggggctttcccatgacatgatcaaccgcgaagtccatacccggacggtcagatttctcgtgacgaaaacgtcgcggatcaagatcattctgggaaagtttcttggcgtctggctgttttggtttttctgcatgctcgtttcttatgccttggtgatgatcgcctcaaaagagtttttatggctgagttatgcagacagcatggcttttcttacagctgcgatctctttgaaccttttattttcgatcgtgatttcaaggcccgccgtgtcaatgtttttcggaatcgtgtttgctctcgtttttccagcggtcagtttatgggctgtttattcagagaacggcatgatcacctggtttaaatatataacgccgtactattactccgtactgggcggttcttttattttcatcaactttgtctacgccgccatcgttctttgcggtgcgatcgttttgtttaaaaggagagatttata

SEQ ID NO: 3269 - DNA, 224 bp, Bacillus licheniformis
atggatctttttaaaaatcgtaatttcgtccgactttttttcgcagctttcgcttctcaaatgggaacgacagtcggaaatatggctttcgcctttttcttgctcgaccggttcagcagccagccggcctatacgacaatcgccgagctgatgtattccttgccgacggttttcgtattctttatcgtcggggtggtcgctgaccgttttgaccgcaagaaagt

SEQ ID NO: 3270 - DNA, 292 bp, Bacillus licheniformis
gtgagaacgggaggattaaggggcatggcgcaaacaaacgaattggacgtcttcaagcatgagattaccgagctgaaagccgatcataaaacgcttgaacagcgagtcatcacgttggaaagggcgtctgatcggcatgaccaacagattatgtcgatcaatgataagctcaacaagattgaggaaaacacaacttggatcaagcgcagcataacaggcgcgatcatcacagcggtgtgtacactggtgatctccgggattgcggcgcttttcattaattttattcaaaaat

SEQ ID NO: 3271 - DNA, 225 bp, Bacillus licheniformis
tgggtttgaacatgaaaaaaacgaagacgacaatgaattcgtccagcatggaatcacagtgcttgtagaccaagaaagtctggatatcatgaacggtacggtcattgattttaaacaatcgatgatgggcggaggcttcaccatcgataatccaaacgccatcgcttcatgcggctgcggatcatcattcagaaccgcagcgaatgcggggaagcctgaagagtg

SEQ ID NO: 3272 - DNA, 468 bp, Bacillus licheniformis
tcattgtgtccatcgtctatatcaagttcaaacggtcggtcggttatcagcctttaaagccggcacgcatgttgttccggatcatccttttttcgggaattttcgtttttctgctgacgatgagcgcacttcaccctttatcatacttttatgatctgattgggatcgcgctcggactcatcttgaccgtctatgcgctgaagcatgtgtcgatcgaaaatcggggcggagtcctttatttcagaacgcatttatgggttgaattgatcgtactctttttatttttataccggtttctgtaccggatcgccgagatcggccagctgcagactgcggtttcagacgggggttcggcagcttacggcgccctttttgcgcaggacccggcgacgatgatcggtttttttgtactggccgtttattatgtcggtttctctttttttgttttaaaaaaaggcagaaccgaag

SEQ ID NO: 3273 - DNA, 714 bp, Bacillus licheniformis
atgaaattgtttaaagtttatttttggttaagctgtcccgaagcggtgaaaaagagaatgaaatttcagacgtttgcatgtacggttatgatcatcacggtgctcgccgttttgcttaattatcttctcttttataaaaacggggcaaataaagaaatccgtagcatggagggaatggctgtttatgtcgtctcggtttggctgacttatattacaggcagaagattatttggacgcatgatgcatcaagcttttatcttgcggtatcccgttcgcctgttcacttgggtgctgactggaatcgccgtgataactatcgtctcagcgctggtcttgctttacggctgtttggcagtcagtctgctgtttcaaaaggatgttttgttttcgccagagcgtttagccgctgttgcgatactggcggtgatcatgtcttccgtccagttttttctgaagacgttaaaggcagaatatctatttgtgctgttgatgacgctgacgccgttttttatgcaaagtggaacactttatttgccgtggggagtttcttggcttttgttgactgaatattcagtgaacgatataggcctggcagtttatcttatttcggcgggttatatagcggtctgtatgtgttggatcttaaggagcggggaggaaaagatccgtgaaaaatttgctcaaagcggaatggatcaaactcaggaactctga

SEQ ID NO: 3274 - DNA, 714 bp, Bacillus licheniformis
atgacgatccggctgaacatcaatgatctgcacgccctcgcccgccaatttcgttattcccaccagcgaatcagcgatttaatacgccttttgaaccgtcattttcatgttcttttctccagcgtgaaaacagcaagaacatgcggcatcgatcaggcgcaatccgaaatggaacatgaactcaaaggatttttacacacgctcgatgatttgcagcatctcctgcactttacagaaatccgcatgaaaaagaccgatcagatgcttgcggagaagctctttcacagcggcgggcatttggccggctacctgccgatcatgtcttctttggctgcagccaaatgttcccctggcagctataaactgaccgcaccgccgctgtctgaaccgctcgctctcatgaagcagatcaaacaaaacggtctgtcaggactcattacaaaaaaacgagccgcagcatatattcagtttgatgaagagggacagcagcagctgtggtcggcgcgccgcatgatcagccgcacaatcgccgacaacctttgcattctggcatatcagcaaatcgcaaaaggcccgctttctcttacagtcttacttttcggaaaaaaagcggaagcagatgcggcagatgtcaaaaccgtttgtctttcaaaaaacaaaacgattaccgccgacacgcttcacagcttcagtgccaaaatatattccggctag

SEQ ID NO: 3275 - DNA, 270 bp, Bacillus licheniformis
acccgaaaaaacggaagaagagctgaatctgatcgtcgactttggcgtaacggtgaaagatgtaacgattgaacatccggtctacggagacttaacagcttcgatcagggtcagcacaagaaaagaagtcgcggatttcgtcaaaaaaatctcttcgacaaacgccgcttatctgtctcagctgacaaacggcatccatctccacacattggaggcagatgatgaagagaagatcgaacaagcttgcggcgccctgcaaaaagcgggcat

SEQ ID NO: 3276 - DNA, 240 bp, Bacillus licheniformis
ttcattgatttcaccggatgacgtgtgggtgctttggggatttatcgcggtgtgggctgctgtgagtatttatttagagcagcggtttcgctgggctgccgctgtatcgggggccgtattggcactgggcggatcgatgctgtttactaatgcagggattcttccggccgagtcgcccttctatgatgcggtgtggtcctatgttgttccgcttgcgattcctttgctgctttttcaaat

SEQ ID NO: 3277 - DNA, 230 bp, Bacillus licheniformis
atgatgaatatttctgatttccagataaaagatgtcgttaacgtatcaaacggaaaaaagctcggcagcatcggcgatatcgatataaatgtaacgacaggcaaaatacaggcgatcgtcatcggaggaacggggaaagttttcggatttttcggaaaagaagaggaaatcgtcattccgtggcgaaatattgttaaaattggagaagatgtgattcttgtgcgtttaag

SEQ ID NO: 3278 - DNA, 414 bp, Bacillus licheniformis
agaaaaacatttcgtagatacgtacgattttgataactctgcatttacggcaactgagggcgtggttacaaagataaagttcggagctgcccgggctgacgaccaatcagaatatgaccaaacaaagtctgagattaccttgaaaaacagcggtttgtatctggtcagattgtatatttcagcaacagccatcccatctaattcggacatcggatttatttgctatgtcaatgatgcgcaatatcaaacgatgggctactggtacccttcaaaaagtacacaaacgaatgtagtattcttacagcagaagtttaatagcggtgataaagttacctttcatattttccctaaagtgaccggtagcactccttcatcagtcagtgttaagtctgcgtttttaacgatgtctcaaat

SEQ ID NO: 3279 - DNA, 459 bp, Bacillus licheniformis
gaggcgttttatttgaaatcccgaacgggtacgggcgctttcttctcgatatactgaagccggttgaaccggccgatttcaattggctgcttgccgatggcgaatgctatctcgtggaaaacggtgaattgtcagatgaaaatctttttcctcaagatccgcaggtgatgacaggagaagcatttaaaaaaaggctggaagacgcaaggtactatctcatcttcgccgatctgaaggcttttccgaaggatggccatcccgaagatgtcagcacatatgaatcatatatgaaaagcagctgcgagctgattgtgcttacagccgattcgagttttgtcacgatatactgcaaagatcaaaaaaacctggagcttctatatcaaaatgcaaaggactgcggtttcaagcggattgaatatataacggatcacaacgatgccagaacaggaatgcatgtgt

SEQ ID NO: 3280 - DNA, 262 bp, Bacillus licheniformis
atgacaacattcgacaaaggcacggtcgtccggacggtgcttttttttattgcattggtaaaccagacattgatcatgtgcggaagagcatctctgcctatcaacgaggaccaagtgaatacgttggccgacgctttgtatttggccggttccacggcattcaccatcattacgtctgtggtcgcttggttcaaaaataactatgtcactggcaaaggaaagcagcaaaaagaagttctaaaacaaaaagggttaacgaaat

SEQ ID NO: 3281 - DNA, 351 bp, Bacillus licheniformis
atgaaaaaaacaatttctctcattacagccgctttagctgtatgtatcggcgcatttctgttgattcataatgaagtgacagacaggttcaatccacttgtgaagaaagaaagcgtatatgtccagatcaacaaagacggtaagcacctgagcccgggccgctatgagtacacgctggaaggatataatgacaccggtaaggaaaaagaaattacattctccgccagcgattcccttcgaagaaacgcctatctaaaggtaaacgcgaagggaaaatatgttgagacatgggaagaagtacagcccggcggcatgccgagtgccgttcagaaaaaattgatcaagcaataa

SEQ ID NO: 3282 - DNA, 465 bp, Bacillus licheniformis
aggaaacgaaatgaagcatgtaagagcattgtgtttaaaattcattgtgagccttgtccttttatatgtggtcctaactctgttttttggcgttccattcggtgaaatgtttgttttgacattgtttctgggtgtgatatcctatctggtcggagatcttctgctgctgccgagaacaaacaatacaaccgcgacaatgggagattttggcctttcactcgtattgatttgggtgattctcgccatgcaaaataatcccccgtatggtacgcttgctgcagcttcaatcgtgtcagcgatcggcgtcacagtgttcgaatattttttccaccgctatatggaagccaacgtcttgaacgaaacagaaaacggaaaacgggaaaacagagaaaagcctggttcattgcagtatcaaagcgaatcatcagaggagctttatccggttacccactctaaaaaacagga

SEQ ID NO: 3283 - DNA, 307 bp, Bacillus licheniformis
  misc_feature (1)...(307): n = A,T,C or G
atgggcacaagagtacattacgcagaagaagtaaaatgggaagtaattaaaatgaaacaagctggaatgacaaacaaagaaataatggaacaactggggataaaaaataagactcaaattaaaacatggatgcgatggtacaaaacaggccaaacctatcgattttcgcaacaagttggaaaacaatattcctacggtaaagaatcggaggaaatgagtgagctagaagaattaaaactaaagaataaacagctagaggctcaattggncattataaaaaagtaccangagatcgaaaggagttgga

SEQ ID NO: 3284 - DNA, 708 bp, Bacillus licheniformis
atggatcttgaaacggttatgaaagaactggaagcgctgggtacggaaaacatgaaaaaaagatacataacgaatggtgcacacgaaccgctgtttggcgtggctacaggcaaaatgaagccgctcgcaaagaaaatcaagaaaaatcagcccttggcggagcagctttacgctaccgggaactacgatgccatgtattttgccggcattattgctgacccaatgacaatgactgaagcggattttgagcggtggatagatgcggcgtatttctatatgctatctgattatgttgttgccgtaactttggcagaaaccgattttgcgcaggctgttgctgataaatggatctcaagcggtgaagagcttaaaatgtcggcaggctggagctgttactgctggcttttaggtaatcgaccggacgatgaatttaatgtagctaaaattgccagtatgcttgatcaggtggaacgtacgattcacgattctccagatcgaacaaaatcggctatgaatcattttatctacacagtcgggatttcatatttgccgcttcatgaaaaggcggttgaaaccgcaaaagcagtaggcccggtcgaactcaggcggggcaagaaaaaaagcagtatcctgaatgcttccaaaaatattcaaaaagatattgatagaggccgtctcggtttcaaacggaaatatgtaaggtgttag

SEQ ID NO: 3285 - DNA, 705 bp, Bacillus licheniformis
atgatgaataaacataagtggttagccgcaattgctatcatcgcaattttagccgttattggctatttcacggtcagacaccttgaaccggaatatgcctatatgcctcctaaagaaaaagtcatctcaaaagaaaaacgattgcacggatacgatttatggggggcatttacaccggataagcccgcgtccgcaggggagggagctgtaaaggttgatgaccgccttcttgacttgggacgtgagacattttataaggaaacattcggaaacgaggtgtttttgacggatatcgtcggactgcttgacggtcccattacagctgccaacatgacgaaagccattgctggattgaaagggaaagggacgacaaacttgcgcatcgaattggcggaaacggttaaggtcggcgggaaaacctttaaaaaaggcgagaagatcgacaccggcattgatgttgcaaaaggggcatacgcgccccttggcatgccttttaaatacgctgacggaaaaatcaaagccggcatcagctgtgcggcctgccacgccacagttgattcgaaaacgatgaaggtgatggaaggcgtgacaaactcagatttaaatacagggctgatgctggcgctggcgacgaactcagctgcatattttacacatgccgaaattcataatattaaacaatttatgaatgataaaagcccttga

SEQ ID NO: 3286 - DNA, 420 bp, Bacillus licheniformis
gtatcatcccgcctatcccgccaggcaaaacaacaggctgatcaaagatctagaaaaagcggtaaacggagagcacagtgcggtcgtctgctaccaaaaaatcgcacaaaaggccccggatgctgaggcaaaacagcaaattttagaaatcagacaggacgaaatccgccactttaatgcgttcctggcattttatacgtctcttgccggccgaaagcctgacatttccattacggagccttgtccggaacagtattggaacgcgctggagtccgcattaaaagacgagcaggaaacggttgatttttatttggacatcgcagactatgtcaaagaccgggcgatacgggatgcgttcaagcgggcggcagctgacgaacaaaaccatgcagtctggtttttatacttcttgtcaaagag

SEQ ID NO: 3287 - DNA, 518 bp, Bacillus licheniformis
ttgcaaaacaaagcagcagacagactcattttattaggcatcagtttacatagcatatattggttgttcattttatttttgttttttcatttcaaacatcagcttgacgcttatgctgtttggaatccaaatgtcacggacggatatatggaggctggaactttcgtagctgcgctgaaattgatgctctactcaggcacattatttaatttgggcctcttgttcattttgggcttgctgatagtgatattagcacagtcgatcatttttattgccttggaaatcgccgcttacgtaaaaatcaaaaaagatccgttttctccatggggatcttttattttagcgatgggcattaaaaacattttcacgaacttatcagggattccgtttatggctgccggattcattcttcataagcagcaggaaccgaaagaagcagttgtagagccggcggcgcgaaggaaagcaaggcgaaaccctgcattgcttatgaaaaaggcggcgaaagctagaaaacg

SEQ ID NO: 3288 - DNA, 421 bp, Bacillus licheniformis
atgtgggaaaaattttactctaaaaatggtttggcagctaaaaatattgctaaagaattgatgaatatcaaagcaggtgaaaaaattccccgtatctcagactactgtcataagttatccatcggcagggggactgtgcaaagtgcgctgaatttattagttgatatgaaagcgattcaattggaggctagagggcatttaggaacgtttttggtaagtaaggataacaatttattacttgagattgcaggtattgcaccattaatcggctcaatgccacttccgtattcaagaaaatatgagggtctggcaacagggattgtggaagggtttgaatcaaccggaaaaacagttaacttgatctacatgcgtggcggagtgaatcgaatcgaagcagtccgaacaaaaagaagtgattttt

SEQ ID NO: 3289 - DNA, 594 bp, Bacillus licheniformis
tctggaacggaattactagcatcgcaaaaggcgcatggcaagtcttaaaaaatgcgatcctcggcccggttctgcttgtcatcgaccttgtgcaaggcgattttaaaggattcgcaaaccatttaaagcaaatctggacaaacatcagcaacggggcaaagcaaatctggaacgggatcaaaacggttgtgtcatcactcgttaaaggtttagtcaacgctgttaaaaattattggaatacagccaagactgtaacgacaacaatctttaacgggatcaaaagcgtccttagctcaatctggaacggtataaaaaataccgtggtgaatctcgccaaagggctgtggaacgcagtcaaaaccacttggaacacgttcaagactgtaacgacaaccatttttaatgcagtcaaaaccgtcctgacaaccgtctggaatgcggcgaagtcagtcgtcataaatgcggcaaaaaacatctggtcgagcgtcaggaataacttcaacaacatgaagaatgttgttacaaccgtcatgaagaatgtcaaaaccacgatccaaaacctttggaataacgccgttaaattcttgaggggat

SEQ ID NO: 3290 - DNA, 699 bp, Bacillus licheniformis
atgttaggagaaaagtttgaggaatttgtcgatggattacaaatagcatcaatagaggaagaaacgaagagggtaaaggaaattaccaaaaggctaaataaatcatttcgagacttagataatgaggaaatagaaaacagtcatatagtaggttcattaggaagggatacagcaataaaaacattcagcgatgttgacatgctttatgtactaccaaaggaactaaaaaatcaatacgatgaatacgagggaaatggtcaatcgaaactattgcagaaggttaaacaggaaattaagaaacgatacccaaaaacaatagttagaggcgatggacaagttgttgtcgtaagttttgagagtataaacaaaacagttgaagtatgtccatgctttgagagaacggatggggcatatgattatcccgattcaaataatgggggttcttggaagaaaactgaccccatgccagaaattgatgagagtataaaagttatagacgagacgaactcgaattataaatatgtttgtaatatagttagagcttggaagaataataaggggtttaaatttggtgggttattaatagatacattagtttataatttcttcaatgaaaatgaaaactataaagattcgacttttgatgattacctttctttgttaaaggatcttttctattacttgaaaaactcgaaataa

SEQ ID NO: 3291 - DNA, 699 bp, Bacillus licheniformis
atgatgataaagaaagtcttgtatagcgtgttgattgtgctgctcgtttcctttgtgcttgccgcttacaacgccttcatcggaaatcccgtaagcaagcagctgtctcacacggcgcttgagcattatttgactgaccgctatcctgaaaaagacttgcggatcgacagcggcatctataatttcaagttcacggaatatgtatttgaagtcactgacaccggtgatccaaagcgcaaagatccctatctgcttactttgagagggtttgttcaacctgaagtatacacggacggaatctatgaagagaacctcaatgaaccgctgatggagcggcttggagaagaagcaggaaaagatatcaaagcgcttttatcaaaaagcatagaccaactgaaagacgttgacgtgcatgtggaagtattaaaaggaaagctgaaaaatgacgcaaaatgggagaaaagcatccgcttagacaagccgatgcagattcatattttacttgatgccgaaaatgccggccgaaaagaagtatacaatacggcgcaaaagattcagcgcctgttgaatgaagaagggtacgactacgaaagcgtgacgattaatgccaacatttttgatgggcaagatattaaagacgaggagatcggctgtcttaaatacagcacctcctttaaaaacatccggaaatcaggttga

SEQ ID NO: 3292 - DNA, 699 bp, Bacillus licheniformis
atggtaaatgtcttaaataatatcttgaaaaatgacagattggatgcatatccattatttaaaaagttttgttccctcaaagaaaaagggttgcgtaagaaatcctttacagcattatcttcctttattgatgaagcaaagaaatgggatgatattgcacaacagaattttgcttgttggctgtttgctttatttgaaacatcagatgatattcaccatgtactcgttcatccattggaaaaggaacttttacagcctttgcttgagagatggatgaagagtgatcctgaagattcaagaccatataggtggtatggggtgtttttaaatcctgaaaaccgtgtcgattatttaaacaatgcacttagacttggtggcgggaatgaacaactatccttattaactctaatcgatattaatttgaacgccctttggtattcatttcatcatatctccgaagatttgtatcttggcgatattaaagaagatacagcacttcttgctaagtcccggcaattaaacaacaaagtagaatgtgaacaaacaaggaaaaacaataacgaagcacttaactattatcaagatctgttggatgactgggtgatgtttaaaaaagaacgatcaaagggatttgttgaatggtgtgaaaataagggtagaacctattattgggtcaaagcttattattacgaaagataa

SEQ ID NO: 3293 - DNA, 696 bp, Bacillus licheniformis
atgttctctgcagttcataatgcccgttatatggcggaaggcttccaggggagccgctatgatgttctgcctgccgaggcgcccttttattttcgaaacagcggaaaagcagtgatgatcagactgctccacgcggctcctcataccgacaatctcgacgttttcgtaaacgggatatccgtttttcgaaacgtctcctatacagatttatcttcttatgtccggtttcctgccggccgtattcaaatcgacgtttttcgaagaggctgggcgaacggtcccctgcttacggtacagtatcacctgatccacggccggtactgcacggttgctgtcacaggcacagccgcaaagctcgttcccgtcggaatgtatgaccagcctgcggctgatccggaaagccgcagcattcgatgcgtccatctctcgccggactctcccgctcttgactttgcagtgcaaaacggacctgtcctgttttccggcgtcccctttcaatctgttacccggtacatcccggtgcgttcacagaaaatggacgtcgagctgaggggggccggttcaacagcagtcctgctgaaggccccgaggatcacgcttcatgccggcgaatccacaacgttgtatggcctcggtttcgtcaacggctctctgtctctagagataaaagcggcgcaaggtcccgtcggcgagtag

SEQ ID NO: 3294 - DNA, 392 bp, Bacillus licheniformis
atggaaacaagaccatattcatggattgcgcttgacccggaatgcgaacatccaggcaacgattatcaccctagttatcctaagaaaaaattatgtgacgactatacttgcaactgtggtaggaaagggcaaaatggctttatcgattctgacctagatcaacttcatcttaacaaacagctctcagatgaaacgatcatcattaaagactcttgtgatgttcaagtctcaactgaagacacacaaacgttggcatcagtcatgacagctgcacaaacactagctgttactattattctcgccattatcgatgatcatgatctagccgaacttgtcacaactgatctgttgcaggtaactgccaataaacaaacgaacagacaaaaattggt

SEQ ID NO: 3295 - DNA, 690 bp, Bacillus licheniformis
atgagccttgccatgcttttcatccccctgattctcggtgtcatgtcggggtttatcctgcttgatgagcgcgacgaaaatatgattcagtattttgccgtgacgcccttgtcgaagcgcggatatgtcatgatccggctcatcctgccgatggcgatgacattatgctacagcattttgctgtttgcctccggcggtctaatggcgcctggcgctgtgaacctattgttcgtcctgatcatggtcacgcttgaagccccgatttacacgctgcttttagccgcctatgtcgcaaacaaagtggaaggactcgctttaatgaaaggattcagcctgctcactctcatgccggccgcggtttattttattcctgtgccgtggcagcttttcggtgttttcaccttattggacagcgaaaacgtacttggcgggaatatcccacgaagggctttttctcgttttcgggatcaccggaattgcgctgcacattatgatactgctgtttttataccggaggtttttggtgaaaaccgaccaataggagtatatcccgccccgttttgcaataaagtattaaaacataagcgggaggcgggatatcccgatgaagaaacatatgaagctttgtctgtgtatgatgatgatcttcgtattgacttaggccggcagcatgtatcgcttgggcgctga

SEQ ID NO: 3296 - DNA, 328 bp, Bacillus licheniformis
atgaaaaacgtaacatggcttgcggaaaagtttatggacttattcaggcatggcggagaagtgtttgtcggtatgcttacagacatcgttcctttattgattatgctgcttgtcgccatgaatgctctgatacgcctgataggagaaaagcgcgtagaagcgcttgcgaggaagtcgggaaaaaatccattgaccagatacatggttttgcctgtcatcggtacgttcatgctcgcaaatccaatgacgctgtcgcttggcaggttcttgcctgaaaaatacaaaccgagccattatgcggctgattcctatacagcccacatgctgc

SEQ ID NO: 3297 - DNA, 531 bp, Bacillus licheniformis
acatttcttctcaaaaagaaaaatctgaagaaaagcagtacaccgttcagccaggggacacgctctcaaaaatcgcaaaagagttcggtgtgactgtaagcgatcttcaaaaacggaacaacctgaagtcagacttgattattgcagggcaaacgattgcaataaacggagaagcggcagctgcagcagcgcctgtgaaacaagagtccgctccaaaacaaaatgatcagcctgtcaacgtacaaaaggaaatcacagtgaccgcaactgcgtatacggcaaatgacgggggcatttcaggcatcacaaaaacgggagtcgacctgaatgcgaaccgcaatgcgaaagtcatcgcggttgatccaagcgtgattccgctcggcacgaaagtatatgtggaaggctatggcgaagcgacggctgaagacaccggcggcgccattaaaggccataaaatagacgtatttattccagataaaaaagacgctttcaattggggcgtcaaaaccgtaaaggttaaaattttaaact

SEQ ID NO: 3298 - DNA, 687 bp, Bacillus licheniformis
atgactttatgcaatgcttttttgaataataaggattggattatgtttacggcgaccttttgctcgttgatcaacacggggaaaaatgcgggtctgtggacatatcaagagtatggcgatgaggagctggtgaggactatttttcaaaggggcggctcaggcattgtcccgatggtgggcatgtttaaagcatcttattatcagcaaaaaggcttcacttggctggttgatccgcaaaagccgcttgcaggggatgtgctgaattgtttggccaacacgaagcgcggctggaagcggcgctatttaaaaaaacctgtattatgctaccgccgccaccaaaaaaacatttcctaccaattgcataaaagaattcaatcgcttgtgtacgtcatggattatattgtgaaagaatttgacgaaagcgtctattttcctcatatcaaatggaaggagcttgaggaaaatcaaagacagtccttgaaatatttcagcatcggaaaaaccttttggagaatggcccggagatacgcacaaaacggatatacccggcatttagatcaagacgccaaaaaagaatgcattcagccgctcctggataaaatggatgaatacttccaattaagcctcgcttcagacaatcagtatgaacgatatatgaaaaatattaaaaaaatccagctgatataa

SEQ ID NO: 3299 - DNA, 357 bp, Bacillus licheniformis
gtctttaattattgcgtttggaattattgggtttgtttatttcgcagtcacaagtccgggccgcctgctccaatactagcttgtttttgccgcgttcggcgccatcatttatttcgtgatcaggcgcatttcctatcgcaatatgggcagtgagggagccgcttttaagaaagctgccaaacaatccaacatgcgttttcaggatcataaaaaacgctctgtaaaaggcagggtcaatcacctgagaagcgtaccgtctatcaataaatcgaagccggtattggtgaagaaaaaaagccagacccagctgacagtgattgaaggcaaaaaaagcaaaaagaaaaacagggctttctt

SEQ ID NO: 3300 - DNA, 249 bp, Bacillus licheniformis
ttctgaaacacagcgtgacatgcccgatcagcaggcgcgcgtttgaagaattcgaatcattcgccaatcagcatgaagacataccggcttattatttaaaagtgcaggaaagccgcccgctgtcaaactatatcgctgagcaatacgggattaagcacgaaagtcctcaagccttcatttttacaaacgggaatgtgaaatggcatgcctcccattcgcaaattaccgcacaagcacttgcggaaaaca

SEQ ID NO: 3301 - DNA, 373 bp, Bacillus licheniformis
atgttattgcgctatttttacgataaaaaactggcccatgcatcctatctggttggctgccaaaaaacaggggaagccattgtgattgaccccggccgcaatctaaaaccatatttgcaagcagccaaggaagaagggctaaacatcacagcggccgcagaaacccatattcacgccgactttgtttccggtgcccgcgaactcggcgctacacatcaagcgaagctgtatctttccgatgaaggagacgcaaattggaaataccaatatgtcgatgaatcgaaacatcaacttgtgaaagacggcgatcgcttttccattggtaacctgatgtttgaagttatgcatactcccggccataccccggaaagca

SEQ ID NO: 3302 - DNA, 375 bp, Bacillus licheniformis
  misc_feature (1)...(375): n = A,T,C or G
cctttaaacatcaaaagaaggcattttggtggcttagctttgtcgctttcttcagcgtgatgaacgaaaccgtatttaatgttgcattgccggacataaaaaatcaattcggcgtgtcgcctgcggcggcaaattgggtgaatacgagtttcatcatttcctttgctgccggttcagttgtttacagcaggctttctgatatgtacggcgtcaggaagctgtttgtggccggactgctcatctatggcggaggctcattatggggtttgttggctcaagcttatttcccggctgtgatctttgcgcgctttgttcaaggatccggggcttccgctgtacccgcgcttatcctggtcatcatcacgcgctatgtnc

SEQ ID NO: 3303 - DNA, 444 bp, Bacillus licheniformis
atggggacggtcgtatcttttaacaatgaaaaacaaaagaagcagatcaatttggaaaaacagcttctgcgcgaactgtctttggaaaaaatgctgaattctgcagaggaatgctttgctcctctttttcactttttttctaagcatacggatatcttatatgacggctgcatcgactttgccattgaggcatatttgctgggagccgagtacgggaagttcggctatcacggagaacccgttcatcgagcgatgatccgctcagaaaaagaagaaaaacagctactgcacgagctttatgaatatgctgtcagctggtctgaggcttttaatgttcaagctgcttatgaaccgctctattatgcctgcgaatacttcatccaaagctggtggaaggaaggcttcagccagcgggaaagacgctttaagcttcggctcagataa

SEQ ID NO: 3304 - DNA, 240 bp, Bacillus licheniformis
atgcgtaaagaagtgcaggagtatgtgttcgccgacgaagagcgccgccggttcatccgtgagcagccggtctggtaccgcaagctttcgcggaatccgaatgatctgtcagcctttcatctcgatatgatgaatttttatgaaaaaacgattcctcacagggtcaaccagttatcgggcagcattcagatggcccagatgatgctgcaaatgtttcatgcgatgcgcactcaggattaa

SEQ ID NO: 3305 - DNA, 681 bp, Bacillus licheniformis
atggaaacgaatttagaaactgaaaaagtaaagaatccatcattgctcggattgattacccggcccggagaacagttcgagagaatgagagaaaagccggctttctggtttccgcttgtcattgttttaatcttgtcggttgcgggagcgtatatgctcagcgaaaaaacggcgttgtctaccgatttgtcggaaatgccggatgctgaagcatttcaagctgctatgaagggaatcggcatcatcggcgggatcttcggctttgtgattgccttgctgatcagcgctttaatttattggctgattgtcaaaatcggaagaggaacaaccaattttgttcacatgttttcgctgtctgtttttacatattttattgcggctatcggacaattcataggcggactagtgatctattattcaaatatcgatcccacgatcgtcgtcacgtctttaaacggcatcatcccggcagacgagccgctcaaatcggtattgggtgtatttgatattttcacgatctggtcgctctcattggttgccctgggtctccaaaaggttgggggcatctccaaaaaagcggcttggaccggtgtgatcattttatttgtgatctccattctgctcgctttaataggcggtatggcgatcaatttcttcgattcatttgaaggagcaatgtaa

SEQ ID NO: 3306 - DNA, 277 bp, Bacillus licheniformis
atgggcttaaatcagcaaaatcagattcatctattaaaagacattctctcagaccatcaagcagactgcaccggaaccgtcgctgaatgcgaacagatggagcggattatcaagtctttaatggcaaacacgaatcttgacgccggcttgaaaggcgttttggaagacatttatttgtacagccagaagggaagatcttccgcttcgatcaacaaccacattcaggagcaccaggattatctcacgcaatgggtggaagatatcgactcattttcat

SEQ ID NO: 3307 - DNA, 223 bp, Bacillus licheniformis
atgtttcattgcaaaccaaatgtgatgccgccaattgtacacccgactaattgttgtcaaactcatactttttctaaaacaattgtgccgcatattcatccgcagcatataacaaatgtgcatcataagcatttccagcatgtgcatcaatatccacacacttattctagttacgatcctgttacacactctcatactcattgtggtaaaccatgttgtaact

SEQ ID NO: 3308 - DNA, 573 bp, Bacillus licheniformis
taaagttacgcatcacggatcggtgcaggccgagctttacgttaattatgacaacggccagaaattgagcgtccataaattttcgtttgaaatcgatcgagcactcgtcgaccaggatatcgccccggtggccgaatattatgttgacgatttcgaatcgctaaaggccgtcattcaagaaatggcggacgatgccgaacaggttctcgctgagttacagaagaaattcgaaaatctcgataacattgagacgaaagaaggcgctcaggaaaaagcagacgtcgcagaggctggtgctaaagcttataccgataagcatgcggctaaaattgataatccgcacaaggtaacgaaagctcaggtcggcctctcaaacgttgataacgtcaagcaagcgtctaaatccgattttgacaatcatgtcggcaatacagcgaaccctcacgcagtcacgaaagcacaagtcgggctgtcggatgtagacaacgttaagcaggcgagcaaggccgaatttgatacgcacaacagcgacaacactcgccatattactgcggatgaacggacgaaatggga

SEQ ID NO: 3309 - DNA, 261 bp, Bacillus licheniformis
tattttcttaaaagcagggctggcggcatttatgctgaccggaggcgtaatcaaggtgctgcacgttccttttcaagtcgaacattggcgccattatgaatatccgctgtggtttctttctgttacaggatgtctcgaaatcgccggagcgcttggcatgatcggcggaatttggaatgtgcatctggctgtcggttcggggctgttattctccctgcttatgacaggagccatccatgcccacctggtccgggcgcggca

SEQ ID NO: 3310 - DNA, 678 bp, Bacillus licheniformis
atgatgcgggagaacgcgtccttggcggccaaaacccgcagatcgccgtacaatccgacccaggcgagttttggattccggcaaaccttgaatggagcggccagcctgatccgtggaagggatttgattcatttaccggaaatccgggactgcatgtcacgacgaagaatccttctcaagatgtcggcgttctcggcagctatattaaaacgctcgtcttctttgcggccggaacaaaagccgaaaccggcggctttaccgctcttggaaacaaagccaaaaatctggcaaaagaactgcttgatgcagcatggagtaaaaatgacggaatcggtatcgcagcagaggaagaacatgaagattatatccgctactttacgaaggaaatctactttccgaatggctggagcggcagaaacgggcagggcaataccatccctggccccaacactgtgccgtctgatccggcaaaaggcggtaacggcgtctatatcagtcatgcggagctccggccgaaaattaaaaatgatccgatgtggccttatttggaaaacaaatatcagacctcgtggaatccgaatacgggcaaatgggaaaacggactgccgacctttgtatatcaccgtttctggtctcaggtcgatatggcgacagcttatgctgagtatgaccgtttaa

SEQ ID NO: 3311 - DNA, 675 bp, Bacillus licheniformis
atgcaggtgaaagcagatacgctgtcggcggcagaactgtatgttttagcaggagcagccggagtttcctacatattcggtcttccggaacgcgaacagctggccttggtcgagccggattgtgcaataaaagcaaaggacagcctgattgaaaaaggcattcttttaaaggaaggcaagctgaccaagaccgctttttttctgattaagctgctgcaacattaccaagaaagcggagaatacgtgcgctttaataacgtgatgtgcgcatttctgccggacgacgaggagcgcgttatcgccctgactgaaataagcccgggcaaagggtacacattagattatgtggaaaagcgcgaagtttatttatcgctcatttcaaaggtgtcatttttagtaagggagccgcgcgatcaagaccgcgcctttttgacaaaaccgatgagcgccgctgaaaaagcggaagtcagggcaatgaatcttgatgaaaaagaagttcttgctgtggaaacgttcaagctagcctcacagcaaaaaccggcagaccccggcttccagacgacaacactttactttacaaaaggcgaagacttcatctcggttgatcctttaaatgatcgatatgaatggatcagcctttatatcataacaaccggatctagatgcactcagtaa

SEQ ID NO: 3312 - DNA, 388 bp, Bacillus licheniformis
  misc_feature (1)...(388): n = A,T,C or G
ttggaatcacatgaagaattatggagggaagccaaggccttcatcgagctctgctacggggaactgtcgaagtccgaagaagaaacaaggatgcgcttacataaaatagataaagaaatcagagaaaccggaagctatacacatacattagaagaaatcgaacatggagccagaatggcgtggagaaacagcagccgctgcatcggcaggctgttttggcactctcttactgtcatcgatcaaagaggcgttcaaaccgaggcagaggtgcgggatgcgcttttccaccatattcagcttgcaacaaacggagggaaaatcagaccgttcattacggttttccccccggaacaaaacggacacagcgaagtgtgcatttgnaaccaaa

SEQ ID NO: 3313 - DNA, 207 bp, Bacillus licheniformis
atgggagtagacgtaaatattatttttcaaattgccggcgtcgggatcgtcgtcgcttttcttcacaccatactggatcaaatggggaagaaggaatatgcccaatgggtcacgcttttaggattcatttatatattgttcatggtggcaactgttgtcgatgatctattccaaaagataaaagctgtctttctatttcaaggatag

SEQ ID NO: 3314 - DNA, 417 bp, Bacillus licheniformis
ctgaactaaaatggctgaatagagcgcctgcttcgttcggcggggtgacttggggagtgccttgggcaaaaggagtgctgcaaaaaggggagacggccgtcatcgcttcggaaaacgccccgtatttgcaaacatggccgcttgcatattggcctgacggctcgattaaatggacgggccatgccgcagtattcccagaagaaagcggacgccgatttacattgcaaaaaggaaagcccggcgcgccgaaaaccgtcgtccgtgtcagcgagcagaaagacgaaatcacggtgaatacgggcgcgatagtctgcaagctcggaaagtcggggccggcactgatccgttcgatttccatttccggggaaatgatggcgaaagaaggacggctcatcgctttaaaagaaaaaaagcggt

SEQ ID NO: 3315 - DNA, 582 bp, Bacillus licheniformis
ttggcacaagcgctttcaagatgagaactatgtgtatggaactgaaccgaatgcgtttttggcagattcgcagaaaaaacttcaattgtcgggcgatgctttagccatcgcagaaggcgaggggcgcaatgcggtttttttagcagaacaagggatgaacgtcacttcatgggattatgccgaatctggactgaaaaagacgcaaaagcttgctgaaacccgtcatgtatcagtaaagacggagcttgttgatttaaatgaagcgtcttggaatcaagatcagtgggacgagattgtatgtatttttggacattttccagaagagctgcgccgaaaaacgcttctgggagtaaaaaaagccgtgaagcccgggggctttttcgtaacggaagtgtattcgacgcaccaaatcccttacaaaagcggcgggccgcaggatccagaacttttatatacaccggaagaatttttgcaaatcttttcagattggcgtactgtccacttttttatgggagaagtcgttcgtcatgaaggagattcgcacaacggcctgtcccacgtcattcaatttattgggcaaaa

SEQ ID NO: 3316 - DNA, 666 bp, Bacillus licheniformis
atgggaaaatggtttctttccggaggcggagatgcacaccaaaccgaacagctggatcggcattttgcccggagcatctgtcctcataagccattattgtatattccgattgccatggacgccgacaggtatgatgacggcttcgactggatcagccggctctttcacccgctcggcatcaaaaacattgtcatgtggacggatgtcaaaggtaaaaccgtacacgatttagacgtgttttctgccgtatatatcggcggaggaaacacgtttcgtctgctaaaacaattcatcgaatcgcattttaccgcggttttaaagcgctatgccgaaagcggcggcgccatttacggcggaagcgccggcgccgtcattctcggaaagaacattatgacttgctcttatatggatcgcaacgcttgcggattgcgggattttaacggcttaaagctcctcggagactattcggtttggtgccactacaaggctgaacatgatccgctgattaaaaggtttaggaatgcttttggcactcccgtcatcgccttgccagaggaaacaggaatcgcagcaagcacttcagacatccgggtcatcggaacaaagcccgcccgtatgtttaaagaagacggcgcagtattcgtctcagatcaatttgttttataa

SEQ ID NO: 3317 - DNA, 414 bp, Bacillus licheniformis
taccttatctcctgacggggattatgcattgtacggctatactcaggatcaaatcatttcactcaactcaaaaacagcagcgccccttgtgaccaaagaatagaaaggagaatggacagtggccatagcagacgtcaccatcataccgatcggtaccgagactccgagcgtaagcgcgtatgtagcggagattcaaaccattttggaaggatttaaaaaagagggcaaaatcaattatcagctgacaccgatgaatactttgattgaaggggaactaagcgatttatttcaggtgattcagacgattcacgaagcgcctttccaaaaaggcatccacagagtagcgacaaatatcaggattgacgaccgccgtgataagaaaacgacgatggagggcaagcttgcaagcgttca

SEQ ID NO: 3318 - DNA, 318 bp, Bacillus licheniformis
ttatgatcttaattacgctgatgggcattgaatttgtcagcaaaagcttgaacgaatgtgtggaagatcgatttacaattaagaggctgtttacaaggctggcgaaaaaattggttacgctctttctgatatccgttgcccacctttttgatcaaatgctgcaaacaggcagttcgatccgcgatttttctattatgttttatattttatatgaagcgtttcaaatcgtgagcacggctcattcgttaggaatccccgtgccgcagatgttattggacattttaaataccataaaggaaaaactccggggaaagccgt

SEQ ID NO: 3319 - DNA, 291 bp, Bacillus licheniformis
aaatagattacagcaaagctgcggcatctccggagttccagcggttgttaaagcggaaacgggcttttattgtaccgatgacgattttctttttgctcttttatttcctgctgccggttatgacatcatacttcacatttttgaatcagccggcagtcggggccatcacgtgggcatgggttttcgcgattgctcagtttgttatgacgtggacgctgtgcattgtgtatacgaaaaaagccggtcaattcgatcaaattgcaagcgatttcaaaaagaagattggaggcg

SEQ ID NO: 3320 - DNA, 288 bp, Bacillus licheniformis
gctgcgaattcaccctgcagtctcctttcggcccctccccgtgcaaagtgatcgagcttgatgcgccgcatcgactcgctttcagctgggatacgtcgggatggatcgtcacatttgaattgaaagagctttctgcagaaaaaaccgaatttaccctgattcattcaggatggggtgcgccggaagaaacggtttcaaaagcgggagaaaagcaagcggatgtccgcaatcggatgaatggcggctgggaaacaatcgtcaatcaaaagctgcgtcaggcagttgagg

SEQ ID NO: 3321 - DNA, 219 bp, Bacillus licheniformis
caatcatgccagccattgtcggacccattaaaatcaatgaaatctcaggaggagtagtgaatttcggcgattctttttatctatctccaaaaagcacttcaaagtctgcgctcggttctggtgctggtaacactggagatttccttatcgtcaataatggtataaacgcgacaaattatatagacccggatgtaagcgaccagaatgttgtcggaaatg

SEQ ID NO: 3322 - DNA, 297 bp, Bacillus licheniformis
gagtacattacgcagaagaagtaaaatgggaagtaattaaaatgaaacaagctggaatgacaaacaaagaaataatggaacaactggggataaaaaataagactcaaattaaaacatggatgcgatggtacaaaacaggccaaacctatcgattttcgcaacaagttggaaaacaatattcctacggtaaagaatcggaggaaatgagtgagctagaagaattaaaactaaagaataaacagctagaggctcaattggcaattataaaaaagtaccaggagatcgaaaggagttgga

SEQ ID NO: 3323 - DNA, 660 bp, Bacillus licheniformis
atgtttaataatatctcggcatcgccaaacccaaagcaaattacaattgaaaaagcacttacaattattctccgacagatggaagtaagcgggaatagggagcggacaattagcgattaccatcttcatgtatcacattttaaggaatcagaagaattaacatatctacatgaaattacatataagtcgattcattcatggcttggaaacatggatgtcagtgcacaaacaaggctcacgcgtttgaaatgtctcaaagcatttttatcgcgttgtttcgataatggatggttcgaatcgaagttttggaagaacgtaaaggtgaaggtcgacaataaagttaaagagggggcgacggatcaggaaatcaaaatcttactttcgttattagatttaaccgactttgtacagctacgtgatgcgacagcattgcttcttatgtataaaacaggtatgcgtgtagggacgctcgcaaacttaaaagaagaacatgtcgattttaatggagaattacttcggttaagtggtgaaatcgttaaaaatcgagaacctttactactgccctttgatgagactctcgctcaacttctctctgtactggtgaataaaaacgccgaaatccgccgagcatataagaaggacaataaatttgttttttaa

SEQ ID NO: 3324 - DNA, 362 bp, Bacillus licheniformis
atgcagaacagaattgagattacagaagccaatctgcgaaacgaccggctggtgttgaccagcgaaatcaatgacggagcggagcggaagccggccggacgcatgctgacagactccgatcattttgcatttgtatacctacttgaaccgggccgaatcctttgaatacgtcatttaaacgaaggcatctggtccgatcttaaagcggcccttgacgccggtcttcctgtgtttttacatatcggaaacacggagctggagcttaacgggttccatgatgagctcggatatttaatagagaatattaaagataatgcaaattatggcgaagaaatggaagagagagtgaaacggatattcct

SEQ ID NO: 3325 - DNA, 444 bp, Bacillus licheniformis
atggatatggaacgtttccatcaaatgccggcctttatgaaagaggaaatggataacctcaagcgcgtggcggcgccgttcttaaagaaaaggctgatttttctttttatcgcgattccgctgcttcttgcttcatttgtttatctttcctctttttgggggcaggcagcttatggaaccgattcaatgataaaaatcggctgcgctgccgcaggtgcagcattcggcatggcgctgttcagagagtcgtcataccaaaaaagaaatgttcagcaatcggtgatgaagtatatattggaacggatgcaaacaagcgaagtgctttccgatgaacggaaaagccgctacgttcgggcggtcaaagaagagccgtttactgtaatgagaagctttttggaatttttaaatgaagaagagatcagaaggcgcaggctggctgaatga

SEQ ID NO: 3326 - DNA, 651 bp, Bacillus licheniformis
atgaaagccgaacagcattacaagcaagcccttaaagacgcggcactgatcaaacatcatgtcctcctcggcatggctcaccacaacttagggttgagctatgtcaatcgcaacctcctcacattggctgaacatcatttcaaagaagcgctgcttatcaaagagcatgaagaatcggtttacggcatccattccatgtttgaactgacacatgtgctgtacaaatcaaatgttgtcaaagaagcacgcaaattgtatgaaaaaggatttttccgtgcggaaaaagcaggagaaagggaatatttgtcgaaatttaaacttattcatgctctgtatgatgaacaggatccacttacggttgaacatgctttagaatatcttaaaacgatcaatctctggacggatgtagcggaattaacatttgatatcgcactttactataaagaaaatggagatgcagacaaagctgccgaatattttgaagaatctcatcatgcaagagaccaaattcttaaaagaacggaggagtctaaagtgaaaaagatgattgccgttgcgttgactgccgtctttgcaagccttgtcgttttaagtttttcgtctcagcccgaagggagatgccgagtttgccggccgagccatttttcttga

SEQ ID NO: 3327 - DNA, 406 bp, Bacillus licheniformis
atgattctcagaacgtccaaagtgaagtttttaaaagtacactctgtcggaataagcagcacgctgcaaatcggagacacggaagagcagtttctcaagtcaaaagttctcgccgttcaaagatacctttctcttttttacggaaatgaagggtcatttaaacaggatgattttcagcttttcaggcagccgatcccgcaacttctcccagaaaccggcgtatgctcggcttttttccatgagatccccttcatccgtgtaagggcgattaaaatcaacggtgtatcatcatcctccgttgctcaggtcggctcaacgcgccgcatcaatgccgactcgagagtcaaacatatcagaaagcttcctcccgcaaggaactcacaatagcagcccggccgacatatac

SEQ ID NO: 3328 - DNA, 652 bp, Bacillus licheniformis
atgctcatgttgggcagccttgaaatattcggttttcgcgccctttggagcccctatttcctaggggctgtcgttttcataaccgccctttacttttttctgatgaaacgcttaggatcagaaggagagcgggcgtccaggaaagaaatcggtttattcctgacggcgatgattcttttatacgcgtctaagggcagtccggttgatttgctgggacatattatgttcagcgcgcatatggcgcaaatggcggttctgtatttgatcgtgccgcctctgatcatccttggcataccgccttggttttggaaaaaggtcatttttctgccgatcgtcaagccgctgttccggtttttttccaaaccattgatcgcgataatcgtgtttaacggtctattttcgatgtatcacattccattggtgtttgattttataaagacggatgccgtttatcatgccgccattaccgtgctgatctttattgcagcgtttttcatgtggtggccgctcgttcacaaggtcgaggagcttccgcagatgagcggacttttgaaactcggctacattatggctgacggcattttgctgacaccggcgtgcgcgttaatcatgttcagcgatacggctctgattcgacaattcggcaccaaga

SEQ ID NO: 3329 - DNA, 210 bp, Bacillus licheniformis
atgatttctcactttcaatggaagccgctgtttaaaaaagaaaggcttcccggctggaaaatatcgttttatcataaagggattcattatgaaggaatttatcataaatcgggggaaatcgagtggggcagcacctatcccccgcatgatgacgagccttccctgaaaagcgaaattcatgaattaatgctcttccatatttacgagtaa

SEQ ID NO: 3330 - DNA, 648 bp, Bacillus licheniformis
atgggtattataaaaaatgacagattaaggagggtttttatgaacaaaaaaacagtgtttaaagcgttcggaatgttgatgacaggggtattgttttttgcgctgtacagtgcggccgcacttccttctgcacacgcggcaaacgaaaaaaaaccgacggtcacgagccatacgtacaaaaacattaaggctttgaaatacccgcaagtttcaaatgtaagccccaaatctctccaaaacaagatcaacaaagattttaaacattatattgagcagtcctacaaagattatgtaaaaaacaagaaagacggccaacagcacggataccaaacggattatcaaacgtcctttgaagtgaaataccggaccggccaaaagctgagcatcctgacaagcaattacgtctattccggcggagcgcacggaaatacggcagtccgctctttcaactatgaccttgtctctaaaaaacgggtgtatttatccgacatcctaaatacaaaatcgaaaatggataagacaaaaacatacatttacaactatattcaaaaacacagcgacattttctttccggatgtaagaagaaagacatcgtcctcggtaaaaacacggccttctattaaactaacggcgtgcattcttccaggg

SEQ ID NO: 3331 - DNA, 441 bp, Bacillus licheniformis
tcagacgttttttcgggcgtttaaaaagaaatgggccaaatcaagcgttctcggttgtgatattgggtctggtcggcttattgctgtttgttgattttcagattgcggccgtctattttcccgatcagccagtgtttttaagcctgttcatcagtttgtttatcatttatgccatcatcctcttatacgcttttccaattgatgtccactacgatttaaaacggattgcagtgctgaaatacagcttcatcatcggcttttcccgtccgctcacctcgtttttcatgctgatcagcgcgtttggcatgattctgctcgctttatttcatgtcacatttcttctgtttttcagcggcagcgctttaagcttcattttgacgaagctttcgtttcaggcattccgtgcaatcgacgggcgccggacagacaagcaggctgccg

SEQ ID NO: 3332 - DNA, 197 bp, Bacillus licheniformis
atggcgaaaacgttgtccgatattaaaagatcgcttgatggacatttgggaaaaaggctgacgttaaaagcaaacggtggccgccgaaaaacgattgagcgttcgggcattttagctgagacgtacccttctgtttttgtgatacaactagaccaagacgagaattcgtttgaaagagtttcatacagttatgcgga

SEQ ID NO: 3333 - DNA, 285 bp, Bacillus licheniformis
caaaggaatgcaaggggaacctggtccgcaggggccacaaggaccaaaaggggacaagggagatactggcccacaaggcccacaaggagaaccaggaccccagggaccaaaaggtgacaaaggtgatcctgctgtcattgaagaaaaaagcattacccatgaaatgcttggtgaaaaggtagtaagaagcaacaacgtaggaactggtagcatcatgatggacaacttaaacagcgaagtaaaggccatttttgaagacctacaaaagcaaattgatgaattaaa

SEQ ID NO: 3334 - DNA, 645 bp, Bacillus licheniformis
atgctgcgtgtgcttacgcttgccaagggctatcccggcaaggcggcaattgtcggatttccgatgattgccgacggcgcatcggcggtgtgcgaaattttggatattcggatcgacgcctgcaccgtatcagacgaacgcgatgttgaaccggtgcttcttcagctcaaagaacagggctatcagatcattatcggcgatgtgatcacaattgagaaagcagagcagctcggtttaaacggactgcttttgacatccggaaaagaaagcattgccaaagcttttgcatacgctaaaaaactgtattcctttttagagagcatcgagcagaagtacgctgtgccgtatcacattttacagaaggccgagaccggttatgcagtatacaacaagacattgcggccggtttttcggatcggcgtatttgcggaacatatcggcttgctggataatgtggaagagctgatcgaggaagcggtaaagaaggcagtcatccattttagagtccgtaagcatggacgcacatggaatatcacggggcgcaggttttttgtatcagagcaggcattggccgtattgaccgcggaaaatgcaaaagatgttcgcgtttcttctttgcccggggcgatgattctttatccttag

SEQ ID NO: 3335 - DNA, 320 bp, Bacillus licheniformis
tggcgaccgggtttttagccggattgcttcaatttgtcactggaggattttacgttgatcatcctctgcaacttcttcttgattactttatcgcgcctacggacgcgggaatcggtggcttttttgccggatcgatccgaaatgcttcatttgagaaacaaaaaggaaagatcatttcctatgtaatgctggccgtacttcttggaagcggactgaaattactcgcacatgtaatcaacggcgctgacttttttggaaactatgcgcctaaaggcactccggtatggatatattcattggtatataatggaacgtatatg

SEQ ID NO: 3336 - DNA, 642 bp, Bacillus licheniformis
atgaaatatatttatgttataatttcattaagaaagataagtaaggatggttatatgaacggatttgaaaaaagggctttgctgattaaggagaagatcaaaaagacggctttggatatgctcaaaacatgggagccaaagcgcatccggataaccgatatcgcaaaagaggcaaacgtttcgcaggtgacgatttataattactttggaagcaaagaagcgctcctgaaagaggtttttaaagattatatcgatcagtccatcagcgagtttgaagaatatatgaacaaagatatttctgttaaagaaaaaattgaattgatgattttgcaaaaaagggcagccaataatcaaaaattcgctttaacggtcatcaaagaggtgatgatcgaagacagtgaaattatggattatgtgaagcagcaatacgatgaaaaaatcattccccttatgctccaaatgattgaagaaggtcatcggacaggcgaaatctcttccaaaatcaccgcggaaagctttctcatctttatgaatatgatcattgaacattcaaaaacattgggtaaagcctttgaaaaaaacaggaagtttacagaggaaatgctgcacattttcttctatggcttgtgcggcagaccgtag

SEQ ID NO: 3337 - DNA, 238 bp, Bacillus licheniformis
gtgtaaatttaactccgatcatgataaaaaatcagccgtttacggctgtaacggtcaaactgccgaaaaccaactttatggcggtaaccaatgaccatggatatattatgtgcggagcgcttgatgtcgccctgctgaatgataaattaccagaactgataatcgtcgccgccagacccgtcggcgtgcggacgaatgatcagcttctcgaaaccccgctcgaatctgtaaccgatgc

SEQ ID NO: 3338 - DNA, 210 bp, Bacillus licheniformis
gatccgccgaacgccgaaaggattcattgaaagatgttccttccaaatcaggctatgaccgcgacgagtggccgatggccatgtgcgaagaaggcggaacaggtgcttctgtcgagtatatcagcccgtctgataaccgtggagcaggatcttgggtgggcaatcaggtaagcgattatccggacgggacgaaagtacttttcaagatta

SEQ ID NO: 3339 - DNA, 639 bp, Bacillus licheniformis
atgagaaaacacattttttcgctcgctataatcgctatgaatctaatcatgtgggcaatcgcttatccgcacatttccggtcaagttccaatccattggtcatcttcgggggaaatcgacaggtatgcttccaaaatggaagcgatgcttgccatgattgggctgctcgtttttgtatatgtcttgatgttcttaacgccgaaaatcgatccgcgcagaaaaaactatcagcttttttcgaagacttattacattctcatcaatgccatgctgcttatattttctctgatcaacgtgcttgttatcatgaccgggctcgggtatgatctgccggcgggcagcatcgtaccggttcttgtaggcgctctattaatcgtcataggcaattacctaccgagagtccgctccaacttttttttcgggatcaagaacccttggacattgagcagtgattcaatctggaaaaaaacccacagatttgcggcgaaagtatttactttggcaggacttctaatagctgcggacgggttgttatcaatcagtccagaaatcatgcttccggttattttggcaacggttttggcgccctatatttattcttatgttttgtaccggaaggaaatcaatatgaaaagctga

SEQ ID NO: 3340 - DNA, 237 bp, Bacillus licheniformis
atgaatgcacttcaacgtattgcattggttttaacgatcatcggagcaatcaattggggactgataggattttttcaatttgacttggttgcagccatttttggcggccaagggtctgctttagcacggaccgtttacgcgcttgtcggaatcgcaggtctgatcaacctcggacttttatttaaacctgctgaagagaccgccggcgaagacgccaaacagccggaaatgcgttaa

SEQ ID NO: 3341 - DNA, 387 bp, Bacillus licheniformis
atgtcgtttcatgaaaaagccgaagcgctgtacgcagaaacatttgacgaattacaccgggaatatgaccagctcattgaagtaattgattcagaacatgtcacggtaaacacggcaaacataacagcagctctctctttacaagccatcgtgatctctttgacgattttatcggctcagcttgcgatcgaagacgaggatacagcagacattgtctcagaacaccttttagccgtacacaggctgcaaagcaggagaagagtcatcatcaaagtcatcggcagccgcaatgtcaccattacgctttcctcgctggagatcctgctttccgtccaagttttaaccgaagtgctgatcgcgcttatcacagagcttgacatactttaa

SEQ ID NO: 3342 - DNA, 258 bp, Bacillus licheniformis
actttgaaaaactgacaaatgcgcttcttgaaaaaaatcatatgctgagctacgcacaagccagaacatgggttgaactgctgtggggcgatttcgaggcgacatttgcaaaggccggccacccgtacagaggaaaagagctgacagagcgagtcgtcaaagagtggattgagcactacggcagccagttgcatttatttcaaaatgacaagccttcttaccaggatctgttctccggagcccgcgggctgcttcatt

SEQ ID NO: 3343 - DNA, 214 bp, Bacillus licheniformis
ttgacagagcttttctccgtgccctatttcatagaaaattttaaaacccatattgaaatgcatccaaatgaggataaaatccacgcgatgaacagctactaccgttcagtcgtttcaacgcttgtgcaagaccagctgacaaaaaacgccgtcgttttaaaacggattcagcatttggatgaagcctacaacaaagtaaagcgtgaagaagcat

SEQ ID NO: 3344 - DNA, 236 bp, Bacillus licheniformis
ttgaattacgctgattatgacaaagctttgtactatacgcaccggtcgcagtgggacaacctgctgatcctgatggtgcggacagaagacgatttattatcaaagcggatcgaacattttttgcacgcctacaattttgaaagagatgacgccattgtcgaaaaaaggctttatgatctgctgcagtatattgatcacgcctcattttccggacatgaacacgaaaacggcgtgct

SEQ ID NO: 3345 - DNA, 570 bp, Bacillus licheniformis
cggaggcatgtggcttttacgcgtgcttgcttcatcatcacggccatgtgatcagcaaagacgtgctgatcgacctgttctggcaggatcatgatgtctctaaagcaagcactcagctatattcagcgatttatcaaatcaggaaattaatcgataggcttcctttcggtcaatccatcgagaagactgacacaggatatgtcctccggatttccggtgtgaaagtggatgctgacgaatgggaaaagtcgctgaaagaggctcctcccatccatatggcgacgatcaacaggcacatggaattgctgcttgcatacgaaaaccattactttatggaacacggttatttgtgggccgaacccgaaaagacgcggcttgcccggatctggcttggaaaagcttatgaactggtcgattttcttattcatgaaaaagactaccgccgggggcttgatatatgtctgctggtcgagaaaatcgaaccgtgcgatcataaaatcatccaatacaagatgcagctgtttaataaaaccgggaatgtagaagaagcgatcaaggaatatgagcgct

SEQ ID NO: 3346 - DNA, 430 bp, Bacillus licheniformis
atgaatcaatttcggatggccgttatcgctctcgtcctgatcctgatgaccggctgcggctccatagcggaagaacatgcggaaggcaaggaggccgttcccgataacgcccctgtttcagatgtgaaaagcgtgccttacgctgcatttgcattggaagtgaactatggccatggaaagcacaatacgtttgaagccgtatacgacaaacaggagcgggaagaagcatcgattaaagactatctgaacggagcggaccgcgaaggggaggaagctttaaacgaaatgaaaatggttttaagcgagctttcgatcgccaaatccgatccagagcaggacgtgatcagcaatgtgctcgaggccttcaatcttgacgaacaatatgaccggtttcagctgcgggtgaaatggcctgatggcacgtccagaa

SEQ ID NO: 3347 - DNA, 317 bp, Bacillus licheniformis
gtgctgaaaaatgtcatattatgttcttttttactgctttctagcattgggccgctcaatgcccatgcggcagcttacgaaacagcccgcatgtctaagtgggaagaaaaagcggttgaggaagcaaaaaagagatatccggaagcagaagtgcgcctcacgaaaaaagtatgggatcgaaagcgggccgatgaagcggtcaaacaataccatgtcacattgagtgaaggaaataaaaatttcggagtgtttgtcacaatttcatttgaacctgcgacacacaaaattaacaaagtcgtcgttgtggaagaatataa

SEQ ID NO: 3348 - DNA, 307 bp, Bacillus licheniformis
atgaacatacatatatcaagtttgctgcaaaagatggaggacgaattgaaaaaagcaaaggaatgccaccaggagaacgaattgaaaatgcacttcgcggtgatccgctccctttgcgacgtcattgtggaaccccaacaagggccgaccggccaggcttcgccttatgttcaaacggccaataaaccatcgagcgatcagctgatgctcgaaaaaatgatggggagcgccggtgctgaacaatacaaaaaacaagagaaacaaaagcatgaagatgacggcaacggagattctatttttgatttct

SEQ ID NO: 3349 - DNA, 349 bp, Bacillus licheniformis
gtgtttgattggcaacgcttttttccatttcagcagttttccaaggacggattaaaaaacgctgacccgaaagatgtggagcaatatatccaccacatgatgaaaagcgttttcggaccggggtatgcagttcaatttccttttcgtgaccctctctcaaaagaaacatcggcggcagatgaatctgatccgattgatatttttgaaacgacaagccatgtatttgttaaaataccgctcaccaaagaacagcttaaccttctgaaaattaaacatacttcacaaaccctgatcatagaaaactaccctgaaaaagggcggcaggaaaaagtcgttctcccctctctag

SEQ ID NO: 3350 - DNA, 630 bp, Bacillus licheniformis
atgtatttttcggcaaagaaaaaaataagaggctggaaaagactgaaacgaagaatagaatggtggaaatcagacaatattcaattgaatatggaatatttaagagatcatcatagagattacgttaaattatggatatcccccttttacgggcttcaaacagtgactcctccattatggtataaacgcttgcttttggaggcgatgatcgatgtctatcatgaatggcataagcaattgaaagctgaaaatgaagatttctacttgaaaatttggttgtatgagcctgattttatccgttcacaaattgtggctgcttataaagaagcgattgatttttacagtggttctttcgacaagcaagaagaaaaagaagcgttctctttgaaaatatacgaacctttagaacatgagctgaatgcatttgaatgggaacctcatattcataccgtgtattaccggctatctgatctggaggaggacctcgaactaggattgagaagcagcggcgatgtgctgcgcataaaagaaatgtcctattcaaaagataatgacggaaaagatgagtggtataaagtgagcgcaggaactgtatgggttggttcattaaaagaggtgccgcagaaataa

SEQ ID NO: 3351 - DNA, 229 bp, Bacillus licheniformis
ttgtgtttacaaaagccgtttttgcactgatatttccttttattcttgtcttgttttttacaagggtgacctataaccattacgtcggaattgcgctcactgcagcgctgttgttcgcttcatatttaaaaggttatacggaaaccttttttattgtaggacttgatatcgcctcgctcgtcgccggttcgctctatgcggcaaaaaaggcgggcgaaaagaaggaaga

SEQ ID NO: 3352 - DNA, 627 bp, Bacillus licheniformis
atgaagaacgtttggtcatccttactgtgcgcgcttctggctgcggctcttgtattcttctgcgcggattttgccaaagccggagaaaaaccgacaagagcatcgttatttgagacccttcaatccgtatcggacgtccattttcagctgaccgaaaaggaaagaacgaaaacagacatgatatccctcttggaaccttatatggagcacgccatggcagtgaagtatgtagaggcgaacgcctttcctgaacaagcggggtggattttttacgggacagacgcgcctgaagttgcaatccctttcttcagctatggcggagacacaaaagtggcggggaaagacggaagctataccgtatatgaatttgttggagatcaaaacgacggccctgtttcatatcaaaaaaattatcagacggtgacgctgaagaataccggcggcagcttcaaagtaacggatatcggccaatctgatacaaaaccggctggagaagaaataatgtccaaacaaccggatgaaaaagaaacaagctcgaattttgcggataaaggggaaggagaccaggctgcatttccgctttttgccaccgatgttaactggacattggccggaattttcagctag

SEQ ID NO: 3353 - DNA, 255 bp, Bacillus licheniformis
ttatacaattttaagcacgcttttaaccgtctattcttttgcgctcattatttacatttttatgtcttgggtgcctaatgcaagggaatcttcattcggccgggtgcttgcttcactttgcgagccttatctcgaaccgttcagaaggatcattcctccgctcgggatgattgatatttctccgattgtggcgattttcgtcctgaaattcgcagatgcagggcttcttgcggttttcagaatgctcggcgcttt

SEQ ID NO: 3354 - DNA, 396 bp, Bacillus licheniformis
aactagcttcctggaaccttcaaaaagcgatatacaacaggttatcgacggatgcggcgcttaatgaagtgataaagggcgtttttgacaatccgaataaagacacacctttcccgtatgtgtccatcggggaagacacgtcaacgccattcgaaaccaaagtgacatttggcgaaaacatcacaactgttatacatgcgtggagccgggcagaggacggcaggcgcgaggcaaaggaaatcctttctctcgtcatgcaggccctgacaaaagaacctttagaggtggaggggttcaaaccccttcaactcagttttttgcaatcacaagtgatcacggatattgacgggatcacacaacacggaattttgagaatccgaatttatatcaataatt

SEQ ID NO: 3355 - DNA, 624 bp, Bacillus licheniformis
atgctgggctcaagtgagacggttggaaaaaagtcaggtttatttggtaatgattctgtgtatccaaaggtgcaaacagaagtatataaaaaaatcaatgaactgagtggttttcataggctggatgatatttatctttccttgatcgacaagtatatgtttccttgtctgatcctgaatgaccggggagaaattgtcgcgtcctcggaaagtgctgatcaatatttgaaaagctcaaaaggcagcattcatcaggtttttcccgcgagcttatccgtacaggtcaatgccgcgttacagcgggcgaagaaagagaaaaaagaagtatcgtttaaaaacgtcccgatttatttaagcggagaactatcctttgttcaattgagattaaaatgtttcttccgccagtatcacaagctttatgtgctgtttatcgaaaaagcacaagaaggggcagccaacgcgccggtatccggcggagaggacggccagcttcatctgcaacatctgtaccggacggtaaaagagctcgaagcgtccaacgatgctttagtgtccgcaaatcaaaagctgcaggaggaaaacagaaaattgacggcgctcaacagggcgttgaaaagaaagtga

SEQ ID NO: 3356 - DNA, 624 bp, Bacillus licheniformis
atgccatggtgggggttcacagggcgaaggtcaagcttcagcaagaaatggaggggtatgatgaaggataaggaacgcagtatattcgaagatttgcttcctttataccatgaggggctgttaagcaaagagacggctgaatggattgaggaagcggccgaaaacgatgaggagcttcaaaagcttttgaagatgtcggaagacgagcttccgaaggaacatatcgagtcgtctgttcatgaagggcaaatgtttaaaagaatcaatcgaaagctctccttgtaccagctgatgtttatggcgatttcattttttctcgcgattcgcacatccctgttaaatgaaagcttcggctttattttgtggtacgccgtgcttgggtttgcggggtatctgtttttccgggatatgaaactcgtaatgctcctcacctatgctccgattttcgtttgggggatgggggatattctggccgaatgggacgcatccggcggaacaggggttgtggagcacctgcctgtatgccgtctttggcgctttcgtgctcgctgttattcactgttttttcgccgcggttgggatgatgatcggctggctgtcttacagctgaaggaaagaagttga

SEQ ID NO: 3357 - DNA, 194 bp, Bacillus licheniformis
atgcactgtaaaccgcatgtaatggcgccgattgttcatcctactcaatgctgctacaaccatacgcacagcaaaaccgtcgtaccgcacattcacccgcagcacacaacgaatgtcaaccatcagcattttcagcatgttcattactacccgcaaactcaatcagctgtcaacaaggcgtcacatcagcactt

SEQ ID NO: 3358 - DNA, 621 bp, Bacillus licheniformis
atgtattctcggtttattgtgcctgatcggatcagaggaaaaaacctccctcaagcaaaaatgtcgatggctgatgccgcatccatgctgctagttataggaattttcgtgaggtctgtgtttattgtctttgccggcgtgctgattgccaaactggtcatcggagagtataaaaacagaaccatcacggtcatgtttacatatccagtcagcagaaaaaaactaatggcagcaaaactgctgcttactggcggattgacctttttgacaatgatcgtgtccgaactgattcttgcatttattttctcgcagctcaatgatgtctatcaattcagcccggaaaaattgacgatgcatgacgtagggaatgagattggcagtatgctcatttatgctgcttcctctacaggactgagttttattccattatactttgggatgcgcaaacaatcagttcctgccaccattgtgacatcctgtatcttgaccacgttgatcggtcagcaaagcgatgaatttccacttgcttccatcatttacattccgatttcattggctctagtcggaattgccattgcgttttggtcgatacgaaaaattgaccaggaagacgtattataa

SEQ ID NO: 3359 - DNA, 618 bp, Bacillus licheniformis
atgcagaagttgctgactggtaaagtgagattgcctgggtttagtgacaaatgggaaaagaaaaaaatcggtgaactattagaagaaagcaaggtaattgcaaaaaatccgcaattagataaaaggattactgtgcgattaaatttaaaaggtgtttgtaaaagagaaatatctacggtggaaaaagagggagcaactacacaatatatcagaaaagaaggccaatttatttatgggaaacagaatcttcataagggggcatttggattgattccaaaagagttagatggattccagtcttcatctgacataccttgttttgattttaaagaaggtgtagatggtctctggttttattattatttttcaagagaaagcttctatactaatttagaaaatatctcaagtggtacaggttctaaacggatccaacctaaggaattatacaagttaacaattaaactcccgtcacttagagaacaacaaagacagtcaaaaattttagaatgtagtgataaagaaatttatttgttagagaaagaattagagacttatagaaaacaaaaacaaggtgttatgcaacttcttctaacagggaaagtccgagtgaaggtataa

SEQ ID NO: 3360 - DNA, 234 bp, Bacillus licheniformis
atgatttctaaagaaaaaatagccagaattaacgagcttgccaaaaaagcaaagagcggatctttaacagacgaagaaaaagcagaacagcagaagcttcgccaggaataccttcaaggcgtccgcgcgtctatgaaaaacacgttgaaaactgtgacgattgttgaccctgaaggtaatgatgtgactcctgaaaagctcaaacaggaaaaaagaaaccgccgattgcattaa

SEQ ID NO: 3361 - DNA, 618 bp, Bacillus licheniformis
atgttcgctgtatatatatcgctgtatcatgtcttttatttactggcgggcattttttgcttgattggagctgcagttcatacccgacatgcagaacatccgtttattgaccgttctttaataaagaatcgccgatatataggcgtcgttttggcaggatgtactgtattgggaagcgttgcgggcggagcccttacagatcgcttcggcagccggtttgtttttactcttggatggttattgatcttgtcaaccatggcagccgcgtcacaggtcggcgaccggacaccatggttgatgacgattatgctcgtgtttatatttggcggtctttcatttgtgaaaacggcaatttcaaacagtaccgcagaaagcttggaagaaaaggctgcaggcgctggaatggggatgctgaactttgcctgttttttatctgaaggaataggcgtcgcattagcaggaggcttgatggcagtgcacgggtttggctattctgcgcttccggcaatgaacgatgcctggagtgctgtattcagccgctcgtttgccatattcacagtttttgtattggctggcggattgctatatttattgacttgcaaacgcaaaaaatcttag

SEQ ID NO: 3362 - DNA, 216 bp, Bacillus licheniformis
gtccgaagacaacggaatcatctatgtcacatcggctcaggaccgagacggcttttcaagaatctatcagcttgatttctttgagagggagctgaaatggtttgacacgataaaagggcatgggttcagggtggccaaccaaaaggagaacttcttttgcgcaggtctttatgaatgcaaatttgtcaggccttatgaacagcctgctgcagccca

SEQ ID NO: 3363 - DNA, 617 bp, Bacillus licheniformis
atggcgcaacctatcggaaatatgattgttaaagtaggccttgatgatactggctttaatcgtggaatcgaaggtttaaagcggcaaatgcgtttagcgaattcggaaatgaaagcatccggtgcagtttataaagctgcgggcaatcagtctaagtttcttcaatcgcaaatagaaggactcaataataaataccgcatacaaggccgtttagttgatgagcatcgggcaaaatacaataagctggtcagagaaaaagggctggataatcgagaaacacagatacaaggccgtcggctgaatgatgcaattgccgttcatcaaagccttggaaatgaactgcaacgagtaacaaaacaatttgaaaataccacaaacagcacccggcgagcagcgagtgttttttctgtgtttaagcgcaattcaggagaagtatctaaagagttaaacgcggtgtatcaagcagcctcaaccgctggaaaggctctttctgctctcggtgcagcgggatcgtttgggattggaatgactgttaaagctgctgctgattttgaaaaagcgatgagccgtgtcggtgctttagcaaatgctacaaacgaccagatactactctcggg

SEQ ID NO: 3364 - DNA, 615 bp, Bacillus licheniformis
atggagtatagattaaacctggctaagtttagtatcttagaaacactcgagaaggcggcagttgaccgtgagttggtttacgttagagccggacaaaggtgtttaggaaagaccaccgcgcttattgagtttgctcgtaagcatgactgcgaaatcatggttcaccgcaacatgttgggctactacaaaacagagcatccagatgttaaggttagatctcatctaagcgagaagtgggttactccgagtgataggtttgtgtgcgatgaaggtgtacctcaggatgcaatcgacgaattgaaacgaggcggcaaccttatcaccggattcgtaagagtgaaggattcttttagggacggattgtatgaccaattaatacgtgagaatacaccgaacttactaacgatagaactcacggatgaacaatcgataccacgcgtcatatacaaaggcgaagaaattaccggtcgtattgcggtagacttcgagtggcgtactaaagacgcagaccaatgcggctctacttattaccgtatcaaacacactaaggatagcacaggcgctccggttgtagagacgaaggaacttgcggtaggcgaacgagcttatgaatag

SEQ ID NO: 3365 - DNA, 376 bp, Bacillus licheniformis
ttgcaatacgctcgtttttgggttagagcgggtgcatggttgatcgattgcgtattggcggtcgggttacacttttcatccgcatggatattcggcgacggatctcatgaagttgctgcagccgccctgctggtatacgttttgtatccgcttctgatgccgctgacaaagctccagggcacgattggaaaagcaatttttagaattcgtatcgtttctgatgatacgggccgacggattaagctttggcaggctttcgtgcgctacatcgtctcatgggtgcatatctttttcggtctgctgtatttaaccgtcgttttttcaggaacgaaacaagcggtccacgatttcgcggctagaacatatgtcatgaaaa

SEQ ID NO: 3366 - DNA, 280 bp, Bacillus licheniformis
atgaacgaattcatccaaaacatgacaggcatgggcgcgatgactgaacaagtcattgccaccgattttttaatctcggcaaaaaccggtgtcaaaaacattgccacagctatcacggaaacatcttctccagaagtgcgcgaaacgcttaagcagtatttaaacgacgcgattgacacccatgaacagatcacaaactatatgatttccaaagggtattaccatcctgcgaatttatctgaacaaattcagattgataccaaagctgccgaaacggcta

SEQ ID NO: 3367 - DNA, 237 bp, Bacillus licheniformis
caagacggaagagtttagaatactcggttatgacgatattgaaatagaggaattgtggtcatacttattgaataagaaatggaagaaccggaaggatgttcaaattcaccagctggccggtgatattttatctgtgaaaattggcgaatttatgaactatgcaaccgtagaatcgtttaaaacgtctaatttactcgacagcaaagaagggcaggatatgctcgatgagctgctgag

SEQ ID NO: 3368 - DNA, 612 bp, Bacillus licheniformis
atgaaggatgggcggttgttgaactcgaatttaaacgtctgtctaaattggtggcgatcagtcaatctatttttcaaaaagagggagatacaagcaatgagtaaaaaaagaaagcgtaaattccgtttttttcttgcctggcaagaccggaaggaagaggactggctgaatgaaatggccaaacaagggtggatgttaaagtcattctttttatttatctatacatttgaaaagacaaaaccaagcaatacagtatatcggctcgactataagacaacatcaaaccttgatcaagaagaatatattcatatttacgaagatgcaggctggaagcatgtgacacagtttttaaattggcattactttgcggctgatccgagtcaagttcaaacaaatgtgatttatacagaccgtgaatctgaagcggaaaaatataatggcttactaaaagtgttatatgctgcacttgccagtgtatttctcagctcgggacttccgattcttatcataggcatcccgggatatttttattggatagcagcattcaatctctttgttttgtgcctgttgatcgtgtgtatattaaaggttcgtagaaaaacaagaatttga

SEQ ID NO: 3369 - DNA, 407 bp, Bacillus licheniformis
atgaaaaccaatagagtaagtgtaatgatctggactttaatctccgcttttctgttttgttctatgatagtcgcagcttcactttctccgctcgctcattcaggccctcatgctaatgagtttggcactttggggatgtgggcggcaatcggaaccgttttgctcttttatatgctgcccctcgctgtttatatggccgggtttgatgcaatgaagtttgtaatggctgttctttgcggaattgggttaatcatcacgctgactatgagtccagtgtttgtgttgattggcgctattggcggaaatgcttctgcattactgggtgtcgcaggtctttgcgttctgttagcgattgtgaatgtgatttggctagtggttgcttttcgccggacgtcagcaagtgcctc

SEQ ID NO: 3370 - DNA, 251 bp, Bacillus licheniformis
atgacaaacgttcatgaagcgattacagcacattcaaaaaaacagcaccagcacatcaagcagttcgtgcgtctcgaacaggagagggaaaaagcaatcgatgatgtggtcgataagtgccggcgtaacgaagcattttcaaccgacctcatcaaccaaattacagtgcagatgaacgaattggccaaaaaaggcatcgttcccacaagacggctcgtctcgaaggaaatggttgccgaatacgtcagccg

SEQ ID NO: 3371 - DNA, 319 bp, Bacillus licheniformis
atgaacaaacaatggacgttaattgctgcacttatttttacattaattgttgctgttttcgcggtcattaatgttgaaccggtgaaggttgattttctttttggtacagcagaatggcctttgatcctggtgattttggtgtcggtattgatgggggcgcttatcatcggctcggccggcgctttccagatcatgcggctgaaaaaagagctcaaggcgctcaagaaagaagaacgggcaaagcatcctgaactcgaagccgaaccggcggcgcccgaaaaccagaaagactagaaagattgtacgaaataaattgaat

SEQ ID NO: 3372 - DNA, 442 bp, Bacillus licheniformis
atgctctccttctttcttttcactccgatcgcgaaggcggaggaaaccgataaagtcgatgtaaagccaaacgagtacgaaaagcaggatattaaaatcgagacggactaccttcaggaagaagaggcggaatacaaagaggaaatatcaattccagaagaactgaaggaattctcatttacagattcgaaaaaagaagatgctatcgaaaagctgaaaagcctgtccggaagcttcacgaatgaaagcaattccgtggcttcaaagctaaagcagcttgacctgtcattctcggcaaatccgtccttatcgggaagggaagatgactctgcggaaaaccggcaatccatcttcctgcccattctatacggtctgctgatccttctttgcatcgccggtctgttctttttgattccgaaagtcagcgggcagcagaaaaaat

SEQ ID NO: 3373 - DNA, 606 bp, Bacillus licheniformis
atgtttggtccaaattgtgaggttgtcattcatgatttgacaacccccgagtcttccgtcattttcacaatcaacaatcatgtaacaggaagagaggttggccaatcctttgaccatttggtgaaaaaagttcttttatccaatgaatttaaagaggattacttagctggatatgaaatccaagcagatgatgggagaacaataaaatcatcgactaccctcattagagatggccagcagcaggtgattggggctttttgcatcaattacgacatgaatgtaatgattcaaatgaaagaaatgttagatgcatttatgcctggtgttgaaaagaaaaatcaaatacaaacttcgaatacggcggagcaggaagcttcgattcagaatgtagaagagatcacgaaccagttaattgaacaaattgtagcgaaccgcaaacactctatgatgaaacgccgggaaaaaatcgagctgatcaggtttatggatgaaaaggggatattcctcatgaaaggtgcggttgataaagtggcagaacaattaggcatttcaaaggtaactgtctacagctatttagatgaagtaaaaaaaagacaatcggagtga

SEQ ID NO: 3374 - DNA, 606 bp, Bacillus licheniformis
atgccgttccgtctattgccggattggcttctcgaagctcagcggatctgtttatttgatgcatatggtcgctgtcctgtccgcagcctgtttgttctacggcacagcgaatggatgcggcgttcagcaggtgcaattgcaacaaacagaacggtgttgccgttgattttgctcggctgcaccgtttctgcttttgtgatgatctgcctgctgttttggagtgcggccatcggctggtttacattcggcggctacggtgcggagaatgttcatcctttttttgagctgtcgggttctcccctctggtttgttgtctcacgcctgttcattgactggtggtcgctttgctttctgatttttctcggcttggcgggagtgctgatcgcaaagaaagagcagcttgctctatggctgccgcttgcgtggtcctcgggtttaatgctccttttcaaattcaatatatcctttaaagggctgctcccgggggaaggcatgctgttgtccatccatgcagcaggagcttccccgattctggccgcatcagtcagcgaaggtgcagttttcgtattatggctgatttcatatgtggcgaccgccaaaaaatag

SEQ ID NO: 3375 - DNA, 404 bp, Bacillus licheniformis
atgtcaacaatattatggcttgtgagcttcacgctccacggtatattgatttatttcgtcatcattttgaatacgaggctcagcgctttcaaggcagcggagaaagagcaaaaacagcttttggaagaaaccgagaatacattgaccgcttttttgatggagttaaaagacgaaaatgaaaaactcgttcaagagattcgggcgaatgccgaaaaagagccgcaaagaccggaaacacagcctgaaattcccgctcaaacccccgtccttccggaagcggacgaatcgcgcgatctgccgcttcacatcgaagcgatgatcaatgaggtggagcaggaagaggatgagctcaatcaaaaggagcaggaagcatccatatcctatgaagaagaagctctcgcatt

SEQ ID NO: 3376 - DNA, 606 bp, Bacillus licheniformis
  misc_feature (1)...(606): n = A,T,C or G
atgaaacaaagcaatccacagaactggtatgtgtatttgcagcagcaggctgcgcaaatccagaagctcgaaagtcagattgccgtattgcattcggagttgaaccagctgaaagaaaatcccggnacccggatcgaccggatcgaatacaaatttgattcactaaaaattgaacgcttggacggaacgctaaatatcggactcaatcctgcggacccggataatgtcgaaaactttgaaatcagccaacagccgccgggtatcggaatgcttcagcaggagcttgacagccagctgatgcagcaaacgagacagcttgtcgatgcctatttaaacgaagagacccctcgtttgctggaacagcttgaagaccggtatgacagcaaactggacgatacaaaccgccaccacattatcgaagacatcagaaagcaaatcgacagccgtatccgctactacgtcaaacatgtaaagcctgacggaaacatccagccccgcgagcatgcagaacggctggccgactatgtcaaacgagatatcgcacgggcaatcgagcactttctcaaatcaatacctgacgaaatgaaaggaaatgaaaacgaatga

SEQ ID NO: 3377 - DNA, 237 bp, Bacillus licheniformis
atgccagttgaatttaacacgatgattgtgacaaaaggaaaagaaacgcgggttgaggaaaatgtgtttacactcgagaaagaaggttatcgggtttaccctcttcatgtgccgcttgaagtcagaaagaccaagcggggcgacattaccggcaccgcgcaggcggagcgccttgaatggtcagacggacggactcatttaacatacaggctcgtatcattaaattccacgaattaa

SEQ ID NO: 3378 - DNA, 603 bp, Bacillus licheniformis
atgttctcttttaaaaaaagccgattcttttggctgagaagcaatgttattctaatattgttaactgctctattgttgttgaataaaccttattgggaaaaaaacgccaatgttatgttttttatgtttgtttgcattgctgagctgtttatcattttacttgcattggtatatggttttcaaacaaaaaagacaattgcgcgccctccttcaagagctataagaaagaccaatatcccaataggtatatttgttttttctatttttagtttattttttggatttgcgatgtcaggggatataccgtatcccaattctgcgcttatcatatatttaacaattaacatggtgtttgcatttgtttctttgtttgtaccaacattaatcattaagctatatgaagtcaacgtatatgacgaatcaaatgggctgatcaccgacttttttcgatatgtagccattctggtttcctctttaaattacgaagtccaaatcgttttagcccgcctcccttttgtattacagcgtctactgggcgtcattttcatcgctgttttgctgtgggagcttactatgatcggattaatttttgaaaacaattga

SEQ ID NO: 3379 - DNA, 183 bp, Bacillus licheniformis
cggcattgctgcacgatatcggccattatgaatggtacaccgacggagaatgggattatgaaaaatacaagcaaaacgacattcacgcaataaagggagccgagcgcgcccacaagcttctcatccgcctcggcgaagatcggacagcggccaaagagattgctttggcgattctgcttcata

SEQ ID NO: 3380 - DNA, 603 bp, Bacillus licheniformis
  misc_feature (1)...(603): n = A,T,C or G
atgaaaaatttaaaaatggtgaccttggagacagacaanatatattatctttttttaaaaagtgatctttcaaaataccggattgttaaagaagaggaattaaattcaacaattgagtctgggaaactgaaggaatacttatccgtatttccaaatgtagcgaaggatggagcatatcgtaagttatttgataaatacatttttgatgaaaagaaaaacaaagttaggaaaatcaaaaacactgatattctgagcaaagacggtaagtatgtttatattaacggagcaaaagaaaaagaaacaaatgtaatgcctgatggtatccaacagatacaaacaatggataattatctaaaaggaaatgaaaaatatgaagctcaatttaagattgatttcaaacaaattgcaaaagagatggatttaaacgcgggtgatgcgaggatagctaatattcattattttaataaagattatgtagttttgtatatttcttatcatgggaagacaattggtacagcaggttctgttaatgtacttattgatttacaaaaaaacaaacaacagccaacggcttatttagttgatttaggaattgaatcatag

SEQ ID NO: 3381 - DNA, 251 bp, Bacillus licheniformis
gtggaccgatattataggttttgccaccaaaatattggcagagttgcgagaatcaccgacaaaggaggccgcgtccatgtcggaagaatcgtccgtgtttcaccaagcaaagtatatattgccccgatgatcagacggggaggccgcgggttcgcctacggatattacggcggctggtggggttggggccctgtatacggacttggcctcggtctaattgccggtgtggctcttgcaggcttgtttttttg

SEQ ID NO: 3382 - DNA, 222 bp, Bacillus licheniformis
atgccagctattgtcggagcttttaaagtaaatgccgtcggtacgagcggcgttgttcatgtcggagactgcatcacgatttctccttatgcagaagttaaaacatttgcgggtgccggcagcttcaataccggagacggactcagagtatacaaccagaacagcatcaccaacacatatgacaacgatgtaatcgatcagccggtcgcaggcaacctgtag

SEQ ID NO: 3383 - DNA, 252 bp, Bacillus licheniformis
  misc_feature (1)...(252): n = A,T,C or G
ccatatgccagtcgtggaaaacggaggcttccagcaaatgacggaaagcagcaagctggaaaggctgacgcttttggaaaaagatttggaagatgtgtttgatcaagtagaagaagatgatgcagacccttccntgctatgggtcatcctgacgacgggaagcattatcctctcgacgctgacatacgtcggtttcagaaagtataaagccgaagaggacaggcgcagaaaaagagaaaaagattggccgaa

SEQ ID NO: 3384 - DNA, 597 bp, Bacillus licheniformis
atgaaggtacatacagggcttgccggcatcatcatgattgttatcggcctgttgatcagcgccgagaatcatcaaggcgcgtctgtagcagacgcgctttcgggctttttaaaactgcccatccggaatttagtggttctgatctgcatgtttatgatcatcgccggcttcattatggcgtggcgccattattatggagtaccgtggatccgctttaagctgtttttgtttatcatcggtatttcagtattttacccgctggtcacagaacagctgatgttctttcaaaaatggaatgcacaaggcgatagcgccgtggaatatatgaaaaggggaagcgcttgcagctatcagggcgatatggaagcaggaagcatggactgtgaggtgaaagtcaacaactacgggaaaaagaccgcacgcgtccagctcacccctgatataataaatgaatttgactttcagccggaagagctggaactgtcgccgcattcacaggaaacgtacagcgtcacctttacggctccgggaaatgaggatgcatttgcatccggaattgaagaagagccgaggttgaagattaaagtggtgaaatga

SEQ ID NO: 3385 - DNA, 597 bp, Bacillus licheniformis
atgctttgcccggaggacactgaattggcgctgcaattggctgaatccggcagagaaagggggctttccgtcattcctgtcaatgatccagcttactgctgggattacgggacggtcgttccgctgcgctacctcgttccaaagggagatattccggttatcgatttatcggttacattggccgcgaacctggaagaaacgcatttgtggggccggcttgccggaagagtgctgaaagaaagcagaaagaaaaccgtgttcatcagcagcggggcgctaagccatcatttggtgagggggccggaatgtatgccgacattggccgaacaggccctcgatgcacaatttttgacctacttaacagacaacgatcttttatcagctcagcagatgctgcctcaatatgctaaaaacgccgggcttgaagccggcggccgccacattgcaatgctattgggcgtgctggaggacggatgtaaaagcacgttttacggatacggtcagtcttccgggagctccaatgtcgtcatggcattcgagccggcgggacaaaaagctcgcacgcacgctttcaatgaaaaagataccgtgcgttaa

SEQ ID NO: 3386 - DNA, 237 bp, Bacillus licheniformis
aaatgtcgaacgttgaaacgcaaagaaactttttaacagctgaagaatttcctgaaggtgcgtatggagctgcacagggcaaagacgagcccgttgagaacaaaagcacgccatggaaggaaggccagcaatactacagcaatttcgcatacgaattccgcaatcttcatcaaggaacgccgcgtcaatatcccggagcgcatccaacccatgacgaagaggatcaaaacgaggaat

SEQ ID NO: 3387 - DNA, 597 bp, Bacillus licheniformis
atgcattatttagcggaacaccaaacgttcgcttcgacggccgaactcaacgcggcagtctacgaacacatcaagcgcaatacatacgaattaaatgacacggaccggctgacgctgaagacgattgctcgttacgcagtcaaattcgccggcgcagcgcatctcaaagcggagacactcgcggacctgatcggaaagtccgtcaagacagcgcgtcgtgccgtcaacaaactcgcatcactttcgatcatccagaaggtcgcgacaacacggaaaataaacggcggccacggcgccaatatcatcgtcattcttccggtcggaagcagagtcgaggacatgcaattgtccgaagatgaccagtcgacaatgaccacgcgtggggatgccgaaaagccatcagagccaacggatgaatcgcctaaaactacgaatgaaccatcggattctataaatctttcaaaaaatcacgtaatagatacggtgccggcctgcggtcttaaaaatgcgttaccaagcgaaatctactccgcaatggcgcgctacttcgaagcagacgaaatttataaatactacaggaatcttatggcgggctaa

SEQ ID NO: 3388 - DNA, 381 bp, Bacillus licheniformis
atggaaatcgtgtggaatcagaacggctttgaggctgatctggaatatgggaagcttaaaatatcaagcaatgaagaagcgggattcaggccttatcaattgctggccgcttcgattgcggcatgcagcggaaccgttcttcgtaaaattttggaaaagaaaaggatacagctgaaagatatgatcatcgaaacaaaagaagaacgcatttccgaagaggctggccgcatcaaaagcatccatcttcacttcatattgaagggagaaaacctcggtgcagaacaaatcaaaaaggcgctgagaatagcgctgaaaaactgcgccatggtgaggtctgttgaaaacagtattgacatcatcgaaacatttgagattcgctga

SEQ ID NO: 3389 - DNA, 421 bp, Bacillus licheniformis
atggataaagaatacataaccgaactgatctcatccaaattaagattaatccgggcggaaagcggctatacgcaggagaaaatggcgaacgtgctcgggatgtcgaagaaaacgctcgtgcaaatcgaaaagggcaggtcggctgcgggctgggcgcatgttgtcgcggtatgcgcgctttttcggaacagtgaagtgctgcaggccgtcctcggggatgagccccttgaggtggtggagactgttgctcaccgaagcatcgacagaccaaaagggaagacgcttggcggaaaggtgtggtggcgggacattgagaaaaaaggagagtttcgccttcagcaaaacttgatttctcaccattaccgcatcttggattcgtatgacgacctatggttcagcacgtttgaaaagcaggatgcag

SEQ ID NO: 3390 - DNA, 350 bp, Bacillus licheniformis
tgaccaaggaaaaaattcagtccctgcttcattcttatatgaaacaagcaactcaacagcctaaagcttctgcaccgaaggcttctgctcctaaagcttcaaagcctgcggcttcaaaagagcagacttcacagcaaaagcaaaatacagcgcctgcatcttcttctgtgagcgcgtatgaaaaagaagttgttgaactgacgaatggagaaagaaagaaacaagggctaaaacctcttacattggatgaaaagctgagcaaggttgcccgcacgagatctcaagatatgaaagataacaactatgttgatcacaacagcccgacttacggtgctccatttgacatgatg

SEQ ID NO: 3391 - DNA, 591 bp, Bacillus licheniformis
atgcccctgcggactaagcaaatgaggaggattttcatgaaaacacaactcaaagtgatcgagggtactcgaaagccagaccactactcaatctaccacaggatgtttcaaaaagcggtaattgagagtgcgagaaaaatacaaagaactaatcaaattgacacagacgatttcaagaaaatcgcgtttgctggaatcaagatgatcaacctggagaaggctagatcacgccgtttcctagaagtaaagctgcgtttaattgagttcattcaaaccgtaataggaaagcttacacccggagaattgatgcagatgttccccatccgtaagcagtatgatggtgaaaagtttggaatgaaagactatttcagtaccatgcatgctgtcaaagaaaaaggaatagacaattgcataggaacggaagaagaggtattcgatttcctttgggattatcagaatccggatatcactttattcatggttaccttagtatcgacagttagtgatttaggaagagcctcaggacaaaaaagtctgtttgaagaattcgctgataaaaacgacattgctatagatgttatgacccattga

SEQ ID NO: 3392 - DNA, 548 bp, Bacillus licheniformis
ttgttatctttaggaaatattttaacaatagaatttgaaaacgaaattcaagagtatgtcctcgcgaaaagcaaagtgctatccattgaggacaatgttttaagagtacattatcctgttgatgaagaaacagggagaactgttattattccaacaaatacagtagcaatagttcactttataaatgagcaacaagtcccatataaatttaccagtgtaatacagggacgagagatctatcaggatatacctgtattaaatatgtatttacccgaagaagatcaaatgacaaaaattcaaagacggcaattttttagagtaaatacaacgattcctgtcactgtccgcccatatggatctggttcaatgtttaaaacatatacagcaaatatcagtgctggaggcgctgcgttaattattgaagagacgcaaatacacgaagcggaagaggatttaaatttaagcattcatctgccaaatgagggacatgatgaaaatgtgattgacgtttatgctcaagtcaaacgcacttacatagatcggagaac

SEQ ID NO: 3393 - DNA, 444 bp, Bacillus licheniformis
tgaactgaaaagcgttcagcaaactgcgagaacttctttaaatgaagtcagaaaaatcgtatcctccatgaaaggcatccggctcaaggatgaaatcataaacatcaaacaaattcttgaagcagccggcattgcgttcatctatgaagaagataaattgccggaaaatatctcattgcttaatgaaaacatattgagcatgtgcttgaaggaagctgtcactaatgtcgtcaaacacagccaggctaagacctgccgcgttgacatccagcagctctggaaggaggttgtcattacagtgactgacgatggaacgtttcaaggtgaagagaagtgcttttcaaaaggacacggcttgcttggcatgagagaacggcttgaatttgcaaacggaagcctacacattgatacaaaaaacggcaccaagcttaccatgtcaattcc

SEQ ID NO: 3394 - DNA, 483 bp, Bacillus licheniformis
  misc_feature (1)...(483): n = A,T,C or G
cttgactggtttcatggccccggcgttaagctggatttcagacatctgaaagacgggcatatcgtaacccnctgaagaaatcgaacaagaacttcaccgcatcaatcataaactcgcgcccggggatattgttcttgtgaatacgtcggccggtgccaaatacgggcaaagcgattacctggacagcggctgcgggatggggcgcgaagcaacgctttttttaacggaacggggcgtgcgccttgtcggaactgacgcttggagctgggacgctccattcagcatgaccgccaagcgctttgaacaggaaaaagacccgtcgattatttgggaaggtcattattcaggaagcaccattccttactgccaaattgaaaagctcgccaacctggatcaattgccttccaccggattttatgtcatggcttttcccgtaaaagttgaaaaagcgtcggccggctgggcgcgtccggttgcaattct

SEQ ID NO: 3395 - DNA, 589 bp, Bacillus licheniformis
atgtttaaaactaagttcaagaaaacaattgggattggactcgttgccgctgcctgtttgatttccgcgtcggcggcaagcgctgcgtcgcaaaatgaaagcgatgttaaagtgaaactggacgatcagcagcggaatcaatatacggtcaaatctttccactacttaaccgttgacggaaaaaatgtggattcgtcggctcaagccaacgccaaatccgtcagagatgtcaaagtaaccatggttctgcccaagcagaataagaacggcgatttgcttgcgtatggatttacgagcaaggttactttagaagcctttatcgcgaaagacaagcagaggcttgagaagcaattcaaaccttctgccagcggtccctgctgtaccgatttctatgaatataaaaataaaggcgggcagtatatttactggagagacggatttaaaaacttgccatccagctggaatgacagaatttcatcgttaagtacggcgtctccttcatcaagctattcaacgacgctgtgggagcatacttcaactcaaggatacggcaaaggcgttttgtttagacattccgattggtacggca

SEQ ID NO: 3396 - DNA, 171 bp, Bacillus licheniformis
ctgtctcatcatggaaggcgctgaatttacggaaaacattattaatggcgtcgagcgtccggttaaagccgctgaattgttcgcgtttaccttgcgtgtacgcgcaggaaacactgacgttcttactgacgcagaagaaaacgtgcgtcaaaaattacgtgcagaaggagt

SEQ ID NO: 3397 - DNA, 336 bp, Bacillus licheniformis
gggtgatcgatttgcgaattgtaaaggcagcaactgaagaacaagaaatttatatcgaagagcttgtatcagagctgtatcaaatatttccattgtacttgaataaacaaaaaataaaagaactcaaaaagcagggcgcgcttcaattgaaagaggatgaatacaaaggaacgctcgatgaagcgtttcagattatgacaagcctgcaattgatccatgcattattaactaaggcgaagcgcaagtgggtgctcaaagaccgtgatctgttcgataaaaatagccgcaagctgaatgactgcggtctgtacttccctctaacatctgccgactttc

SEQ ID NO: 3398 - DNA, 588 bp, Bacillus licheniformis
atgacagcggaacagccattttattcagcggacggctccgcaaaaaaacaccccatgatgacgcagacaaaccgctttccttatctggaaaacgaacattttcaagccgtcaagctgccatttcaagacgaaggcctgtcactagccgtttttctgccgaaaaaagcggcaaatctagaacagcttctgactggcatgacgcatgatcaatggcgcgccttgcaaaagggctggacgatgaaacaggtggagctcaagctgccgcgcttctcatttcaaacagactacatgttaaatgaaccgcttaaacgccttggaatgaaaaacgtgtttagcagcgcgaatttttcaaatatgtttaccgggcatggcgccgctcaaattaataaagtcagacataaaacatttatcaaagtggatgaagcgggcactgaagcatccgcggcaacggcggttgaaatcatcgaatcagcccccgtccctgaagtgaccatgactgcagaccacccgttttattttgcgatcgttgatgaagcatccggaatgattctctttttgggcagtgtggcagagccgaaagatgattaa

SEQ ID NO: 3399 - DNA, 273 bp, Bacillus licheniformis
atgaccatgaagcaaaagaatctgatctcaggtctcgccgttgtcgccggagtcaccgcatatatgctcaaagacgaaacaaacagacaaaaactgaaatcgtacttgcaaaacgtcaaagaaaagatcccttacttttcggaaaaacacaacgtagattcattcccggttgaaaaagcaggacacccgtctccgcatgatatcgaagataacaaaatggtatcggaaggatccatgtaccctgttcaatactacgacgaaaagaaaaaatag

SEQ ID NO: 3400 - DNA, 327 bp, Bacillus licheniformis
atgacgagaaacaacgcgctgatttcttcaatttgttattttagtgttttttttgccccgcttattttgccaatcgcagcgtattttataacagatgatcaagaaacgaaaaagcatgcgatgcgttcgcttatttcgcatattattccgtttataagcgtagtcatattggcagcaggcgcgataagcggtacgcttatctttggtgacggcggttatttggcggtcattttcatgatcggaggtttcgtttttttcgggatcatcagtttgattattgtggtctggaacgtagttcaagggattaaaatgctgactcaggcctaa

SEQ ID NO: 3401 - DNA, 324 bp, Bacillus licheniformis
tcgaacaaatagtgaaagcattgtataaatcctggtcttcagattcaagttcaaaatggagtaaggataaccctgccaagggacaatgcggtgtaaccgcgctagtcgtaaatgatatattaggtggagaaataaagaaaacaaagctgcctgaagggtggcatttttataattttgtcaatggtaaaagatatgatttaacggtttctcaattcaaagaagacatcctgtatatggatattccctcaaatagagacgaggcattctcagataccagcgaaaaacagtgtaattatttaaagcatagcatgatcaatcatttgc

SEQ ID NO: 3402 - DNA, 585 bp, Bacillus licheniformis
atggcctgttttatcgtgttggtgctggatattctctgcatattacctgtgctggcgagcaaagtcgaatttttcacttttgccgtcctccctgtcgctattctgatcaatgtttggatgatcctcataaataccagaaacatgaccgaatatcttcatcaccttcaatatgttcggtttatgggcgtatctttcagcggtatgtcatattgccagctgatcacggcgcaaaaaatgatgttttctgccatcggttttcatttaccgttgatcagtctgtcactattcatatatgccgcctctatcttcctcgtcattcggtattacttggctgtattccctgatcctaaaagaggcaaaagggagacagcagctccgacagggatgcttttggcggctgttccggcggccggttatatgataagtcatgctgttttgcgagtttcagagtctgccgtctatttgttgatgagtatcgtctatctgcttatggcttgtttattttctataatgggggtcaaattcatccacaaatacttcttcatcaaagcgaatcaagatatcatcagacagcataggatttaa

SEQ ID NO: 3403 - DNA, 301 bp, Bacillus licheniformis
gtgagaattgtaataggcggacagttgaaaaaacaagcgattgaaaaacttgttaaagaaattgggggaaataatgtagaagtattggtcaaaggtgatttggacgctgttatggctgtgaaaaacaataaggcagattattatattggcgcctgtgaaaccggatctggcggtgctcttgcaatggcaattgcattattaggtaaagataaatgcgtcaccttggcttctgcaagtaccataaaaaacaaggaacacatcgacaacgaagttcaaagcggtagaattgctttatggtttc

SEQ ID NO: 3404 - DNA, 178 bp, Bacillus licheniformis
atgggacagcagcgtcaattccggccgggccaaaaagcgcccaataatggagtgtatgtggaaatcggcgaaacgggaagcatggttcacaaccctcagcaaatcaaattgagcgccggcgagttcttccctgaaacctccaatcataaccggctctggacatataaaagaaagcctt

SEQ ID NO: 3405 - DNA, 585 bp, Bacillus licheniformis
atgccaaaaatagttgatcacgaaaaacaaaaagaaaaaattgccgaagcggtgtggaatgtgattcacagagatggacttgaacaatgcaccgtcagaaatgtcgctaaggaagccggactttcggccgggtcgatgcgccattattttcctcatcagtctgagcttttcatttattcaatgaggcttgtggcaaaccgggtcaaaacgcgtatcgaaaacatgacatttaacggtacaccggctgaaaacgtcaaacagcttctttttcagcttatgcctcttgatgaagagcgaaaactggaaatggaggcatggtatgcatttacagccaaatcgctcagcgatccggagctcaaaccgttgagaaaggagatgaatgaaggcatttattcagcctgcaaatcggctgttgaaatactggtaaaaaccgaaaaaaagaccgggatcgatgttcttaaggaaaccgagcatctatacgcccttgtcgacgggctggcgcttcatttgatcatggcccctgaaaggctgacggctgaaaggatcgatactgtattggcgggttatttaagatcgttggaatag

SEQ ID NO: 3406 - DNA, 582 bp, Bacillus licheniformis
atggcaaaaggcgtacgcgtaggtttaaaaaatatacactttgcgaaaattctaacggaagatgagaacggagttacttacgatactccggttaaaatcggaaatgcgatcgaagcaagtatcacaccgaacacaaacagcgaaactctatatgctgatgacggcccttcagaagttgaatcttcgttgggagaaacggaagttgaaatcggtatcgatcaattatcaactactgcacaggcgttgttgctcggtcacactattcttagcgatggtgtactagagaagaaagaaacggatatcgcaccgtacggagcgttgctttttgagtcagctactactggagggaaatctaaactttacgcgctatataaagggagattccagccgcaagaggagtcttttgcaactaaaggagatagcccagaattccaaacagactcaatttctggcgtatttgtacgtcgcgatcacgacaaggtttggcaacgtagcgtatttacgggagatgagggcgtgaaagcagaggttattgaaaactggtttaagaaagtttacgaaccaacaacttctactccctga

SEQ ID NO: 3407 - DNA, 327 bp, Bacillus licheniformis
tttagcatttctgttgggctttttagtcatgtatttagaggtcatatcattatccgcagtatcaaaaagcatggacaaactgcctggtgtaagggagatgggagagcatatccgcacttcgctgtcagatgttctaggaatggctatattaattggcagtgcgatggcaggggaaaaaattgctcctggcattggcttcttctgggttattggattttatttaataaaccgaatagcatcaaaaccgcttgttgaattggctgtcggcccaattgcagttatattgttggggattgtcgctaatcttctctatgcagtcggtttatg

SEQ ID NO: 3408 - DNA, 195 bp, Bacillus licheniformis
ttgccggcgctggttctgccgttccggttacagggtttgccaacagtatgacgagcgcagcgctggagcataaaagcgaaggctacgtcctcggcgtatggacaaacatgttcaagcttgcgggaaacgtcatcgtgttcggtgttgtggccgcttatattgtggggatgatccgctttgcctttgacaagctgt

SEQ ID NO: 3409 - DNA, 321 bp, Bacillus licheniformis
cgaaaaaccgggcgagactacaggcggattcgagaaaagaaagcagcccacttctactccctgaggcgccccaaaatctacagtatacagctacaactaatagcgtgaccgtggattggaaggctgtagatggggcgacttcatacaaggtatacaggggatcggaaaaagtattctacaaagaagtgacagaaccaaaatgcacgctcacagacattacgccggatactaagctcacagtgaatgtgacggccgttaacgaggtgggagaatcgcctatgagtcagatagaaacacgtacagagccagaaacaagtggct

SEQ ID NO: 3410 - DNA, 582 bp, Bacillus licheniformis
  misc_feature (1)...(582): n = A,T,C or G
atgtctccttccttcggtctcccgttcctggggccggcgtcgtctctctcactctcctacggcgcgtgtctcctgtctccccggcttcgtcggctcgctctccgtttggccgatttgtgtttctctctcacttcttccctgtcgccctccctccgcccccctcccccctctcgagtttttccctccgtacgcccttcttcctctcctcatcctctaccccttctcatctcctacgttcgccctctcctccgtactctctttattctcccttcgctccccgccttttctctagttcgtcactttctgttgttgttcgctccttctctagtgcggtcttcgtcgngtccggctttgcgtcggcttcggcggcctagcagaccgctgtgtgcacgatgcgggactcgatatgtgacgcgcggatcgattcaccccccccccgccgacctccgcctcgacagacccgtcgcaccatccgcgcctcttttcgcgcgccggcacgcctcgctccttaccactccctctctcccctcctcgtcccccaccgctgttcttttctctccgtctactgctcccgcctcttaa

SEQ ID NO: 3411 - DNA, 579 bp, Bacillus licheniformis
atgtcgactctagaggatcccgctaatacactaatctttcaaaatccggatacatattggataaataaatcgaatttctctttcgacgaaaacagcaacgttcaaaatatagagggcgatgaactcgtttatgacaaaaatttaaaagcgatgctcccaccggaagttgcctccggaagtggcgcaattaaagtaacacccgaagttgccaagcagctcgcgcaaaaagtaaatgcgatcatcgatgacttgcggacgatgaaacgggaagccgaaaacgcttatcaggaacacgacgccgagatcaacgacctgaagcacgatacctaccgtcaggtcggccacggtttatacgacaagctgacactcgaggatgtaaacaatacgctgaaaaacctggcgcagtcgtttgacaaaaaaggcaatccgctattttacgatgttcatgccgaaaaagcgtacatcgcctcattaaaaaatacgatttcagatttagaagacatcagcgggtacctggcgcagattgcaaaagattttaaatcgaaagataaaatgctggcaaattggcttaaactttag

SEQ ID NO: 3412 - DNA, 756 bp, Bacillus licheniformis
atttttcagtataatattggcttcgttcataactgcaattctttctggtcaagcagattcgatattccctttcatttccggcatctccattataatattagctgtcatatttacggggtgtttattctgggtgcttagacagcttgtcatcctgaaaaaaaagccgattcaattcattacacacttttccaagaaagccgagtttgcacgtatcgtaaaaatgattgattatgttttacaacaaaaatacaaaaaggcattaaaaaatataccgaaccaataaaatctcatgttttttatgaataggagtgacaatccaatgagaaacgaaaaacaattatttcaaaaagctgaacatacagccaaacttcttgagtctcacaaaagtgacgaagagctgcttacataccttgcaaatcaagaatctgttacattaaatcagctaaaaatctatttttcaaatccaagttttacattaacgtatttgattaaagggattttttttagcagtatgactgctgtcattatggcggcctttttatctggtcagatctcctccctcaaccatggtctttcaaggctattttcattcttcttcatgttctatctgatcttctcttttctttggatcgtcaagatgctgatctcctcgcgaaaaggaccgatgcaaacaatcctgcacttccaaaaaagagcggaatattccagaatcacgggtatgattgatttcattttagatgaacgctttaaaaagga

SEQ ID NO: 3413 - DNA, 579 bp, Bacillus licheniformis
atgggaacggaaatgccagctgaattttatgatcaatttattgaccgacatctgattccgtttgaaaaaagcccgtggagaaaggtgtatgaagaagctgcacgtttattgccggagtccaaagatgaaacgattgtcgatatcggctgcggcactgggagattcgcaaagcttttatatgacaaaggatacagaaaatatttaggcatcgatttttccaaaggaatgcttgaagaagccaaaaggtataatccctcgtttactttcatcgaaggaaatgtatatgacgaggcgatcgtccggatgctgcaaaaatatcatgtttttgttttgctggaagtgttagagcatatagagaaagacaaagcgtttttatcgagtcttcctcaagggagcgacatggtgatttctgtgcctaactatgattcacgcgcccacgtccgccacttcaaacatattgacgaagtcatcgaaagatacgacggcattttggattttcagggcaccgaaaaagttgtcattaaaacatctgaacggctgaagaatgaaatttacgtgctgaattgtaaaaaaaggtaa

SEQ ID NO: 3414 - DNA, 213 bp, Bacillus licheniformis
atggctcaaaacaacagacaaagcagttctaaccaactattggttcctggtgctgctcaagctatcgaccaaatgaaattcgaaatcgcttctgaatttggcgttaaccttggagcagaaactacttctcgtgcaaacggttcagttggaggagaaatcactaagcgtttagtttctttcgctcaacagcaaatgggtggaacacaacaataa

SEQ ID NO: 3415 - DNA, 306 bp, Bacillus licheniformis
gccgcaggaattgctgcgtcaggatatccttgaagctgaagcggaagccgagcagataacggggcaccgttttacagatgaaaaatatgatccgctgccggaaaaggcaaggctcgctttgctgcagctggcacagtactttgcattgaaaaacggtgatgaatcgcttttgaaaggctacaaatctgagaaattgggagactactcctatacgctttcaagaagcggaggcctagtgaagcccgacgtctataaactgctcgaagaatttattcttgattatgaatctgttcgattcaaggtgcg

SEQ ID NO: 3416 - DNA, 576 bp, Bacillus licheniformis
atgaacgatattgagatcagaaggccgcgaattgacgacgttgaagagctgaatcagtttttcagaattgtggtcgaggataccttcgctaaagagggaatagccgatctgctcgatgataaagaaagtgaaattgaaagtaagaggcaatacttgaaagcagatttagacagcaaggggaatagccggcacttttttatcgcttcagatcaacgtctgaataaaatcatcggtactatcgaatatggccctgcaagcgaattgatcagcatttgtacggatggagctttaaaggatttatatgaggtaggaacggtatttgtccacccggattatcaaagacgcggaatcgggactttgctgttgaacgtcatgtttttgacttttttgaatcagggagtaaatgaattttgtttggacagcggctatcccggtgcccagagaatatggaagaagaaattcggcgagcctgactatgtgctgaaagattattgggggaagggatacgatcatatgatttggaggagacggacgaaggatatgccgattgatacaagaacatcagtcatgccgtag

SEQ ID NO: 3417 - DNA, 249 bp, Bacillus licheniformis
atggacacaacattgggctacctccgtgagtcactgtcgaatcaccttgaacacggcataggacaaaacatttacagaaaaatcgtttccgggcgatatgccaatgaggaagagtttgtcgagcacttggaggagcgggaaatggaatttctgaatcaagtgcttgaacatgagatgaaatatgcgctgaatgaacaggaccataaacggacaagagaattaaacgaagtgtatgaactgctgttttga

SEQ ID NO: 3418 - DNA, 305 bp, Bacillus licheniformis
atgctatccttacaaaacacagccgctgtgattacaggagggggaagaggaatcgtccgcgccacagcgattgccctcgcaaaagaaggcgcacatatcggccttatcggccgtacagctgtgaatcttgaaaaaccggcagaggaattgaaggcgttcggtgtaaaagtatctgtatccgcagctcacgtaaaggatttaacagctgtagaacgtgcagtccaatcagtcaaagaagagcttggccaaactgatattctcattaacaatgtcttgagcaatctcccgaagaatgggaaaatatt

SEQ ID NO: 3419 - DNA, 573 bp, Bacillus licheniformis
  misc_feature (1)...(573): n = A,T,C or G
atgattcatcagacagctggagactacgcgatttttgcgtggctgttgatgctgggaatcggttttttatttgcctgggtttttgccagattaagcgtcgagtatccgaatgatgccgggattgcttatgcggctgaaaaagcgttcgggtcgcgtgttaaaaagttggcagtcttttattttatcatggctgcgagcttcggccccgccgccgtattaatgacggccggcgaatatattcattctcttgcggcaggcacggcattccctgctgaactgtacggctttgtttttttcatcttttgtatggttatcctttgctttaatctttcatttgtcggcatggttgcactcattttttccactgccgcggcgcttatcctgtttggaagcagcgcggcttccgtgccttacttccgtgaggggcctctcgtagacggaacatttcagtttaccgattttggccgcggattgctgctcctgttctgggcattggtcggatgggaaatcgtcggcaactaccagcatggaagtgaaaaaccgcgggaaaacgattccacgggnctgtcgtga

SEQ ID NO: 3420 - DNA, 332 bp, Bacillus licheniformis
atggatcctgaacagccctttttcccaaactttatcagctgttattttattgcgcttggagtgcttctcggcggttgtttaatcggggggatcggcgcctatctgtcggggcagccgcctttaacgatcattacaagtctcgcaaaccgcctgaaaatctgggcgctggttgcggcaatcggcggcacgtttgatgcggtctacagctttgaaaggggcattatcgaaggcaatacgagagacatcgtaaaacagcttctcctgattctttcggcgatgggaggagcgcagaccggttatctgatcatcaactggctcacacaggagcatat

SEQ ID NO: 3421 - DNA, 570 bp, Bacillus licheniformis
atggatatcaacggcttaatcaacgaattacatttgatgcagcaaagctatgcgacattgttttcggttgtcaataaggtgcaaacccgcggtgacgaatatatggaaatattaactgccaggcaacacatggcgctcatcgctatcgcgcatttgccgcctgaaactgccacgcttacgaatatctccaaaaagcttggcacaaccaaacagaccgccaacaagctgatgactggtctggtcaaaaaaggctatgtcaaatcagtgccaagccaaaaagacaaacgctccattaatattgaaatgaccgctgaaggaaagaaagcgctggtggagtgttccgaaaggtccgtctatttcctggccgacttgtttcagcaatttacatccgaagaggttgcgacattttggcggctgttgcaaaagctttaccgttttgacggtgaggaacatgacggttttgaggagaatgcaaacattcagcttggcgtggggaattcgttagatacagaaaggattctcggagaatttgagaaacgccgctatggaggagaaaacgatgaaaagtga

SEQ ID NO: 3422 - DNA, 570 bp, Bacillus licheniformis
atgtatccaacaaaaacacaccccatacacacaaacttcgcgcgacacatatccgtatataggccttccgtccttatccacccaagcacccacgtccacacacaaccccccagcgatcccacacccgcccgtcccacacaccccccccccccctttcccccccacccacaagcccgccacccacccgcccgccccccaggccgccagcctccttatctcccaccccaccctcgccctctcatttccccgctctctccccccagtccgcttatccaccaccttttccaatctccaaagcatggggcccgctctctaaatcgcttcatcatcagtccacaaccgatccgggcttctgctttcccacacgtttcgaatggcaatcgtcggtctccactttgcacagtatgcaagctttcttttatcagagtgcaatacatatatgactggacaaacgctgctgatcgacggcggaatggtaaaagcaatttaagggggatgagaccatgcaaaaaaacggtcggatttatcgcactcggtgtaatgggaaacagcatggcctcgcacttttag

SEQ ID NO: 3423 - DNA, 298 bp, Bacillus licheniformis
atggacgtccagactatcaaaacaatgcttgggataactacagataggcacgatgcctatttgaaagaggttatccctctttttattgatttcgcaaaggattactgcaataacaggtttcttgttgacggcgcggaaaatctgccggcgggcgtaaagctgtttgtcgcaaaggcgatcgagtttaatatggcgccatcgaatttgagtgcccgcagcatgggggatgtttcttactcctatgaaacggagctgccggaatccgtcttgaggcatctgaaaccttacagaaggctga

SEQ ID NO: 3424 - DNA, 567 bp, Bacillus licheniformis
atgaagaaaaaaagcgctcctcttattttgatcatggcgctgtccctcttgctgccttttgctcaagcagaggcagcaggcagcaaaggagcatccggggtgaaggcttcgagttcctcggctaataacagcgctctaaaaacacgtgcgggttcagtcaaccagagtatgcgcagttatatgaaacagtctgcgagccgacgatacttaaacaagaacagtcagttcaacaccattcagcggacactgcctcccgatgccctgtacaaaggaagcatcaagcggacactcaatcaaaatcctgctggatcagcctttttgaattactactttccatattggatgatcttccacgtaggcggatatacagcggaacaaaaaaacatcctccgtaccgcaggaatcaaagaaaaagcgctctctgaacgaaaagaaaaaagatattggctgttgattgaagatcaaaacggaaagaaacatgccgtcctcgtctcgaaaaaacaatatgacagcattcaaaaaggggaccgaattgaagtgcgccgcaaacagatcaccaaaaaatag

SEQ ID NO: 3425 - DNA, 190 bp, Bacillus licheniformis
atgggtgcaatagagcggaacggatacacgtttgaaccggaatacagcgtgaccagacaaaacggtgcgatccatgtataccggcgcggccggtttgtcgaggagattccctttgagtttcacggggagtttccagagcatgatttaattgaagagcttgtcaatcattattgttatgaaaataaaatat

SEQ ID NO: 3426 - DNA, 184 bp, Bacillus licheniformis
atgggtaacgcagtacatgacaaagaacagcaagtcaattatttgaaaaacagattggatatgtttatgtcagtcatcgattctttagacccggaatcgaccgaccttgaagatattgacagactgatcagcatgctcgacgatttggaagccaaatacgagcgctttaaaaaagactggaaat

SEQ ID NO: 3427 - DNA, 249 bp, Bacillus licheniformis
atgaaaatcaggaaggcaaacatcttaaacgaagatcagatgatcacagacgtttacctccatgaaaataaaaaggaatttcatacgcttgtggctgtgccgcaactggagtggagcacgctgatttcctatgaggaagaaaaagcagaactcgccgaaaagcttgaccggtcattgtcgaaagtggctgagtcggatgcggccgaggagctgtccaaaaagatcgtacaatgggtgaccgaaatgtag

SEQ ID NO: 3428 - DNA, 360 bp, Bacillus licheniformis
ttggatacacatctcttctatacagacacagatttaatcgccttgtaaaagaagcggaagaacgatatagaaagggaaaagaggaagggacggaatacgattttttcgaggttgtcaaaccttctgtcgagaggttcgaacaaacagtgaaaagctggctggcggaaagcctgtcttatatcaaggccaatcggccaaaatacatttacgaagaacagctcaactcggttgaggaaaatgcgaatgaaattttcatgcagtcctatttctgcaaaattcataaaaaacgctttaaagatctgacggaatccgtcctctacacgctcaaaaacgtagaagacgatatattaaaagaagacc

SEQ ID NO: 3429 - DNA, 426 bp, Bacillus licheniformis
gtcttgataatgacggccctgttacagaaatgcttgaaaacatgaacgggagacacggtgcaacaaacgtaaacaatcgagcgggaaacggcaatcccgttccaacaggcgatggaacttacagccggggagacatgaattatcacaaccatttggtgaatacggcggatacaggctatgacagaccggaaaaccgtaaaatctcaaggaatatcactgggcgcgtcaacaaattgaattatgttgacgaaagccaggcagtcgtaacgaatgaaacggtcatcatcgccgtacggtctgataaaaggctgacaaataacgagagaactcaaattagaaaagcagccaaaacatttgccggagaccggaccgttcaagttgtcgaggacgacggcgcatttacaaggctgcgcgaaatgaacgatg

SEQ ID NO: 3430 - DNA, 645 bp, Bacillus licheniformis
tggcagaaagctatgggacgaataaccgtcggatctccgagaattttaaacgtaacataaatcgctttaaagaagggaaacatttttactctttgcaagggaaggaaaaacgggattttatcaaccatacgcaaattgaggatggttcaaaaaacgcccaaacgctctacctttggacggaaaaaggtgcatggcttcatgcgaagtcactaaataccgatcaagcctgggacgcttatgaaatgcttgtggatgagtattacaacgtcaagcaaactcaaattgatacatcccagttaagccctgaactacaaatgttcaagcaaatttttgattcagtagcccgtacacaactaaagcagcaggaacaagacaaacgccttgatgctgttgaaaagaagcaagacaacattaaagaagttctttcgcttaatcctactgaatggaaaaagaaagtgaacaagatcatcaatgctattgcgctatcaaaaggcggtttccaagcctatgcagatgttaggaaagaaagttatcaattgttggaagatagagcgaggtgtcgtttatccattaggcttacgaataagaaatccgaaatggccttaaacggtgtgcctaagtcaaaaatagacaaggtaaacaaaa

SEQ ID NO: 3431 - DNA, 440 bp, Bacillus licheniformis
atgaagccggcacttgtatatggagcagatgagttcttcggcctttcattttgtgaacatctacttgaagagggtgttgacatagatgtaaagctggaacagacaagcgacgaaaaaaagctgatgtacctcgaagagcggatgatgtggctgggaagaaacgagcatttccgtctcatcgaaaaagagcttgaagccccgtacgaacaagtcttcatccaatacacaggctcagtgccggaagaagcgctggctgcaggcgttgaaaacaagcctgttattctgtttgtctaccaggaacaattgaaagaggatttacgcgccggcatggaggaaaagggtgttgaactgatcgtgcttccggatctgttcggtccgtgggacgtcagggcagaggataaacaaaacagggacggagcgctttttgtgaacgacgcggc

SEQ ID NO: 3432 - DNA, 202 bp, Bacillus licheniformis
atgaggctgagtgaactttcgggaaaagaaatcgttgatgttaagcgggccgaacggctcggcgtactggggcagacggaccttgagatcaatgagcaggacggtcagattaccgctcttatcatcccttctgttaaatggttcggactaggaagaaaacaggggaatgacattaaggtgcccggtcgcaaattcaaaaaat

SEQ ID NO: 3433 - DNA, 198 bp, Bacillus licheniformis
cgaaggggtctttggaggcggagataagcaaagccttaacccaatgggaaaaagactatttgggacgcggatccgtatctgttaaaacagatattataagaaatatggtcatcgtttccctgaacggtatcctgacgcccgccgaatacgaactttgcagtacaaaagaaggcctgctgtcaattaaaagaacccgtc

SEQ ID NO: 3434 - DNA, 186 bp, Bacillus licheniformis
cattggctcagcggctcgaagtagccagaatgctgcgcgacggcaacacgtatcataaaattgagacggaaaccggagcgagcaccgcgaccatttccagggtaaagcgctgcctgaactacggaaatgacgcttatatcatggcgctggaccgcgtcaaagcaaatcaatctgaatcatcttcat

SEQ ID NO: 3435 - DNA, 558 bp, Bacillus licheniformis
atggtcgttagcatgggcatcagtatacgttttagccctttcttcagcttcctcagcccgctttgcaatccgttcatcgtttacattcagctgatctatcgcttcgttgaacaagtcggcatgggcgcggtctgttgtttcaaagcgtctcggtttttggatgtccaccttgtttcagctcctttaataaatgtcgtcgatttcaaagacgaactcgatgtcgccgtctttctgcttgtctgtcatcgttctgaccgctgtgaattttccggcttcatcgacaagggcgagctcgttgatcgtttcccctgcgagttcgctttctcccaatgtacatgtataacggactttcgccggctccataaaggcaaagccgtcgatatccttttgcagaagttcgtttttcagggcctgttcgttgccctgcagaggaacgggttcgcctttatcgtttgtacctccgtttccgaaagccatttttgtgattttggtgagcttgccgccctcagcccgtgcttttgccatttgctgtctcgcataaagcgttgtcactgttaa

SEQ ID NO: 3436 - DNA, 195 bp, Bacillus licheniformis
gaccggcgtccagtatcatatgtatcatgcgctcggtttaattgccgtcgcgctcatcgcgtcaaaactggcaggtgcgggaagcgtttctgcggcagggtggctgatgtttgccggaatcgttttattttctggaagtttatatgtcctcagccttacgcaaatcagcgtcctcggtgcgattactccgctggg

SEQ ID NO: 3437 - DNA, 234 bp, Bacillus licheniformis
caaaacaccgcctcgagttaaaagaaaacctgactgtgcaaaacgcggaaacattggtcaatatggttcataacaatttgggaatcggcttgatatcaagcttctcgctttcctccgtgtcccatcggttgatcaaaaaagacatctctcctcaaattatccgcgaagtcggcatgataacaccctcatttgaagaagcaacacctgcggctgcagagtttatgaaaatgatca

SEQ ID NO: 3438 - DNA, 1158 bp, Bacillus licheniformis
aattgtgctcctacttgccgccattgtccttcttcaagggtgctgggataaaagagagctgacagatctgctgctgatcactgccatcggtattgataaaggtaaagatacagattacgaattaagctatcagatcgtcaatccgatcaatgtgacaggcggccttcaaggcggacagggaggagacaggccgccgatttcaagctattctgtgacgggcaacaatctgacggaaatgagcagacatgcgtcagcaaaaatgtcgcgggaaatttattactcccacaccaacctcgtggttgtcgatgaaaaactcgccaaggaggaaggcttgatcaaaattctggatgttcttgaccgggacaccgattttcgtacaacggcgacgattattatttcccgcggccaaaaagcgaaaacattcatccggacgctgacgccgatcgataagatcccgtcaaataaagtaaacaaaacgctgcaatttaccgaagagcatttgggagaacatatgaaaacgagcgtccaggatgtcatcaagtgcttaacatcgaaggcaaagcacccgattatttcttcctttaaagtaaccggaaacaaggaaaagggtgaaaaaatggaaaacgtgcagtctacatctcctgaggcaatagtcgaagcggacggcttggcggtcattaaagagggaaagctcgtcaattggcttgaaggcaaaacggcgagaggcgttttatggctgcgcaataaaatcagcagaacgtatttgacaattccaatgaatcatgagagagatgccgtcacatttgacgtcatccgccaaaaaacaaaaatcggatctcacctgaaaaacggcaaaccggcgatttcggttgacgtggctatggaaggggacatcggcgaaacaactgtgccgattcacctggatgatccaaaagtgctgagcgatatcgaaaggaaggtggcaaaggaactgaaaaatgaattgcagaatacgattgacattgttaagcggaacaagacggatgttctgcaattcggtgatgttgtgtatcgcacccaccccgaagtgtggaaaaagatggagggtgaatggagcaatcggtattttcctgacacagacgtcgacattacggttaatgcatacgtacgaagaacagg

SEQ ID NO: 3439 - DNA, 185 bp, Bacillus licheniformis
atgaaagtattggccgttacagggtacaagccgtttgaactcgggattttcaaacacgatgacaaggccctgttctacataaaaaaagcgcttgaaaaccggatgatcgctctccttgaggaaggcctggaatgggtccttatctcgggccagctcgggactgaactatgggcggcggaagtcgc

SEQ ID NO: 3440 - DNA, 339 bp, Bacillus licheniformis
tctccagcgcatttatcaagaaaaccagcaaacagaaggacgccgcattttaatcgatcgtgtgtggccgcgcggcatatcaaaagaaaaagcgaaccccgactgctggatgaaagaaatcgctccaagccccgaattaagaaaatggttcggtcatgatccgaaaaaattcgaatcgtttaaagaagcctatcaaaacgaaattaaacaaaacgctgaaaaacagaaaagcttcagggaattaaaaaaaatggcggcggacgaaaccgttattctgctttacggggccaaagatgagcgccataaccatgccgtcgttctttatgagatgctgaaccg

SEQ ID NO: 3441 - DNA, 555 bp, Bacillus licheniformis
atgaacaacgggcttaaaggagcgattatcggacccggcgcttcgcaactacttctctcggacgaagcatttacaccgttttgggaaacggctgatagaagaaaagcgattatctttatacatccgctcctttctgaagatccgcggctccgccgcaggatgctgccaaacttgatcggcgttccgtgggaaacgacgatttgtgccgcagaccttttgttaagcgggtttacagaccggtttcgcaatgtgaaaattcttttggcccacggaggcggctttttgccttatcagatcggaagactgaacaaagggtatgacaaatgggccggcgtttcttcatcgctttcggctccgccgcgcgaatatttgcggaagttttggtttgatggtgtgctatgggagcaagaaagcgcggcatatttgaagaagcttgtcggagaagaccgccttgttccgggttccgattttcctttcgacctttgtcagtggccgcctctcgatcccggccggaaaggagcggagtctctgctgaatgtagcgattgaagcataa

SEQ ID NO: 3442 - DNA, 252 bp, Bacillus licheniformis
cgcagcatgggcggaggcaatgaagctgtgcgttcctctcgatacgctgagcggaatgacgcttacaggtccggaaatgttcagcagcatgcctgttctcgaagatcagcagcttggcgcgattgtcatgaaaatcctacaggaaatcgtgtacgggacatttttggcgattatctttttcggctgggcgaggaaggaaagagccaaagacgaaaaggacctggaagaagaatcatattctccgtctacggt

SEQ ID NO: 3443 - DNA, 261 bp, Bacillus licheniformis
caaagaacgaacaaagcgtttttatcaggttgaacgcttttattatcaaagccttgattcaattgttgaactgacggaaaagcatgcgtttttggcgtcacagccaaagcgcaatgcgaatcttgaagtttctttaagcgaaacgcgtatgatgatcgataagctcgccaagcaattggaagacgacctttatgacttgctgaaaacagacattgaccacttggagtttgaactggacgtcgcgaagcattcaatgaaaaa

SEQ ID NO: 3444 - DNA, 357 bp, Bacillus licheniformis
atttttcaccggaacagcaatacaacgcatggatcattagcgatttggtcaagcagattttttcaagagagggtcatcaggaagttgatactcatcgatttgaatcatttgccgccagacgattcggcatcaatatcgattatgtcttttcgatcatcatgaacatcggcgatccggaagaaaggagaacggcaagcagctccgaagacctcctctcttcttatctcctgtcattgctttcttttatcacaaaagacatgttccaatattcaagagaaaatgccaatcaatatcttttaaatgaaagaaatgccgatgtttttcacctttttctgcccgattctgtactgaagaaaa

SEQ ID NO: 3445 - DNA, 242 bp, Bacillus licheniformis
ttggctacaagacaatccgtcggagagcacatccaaagaagcgaagatgcttatgattatgctttatctcaatttgaaactgcaagcaggcaggaacattacaatgagacagagtacagcgatgcgcagctgatgcttgaaaacgcggtcaatgaattaaacaagctttcgctgtttgccaatgagcagcaaagggaggaaattcaccgcaaaaggctccagctgcaaacccttcaaaacaa

SEQ ID NO: 3446 - DNA, 289 bp, Bacillus licheniformis
atgaaaataagtcaagaactgcgtacaatgatagagaaacagcagactccgcctgcaagaggagaaaatgtttctgcttcatttaaagagaagatgaatatacaaagcggcaagcttcgagttgaacagctgacaatgcttttaacagatattgaagcgttcggaaaacgcctctcaaaatcgagaaacttcaaagatttggccaggatcaaaggcttgatcaaacgaattgtaaaagagaccgatgaaaacgtctggacggtggagaattcaagaagcttcgatctgt

SEQ ID NO: 3447 - DNA, 191 bp, Bacillus licheniformis
atgtcttactacaacaatcgcaatcaagagcctctgccaaaggaagatatcagtacgtgggaatgtacggctgaggactgcaacggatggatgagaaaaaatttcacgagcagcgaccgccctttatgccctctgtgcaacaaggaaatgataagcggaagccgctatatcacctctatcaccaacaacac

SEQ ID NO: 3448 - DNA, 263 bp, Bacillus licheniformis
atgaagactcttgatgtccatgcgttgcaccatgcaattgatcaaacgctggaacaattaaaacagcagtcagacgaattatccaaagtcaaaaaagccgtagagggcattacatcacttgatgatgctttaaaaggaaaaggcggcgacgcgatccgcgccttttacgaggaatgccacaccccttttctacagttctatgatactttcatagaggaatacagttccacgctgaagaaaatgaaaagcgcgctgaattcgct

SEQ ID NO: 3449 - DNA, 199 bp, Bacillus licheniformis
atgggttttcttcggaaaaagaagcttagaaaagaatttgataacaagctggttgaacagctgatccatcaaaaggaagaatggaacaggcaaaagcggctgattgaaaacagcctagagccttcccccagagttctttacgaattaaaggttgcccgagcaaagtactttttttatttgcgggaagcaaaaaaaagaa

SEQ ID NO: 3450 - DNA, 1098 bp, Bacillus licheniformis
gtgctgctgtttctgatcattatcgtgtccagttataatgtcggaaaaagatcggaaacgattattatcccaagcggggaagaaaatcatatctatgaccagaagacccgcccttttcaagtcaatacgatctatcgtcttccaaaagtcgggcagctgctcgggtggtcttcaccggattccgttgtcggttttttcaagggagaagggacatccgaacgtacagcgcacagtcttcagcgcctttcctccccctatgaaaaagctgaaatcgtaaaaggcattgaaagcaacacgtccaacctaaaaatgtctccagacggaaagcgtatcgccggagtcactttgtcattaagtaaggcatcaatgcagctgttttcgccggcgagcgggaaaaaaacagaaatcgccagcacctccgccagcagtgaggtctatgtccaagatgtttcatggtcaaataatagcagatacgtttgctatcttgttttagatgtcgggcagggggatgagaccggccttcgtgtttatgatacggcttccggaacgcttaaaacgtattcattgaatgattttgcggagaaggattcgcttaccggagttaacatctccgataatggacgagatttgctgtttaccgtgttgcagcgttccgacgagtacgggatcagaatgggaaccattgacggcagccgcattaaaatcgaggacaagcgtctggacagccgcggcgggcctgtttggttaaacaatgatcaatttgtattcctggacaccggggaaaccctgtgcgaatatgatcgcagaaacggagagctttctgctctgctcgataaagtaactgtttttaaattctcaaacgactttaagaaaatcgcttactctttaaaggatgaagacaatatctatgcaggtaagcttcaggggaaaaatatcctctatgaagaaccgatataccacggcaccatcccttcggaaatattttggagtccggacggcaacagcctgcttgttaacgctcaataccagtaccctgccatggagagtgcatccgtgcgatttttagaagagcaagcttatatcatcacatttaaataa

SEQ ID NO: 3451 - DNA, 549 bp, Bacillus licheniformis
atgcctctatatcatacacttataaaaaagggctataggaggagaggaaagatggaagagaggagatccgccgtatatccttattccggccctggtgcgcatattcaagcctatcagcaaaaccatcaggcctatcatcccgttcagctgtacttcagccaggaaaccgttccgtacgcccatcctgcacagcggccgcagccatatcagcagccgattgagcagaatttggacccgttttcagtctatcatcagcctgttcagcagcaaatgcagccgcttccgccgtttcagggatttccttatcagcatccatacccttcgccgcggcctaatctccatcagccgtcacagtttcaaacctttctgtcgcaattcaaaaaaaagacgggcagattgatttcagcaaatgatggacaccgcaggccatatggtgaccacggtcaatccggtcggatccctttgcccagggtttatgggattcttcaaattataaaagcttggatgaacgtcattcatgctttttttgccccgaaaatgacaccgtga

SEQ ID NO: 3452 - DNA, 384 bp, Bacillus licheniformis
tggcccaaatcgaggagcctcgaagagatttaaatggcctccttagttactactcatttttctttaggggcatgtatgaatttgagaaaaaacagtacatcaaagcgatagagttttatcgaaacgcataaaaacagttggctctcattacgatgttatacaacaagccgagtttcactttaaaatggctgaagcatactacatcatgaaacagacacatgtatcatatattaagggcctttaaaatatacaataatcatgaactctacacagtccgtaaaatccaatgtttatttgttatcgcgggtaactatgacgatttaatgcgccatgacaaagccttaccccacctggaaaatgcacttgaattagcgatagagatcg

SEQ ID NO: 3453 - DNA, 185 bp, Bacillus licheniformis
atgaacgtatcatacttaagaaattgttttgccgagatgaaacagtatgagacagactgcatgaacaaactgatggatttcgctaagtttttgtatatccagggacatctgacattaaacgaatttcgcacaagtatgaaagttcttgaagcgaatggcgcacagcaccctgcttatgatatgaa

SEQ ID NO: 3454 - DNA, 543 bp, Bacillus licheniformis
atgtttttaatcgatttatttttgaatttgtgcattttaattacttcgctctttatttacactcagctaaagtggaatattttttcccgaaaagctacaaacaaacaacttgattggattgacggcattcttggcggggtgctcggaaatgtgcttatgttcttttcgatccaggcaaccgatgagacgatcgtcgacttgcgttatgtccccgtcatgattttgtttttatttacgggcgcctttccggcctttatctgttctctgctgattataggaggaaggtttgtttacgggacgaatacatcctcgattgcagcgcttataggtatgatcgtgatattcgcaggatattatctcattcttcggatcatggataaagacgccggcacttatcgaaagacatttgcattagttatttttgccaatgtggcgatttcaattgtgatcttgatgatccttcatgatttcttcttaatgaaaatgttatggacgtggttctggaattttattctactatcggcgggttttaccttaattata

SEQ ID NO: 3455 - DNA, 235 bp, Bacillus licheniformis
ttgacgctgaaaaaagaacgtattgatattacagaacatgtggaaagccgattaaaaaacggcggaacgcagctgtatcatgaaaatgagctgatcggccgaatgaccggcaaggatcaatacgagttgaaatctggatattcattccaagatgaaaagttttacaaaatggcggataccgtaagcggaccggatgctaaatatgtagactgtgatgaccaccaaggctggtgtt

SEQ ID NO: 3456 - DNA, 540 bp, Bacillus licheniformis
atgagctatgttttattgaggctatttattaaacttaccttaattgtacctgctaaaagggctattatatgtaatataaaaaaggcggatttttcaacagactatagaacaattactataaacgatgtgcagataaatataccaaatggtttaagaaaagagatcattataaatattaagttggtggaaaagctaaaggataaaaaaatggataattctgaccgattattttatttcttgaatgaaagctcattccgaccagaagatttgaattcatggttttgtaatttattaagggaatttaatattattgatatctcagaagataaatctacttatcctgttgaaaccattagaaactctgtaattgtggaattaattttaaaaggattcgatttggctcttatctctaaagtgagtggagtttctatttcaaccttagaaaatagatattacaaggttaaatcttatgaagctgaggaattaaataaattaataaatgaaggaatagcagggattccatattatagctatatataa

SEQ ID NO: 3457 - DNA, 210 bp, Bacillus licheniformis
atgttggccgataaagaatttggcctgaatgacgtggtcgaaatgaaaaagccgcatccctgcgggacaaaccgctggaagatcattcggatgggaatggatatccggatcaagtgcgagggctgttcacacagcgtcatgatcccgcgcaaagagtttcaaagaaagctgaaaaagatattagttaagcatgaggagtccgaaagttaa

SEQ ID NO: 3458 - DNA, 537 bp, Bacillus licheniformis
atgaagccagccttgaaaaaaaattccttgaatacctatgctaaatactctattttgttcattattatttttggtttcggtttttctcttagcttttttgtatttcaagaaatacacgagacttactatgatagctttaaaatatccaacgctttagagatttttacaaataacttaattgtaggactaactattttctttcttggattaatcagtgttggtttcctatctagtgtagtagtgtttttaaacggttatttctcaggggcaattttcttttcatatgagaagtctttaggtttttggaaatcactacaatatctcttatttcacggcccctttgaaatccttgcccttcttgctttttatgtaatatctcttgatatttcttcccgttttttaagatttctaaaaaagtctgaaataaacctaatgattaagccgaaagtaaaagagtacacaataataatgataagtgcagtaggccttctaatcttagcatctattgtcgaatactacgtaatattactaaaataa

SEQ ID NO: 3459 - DNA, 204 bp, Bacillus licheniformis
atggctaatcaaaattcttcaaatcaactgcttgtcccaggagcagcgcaagcgatcgaactaatgaaattcgaaatcgcttctgagttcggcgtaaaccttggcgctgacacgacttcccgtgcaaacggttctgtcggcggagaaattacaaaacgtttagtttcccaagctcaagcatctatgggcggtcaacaattttaa

SEQ ID NO: 3460 - DNA, 301 bp, Bacillus licheniformis
atgaaacgtgtcattgtgctgttttcgattttgctcgccctgttcattgtttattatgacttgaaatcaggcaccatccctcaaaacgccttaccggcttcaaccatggcagcggaagctccggctgcaagcctgcaatataagtccgttacggtaaagcccggacaaacggtattttcaatcatcgggaacagcgccgttccggctgacaaaatagccgaagattttgaagagttgaatccgaatgttgaggcgggccgcattcaagcaggtgtcacctacaagtttcccgtttatcctg

SEQ ID NO: 3461 - DNA, 531 bp, Bacillus licheniformis
atgacaggagcgctgattcagctcgaagcggcgaagcgcgtccttgacatagacaaggaaaaagcttcagagctcctgcaaaatgcgattaacatctccaaggacgggatcgaaaatattagattgacgttaaaaagcgtcaagccgccctcagaacagatgggcatccacagattgaggctgtttatcgatgaatgttcggcgcagtaccatatgaatatttcatttttgcataaaggcgatttggatgttatttctcagattcaatggaagattatttttgaaaacatcaccgaagcgctgacaaactcggtgaaatatgctgaagcgacacatgtatccatctgtattcatgtgctgaatacgctcattaaagccgaagtgaaagacaacggaaaagggcggcagaaaatcaagaaagggatggggatcatcgggatggaggaacgggccgcttctgttaacggaaaggtgatcgttgacggttcaaacggcttctctgtcaccaccctgctgcccaagcatgaatga

SEQ ID NO: 3462 - DNA, 531 bp, Bacillus licheniformis
atgctcgttaccaggccaatgatcggaaaaatgattgataagattggtgcgaaatccgtggttatgatcagtcttgtttttccgcttatcttaatcaccgataaaacaagtttgatctggatttccatcgtattgttcatccgctgcaccagtatcgggggaaatcttccgttggcgagtgacgcttatacagggcttgacagaaaacaacttccagaagcaggtgtcggtattaataatattgaaaaccctggttcaagcttcggttcagctgtgatcgcaaccgttggcgcaactgtcatggaaggattgcaaccaacgattgcgaatagcttaaaaggttatcatgccgggttcttagtttctacaattgtccttgccataatcttcatcccacacataaaaaagccaaataaacaaatgctcactggtgaagtttacacgctccaagagcattcaaaattggctgatttattccatacggggaaacttcatcaagcagaagacgcgcccgttacccagccaaattag

SEQ ID NO: 3463 - DNA, 302 bp, Bacillus licheniformis
atgaatgtatattatgatcagcacaacccttccggcggggcatctggtcctgaacataatgtgacgatgaagggccgcaagcttctggatatatccggtgtcaagcaggtcgagagctttgacaacgaggaatttttacttgagacggtaatgggcatgcttgcagtcagaggcgaaaacctgcagatgaagaatctcgatgggaaaaaggcgttgtctccatcaagggaagagtgcttgatctcgtctatttggatgagcagcagggggagaaagctaaaggattttttagcagtttgttt

SEQ ID NO: 3464 - DNA, 196 bp, Bacillus licheniformis
atgtcaagtttgaaagataattatcaatcgaaagttaaagcgtatcagccttcaccgccttatgtcctgaactgtatcaaggcatttctcgtcggtggtctgatttgtacgatcggccaggctttccagaatttttatatggctgtgttccattttgatgaaaaaacggccgggaacccgacggttgccacgctgc

SEQ ID NO: 3465 - DNA, 242 bp, Bacillus licheniformis
atgaaccctcatatgctttattcgagatcaggtcctgccggatacccggccagattcccgttattctggggttttggagcgccgcttgtcggcggattgctgggcggatttctcggaagcgcgatttttaactacccaagaccttacgcttacccgccgccatacccgggaccttacggcggcgcgccttattacggctacggggcagctcctggggcttttccgtacggaggtgttccggg

SEQ ID NO: 3466 - DNA, 200 bp, Bacillus licheniformis
gtgagggtaaagtgttcattgtgtgacaaaatcgaaaaaatcgatgacgacacactcattgccaaacgtctccgaaaccggccgatacatacctatatgtgccatgaatgcagcgaaagaattaaaatcaaaaccgaaaaccggatgaaaaccggccgttttaagttatatccgcacagaaaagataaagagcagatcaa

SEQ ID NO: 3467 - DNA, 597 bp, Bacillus licheniformis
aacctcttattttcatagccggcctttgtctatgcgcctttctcgcattgccgtacgctccggctctcgcagaggaatcgggggaccagaccgttgatcatctgtttgagcaaaaaggtgcgggcaaagagaaagaaaaagcaaaagacaaagacaaaaccgaggaaaaaagttctctaaaggaagaggcggagaccgaacccccgtctccttccgtttccatatttgattttgtgaaaatgatcggcgcgttactgttcgtcatttttctgatctatgctttggtcaaattcatgaataaacgcaaccgtttgctaaaacccttccagtatgttgaaaacatcggcgggacttcactcgggcaaaacaagtccgtacagctgattaaagtaggaaacagggtgctggtcgtcggtgtcggcgaaaatatccagctgctgaaagagatcgatgatgaaaaggaatataaagaaattctcacgcagcatgaagctgcgatgaacagcaagattgaatggcagaaatggatggatcaagtcaaagttccaggcgtgcaaaaacaaagcggcacggcatctttttccgagtcgttaaaag

SEQ ID NO: 3468 - DNA, 231 bp, Bacillus licheniformis
atgtacttgacgataaaggaaaccgcagaatatttaacgctttcagaagcatatgttgaacagcttgtcagagaaaagaaaatccgcaccgtctttgacggacagcagcatttaatcaacaaagagcaattcaatacgcacatggaacagatggaaaagtataaagagtgggcggaatccgttctgaacgagcccatccccgaagatccggacgtcaaagatgaagattaa

SEQ ID NO: 3469 - DNA, 525 bp, Bacillus licheniformis
atgaagagggtgagcaggttgatctatatatacaattgttacggcggcactcattcatctgcacttgccgctgcttatcatctgaaaaagctcccattcagcagaaaaccaacaagaaacgaaattttaagcaccgactgttttaatcaattaagtccgaaggaaatgggaaaattaatctttcacggacttgatgaagaaggcaaccaggtgtacacgatcggcagaggatcgtcaaaagctgtcattccagccatgcgaggcgttctcgagctgtttgaaaaaaacgggaaacttcaggagaaagtcattttttcaaacacgtctccgactgtgccaatagcgatgacattcggcggtttattttcgaggaggctgaaaatcgatccgatcggggttcctttgctggtgcttggagcgcagcaggcataccaagacatcatcaagcttgtgcagcaaacaaaaaaccatgcaaaaacgacttcttcgatgatcgaggtactcgataacggctttaaaggatag

SEQ ID NO: 3470 - DNA, 173 bp, Bacillus licheniformis
ctgaataaagataaaaatgagaaagaagaattggatgaggagtggacagacttgattaaacacgctcttgaacgaggcattactccagaggaaatacgtatttttctcaatttgggaaagaagtcttcaaatccttccacatcaattgaaataagtcattcaataaatccttt

SEQ ID NO: 3471 - DNA, 255 bp, Bacillus licheniformis
tcaggttttaatggttgggttgcactcttttaagcggttgaaaatgttcaggaaattcgcaaatgttcatcacggttcaaagcgtctaaataaggtagtggtgtatcgcaatatggaagattcgcaaaggatcatcgcaacaatacgttcgtactcttttgtcaaacaggtggatctttcatacaaaccgtttttgaaaatggagtttgaatccaagcaggataaagcgaaagaatacgactataaagccgggct

SEQ ID NO: 3472 - DNA, 196 bp, Bacillus licheniformis
  misc_feature (1)...(196): n = A,T,C or G
atgacaaagccgaaaaaaaagcgctttgaagtaacggaaggcgaaacgatcgaaaccgtgttgacgaagatgcangaagaaggctacacgccggtgcgccgaatggaggagccggtcttcaaagaaacaaaggaaaatggaacgattcaggttgttccgtgcggaagaaaaattatattcgaagggaaattactct

SEQ ID NO: 3473 - DNA, 522 bp, Bacillus licheniformis
atgaaagccgctcacatcggatggagaaaagcggtttctggaaaactatgcgcactgttaagtctggttattgttatggttattgcagctttattgcttggactggcaggcggttggctggcttggacgttcgccacggcacattcagacttagccgcttctcttgaagtgaatgcagctgtctcctatccgatattaattttgtttttaatgatcggattgacattttacagtgttctaggaatgactgtcacgctgttgacgaaaagccggctggcgggtgtgctgatcagcttggcgatcccgtatgctgagcaaatgatgagtctgccttttttgccattgactgcttatcaatccctcatggttcaccattttatttatgtcgacggaagcatcatcggccagccctatttgacagagccgatgggcgaaccgggcgcttgggctgttcttgtatgctggctctttgttgtcattgcggttcagcagtttgcagcgaaaaaacagcagattttatga

SEQ ID NO: 3474 - DNA, 444 bp, Bacillus licheniformis
caatcatgatcatttactttatcatcgcccttggagctgcatggcttctccagagcgttttaggtttttggcaaatcaggcatttcaatcgaacgttcgccgcgtacaggcgtatagggagagtcgcggtcggaaggaagaccggcttactcagagccggaacggtcgtcctgtttgtcatcgacaaacgcaacaaaattttgaaggcatcaaaaatgcaaggtgtcaccgtcttttcaagaatcagacctttaaaagggtttgaaggaaagtatttgctgaagatcggacaagcggagcttgcccggcacgaccgcctcacacgtcttgcaattgaagatgccttgagaacattcgacatcatcacgaaagggggtgatgttccgcagaagaaaacacggcttcaaaaactgatgagctttcaaatcaaaaaaagaggtgaaa

SEQ ID NO: 3475 - DNA, 196 bp, Bacillus licheniformis
atggcaagaacgaataagctcctcgttcccggggcagagcaggttttagaccagttcaaatacgaaatcgcccaagagttcggcgtccagctcggctcggactcggtcgctcgctcaaacggatctgtaggcggggaaatgacaaaacgacttgtacagcaggcacaagctcaattgaatgggcataatgacaaat

SEQ ID NO: 3476 - DNA, 519 bp, Bacillus licheniformis
atgccggaaatagtgtctaaatcactggcgcatctacttgaaacgaagaacatgacaaacgggcaactcgcccttgatctaaacgtttcggagtcgatggtcagcaaaatgaaaaacggaacaagaaaaatgccgtgggatgtggcggaaacgtcactaaagaaattcgatcaaccatttttcgcaatgggaatcatgaacaaattcagcgatggttgctcgccgcccgtcttcactggtgaatcagtcgagcaacatcgactggcttttgaagagatcatggtcacacaggcgacagaagccatccagacacttgcagatgtgagttttgttaagaatccgaagctgatctctttggaagaaagggagcgcattaaagtggtcataaaggaacttctggacgtggaggcatgggctaaaaacttagcggccttattggcgaaggaatacaacatttcactcaaagagtgctacaaaaaagcaactatcacatggaaggcgaaagggtggctcgaatga

SEQ ID NO: 3477 - DNA, 288 bp, Bacillus licheniformis
acacagcgttcaagcgaaagcggaggggaaaactctggtcatggagcggagtttcgaggcgccacgggagctggtgtttaaggctttttctgggtcagtgcatttggaaagctggtgggggccgaaaggatggcagactgccaacagcaggtttgagtttcagccggatggcgtatggctttactgtatggaatgcagagatcaaaaccaaggcgaattctatggccggaaatcttgcggcaagggctgtttttcaagagattgcggcgccggaaaagatcgtgtaca

SEQ ID NO: 3478 - DNA, 178 bp, Bacillus licheniformis
atgctgaatgtggccgtatttgatgaagaacacgaaaaagatttgcagcatgaaatcaatgaattcttaaaaaagctgtcggaagaccagctggtcgatataaaatatgacgtatcagccgcatgcgatcctcaaggcgaacagctttactgtttttcagcgttaatcttatacagga

SEQ ID NO: 3479 - DNA, 521 bp, Bacillus licheniformis
atggtggttattgccggtcttttattgctggccggatgcggtgcactgaaggaggctgatcccccgcgcggcagatcagcgcaaaaaacggaagcctcgttttctgaagctgaacagcgatttgcgctcgccttgtttcaagacatgataaaagaagaagggagccggaaaaacatcttcctctcgccttacagtattcagcaggcacttttgatgacggcaaacggtgccgcgggagacagcagaaaggacctgatcagcactttacatctcagccaggcggatatggcatcgatcaacgggatatcaaaatctgttaatcgttctcttgaaacgctgcctcacggtgaattttcatcaggtaattcgatatggaccaaaagggagctgaaagaaagctttcaagacgcgatcaaaggccttggcgacgcctatcagcttcaaattgatcctaatcgggtcaacagaggaaatcaacagcgggtcaaaaagaaaacgaaagaccgctcgatcagtagagg

SEQ ID NO: 3480 - DNA, 240 bp, Bacillus licheniformis
tctaggagcaagccttttatcttttatttttgtccaatatgccgcgggaattgcagcgctttttttactcgcaactctcgtatattttatttttatcgtttatacgatccacagcacgctttcattcatgtcattaatcggttttattatgtttgagctgctgttttggtttacgtttatgatcgggacggtgtatatcatcatcaagctttataacagcgtcatggcgagcctgcccgt

SEQ ID NO: 3481 - DNA, 228 bp, Bacillus licheniformis
tatcttttattaccttgttcatcgggcgggtttattgcgggaggaaatcgaaggaaaaggggtggttgagcggagggttgacagcgctttgcttctcctttacggtgcttttgtttcaatatctcggctttggagaggccttcaatttgaagcagctcctctatcattccggctttttgggagtcagcatgctgggcggggttttcggggtcaatctgcaggggagcc

SEQ ID NO: 3482 - DNA, 198 bp, Bacillus licheniformis
acctggacgccagcatcacgaccatcatccacgaaatcggcgtacctgctcatattaaaggctatttgtacttaagagaagccatctccatggtatataacgacatcgaactgctcggcagcattacaaaagtgctttatccggatatcgccaaaaaattcaacacgactgcaagccgcgtcgaacgggcgattcgcc

SEQ ID NO: 3483 - DNA, 393 bp, Bacillus licheniformis
tacagccgccgcccttcaagaagaaaagctgaaagagagcaaacagccggaaaataaagaggatgaaccgtccaaaaaagacgagcaaaagcaaaaagagcggcctaaagaggcaaaaaaagcagatgagcagcctgtcgctgcaaagaagcccgccgcatcgaagcagcctgcggaacaagagaagaaaacggcaaacgcgcctcaaacgccgccagttcagcaagcaccgcagcccaaaaaggtgctgaagcacacggttggcgaaaaagagacgcttttccggatttcgatgaaatattataagaaccggtcaggagaggaaaaaatccgcaactacaatcaattatcaggcaacaatgtctacgccggccaggtcctggatatcccgat

SEQ ID NO: 3484 - DNA, 198 bp, Bacillus licheniformis
agcggtactacatatacccgggagatgagccgctgtatgtcaatccgaaaaacgccgggacaccgtttgtgatcgaaacaactaaaggaaaaaacgctgtgaagctgtttgtatacagatacgatgatcatatagacgtcgttaaacaatataagaaaaagacggccgcttattgtctgcgttctgacagtctgcaaa

SEQ ID NO: 3485 - DNA, 179 bp, Bacillus licheniformis
atgggcagacgtcgaagcatcatgtcagaggaattcaaaaatgaattggctaaagatcttggattttacgatacggtaaagaccgagggctggggcggaattcgggccagagacgccggcaacatggtgaaaagggccatcgaattagccgaacagcatatggctcaaaatcagcaaaa

SEQ ID NO: 3486 - DNA, 516 bp, Bacillus licheniformis
atgttcgatccaaaggctgagtgcgattgcaaatggaatcgggatgccgactatgtagcgccctactattttgaattgatttcacatgctccgcatcctgaccggctgccggcacaccctgcttatattgaacccgttaactgtcaaatatacagcggaagcgcatctcaaacgggattgatttacctgtctgacaaagcaggaaaccccgttgaaaaatccggccgagaaggtctgtatatctctttggtcaaccaggaagcgcatcgtttaaagggctatttatattactttcaaaatggagaatatcaagagttcatgatcagtcaaactaaagctcaagcattctcctacgaactcgctcctgaaaccgtccagacttatccgataaacttaaaaatactcgggagcaattatttccgatttctgtcgacatccatcccgccggacggagcataccgggacgctccttttccggcgaggatgatttactactccaggctttatacgtggtag

SEQ ID NO: 3487 - DNA, 431 bp, Bacillus licheniformis
ttgcttgatatcctgttcgacaatccgattatcatggcggccatcatcgcagccatttccttcatattcaacaagctcggaaaaaacgatgaaaatgaagaagcgaagcgaaaaccggcgcctgaacagcagaggacgcagacgccgaagccgaaacagacggcgcagcaccgtcctgcaaaaaataaaaaccagcggccggcagcggcagctgcaaacagcgcagatatggaagcagagctccgcagaatcaaagaagatgccgagcgttccatgccggccgttgaacggaccattaaaaagcagagcagccgggtgatcaaccggaagcaagagctgctcgacatgaataaaaaaacaatagttcaaggcattgtcctcagtgaagtattcggccctccgcggtcgagaaagccgcattacacaatgag

SEQ ID NO: 3488 - DNA, 351 bp, Bacillus licheniformis
cgactaccggtaaaagtatcatttatattgtacaagctgcaaatgcgccacttggatcagatgcgttaatcgtagggaaccagacagaaggaacatggacaagggaacaagaaacggttgacgagcaaacaaaactaggccgtatcgttggatacggggcgaaaagtgagacattcgaactttctttatacgcacaacgaaaagatggcggacaagaagccttagaatggacttatgataatgaatccgagttgaaagtttggcgtgtagacaccagccaaaagaacgacaacggaaaatatgattgccgtttcggctggacgattatcgaaaacattgagtttagtgagc

SEQ ID NO: 3489 - DNA, 429 bp, Bacillus licheniformis
aaaaaggatttacgcttttggaaagtttaactgtattgatgatcggttctattatgttctctcttctctttgctctactgcctcccatttatgaaaaaagaatcgttcagcactttgtctcacagcttgaagaggatttgctttacgctcagcagacggctctcgtccgccatacgacggttaaggtgcagtttgactttgccggctgccgctatatcatgaagcattcggacgaaggctcatcgcctgaactggtcaggacatacagctgcaatatcgcaatcaaaaagtcgacgctcaaaccaattcttacttttaatccaagcggtgttccgaatcaagggggaaagatcgtgatcgatacacagcatgcctcttttatactgacgatctatttaggaagcggaaagattaatgttcaaaaaaaat

SEQ ID NO: 3490 - DNA, 159 bp, Bacillus licheniformis
ccagtccagactattcggcactgaaattatgggtgaagtggtcaagacctcactaggcaccttaaaaatagcgcaccctgaagaagatttatttgaggtagcccttgcctacctagcttccaagaaagatatcctaacagcacaagagcggaaagatgt

SEQ ID NO: 3491 - DNA, 250 bp, Bacillus licheniformis
ttgttacttaaaagcctggagttcaaacgttcggatggacagaaggtgaaggtgacggaaatacctctgctgaaggaggacgacccgcatttttttatggccaatctgaggcttgaaatctttttaaagacgctctattgctcaaagcggaaaaaaaacgtctactcctttagggactacttaaagagagcattgaaatggcaggattacctggccatttatcaacatgatgaattgaagcataatgcat

SEQ ID NO: 3492 - DNA, 511 bp, Bacillus licheniformis
atgaaattcattcctttcctattattattttacattacacggaaggtgttgtatatcttgagtaagaagattaagaagtccaatcttacggatgagacttattatcgtataagccaacgttcttacaactacgattatctcagaaaaaaattaaaaaacaaagagtacatacggataaattcatctgtttccggagccacctactggtatgttgataaaattaaaacagacgaagacaccgggttagatgcggccgttctatcccaggccgaaaataaaaacggcaagtgggtgaaatccgaccaccccaaaaacgtcgttgtagcttttgcgggaactgatccggggaaggacccgttaagtgacgtagagcaagcagacattaatcatatcgtcttaggaaacgatccgaaagataaaacacaatatgtcgtcaagaaagatgcgaaagatatgtctaagacgttcggtagatatattggttcgatggaacaaactgcgggcggctcga

SEQ ID NO: 3493 - DNA, 294 bp, Bacillus licheniformis
atgtattttcaattgaatccgatatcaatcgctgcagccctgctgttctttgcggccgcatatgcagtcggaataaaaaagcaaacctggatattgcgggggtttcgccgggaaagggtaagggatcaggttaagctggcgaaaatcgctgggtatttctttttgaacagcggatttttgttatttttaaatggggttgtttacatcccgtatcaagagtcttttacaccttcagccattcttgcctacggtatttgcacgatgatttatgttcaaaaaacaatggccgaatag

SEQ ID NO: 3494 - DNA, 513 bp, Bacillus licheniformis
atgattcgtttacgcctttctttgtttctttcttgtgaagaaagcgaaggctcctccagacagaatcagcaggatgccgatcatgatcggaatgatgctgtctgtgtcaccggttttcggaagcgtatctttcaaatgaccgttgtcatttgttttaggatctcctttcgaatttcggtccggtgtgcctttgttatctgttttagggtctcccgaattcgggtccggtgcgcctttatcaacagccggcgttttcagtttttcattggacgcgatcacctcgaccggttttgtctgtccttttttaatttcaaaaggaatcggtgtttcatccagcttgtaaccgtcaggagccttcgtttcgacaaattgatagcgtccaggtgccaatccctccgctgtgaactgcccgttttggtctgtagtccagactgccggcagctttttgctgttgcctccggctttaactggctttccatcggcatcgagcagtttgaattcggctccttttaa

SEQ ID NO: 3495 - DNA, 165 bp, Bacillus licheniformis
cattgtcttgtccgctttaatcgttcccttggcattgttcacgctgttcagaggcctgagcatgcaggtggaacgccaccgcaaaatcgcccgctggacgatgccgctttggctgtatgtcagcctgacaggcgttctcgtctatatgatgatttccccatatta

SEQ ID NO: 3496 - DNA, 168 bp, Bacillus licheniformis
ttgtcatcctagtgggcgttttagcattgctcgcaggtgttgcactcggattttttattgctcgtaaatatatgatgaactatttgaaaaaaaatccgccaattaatgaacaaatgctgcgcatgatgatgatgcagatgggtatgaaaccatcccagagaaaaataa

SEQ ID NO: 3497 - DNA, 217 bp, Bacillus licheniformis
ctgacgccgtctggaacaatcaaagtcatcgatgtcgccagatttttgcagacgaaagaatgcaggcagtgggatgacttaaaaacagcctatcaaaccctttacaaaaaaagccgtttcccgcagaggcttcctaagatgtggatggaattgatcgcttatctttataaaaaaagctggcttcaaaaacaatgggcctccagaaaaaacaaatttc

SEQ ID NO: 3498 - DNA, 324 bp, Bacillus licheniformis
aagaattttcccatttggacattatcttttactttcatcaagtaaaagaggaacacattcaatataaggcgaggcgcccgagaaacaataaaaactatcctgagacaggcattttcgcccaacggggaaaaaacaggccgaacaggctcggcgcgaccgttgtcaccctccttgaaaaatccgggagcaagcttgtagtgaaagggttggatgcgattgacggaacacctgtaatcgatatcaaaccggtgatgaaagagtttctcccgaaaggacaaatcatacagccgaaatggtcggaagatttgatgaaagtatattggc

SEQ ID NO: 3499 - DNA, 394 bp, Bacillus licheniformis
atggatttttgcaaggaatgtggaagggaacgaacaaaaaatgcgctgtattgcaagcattgcggcgcgcgggcggacgaggaacgagcttccgacccggcggcaaggtatcagcgtgcgatgacacgaaaaagaatcatcatcatggcggcaatcgcggcctgcttgattttattgtttgccggctataaaaccggtgaagcactcacatcaaaggaaaaactgatttccgattttgaagccgccctcgatcagaaagatgccaagaaagcagcaaaactgcttcaatcatcagacgtggatctggctgtcacggagaaaaacgtcaagccgctcttggattacttgaaagaacacccgggatgaagaaaaagaatgatcacatcccttaaaa

SEQ ID NO: 3500 - DNA, 255 bp, Bacillus licheniformis
ggcccacttgttcgtgttttatttcggcatcgtagctgacattacgccgcccgttgctttggcagcatttgcagctgcgggggttgcgggaggagagccgatcagaacggggatcaattcagcaaagcttgcgattgccgcttttatcatcccgtatatattcgtcctgtctccggagcttctcatgattgatgcgcattggtatgaaattctctgggtggtctttaccgcattgtccggaatgatcgccatcgg

SEQ ID NO: 3501 - DNA, 246 bp, Bacillus licheniformis
tcatatggatatacatgatcctcataaacggatacggttttttcttaatgaaagccgataagcaaaaagcggtcagaggcaaatggagggtgtctgagcgccgcatctggctcgttgcggctgcttttggctccgcaggcgtctggttcgggatgatgcggttcagacataagacaaaacacctttccttcaggctcggcattccttttttgctcggcgtgcaagctgttttgaccggcttttata

SEQ ID NO: 3502 - DNA, 364 bp, Bacillus licheniformis
atgttcgttgcaggtacgatggcctcgatatttcatctgtttttatccccggaaagaaacggttcggatattcacccccgtgaatggacgattactgccgagcaaatattgaaggagtctaggaattcgattgacataagaagtgccggtgatcatcagtcactagcgatgacaaaccgccaaggtgacaccgttcgctatgagcaatatcagacagttattcgaaaaagggtcaatggaaaaggtcatgtgcctctattacagcatgtcaaaaaaatgaggtttatgattgaaaatcacctgctgatccttgaagcgacaagtctaagcggcaaatcataccgcacgtctattccgctctatc

SEQ ID NO: 3503 - DNA, 504 bp, Bacillus licheniformis
  misc_feature (1)...(504): n = A,T,C or G
atgcctgaatacagttcagttaccggattggaaggcgttaaatttgcgcctttaaaaaaggaaaatggcttttatgtggctacaaaaattattgattacccttacgcaattaacgcgaaggtcaatacggaaacatcaacagaaaagcagtatgcagacaacaaactggtggatatggctgtcacgactggttccacaaaattggagcttgaaatgcgggatctgccaatggaaatnttggaggaattgtttgggatagaagaaacagacgggatctatatgttcaaaaagaatgttatcgcgccatgggttgcgatgtctttctatgggccaaaagcgaacggcaagaatcgccatgtaagcctcagtgaaacgggcgttcttctcttccggatgatgaatggaaaacaaaagaagaaaagactgatttttcagaccggtcaacctttctggctgaatctatggagcggtggcgagactagcgcactatatagtattggctga

SEQ ID NO: 3504 - DNA, 314 bp, Bacillus licheniformis
atgaaaccgattcttcattttatgattcgtgcaactgctgcaagtgcattgtccgtgctcctttggtttacaagcttcttcgcgtttaaccagacttttctgctgtcctccgcttacgcagccggagcctggattgccgtttatcttggcgggaaatggtacggaacctatttatttttaaaagaaaaccagcttacaaggcgggaatatgcctatataaaacagaatctgcgggaagctaagctgaaaattgcccggttaagaaaagccttatttgcagttaaaaacattcaaactattaaacagaatctaga

SEQ ID NO: 3505 - DNA, 200 bp, Bacillus licheniformis
atgaacttcggcctcgatctgatcaaagataaaattgagttttttgaggcactgagcttagaggagcttgaaaaaaagatcagtcagcagattgaaaacaaccaggcgattttgctgagggtccattcggtttcccaccatacggcggttattgacggacggatccactacagcgcagtcgttcattttaaagccgaatc

SEQ ID NO: 3506 - DNA, 504 bp, Bacillus licheniformis
atgcaatatcagcaaacaggacaggacccgacttcaaaagatgcggcgcagcaaatcaaaaagcaggcgatcgacatttttatcggacaggcattaattacgcaggaagcggacaaaaaaggctacaaagcatctgagaaagaaattgaaaaacagctggacgaaagcaaaaagcagtataaaaacgagcaagattttgaggaagcggtcaaaaaagcaggcttaaacatgaacacgctgaaaagcgacattgccgacagcatcaaaacagagaaatatattgacaaagaactgccgacagatcaggttacagacaaagaaatcaaagactattatgatcaatttgccgcacagcaaaaagacagcggacagaaaaacacacctgcgtttgacgatgtcaaacagcaaatccaagatatgctcaaacagcaaaaaagacaggaaaaactcggacagcaggtcgaaaagcttaagaaaagcgccgatgtgaaagtggaaatttaa

SEQ ID NO: 3507 - DNA, 259 bp, Bacillus licheniformis
atgaaccaagcagagtcgattaaactccgcgcccaatcgatgacgttaaaaaacttgattgagctgtacaagctttgccgctcagccagacatcagctatatatatgctcaagaaaaacgatgtgcaaaatcaaagatttaattgagctggaaatgttcagaatggccaatcgcgaaaatgagtgcctgattgtcatcgaagggaaaatggcgcaggaattagtaaaaaaagcacaatcgattctttctgacgctcaag

SEQ ID NO: 3508 - DNA, 362 bp, Bacillus licheniformis
atgaaactaaattatgattgtgtccgctcaattcttctagaattagaggaaaatttaactcttaacgatggcgtcactttatatcagctcaaagattttgagacattcaaagagtatggctatgaaacttccgtttacgctttaaccaagttaatcgaagctgactttttaaacggttcggtttcgcgcgcagacaataagattgactatattggtgttggctctattacttgggatggacatcaatttttagacaacattcgtgacaatgctgtttggtctaaaacgaaagatgccgttaagtcgttatcaagcgtttccttgtccatactttcaaatgtcggagaaagcatcacgaaaaa

SEQ ID NO: 3509 - DNA, 276 bp, Bacillus licheniformis
gtttaatatatattgtgatgagagttgccatttagaaaaggataatagtgatgtaatggtattaggagaaatgaaagttgatgctcgttttcttcctgatatctataatcgcattcgtcaaattaaagttaatcatggtttaagctcttggtttgaagtaaagtggacaaaagtttcaatgagtaaaatagacttttatttagatttaattgattatttttttgatactgcagctttaagttttagaagtgttgtagctacaggaaaaaaagaagt

SEQ ID NO: 3510 - DNA, 501 bp, Bacillus licheniformis
atgaaaaagatttcatttgagctcgcaggttcatttttcgttttaatccttttcatcgaagccgtcctttttgccgcgctgtatacaacgattgtcaacacgagaataaacgaagaaataagcgcgcttcaactaagaggcaacagccacagagacgtcctcgaaaagcattttgacaaaaggacgatagaccacgtcaccctgatggagactgaagcccggacaaacgtgatcatcacggaccaaaacagacgcgtattggcgcagtctgccccgggagacatgacggaacaccttcatttcgaagaacagaacatcccgaggaacgggaccgctttatcagcccatgggaatacatcaaagtacatttgtacgatcagtgcgatcatggacggacgggaaacggccgctaggacctcaaggatttggaacgggcgcataaaagcccttgtggaaactttacgaacggtttttccgaaatttgggttaccggggttttaa

SEQ ID NO: 3511 - DNA, 174 bp, Bacillus licheniformis
aacgcttttcagaagaagagagaaaactgttgctgaacgtacttttggaccatgagtatgccgtagagctactaagcagtgagatcaatgatatagaaactggtacaaaaaatgtggatagcctgacatataagaaactggttaccttatatgaccgtgtccggtctgaaaatt

SEQ ID NO: 3512 - DNA, 257 bp, Bacillus licheniformis
atggaatacgatgatcaattaaaaaataggatcaaacgagttgaaggtcaagttcgagggatattaaagatgatggatgaaggaaaagagtgtaaagaactcgtaagccaaatgtcagctgttcgttctgcattagatcgggccatcggtgttgttgtaagcagtaacttggagaaatgcgtccgccttcaaattgaaagaggagaagataccgaagacctcatccaagaagccgttaatttattggttaaaagcag

SEQ ID NO: 3513 - DNA, 498 bp, Bacillus licheniformis
atgcgtacagatgtggaggaacaccactggttaaggttattttttggcctgttattgacttttatgctttatactttggggatttatttcgatctcatcgtcttgcctccgttccgtttctcctcctcagcctcccctcgccccctgtgtttccgctgtcccccccctctcctcctctgccctttcttttctcctcctctttctcgttttgccgcctgtttgtttttccccccttctgtccccctcccctcgttccttggccttgttcccccgggttgctcccgtcggttttcttgtccgtcccgtgtctcctctttgtccctcctctctctctttctttcctcttttgtctcttttttctcttccacctcgctcgtgctccccgtcgttttttgtgcccccctctgtccccccccctccccctcctccatttttcacctccctctaatttttctacgccgctctctcttcgtcccgctctccccgtgttggccctag

SEQ ID NO: 3514 - DNA, 495 bp, Bacillus licheniformis
atgggtgaaaaaaccaaagaaaaaaactactctattggggatcatatttttgcaatattggttgttcttcttatgtgtttatttcttatttcttccccttttctgatattcttcggagtctttaaattggtcgctttggcaccagatgtgtcaatcaatacaaaaggtacttttgattctgtgatcgttttattcaagttttttgttctcactgtggtagtcgtagggattgtagacgtagtgttttctcagattttattgaaaaaacgggggtttctcaattttgttattgaagctttgttgatgttttgtgttttttatctatatgtattgatttattcaatgcattctcaggagattgttatacggaataatggtgtattcttagtatctttatttttgtttattttgtatttgctaataaatgtagcatatatcgtttcacggcggttatataaggcaactatgaaaaacatacagaaaaagaacaactaa

SEQ ID NO: 3515 - DNA, 210 bp, Bacillus licheniformis
  misc_feature (1)...(210): n = A,T,C or G
cttgccaaaacgtatacagaaaaaacaaaaaacgtngcttgaatcctttacggatgaagaattggatcgtgaagtcgatttgaccggcgtcttcggacgaaaagtagccggcgaacagctactgcagctcgcgatcggacacgaaattcaccacaaaggcaatctgtttgtttatgtccgtgaaatgggacacacggatctgcctttgta

SEQ ID NO: 3516 - DNA, 279 bp, Bacillus licheniformis
atgggtcaagaaatcaaagtcaaaacgggcgaagtcaaacaggcgctctcaaaactgaagcattcagcccaagccgtgaagccgaacgtgcagacagatatcagcggcaaaaacaaccttgacgtcgtcaaaaaaatcgaaagcatgaacaaagatttgaaaagcctgacaaaagcatacgcatcggctctcgctaaacaaattgcgcaaaccgagcaggctgtcaacgccataaaagacgccgacaaaaagctgtcgtcatcgatcaaagccaagtag

SEQ ID NO: 3517 - DNA, 225 bp, Bacillus licheniformis
tgaacttttatatcaatcaaacaatacaaatcaattatttaagagttgaaggaatcagcaactcttccgtattgcagattggaagcgccggttcaatcaaaacacttgccaacctgtacaataccggaagctacacagaacccgcacctccggtaaccggcgaagtctttgacgacgcttttggagatgggactcaaccgactctcgttcctcttcacgctcctt

SEQ ID NO: 3518 - DNA, 495 bp, Bacillus licheniformis
atgatgctgacgccgttgttcggatcttttgcattgccggtgatcgcagtgctcaccgctgtcctctgtatgtgtgcttattttcaggtgacaggcggagcagccaggctggtggcctcgcaggccggcgggctgtttgcctacagatcaaggggaaatcagccgactgcagcgctggggcttatatttctcatccatacgatcgttttcgtctgcctgatgtttcactttcttaatgttgagacgctggttctgatcgcaaacgcctttttcatctgcaactcgctgtgcggtcttgccgcagcttacaagctgttatcaggccgcatttacaaaaaagtatgcctctttctcatggggggcttcacgctgcttcttttgttttcatcatcgtgggtattactgtttatcatgcttgccagcgcattgtttgttgtgaacttccgccaacttaacatctggaaaaaggtaaaacgccctttcaaatcgtattaa

SEQ ID NO: 3519 - DNA, 492 bp, Bacillus licheniformis
atgaaaaaacgaacagttttattcttcttgttgatctggctcgccggatgtgcgagcgcccaagaggctgaggaacaaaccaaatgggtgaacagcgaacagaaagcgattgagaacggcattcgttatgaaagcattacaaaagacgatattatagacaaaatcgatttaaacggtgaacaagtcgtcgtttttcgattcggcgattcggagggagaggggattggcctcgcacacatcaaaagggaaaacggcaactatcaatggtaccgcgacttaaattacgcaattgtaaaatcggaccacccgaaaacggagaatgcggaagcttccgcgccgttcacaacccctaagggaagaaagtacacgttatatacaggggatgcagatcgcctgaatggtacatttgagactgatgacgggcttcatttggagccggtggtcgatcaaaaaacgggcatgtattatcagatcgtgcaggattcggactga

SEQ ID NO: 3520 - DNA, 185 bp, Bacillus licheniformis
atgaaaccaatagtaaaacaaggattgaaagaggaacaagacaatcgggccgctgtttggaggcttgaggttgattatgaacttgcaacgctttttgaagctatggaaaaaaaggatgaaacccaaatcgagttgagcaagcgcaaactggaacgactcagaaaagaatggatcagattacatgg

SEQ ID NO: 3521 - DNA, 456 bp, Bacillus licheniformis
gtgggcttttcagcgtcatctcaacccaatgagctggtatatacgcccgctctttctggtggcgctcgcgtacttttgttataggcggtcttggaaaggtgtcatcattacttttttgctgatgacgagcagcatggtttggtttcccgtccccgagcggatcaatccggagatgcaggccgttttggattacgagctaatgcttttgtccaacccgctttcagccgtggtcacgctcgctttcatgatgggttttctcgtgttgattggcacggcattttggaagcgctccttagggtgggggcttgcggtattgaatgtgacgctgatcggaaaggtcgtgctgtcagtgatgctgacgggggaaaacggctgggcgcccctcggaaataccgtctttggattgattctcgtcaacggcatcgggctgctgctgatcgcctggagggagaagcg

SEQ ID NO: 3522 - DNA, 356 bp, Bacillus licheniformis
atgaaagaaaatattgattttagagaactgattgcaatcttgcgaaaaagaacggttcttattctcgtattgacaataggtgtaacattgacgaccggaatcattcagtgctatgtgctgacacctgtctatcaggcatcgacgcagatcttggtgcatcaagtaggggagaaaaaggggagcgccacatacagcgatattcaaatcaatcttcaatacacacggacattccaagcgcttttgaaaaacccggtgattttggagcaagtcaagagagagcttgatttaccttactctgccggccggttgggtgaaaaaattgcaacgagcagtgaaagcgaatctgagattataaa

SEQ ID NO: 3523 - DNA, 276 bp, Bacillus licheniformis
tcatctggatgattatcggcatggctgccgttacatatgtgccgcggatgttgcccctcattgcttttgaaagcctgaagcttcccggatttttggagcgcgtgctgaaaaatgtgccgtacgccgttttaggagctctcatttttcctggaattttttcggtgcaaagcggtatgctctatggacttgccggcgctcttatcgcatttttattttcctattttggagcaagcgtcatagtcgtcgtgatggggacgattttgacgctcgcagggg

SEQ ID NO: 3524 - DNA, 488 bp, Bacillus licheniformis
  misc_feature (1)...(488): n = A,T,C or G
atgctccttgtcgacgcgtccgctcgattccatctatctgatcacatatgctcgtgtcgcctcctctgtatgtattggtcgcctgttgcgttgccctctctcttgtggcgtcgctgttcgcttctgtccttcgccatgtcattcccctcctcctccgcccgtcagcccaggaagatacccactcctcccgcctccctactcgccatgtcctcctgctctccctgccccctctgtagccgcgttcacactactactttcttcgtcatccgctctttgtacgtattcttangttactttctttttctgtggaggtccgggcaaccccccccgcacccccccagccaggcacacgtgcctcctcccccgtcgctatcgcctctccagtacccccctcaacttcgccctgggtatgactcggcggcctctgccggcccttcgcgtctccctctcgccctcgggttcgcttactcacaatacataataaaaga

SEQ ID NO: 3525 - DNA, 489 bp, Bacillus licheniformis
atggctgaacagcaaggaaatgagaagcctttcacggttatgggcgccggtgcgcatgatcacggaaccgctcaaatcatcaagagagtcggcagcctttataccggatttggggactccatctatgagctggtacagaaaaacagcggcatcgatctgagagaggctgacttcacaaaaagcgagaatgcggaactgaatcaagcgatccaaaatattatcagcgaatacattcaaaatctcaacaatctgaatgccgatctcagcggaaagatcggtgaatcgatccaaggcatcgtcacaagcaaagatcaaaaagacgcttatttattggacagcatgataatattgtcggcaaagctgcattcagccttgtcgacaagttttttttatacatacgaaaattttgctgtaacggtcaaatgctttttttcatcccgcagcgccggcattcgcgcaaaaactgcccgtttttcacagagcttttaa

SEQ ID NO: 3526 - DNA, 183 bp, Bacillus licheniformis
taagtctaatcatggggaaacgtgtatcatttgcgaggaaaataaaaccgaaggaattcatctttatacgaaatttttatgttcggattgtgagaaaaagattgtatctacatcaacatcagaccccgaatactctgattatgtcaaaaaattaaagagtctccgtacgccgccattatattc

SEQ ID NO: 3527 - DNA, 183 bp, Bacillus licheniformis
atgcgattcttgattatcagcaaaaattccctgaactgcgtgagcgcttcgaattgttcgacttattcaagccggaattgacgaagctctgcctcaacagaaaccggatggtcgactacggctacaaggacggcgatgaccgcccgcacgcctccgaattcggaaaagtgacaaatgcgcttg

SEQ ID NO: 3528 - DNA, 177 bp, Bacillus licheniformis
  misc_feature (1)...(177): n = A,T,C or G
gggngctacagtcccgattgtcaccttcggccactctcttttgcacggcgcgatgcaccaggctgagaaacatggctttatcggaatcggcatggggatatttgaactgacatctgccggtatatctgccgctatcttgttcgcttttcttgttgccgtgatttttaaaccgaaagg

SEQ ID NO: 3529 - DNA, 169 bp, Bacillus licheniformis
atgaaagaaattgaactgatgatagatacagaagaaatcgctgattttttttatctagagctgacaagaagaggctacataccgaacgaggacgaactgttcgaaattgccgatatcacctttgattatctgattgcaaaatgtatgatagatgagcatatagaggatt

SEQ ID NO: 3530 - DNA, 256 bp, Bacillus licheniformis
atgaacctaaaccgatttctaaaagctgaccgtgaaaaggcggaaaggctgttcatttcaacgcgagatcttatttcggaattgcctgccgcgatcgaggaacatgattttgaaggatgtgtagaaattgctgcaacaatcattttaaattgcaaggatcttaaacggatggagcacccggaacaggttgttcggcttcacgaaatcgcgtccaaatttgcgaacaggggattaaacgtttcaactgtaaggagat

SEQ ID NO: 3531 - DNA, 252 bp, Bacillus licheniformis
agtcaaggcaagtgaaaacgaagttctggtcatgcgttccggcgccatcgaaatgaaacagcgcttcaggccgggcagccgcaccgtcactcattataaaatgccattcggcagactcgagctcggcgtggatactaaagctgtatcagtcacacatcagccgccggacggaaagatcagcattgagtacgatatgattgtaagcgatgaacaaaagcatttacataagatgtcgatttcgtatagaggagg

SEQ ID NO: 3532 - DNA, 179 bp, Bacillus licheniformis
atgtgcggcaggtttacgctgttttctgaatttgatgagattattgaccgtttcgagattgatcaaatggcgattgaagattacagccccagttataacatcgcgccttcccagtatattctcgccgtcatcaacgacggttcgcataaccggctagggcggctgcggtggggattgat

SEQ ID NO: 3533 - DNA, 153 bp, Bacillus licheniformis
cgatccacctcgccaaagtaaacggccgctatgtggcgctcattgaagccgaaacgatttcgtttgaaaagggcagctctccggtcgagttttataaacctgagggtctgcatgaggtgattgagcggatacggaataaaattgacagggaag

SEQ ID NO: 3534 - DNA, 297 bp, Bacillus licheniformis
atgaaatgccatcttgtaagagatttactgcctttatacatagaaggcgattgcagccgcaaaacggaacgtttggttgccgcacacattaagacatgcgaggattgccgggaaatgtacgacatgatgagggaacctgtcaattttcatggtgacggaggattgccaaaggaagcagaagaagcggaagaacaaaagttcaggaaagcgtattatcaaaggctgattctcaaaggggcagcgctgtttggcgggggctacttgctgatgcttttgatttacttattctttttataa

SEQ ID NO: 3535 - DNA, 167 bp, Bacillus licheniformis
atggaaaacaaaatcgaaattctatctactgtaagcgtcgagcactcagaagacctgtataaaatcgttgatcttttgaaccgtacgctcaaacgcgatgatctcatgttcggcctcgctctcgatgaagaagaccaaaaacaggccatttttacgatttatcgtac

SEQ ID NO: 3536 - DNA, 480 bp, Bacillus licheniformis
atgccgctgtttttctttctgtccggcctcgtttaccatgatgggaatatgacttttacatcttttctcttaaaaaaaataaagacgctccttttgccgtacttcatcttctccgttcttgcctatttattctgggttctcgtcgagaggcattttacgttcaccggcagttcggatgtcgacccggttgtaccgtttaaagggattttttattcgatgcctgatgactacaagctgacacacaacccggcgctctggtttttaacatgcttattcatcgttgaaatactgtttttcatcgtgaagagatgggggaaaggcagactgtttatcgtcatagccgtattggtctcagccgctttaagctttttgaattatcaatatctcggcatcaagctgccgtggaatattgaagtggccctgaccgccatcgtcttttattcggcccgttttctgttgaaaaatatctggaagaaataa

SEQ ID NO: 3537 - DNA, 207 bp, Bacillus licheniformis
cgatgcgttagcagactatttgctcgactatcaccgcaaatttcaatcggcaaccatgaatgaaacaatcgaacgccttcgcgatccgaaaagcgtcgtcgttgtcggagggcagcaggccggccttttaacgggtcctctttacactatacataaaatcgtatcgatccttttattagcaaagcaaaaagaacaagagctgaacgt

SEQ ID NO: 3538 - DNA, 177 bp, Bacillus licheniformis
ggcccgcagaagatcccgacagctgggggatccgcgagcatgacgttgaagagttttcggaaatcattgagcgtcacggtctttgggaaaaagggattgaatcatttgctgctgccgtccgagaggctgactatcaaatgaatattgatgatgtgaaaagacttcaaagggtgaaat

SEQ ID NO: 3539 - DNA, 252 bp, Bacillus licheniformis
ttgaaggacaaatcatgtcaggcgattttgatgacgaaatgaatgttttttcattaaagaaaatcaagcagtttcaaacgcagaccagtctgaaagaaaaccagctcaaggctttacagcactatttaaggcagcatgagcacgatgaggacggacagatcatcaccctctacgaccaaatgcttgtacctttgtcgcaagatgatataaaagcgctgttggatgacttaacaaaagtccagtcattatatc

SEQ ID NO: 3540 - DNA, 165 bp, Bacillus licheniformis
ccacatttaaaagatgaagaaacacattggtttttacatccgggaaggtaacaacaaatgggccgggaaggcaaaaaaatgcacggcctttgagcgccatatgaccgattacatgctttttgtattcatcaataaggaagcctggaagacgatgaacccagagca

SEQ ID NO: 3541 - DNA, 478 bp, Bacillus licheniformis
atgcttatggttgcatcgaagctcagaagactcgtggaaagatacccaggtattatttggtgcgataatcatcatgataaagaatatgcaggacacatggggttttttcaaagttggagaattgattatggaaagaaaccaggagaagcatggggaagccatacatatattcatataaaaaaaaaaaaagttagagatttaagaatagaatcatacaatcgcaatgaagtagtgcaaacaactattgaacgtaaatcttatgaactcgcaaaagtactgtcacagggcaataataatcttaaagatgtgcttggttactctattcgagaattaatgaggaacattgttgaacatagcacttctgaatctttctggtttgcaggacaatattggccatctaaagataaagttgaaattgcattgctggaggacggtgtcggaatcgtacagcggcctagtctgcgcagggctgtcgaag

SEQ ID NO: 3542 - DNA, 215 bp, Bacillus licheniformis
atgtattgcaaacatcatgagccgcatgtttaccctacgaaatattgtgaggatcatcattactcaaaatctgtcgttcctcatattcatccacagcatacaaaaaaaatagaccaccacaagtatgaacatgttcattactatccgcacacttactcacatcataaagatgtttcacatgaacactatcattgcggaaaaccttgcaaaagcta

SEQ ID NO: 3543 - DNA, 477 bp, Bacillus licheniformis
atgttcaacgaaagagaagcgttgcgtttgagacttgaacagctaggtgatgcggagatccaggtgatgcgggaattgcgaaaagaacgagagggcatttattcgaagctgcgtgaattggatcgggagagtgagcctgcaattaacaaaaaatcttcattaatcgacttggcaagcgctgcagcagaggaattaaaacaatcccagcatgccgctgacaaacatccgcctatcaagaccccatctcatactattttccaatcaaaaacaaccatacagcgtgaggctgccataaacattttaagccgctatgaagagggcttgaaaggcattaagctcaaaactgaaatcgagaaagaaaccggctttccgattaaaaacatgacgacatttatgaagagcttaatgaaacatcgcccagatattaaaaagcctgcccgcggccattatattttgcataaagaaaaagacctttga

SEQ ID NO: 3544 - DNA, 264 bp, Bacillus licheniformis
atgacgacaatcaagctgaaacatgaaacggtcatcaaaaagctggaggccgtaagagcggcgattgatgccctagacctgccaaaccctccgaaagctgcagggaaaaataaattgacatatacgacaaagtgccacgaacgcgagcagaacattcatcagatggtggccgattacaaaaaagccgtacacaaaaacataaaggatacgaaggaaaatgtcgatttgctgaaagagcaggacaaagcaatcgccagaaaatag

SEQ ID NO: 3545 - DNA, 474 bp, Bacillus licheniformis
  misc_feature (1)...(474): n = A,T,C or G
atgaataatatatttttggacaatttgcaaaataaagttaaagtaggctttgttttaacagttgccgaaagagtattttctgtaatcagcaaagatgatgaaaggcatccggaaggaagagaagcattggacaaatgttggttatgggttgaatctcatgccgttactggtgatgacttatacgagctaattgataacgcagactttacaggaatttcagaatttgctgaggaagaagaagactcgaatattgccaggctgtggtcgctactagttgatgctgtcgcttatacttcttgggaagcttataaaaaagaaaaagtaaaacatttgccacaagcgttagagggtataaataaagatagcattaccatctttttaaatagtacggtggaaactggttttatcacatcgaaagaggttgaaaagataagaaagggcattnggtttaacagagtgcaaaagaggataaag

SEQ ID NO: 3546 - DNA, 272 bp, Bacillus licheniformis
  misc_feature (1)...(272): n = A,T,C or G
ctgaaaagtgcgcgggtatttgaagatgaatanttcctgtgtctgtggaatgttttagaggcactgtttataaantcagctaataagtcagaggtactagaaacaatgaaaccatacgggatangtcgtggttacccctatcttgaggaactggcattagaagcagctctattctatactaggaatgagcggccaaatgattccatatttttttatgatcagatggtgcaggctcagaaacaaatcaaaaggggcgactttctgtatgaaat

SEQ ID NO: 3547 - DNA, 321 bp, Bacillus licheniformis
  misc_feature (1)...(321): n = A,T,C or G
aaaagatggaaaaattataccaagagatagcagaggggattaacgaaatcatccctactgaatgggaaaaggtctatctctatgctgaaatattagatgattcatcagaggttttcttttattttaatgtaccgcaaaataaggattatatttattctcataacatacctgaacatttcaatgttagtgaagatatctatgatgagttattgtttgagcttcatgatttatttgaggatctgcanaatgagtttaaacaaaataattccgaagtttgggacaatctcacttttacactcgagagaaatggaaagtttcaat

SEQ ID NO: 3548 - DNA, 468 bp, Bacillus licheniformis
atgattgaccgcgatatcatccatgaatttgcgtatgtcgacgagcaggaaattgcccagctgatgaaagactattaccacttttcaactgatgaggaacatattcctttaaaatttcgtctttcagataaatgctttgactggctgagtaataaagacatgacagaaaaggttcggaagaaaagttctttttcacctgaggaagaacatagctttaatcaattgatagccgatcttgaagcaaaccaatggtcgctaaacaacatctcacatttttacatccctagcttaaacgatggacctttcttgcaaaatatcgtcttttttattccatctgcccgtggcgtttgggttgctcagtatgatgaacacaatgaaaaacctgtacatatttcattaaggacacttgagcaatggaacgaattattaaaagggcttgagtatacagtatcttttcaaaatacataa

SEQ ID NO: 3549 - DNA, 468 bp, Bacillus licheniformis
atgactgatatgaaatggatcaaaatcggggatgaatacatagaaaagaaaatgacgcaatttttcagcgaagccggtacgattgtcgctgccattttatgtttggatatgatcatccgcggctttattttaggaaaacctgcatccgaatacatcatcagtgccatcggttttgcggtctatgcaggctggattttgctccgctatcttttgtcgggatttgaatatccggagatcgcaggccaatcggcgtatcggaaaaaaagaaaagaaatcgcagccctcagcctcgcttccggcctcatatttgctattttaacgcttctctttaccggcataccagagcatcccggcagttgggttgactttattggtatggtgatgttgtttgcattccttcattttctgatcaactttatctcgttgcgcaattcctttcggaaaaatcaagatctattagatgattaa

SEQ ID NO: 3550 - DNA, 468 bp, Bacillus licheniformis
atgaataaggttcttttcagacccggcatgtcgatcaaagaaattggcgaacagttgcaaggctatatcgccgcaaattggaaacaaacgcttgacgatcatcgcgaagctcttttaaaggtgtttcccgaattggaagacgcgacttacggggtctacctggaccacctgctgcctcctgtatttgaaagtctcgaacagtccggctttacaacgattcaaaatgcgggaaaaggcgatttttttatccggaaagggcttgaaactttagacagtccatggaaaaatggggagctgacaactgccgctcacgtgtgttttgggttgtcatctccgatcagcaaaaacagccggccgggacgctgctctttgacttttatcactctcacgccggatttgatgtccccctctccccgcggatttacacgttggaagaaacggagagagaccgaattgttgctcacataa

SEQ ID NO: 3551 - DNA, 397 bp, Bacillus licheniformis
atgccattcttttttaaaggtcgtcatcaaaaagataacaaacaagaatctctaatgagcggagataagaacccggaaaccgtaaagttgtctgggtttgtgcgtcccttgcttgccgaaaacctgagcctgattaaagaaatgaccggaaacagctccgatattgtcatccgcaagttaaaaacgggcgctggcgaaaaaattgaaatagccgtcgtttatgtcggcggcattacagatgagaaagcgattcacgattttttgctggaatcgatcatgaactccgaagaattggcggaaaaggagtacggcagggaggttcttgagacgattgcaggtgatgccgttgcactgggcggtgtcgaaaaagaaagcggttggacaaagtgcttgaatc

SEQ ID NO: 3552 - DNA, 213 bp, Bacillus licheniformis
acaccatgcgctgggacaacatgatcatgtatcgcagcccctcgatgagcggcttccagttcgccgcgggctattccttcaacgtcgacgataccaacagcgacgaaacccatttccgcaccaacgacaactcgcgcggcatcaccgccggcctgcgctacgtcgagggcccggtcaacgtcaccctgacctacgaccagctcaacggctcga

SEQ ID NO: 3553 - DNA, 303 bp, Bacillus licheniformis
ttctcacatcatgcctgaccagcagcatcaaagcaccaatcaccgccacctcaagctcatctttttttccgatgacgagcatatggagcaggaagtggcttattatgatgcgcttttggatttaaaaaaagaatttcccgaacaggtttcaagtatggaaatttcacatgataaaggcgagtggaaaaaagaggttaaagtctttccaagcttgctgcttgttaatgataagaaagtactggttaaaattgaaggaaaaataaaagataaagataaaattgtaaggcttcttcaaaaggaatt

SEQ ID NO: 3554 - DNA, 465 bp, Bacillus licheniformis
atgtttttttataaaatggagcaatgtgctgccctgcgccgtcaaaatcacgccttttcccgaacattttggacaaggctccggctcttctcttccgcttccattgcaatttggacatgtcgtttccaaatcgtccgttgcaatcaccatttacgatcacacctccgtttccgtttagtattatgcggccactccggccagccttcctccatggccaccacctccttaaaaatgcaaaaaacccccgtcacaaaaggacgagggtctcgcggtaccacctttattaatcgcataaacgattcgctcggaacatacggaaaggggacagtcagccctttcgatacgcttctcttgataacggagagaacatcccggctccgcctactgcccgtttcagcgaagcgattcagaagcccattcggcatcaggagggcatcggttcacaccagccaccgactctcttaa

SEQ ID NO: 3555 - DNA, 462 bp, Bacillus licheniformis
atggcttctaacaattcggaaatccttggggaattggacggggaaagcgggcgaaaacctgctgctgcggcttgctttacagccccgggtattaaagataaggtacggggtgtaaaaaattcagcgggtgaggtggtcgacatgaggaaaggagtcatccttgttctgttcgctatgctgttattggcaggctgcggcacaacgcagcataatgggcaaagcggtgatgagagccgaaaaggaacaggcgaggaaacgctcgtgaaagaaggcacctttgtcggtttggcggaccagcataccgtcgccgtcaatattgacggcaaagaaacgatgtttcaggtccctcccgaaaaacgggacaaatataaagggatcgaggatgatacaaaggtggaagtggagtacacgaaagcagaggacggaacattacagcttgaagatatgaaaaagaaagaatga

SEQ ID NO: 3556 - DNA, 462 bp, Bacillus licheniformis
atgagaagggaggtaatagatgaaacaaactgtcgatgtttgtctgattcagctggtcagttttttgaaaaatggcaatttatattaggagggttaatcatgaaaaaaatgtttgctttctttacagctttaatgctcggtttgacttgtctgccatacttatcggaagcgaaagaatcaaaacatacggacagttctgttacaagcttgccttctatgtctatacctacatctctcaatcagtcattgaacgaggaaaaacagcagtttaaaacttccgctattgatctcagcatcagcctcgacctcttaggaatcggaaactcgattagagacgctatcgttcaaagcaataaccgcagcggtttcgtcaaaaactgcatggaaaccgctttttattctgcagggcaaagatacaatgtcatggtgttcaacttaagccaaggctatcacaaggtttaa

SEQ ID NO: 3557 - DNA, 462 bp, Bacillus licheniformis
atgaccatacatattcaacagcttgaagcccctctgaatcgtgagtttgttgatgaactgatcaatttgtggaatgataatacgttggaaacggctgattgtgcattagatgatcaagatagagaaatgatacaccagcagctggaacaatatgttcaatccgcatacggagcggtttttgccgtcgtgaatgagaagcaagaagcggtcggatacgggctggcctctattaagaaagatttggtcagcgattgtctgagcgggcaaatcgatgaagtgtacatagccccggactatcgaagaaataagctggggaagcttgttgcagaccgtatgatggattggtttgaacaacatcaagtctctcacgttcaagtatcggtcgatatcgataatcaatcggcgctgcatttttgggaaggcatcggcttcagcagtgatttttatcttctgacaaattag

SEQ ID NO: 3558 - DNA, 159 bp, Bacillus licheniformis
aattaaacatgctgaacatcggcgtcattaaagctgaagacttcagcaatgaaaagcttgaagaccttgaatacctgcaccaaatggtgatgaaaaagaaatctttcagtccgagcgaaatgcaggcaatcgcagaggaactggccgcactccgaaaat

SEQ ID NO: 3559 - DNA, 453 bp, Bacillus licheniformis
gaaaagccaaatttttccggatggttatggcccccctaatggccctcggggggcaaaatgtgtttttgtccagaaaaaggcgagggtgtgaacaaccaataatccgtgtaaataagagttttttggtttttccgggattcagtttttcagggcggtccgttccgattttttacccggaagggctttctcttattttccctaagcggcttccggggtttttatgccaatgattcaaaaaatgggtggggtataggaaaccgggtggggtttccctgtccatttcaaaagggttttgggcggtctgcaattgatggggatcggcattatcggcgaatatatcggaacgtttttcaccaaagtgaaaagaaggccgagatatgcggtggatatcgatttgtatactgaacggttcggccggcgcgaacctgaaaaacggccggaaacgaagctcag

SEQ ID NO: 3560 - DNA, 143 bp, Bacillus licheniformis
ttgacaaataaaaacgacggcaaagatatgcgcaaaaacgcaccgaaaggagctcagccggggcagccagagcctttgagcggaagcaaaaaagtaaaaaaccggaaccatacaagacaaaaacacaattccagtcacgatat

SEQ ID NO: 3561 - DNA, 459 bp, Bacillus licheniformis
atgaccttcaaaccagtgtcattatgggctttatcatcaccgcagccgttattgttcttggagaaattatgcctgttaaacaggatgcaagtcaacattaaaaccccggcttgtaaaagtggggttttttgctttagacagacagccggcagaaaaccgacggctgtttttttaaggctttcttttatatgtccagagccggttatgattggaggtttcagggaagaactcgccggcgctcaatttgatttgctgagggttgtgaaccatgcttcccgtttcgccgatttccacatacactccattattgggcgctttttggcccggccggaattgacgctgctgtcccatttgcttcactcccttttaccattagattgccccaatttctcaaaaaacatgtcgattttatctttacatctgtttgctttgtgtagtttaatgagaaaagcgttctga

SEQ ID NO: 3562 - DNA, 139 bp, Bacillus licheniformis
gtggaaaagcaacaaattgaagaattaaaacaactgctttggcggctagagaatgaaatcagagaaacaaaggactccttgcgcaagattaacaaaagcattgatcaatacgataagtacacatatctaaaaacctcgt

SEQ ID NO: 3563 - DNA, 267 bp, Bacillus licheniformis
aagcggatccaattgagcccgtttcgggggagcagcacgggaagctcacatttcgcccgggaggcaaatgcacggacgaatttggacaaacgtggacgctggaaggggatttacatattctcgatttgacggttgagcagaacagcctgacatacggaaaatttcctgatgcgctggccagactgtacgcttcatttttttctcatgaaggcgattatttgatcgccaatgcaaagcccggatacgaatttatcggcgaagggtcgc

SEQ ID NO: 3564 - DNA, 324 bp, Bacillus licheniformis
aaagacatacgtgaaaaacgaaagtgaggcgtacagcccatcaccatggcgcgtcgtcagaacaaataccgacgtatacatttattcagcatacagcaaagccgaaaagaaacggttttcttattccaacggaagggtgattgccaaagtcgccgactacagcgcatattccaaggaaaaaaatgcccgcttaatcgctgcagctcccgaactgttgaccgcagtgaagctcacgcttgcctatttgaagcgaaaacggcccgttcacagcgattcagttgagaatcaattgaagaatattttagaaaaagtcgtcgcaaaagc

SEQ ID NO: 3565 - DNA, 399 bp, Bacillus licheniformis
  misc_feature (1)...(399): n = A,T,C or G
acaaaaaagcgttttggggaccttttctgttcggcgtcggcatcatcgccatgatcgacggcatcatctttcatcaattgcttcaatggcacagcgtgtacatggacacagaccgctctcaccaaattatgagcgacggactgttccatctgttttcgctcgtcatccttttcatcggcggaatcctgctgtggaacaggggcgaacttggcagcagccggccgcagcacatcttttggggagcctctttgcttggggcgggctggtttaacttccttgaaggcatcatcaaccatcatcttcttcagattcaccacgtcaaccagctaagcccgaaccgcctcttattcgactttgcttatgacgcatcgggccttttgatcattcggccgggagtng

SEQ ID NO: 3566 - DNA, 456 bp, Bacillus licheniformis
atgagagagcgaaaatatcgggcatttgtaaagcagtgtaacaaaatgatttattccgaaaattcttacccgaaagggaacagcgattatagattcgtagcgtcagaagatcataaaaaaggtttaggggttgaatatttcacaaatcggacggagtatgtcaatcaatacggcggggtggtcctcttgcctgattggagagttttcacagatgaagaggcaccggtcacagaatacaccggattgaaggacgaaaccggccgggagatttgggagggtgatatccggaaagactctctcggtagaattttcaaggttgttttttacgacgatctagccgcattttatggggaacatcccggtgggttaattcagtgtcttgccgattgtgggccggattcggaatatctcggaacagtctatgaaaatcccggtctattggaggcggcggaatga

SEQ ID NO: 3567 - DNA, 456 bp, Bacillus licheniformis
atgcaaacagacaaacaactattcgaagaaacaaaacaaaccgctgaaactctattgttatcgaaagctgaaaacgatgaagagctgatggcatacctcgaaaaacaagatttatccacgttaaaccggctgaaagtttatttttcaggtcctacgctaaaaatcagccacgtgatcaaagcttcgctcgccagttccatattcgcctccattgtaactactgtatgttcgggtcaagccaattccattttacccgacgtttcaaaaggttattttccggctttgttatcgatattacttatcatgagctccatctgggtgttcggcacgatcactaaatctcaaagaaacaaagaacaaaactttttacactttagaaaaaaaacgaaccatacaaaaattattggaatgattgatttcgttttggaaaataaatataaaagtatttcaaattaa

SEQ ID NO: 3568 - DNA, 456 bp, Bacillus licheniformis
atgagcaatatagaagaacttcgtctttttcgaaaagaagatattgaatggctgcagacctggtttgaggatgcagaggtgaaaaggcggctggaagggatgctccctcttgacgaatggttcaattttgcaggcggtaatgaaaactaccgggtatgggcggctttagaggacggcaagcctgtcggcgttgtcatggttgaagttgaggaggacttgaccgggaacattgcccttttagtcgatccgtttttgcgcggagggggatatggaaaagcgctcatcaaaaggacgatggcattgccggaaatgagccggatcaacaaatggttcgccggaattgaagaggataacaagaggtgcttagcgtgcttccgatccgtcgggtattcattggaacacgaacagccggacgaagactgctactactctcttatttatttcccggaatcttaa

SEQ ID NO: 3569 - DNA, 456 bp, Bacillus licheniformis
atgtcatgtttgaaaggcagaaataaaatcattttcttagtttattccctatatgcaacaatcatcattttggccgcccttgtcaaacctgcaatcaactggaaggaaaggcttgccgtcatcggctttatgttcgtttcaatttctttattcacattcatcatttatgtgtttataaataagccgaagaaagatcaaagcgcgccccgatgcaacatcgtcgcgaaaatcttttggaagaaacacagaaaaccgttcacgctctctttctacttcgtcggcatactgattgtgggaatatccgtgttttccatgtccgaactctcactcgcttggaaatccggcatgtttgcgattctgtttgccgtgatatcgggcaatttttttgcggtttatcaaacggcgaatcaaatgctgaaccggtcttgtttggaaagaatgcctgacgaagaatga

SEQ ID NO: 3570 - DNA, 456 bp, Bacillus licheniformis
atggctcagctatcaaacgaactatttcagcttttaaacggagagaagctcgccggtaagcggcacgaagcgatgatgctccagaccgtcacagaagacggctggccgcacacggcgatgatcagcgccggcgaaatccttgccctgaacaaaaccgacatccgcctggctctctggcaaggcacaacgacgaccgcgaatattgcgagaacaggacgggcgctcttcgtcgcttgctggaaaggcaaagcacattatgtgcggctgtctttaaagaaactgcccgaattaagagacgccaaacacccgagagcgcgcttcgccggtacggtcgaagcggcccgggaagatatcgcaaaatacgctgatatcatctccggcgttcagattaagctgaaggatgaagcggcggttttgcggcggtgggaagagacgctgggggagctgaggaaatga

SEQ ID NO: 3571 - DNA, 315 bp, Bacillus licheniformis
ttggatgcatccatatcaacacgtcagctgccggcaggtctatcccgaagttcaagtcagcgccttattgcgctcggcaaaagaagcggagagcttgatggctgacggacagagaattttaagcaggctttcagcctcgcgtactttggcccagcaaatcatgacggctgcccaaagcaaccaaaaaaataacgtgctggccgcgctcaggcaaaccggcgtccgcagccagcttgatgcctcattcgatcccgacggcattcgcatcatgctcatcagcccccgcagcagactattcctgctattgcgttggtc

SEQ ID NO: 3572 - DNA, 210 bp, Bacillus licheniformis
  misc_feature (1)...(210): n = A,T,C or G
cattactcgcccttgcttcatttactgtgccgcagtacggcatgggcctgtcgtttcgcgtgcttcgttttatttccatggtggctgcagccgtgttcgggctttacgggatcatattgtgcatgctcgccatcttcacccatttggctaggcaaagaagcttcnggcatcccngtattttaacccgaaccattttttcagcttaaaaca

SEQ ID NO: 3573 - DNA, 453 bp, Bacillus licheniformis
atgtcgaaatcatcgcctgtctgtttttattcgtcattcatctggcatttgaagacaacaaagaaagaaaccggacatacgaggattgagaaactttcctgcgaagggagaataactgtgacgtttatcattttaatggccggattgtttcttttgattcaactcaaaagaccgttccgcagaaaaatgttcggctatgtttttttagccgtttatttaacggcgctcgcactctataccatcaattccgcttttgttcacttcatatctgacagccttttgtcgatattggcagcgattgctgtggcgcctgctgcttgccggctttctgaagccttcagcggattcccgctgaaccgaatatggacaaatcgtccttattttaaaacaggccttcaaaaaaggtcttttttttcgttaaaattatatagaccgatcagtataaaatcataa

SEQ ID NO: 3574 - DNA, 452 bp, Bacillus licheniformis
atgaacgacaatgtgcaggctgcgttgaaaacgctgtctaatgtaaagagcagaagtatcttgtccgtttttgtgctatgtctgatcacactgggggtttacataccatactggtttctatccaggaaaaaaagcttcgatttgctgccttatcatgatattccctacaccacgttaaaagctatcatattttatcatttattttctattccaattagaatatcagcaaaaatcgcttttcctgacatgcattacagcctgtatatgttgctcgaccgcgtgattttgattctgtccgcaggtgttttgatatactgcgcactggtggtgactgcttcattaaacaagctttcaggcaaagaacctgcgaatggatcgatttttgccttccttttgaatatcatttacattcagcacagaatcaataaactttccgagccgaaaagcgaagg

SEQ ID NO: 3575 - DNA, 200 bp, Bacillus licheniformis
atgaaccatccggcaaagttaacagatatcaacgatacgacggttgcaagccgcatcaaaaaaggaaaggtgacggtgatcgtccttgacggaatgaacggcacggcatggcaggccgaggcgcctgagcacggcaaaaccgtcattgaaacgagaaagggagatctcgcaaggatcgaatttgaaatcggctataagct

SEQ ID NO: 3576 - DNA, 339 bp, Bacillus licheniformis
atgcttcgcgacagaggcagtatcaaatgggtttccatgatgctgcctgagcacgtggaattgctcagggaatatcatgaaagctttcaaaaaatcaaaaaaccgatcctggatgaacaaaaatatgaagaattcaatgaaatcatttgtgaagcgatggcagaaaacaggtttttgcaatttgcttattaccggcagggggaagtgaaaacgctcgccggccggattcactatgctgacgctctgaaaagggagctgcggatcgtaagccgggcggatgaaatttgcattttaaagatagaggatatcattgagattgaatacgattgtcgtttataa

SEQ ID NO: 3577 - DNA, 453 bp, Bacillus licheniformis
atgcattatgccgtcatcgctcttcccctcatcaccggattcaccctttccccggctgtactgaattcgtctgtcgccgccaataaagggacgatgctcaccaaaacggagatcgcccctcaaactgaaggcgaaaaggaacatgtcatgacaccggagattcagcaaggactcgccgattcagcgatgacgaagtcggcgtatgacaggaagatggatcagtttaaacaggaaaagcggattgtcatgaatgacgacatgtttgcagactattatgatgaagtgacaagcaatcttgatcactatattggaaaggagatcacggtcaaaggcttcgtccataaggaagcggggctgagcgcacgccagctcgtgctgtcccgatttatgattcacgcactgcatcgcagacgccagcttatcggatttcttcgcgaattgtacggttcttag

SEQ ID NO: 3578 - DNA, 453 bp, Bacillus licheniformis
atggagaatatgtatactgacaatatttggttagaggttgacaacatgaacatcggaaaattaagcaagtatttcttgtcactagccattgcccttgcgacgattctgtcctttcatgccgtttctgcaaatgctgcatcagttggtactattaaaccaagcgaatgctcaactcacatcttcaccgtatacgacgaaacagttggcattggcggttccggccgtgcgcatttctattgcggcagtataaatggaggtcctcaaattgaattttcggacgaagatttagaggttgcggtcgatgacccctttattctccatgcatatgctaatccgagcatgaactcggtagactacgaaggacgccaaaagggagatgcggaggtaacgatttattggaaaaacaagccggagggcaccaaatacacatttttattagtgcaaaataaataa

SEQ ID NO: 3579 - DNA, 450 bp, Bacillus licheniformis
atgaatgcaaggaaatcgatgaaggaatttacttgcttagaactattagattttgaagagtttgattctccttggatagacttgttcgagccattactaaaacaatttcgaagaatagattccaaaccaacttattataaattaattggggattctaaagaaaacaatattttatggatagaaaattccctaagtttccttaaacaaaaaaaagagtggtttatcgttgttcccaaatgtttacaaccagtgtgggcaaatgttcgagttttagactattctaaagcaattcatgagctttgggaaatgtcagaacctgataatttcctaattgctgataaatctacaggaatgattgcaaaaatattttttaagaacaacaatacgagatcccatatgggaaaatgtagtcttgataacataaaaagaataactaagagaactatttaa

SEQ ID NO: 3580 - DNA, 981 bp, Bacillus licheniformis; identical to SEQ ID NO: 2693

SEQ ID NO: 3581 - DNA, 447 bp, Bacillus licheniformis
atgtctaattttctacaaaaaccaagaaacaaagccatcttatccgtctacctgtttttcgtatgcggctccgttctaagcgccgttctgaatccgaagatgagcatcggggaaaagctgtttatcctctgttttaatattttctcggcaactttattcgcatttctcatttatctactgctaaataaattgatgaaagatgaagaccgcaaacacccggcagatcccgaaaaaaacgggattaatcaagtgatttggaaaaaatacaaaaagcctctgatcctgtttgtttattttggcagcctgtttgccgtctgcgctgctattcttcccatgccgatatataccgttgctgaaaagctcgtgatcctttcgatcgccattatttttattacaatttgctgtatcctggcttataaagtgacgaataaaatgctgcagaaataa

SEQ ID NO: 3582 - DNA, 420 bp, Bacillus licheniformis
caaaacatttttatcatttttaaaacacgcagataagcctttcagcggctgggatttttctttcattgaagacacaggacgaatgaaaagcgacctgctttcatggtcatacggaagcatggctctgtctcttatccaggattccgaatcaatgttggatatggggacaggcggcggcgagtttttatccaaattggggccgtttccttcgtcagcatacgctactgaatgttatttgcctaatgtgccagtcgccaaggaacgattgacgcctttaggggttcaggtcgttcaaattgatgatgatgaagatcttccatttgaatccggccaattcgacctgatcatcaataaacacgaatcatattcagtacaagaggtgaggagaatcctttcaaaaggagcacggtttatcagtca

SEQ ID NO: 3583 - DNA, 447 bp, Bacillus licheniformis
atggggatcgcactttttttcggcattttatccatcactgtcttttatgtattccacttgatggcggagcctttcgactcaagaaatgcagaagaaatcatcttgaagcaggcgggagacagtgaaaaaacggtcagcatcaaagacaggcacaacatagccgtcctgcttgatacatttaataaagggaaaagaatgaagaaaaagacagcgcatcacctgccttctccggcgtatcacggatacatcagcatgaccggcacacatcgcgttcacttcaccgtctggctgaagaaagatgaagccgtcatcctgaaagaagaggaaggcacatatttcgttctccaacaaagggaaaaagacgccctcctaggagaattgcaaaaaagggacgcggcaggcgtcccttttagcgggtcaagatttgtttgtcagaatgtcttttaa

SEQ ID NO: 3584 - DNA, 174 bp, Bacillus licheniformis
tctcctataagcagctttgggtaatgtctgcttattccatcaccctcgcaaccgtgttttttgcaattatggacgcgctggaggcggtggttccaagtcagttcctcctgaactggtttgtgaactttatcatgctgtttctcgccattaaagaaacgccggcttctaaagcag

SEQ ID NO: 3585 - DNA, 447 bp, Bacillus licheniformis
atgaaaattcaaaaaagggtccaagctttgctggcaacttcggcaatgtttgcaggactgatgctgtccgatgcggtgtacgctgcggaaaccccttactatggaaagaactatactcagccagagcaagtgtcatcattatatccggagcctgaagaaacattctcaacccctgcttttgtaaaagaaggggaagcctttacgacacaagaagaaatgatgaagtttataaccagtctgacaaagaaaagcccgaatgtcaaaatcgggaatatcggtttttcaattgaaaaaagaaatattcctgtgctttacttcacaaaggacaagcaaatacgttccatatcaaaaaaaccaaccgtctggctgcaaggacagatacatggaaatgagccggcagcgggagaatctgctctggcgatagctgaaaaactggccggaccgtag

SEQ ID NO: 3586 - DNA, 444 bp, Bacillus licheniformis
atgacagcggccggctatgcgatggagaagacgcaggaaagcgaacgtccggatattcactcgtcagttgccgaaattgaagatgttttgcaaacctcaaatgtctatgatcggccatttaccatggaagaactgaaaaacaaattgaatgagtgcgaacaatattctcagacggaggaaggaaagcgtaccattctggctgagtttgaatctaaaatcgagaaagttgccggcattggtccttttctgacccgtctgcacgacatgtacagcagatttacctcggggcgggggacgccgcgtgaattgctgctgatgggcggcgctttgctgtatttcatcgtttctgttgatgtcataccggattatatttttccgatcggctatatcgatgatgcggcagcggttcatttcgttttcaaccagctgtcatataaatcatga

SEQ ID NO: 3587 - DNA, 174 bp, Bacillus licheniformis
acgaagtacctgttcgtgaaaaaacagattcaatttttgtggaagctcaatctgaacgtgaagtcagatctaaattaaaaccatacaactacaatattgagtttatacagcaagttgaaggcgcttttttagaatatgaaaagcaaagcgaaaattttaaagtattggagttat

SEQ ID NO: 3588 - DNA, 444 bp, Bacillus licheniformis
atgtttttgttagaacgtattatagacattctcacactcttccgctgtcggctcgtaaaaacaatgcgatttaaagcggccgacatgcggctgattgtaccactgtgcgggacacgcccccgccggtctgaaataccacaaactgaactttgccggccaaagccgctccccgttgaccgccctgcgtgccaaacgcctttcgctttcccgcgccctttgatagaaataaccgtgcgtcacggcttcaaaggcatgcggctgatggatcatttgcggaatggtgcgaagtcccacaaagtcggaacagtttgccctgatgcgattgattccgacatttccgaccataagcataccttgcacgccctcgccttcagcctccgctctcaaaagtcttgccaaaagactgatatctttagaagaagcctgaacgactgccatttttag

SEQ ID NO: 3589 - DNA, 444 bp, Bacillus licheniformis
atgagtattgaaattgttttattaccagttgcgattgcagcgacccaagcgattgcatcctatttggcagaaaacgaatcaggccgtctttatacaatgcctaccgttatgaaggatgaagaccttctcaaaaaagcgcttgaccaaaatggatgtaagacgatcgagcttggaacaacaaacgtcgaagcaatcatggaagattcagctgtaactttccatttgacagaagaaggcacctttaaagctgcatttgatcgttcagttgataaaaaccaggcgcgggaatttattgatcaaattgaagaggagtacaaacggatattgcagcaggaaacatatttgaaacttatagaaaaggccgaacatgaaggattggttttagaaaatgaaacggtgacaaatgagaattcggtggtattgacgttcaaggtgaatggataa

SEQ ID NO: 3590 - DNA, 138 bp, Bacillus licheniformis
ccacttaacaaatgatgaaagaaacgatatgatttcttatatggataatggggatttacacgtgaagacgatatgtgaagattgtcaagaagcgcttgagcgaaacccggattatcaccaatatcattcatttattca

SEQ ID NO: 3591 - DNA, 441 bp, Bacillus licheniformis
  misc_feature (1)...(441): n = A,T,C or G
atgtctctctctctccttcttaaatttacccactctattctaagatctactccggctgcccctttacatatacctttttttatttggattcaaagttcctccgtcccaaccatctctctatccagcctccccaccatctacctcttcctcgctcctttcacctttccttanccccctctctccctcccacccatttcttctccgacattctggacctcatatccattactcttgtactctaccttatttctagaatcctctacgcctccgctgctcactctctacttagttcatactctcatcctcagtttctacctcctcctcgttctcacaatacagcctccaactctaccgtttccctacttacttcctaccactcatttacaccatttcatcttctcctcttttaatataccacgcattctcttccaattagtataa

SEQ ID NO: 3592 - DNA, 441 bp, Bacillus licheniformis
atggcggggttgttgggagcaatgttagtgtggggggttggttgtaagggactttttgtgggtgtattatgtgaggcgcgaaggggggggatattaggaggggatattaaggggttattggagggggtagaagagagtggattgaggaagtcagttgttatgattaatctgattattattttacgagtgtttcagtgtgggcacgtgggggggtctagtgccggctggccaggcagcgggcatcgggcggagagagaggggaccagtaatttcagagttccagtgattatggggtggggttgttgcatcacgcccacccgggcatcgttccccgaaccatccccagggggaagggtctcccgctcaaaagcgttccaaggcgccattcgagccctcctgcatctccgacagccgcaccttccaaccgcttccattccctag

SEQ ID NO: 3593 - DNA, 206 bp, Bacillus licheniformis
atgtatatgacagcaagggaacaaaaactaatgaaataccttttgcatcaaaaccgttatgtcaaagtcaatgaaattgccggctatatagaagtcagcacaagaacggtccaccgcgagctcaaagcggttaaatccgttctggacaagtacaggcttcagcttgataagcagccgggaaaaggcttaaacggtggagctacaga

SEQ ID NO: 3594 - DNA, 438 bp, Bacillus licheniformis
  misc_feature (1)...(438): n = A,T,C or G
atggtttttgttgatttcattctcaaagaggctgatgattctatcattctgctttacaatcgttcgcaacatggcaacgatgtttcctgcaaatccaatcaaaatgatcatcagtatgatgatgaaccacatggtataacgacaccccttaatatgcaaaattttcctttcgattcaacattaccacctggtctttcacaaaacaactttccttttgaaacggaggctgattttatggattggcttgaatttgtttctgcgatggttcaatcattggcatggccagctgccttgatgatttgcgttttgctgctaaaggagcttttgtccgatcgaatgaaggaattgatcaaactgaaatataaggattttnattggagtttgacaaaaggcttcaggagctcgtctccgtacggaaaaaaaggttatcgggactga

SEQ ID NO: 3595 - DNA, 438 bp, Bacillus licheniformis
atgtttacagtagaccacagcaaaggtgaagcttttgaaccgattaaaccaggagaatacgaagcgacagttatcaactttgaagccaaaacggctgcatccggaaatgagcgccttgtcgtagattatgaaattcgttctgacgttgagcagccatgccagggccagaaaattctatacgacaatttcaccgttacggaaaatgcaatgtggagatttcaccaagcatcaaaggccgcgggttttccaaacggaatgcaatttaaggatcatatcgaatgggccaaggcgtttctgaataaaccggttcgcctgcttgtcggggaaagagaacataacggcaagaaatatccagaagtcaaagcgtttaagccgtcagaagcgccagcaccggaaaccgaaccaattaatatcagtgacgatgatataccgttttga

SEQ ID NO: 3596 - DNA, 417 bp, Bacillus licheniformis
aaggccttttaaacgtaatggaagaagatcaggatgttttgctttactttaatctacttgattacaggttcagagtattaatggaagacgtcgcgggggagccgcagcttccgcctattgctgaagataaggcgaagacagacggtttgttacgatactattactttctctttaaaggaatgtatgaaagtgcgaggagcaactactctaaagcgcttaattgttttagagttgccgagcggcagctctataatgtcgaagatgaaatcgtaaagtccgagtttcattataagcttggaaatctctattattttacggaaacagactctactttcattttcatcatctttcaatcgcaaagagcatttataggggttatgaagaatataagccacagtcgataaactgtacggtgtt

SEQ ID NO: 3597 - DNA, 438 bp, Bacillus licheniformis
  misc_feature (1)...(438): n = A,T,C or G
atgcttttgcttctctgtttgacagcaggtattgtagatgtgattgggtacttaagtatcggtcacgtatttaccgctaatatgaccgggaacatcgtactgttaggattatcaatcggcaattctcttcatgcgaccgccgtgtactcgctgatcgcactgttcggatttatcatcggcgtgattatatcagcagccattgtcggaaaacaggaaaaatcgttctggccgacaggcgtcacgattgcacttgctgtggaagcagccgtattgcttctatntgcctgcctgactttctttgaaagttcgccgcaccttttaatcttgctgttaagcattgcgatggggcttcagactacggcagccagaaagctcggcattgcagggattccactactgtcctancggggacgctggcaaacttnttcgaagatgtga

SEQ ID NO: 3598 - DNA, 438 bp, Bacillus licheniformis
atgatcgtttcatattcgccggtacgggcggaatttttatttccttttggtgcggcattccctttcgcattttcgtttccaggcggtgcattcccgcccttgtttcctttggcgtttttattgcctattggagcgctgggacgaaaaggagcgctcccattcgatttaggagcgctccctttgattttatcttcccatttatctattgctttccacttgcggacggtactgcttgagacgcccaattcatccgcgatgtcttttaatttcttggttccgctgctttctttccataaacggaacgcttcgtcacgtcttggatcacgcggtctggccattacatttcacccacctccgcaacctgaattgagtttgagtttgtttttaaatttcttcatctttctgaagctgtatatcgagctcgatgagcttttttaa

SEQ ID NO: 3599 - DNA, 438 bp, Bacillus licheniformis
atgatccgttccgaagataaaatcacgacttctcaggcaatcgttgtcttggtcagttatattatggcggccgggattctcaccctgccaagaaccgctgtagaagaagccggtacgccggatgtatggatttccgtcctattaggcggacttgtcacaacggcagccggagtggttatgacaaagttaagccagcattatcccgggcaaacattttttcaatacgggggagacattgtcggaaagtggctcagtattgtgatcagcctgcttttcattgagcattttgtagcgattgctgcttttgaagcaagaattctggcggaggtgatcaccttttttttgctgcagcaaacgccgatttgggcgatcgtcatgtcgatgatgtggatcggattctattcaataaaagacggaatggggtcgcttgcccgttag

SEQ ID NO: 3600 - DNA, 435 bp, Bacillus licheniformis
atgccggaaacaatcgatcaaacagctgatcaaacaaacgaatctgtaagccaaagccaacgcgatcttatcgatcaactgctaaaacctgaagtacaggagtctttgactgttttagtcgaccagcttccaaagctgacagaactggtcaacattttgacaaagtcttacgacttcgcacaatccgttgcaactgatgaagtattaaaaaatgatacggtcggtgccattacagaaattcttgagcctgtcaaagatacggcaaaagaaatcgcggctaccgccattgaagcaaaagaccgcgctgacgaaagcaatgaagtcatcggacttttcggtttgctgaaaatgcttaaagatccgcaggcccaaaagctgttccgatttgttcaaagctacctgcaaatcatgtcagaacgcgaaaaacaaaaataa

SEQ ID NO: 3601 - DNA, 435 bp, Bacillus licheniformis
atgtacatcatcagcaagcttgaaagacaaaatgtgaaagtgacagaaataccgaagtggggctcttacttgagaaaaacgtgggaaaaccgttttgccgcaagcatggagcttccggaaagggacgcgatcttggtgagccattttttgtggcatttattcagctatgggatgaagccgtgttttaccggcggacaggccgatcaagcctttagcgaacagccgaagcgcgattgctttttattctaccagcacacggatgacgcctatattcttgaacatgctgaacaactgatagccgcagatctgaaaggagaagaagatgcatatataacggataaacatatgacatggacatatgcggtgacgcatgagtctgcatacggaccgtattttgcaattcagctggatgagaaggagcatgaacctatataa

SEQ ID NO: 3602 - DNA, 235 bp, Bacillus licheniformis
atgatacgaaaggtgatcctttgcatgatgcttgcgcttgtttttcctgcggccggtttgaaagcgaaagaatcatcggctttgcaggaattgacggaactgtcggatacggtattccagctaacaaggcagtctcaatatgaggaagcggtacaaattcttcaatactttgaaaaaaggctgaaagctgcggagaaagactgttcagatgatattgtgacacgctccgaaatcg

SEQ ID NO: 3603 - DNA, 300 bp, Bacillus licheniformis
gcattggggttatacgagcgagtgggggattcagtggatcacagaccagatttgcgatgggaaaggaatcggcaagccggtcgttttagaagagtccggctatcagtataagtccagaagggactacgtctacagaacctggcttgaactcatagaaaagcagagcggtgcgggcagccaattttggattttgaccggcattcaggatgacgggaccctttatccggactatgacggttttcggatcgtttatccgagctctgccgcttctgtcatttcagagcacgcggagcggatgaa

SEQ ID NO: 3604 - DNA, 432 bp, Bacillus licheniformis
atgataatcctcggccgcaacatgtgtcaggatatcatattaccaaaggagcagcctgagaatgttttaagcgccattgaccttattacaaagcttatggatggtcggaaagtaaaagaatttttcacactgttccccccaatcaaatactacactgacgacggaacatggaattatgattccacattagaaaaaatgaatagcttaggcgagcgattcacaagtgatagcttccttgaattactggtgtcacattgctatgaaaatcgttttatcaaacgtttaggagtaggttttatgtctgccactagcgagatttataaaagacaacacggaatgagcgtaatggaaaaatactgtattgaaaacggcatccgtgtttatgaaaagaaaggtaatgaaatcaaacctaaattttatcgagttaaatag

SEQ ID NO: 3605 - DNA, 432 bp, Bacillus licheniformis
atggaaaacaatagaaaggaggcgaacataatgaatgaaaataaaaaggctgaacaggagagaaaaattggatttgaagggtttgtgctccttctttcactgatttttatttccatttttatcacgacagcatacgaaataccgagcaatctgttgctgatcattctatttttcatcggcagcggctactattctattaggctcgtgagcaaaggtctgttgagaaaaaagaggggactcggctttaaagctgcgttttctgcctttgtcgtttggatggcattatcttttttgtttcatgacatttcatatccatttagtttgaaagggttattatttcaaatcatgatgttttttcttttctacattcctttctatttgatctttcaatttgcttttaggttttcaagcattcaagaaagaaaacaataa

SEQ ID NO: 3606 - DNA, 279 bp, Bacillus licheniformis
atggatcaagaaataaaagtgaataccggagaagtcaaacaagcgctctctaaattaaagcattccagccattcaatgaaagcgacgattccgacagatatcaagggccagaatcaccttgatgcgacaaagaagatagaggaactgaatcagacgattaataagatcgcttcttcctatgcctctgctttctcaaaacaagtcgtccaaacggaatcagcagtcgaagcaatgatggacaccgacaaacagctggcttcatcgatgaaaacaaaatag

SEQ ID NO: 3607 - DNA, 143 bp, Bacillus licheniformis
ttggccaaacgaaaagcaaatcatgtaataaatggaatgaacaatgcgaaacgccaaggaaacggcgcgggatatattgaaaatgatcagcacatactcactgaggcggaacgccaaaacaacaaaaaacggaaaaccaatca

SEQ ID NO: 3608 - DNA, 203 bp, Bacillus licheniformis
  misc_feature (1)...(203): n = A,T,C or G
atggatttgaatntgcgccatgccgttattgccaatgtatcagggaactcgcaagaagagcttgaacatacgatcgtcgatgcgatccaaagcggtgaagaaaaaatgcttccgggattgggtgtgttgttcgaggtcatctggcagcacgcaactgaatcagacaaaaccgaaatgctcgagacattggaacaaggattaaa

SEQ ID NO: 3609 - DNA, 332 bp, Bacillus licheniformis
tatctaccggtcggtttattcctccgcgaaagttccggaagcttgacgagccatgaagccatttgtgttttaaattgccatgaagaaaacgcaaacccttgggcgatcaccgtatacttcgaagaccgtccgccgctcgaaggcatttccgagacggttcatggcaagagaacgaagcatatccgcacaagttctttgcaccgatcaggagaacgcattcctgaaaatgttccttatgcgatcgagatcgcaagcgatgtacctgtgatcgtccagtacagccggctggacacgacccagccggaacttgcgttaatgtcaaccatggcata

SEQ ID NO: 3610 - DNA, 222 bp, Bacillus licheniformis
atgccggcaattgtcggaccgatttttatcaggcgagtcgttgatgacagcgcagccttttttggagatgtgtttgcgatttccccgaagtgcacggattcctccggaggaggagcgggcacatttcaaacaggggactacggattgattcataacgatatcaataaaacgaccttcacagatgcggatgtgatggacggttcccagtcattgaacctgtga

SEQ ID NO: 3611 - DNA, 234 bp, Bacillus licheniformis
atgggaaagaaaaaacaagacccaaatacccggcagctgctgaaagatgcactcgccgacgatttgaaacataagcttcagcaaatgaaaagcgaattgaaagaggaggacgagaaaagaaaagagcgtgagaaagaacggcttatcaaggaaagacaggaaagggaaaaaaataaaagctttgaagaactcctcaacgaaagcggacttgacgactggaggaagtataagtaa

SEQ ID NO: 3612 - DNA, 432 bp, Bacillus licheniformis
atgggcaaatgccgtaaaagagcggcttgccggcaatccttattttcggttcatatccaggctgaccggcctgagaccgaaagctgggaaacgactgaagcgtcagcggatgaaggggagtttacagatgaactgaaaatgttcaaaacacctaaaacgttttttcagcaaaatggcaaagcccggcttgtcgaggcgtttactgcaaagctttcggcgatcacggacaattggattcaacgtgaaaagcagacatttttaaaccgctgcaaaacgagcgccggtcaattacagaaagcggctgttctatccgcaaaagctcaactcgaagaacaaaaagaagcatattttcatgaggcgctggagagcgcagagcgcgaaaacattgaaaaagcgcatgccttggcaggcgaatggctccgctcatgttga

SEQ ID NO: 3613 - DNA, 432 bp, Bacillus licheniformis
atgaatatgcgaaatcttattactatcagtaaatggattggcattacaatagcagtaattggcgaagcgataaaaccccttcttgagcttttatttttcactttaatcatttggctcgctattatgatttttggagcaaaggattcctttaaaaacattttttcaaaaggtgttctttcctactatttcaatcttgtaggcagtgtcttagttattgtcttttatctatttggcttaaaagatgctgaaagtcttttttctattccttttttaagaaatttaaacattttttctttaatttcgttatttttttggtgctatttatgtctagaaaagaaagaaaactcactaaaaattaaatactctttttcttttttcatattgtttttattttctattgccatatctattttctccgatattcttgcatag

SEQ ID NO: 3614 - DNA, 262 bp, Bacillus licheniformis
atgagcaaaacgattaaacttaaccatgcagcggttatgaagaagctggaacaagtaagcagcacgcttcaagccgtatctttaaaaagcccgccagccggagcgctcgggcggaacaaccttgattttacgaaaaagtggcttgaacgagaagccgaaatttgcaatatggtcaaacagtataaagaggctgttcgtaaaaacattgaggacacccgctcaaatgtggacacgctgaaggaacaggatgaggcgattgccc

SEQ ID NO: 3615 - DNA, 128 bp, Bacillus licheniformis
atgtctaatattcaaactggcgccgagcgtatgccgcatgacctttcccatcttggcttccttgctggtcagattggtcgtcttattaccatttcaactactccggttatcgctggcgactccttcga

SEQ ID NO: 3616 - DNA, 426 bp, Bacillus licheniformis
atgaataacatggacaaagaaaacactttaaatcgctatgatttggtttcaaattttacgattgataaatcaaagttaaagcaaagccaatatatgttgtcgcttctaaaagaaggccaaagtgttggagttattaccagcgagaaagcatacaagatacaggtagagattatgcaaattctgcaacgattgataggccagtataccaaaggggaaagtatgtcggtgacaacggaaacggcggaagggattatggtttccctcatgtatgcaatagatgcttatgctctccattttgagaaacctgaagagtttatagtacatttacattctgatagtataaaaaatatatatacaaaaggtgtcgcattacttcactgttattttgaagaagctaaacaattatatcaagacgtaaaaaaataa

SEQ ID NO: 3617 - DNA, 423 bp, Bacillus licheniformis
atgctcgccgatatggcgattatgcaccagacgcaaaaatgctactatttatatgaaagctcagacgggcgccggttccttgcaccttcaagcgaatcttacgaatcggtgcaggaagcgattaagatgatgaaaaacgaagaaagcggcactcatttaaaacccattttatccgatgatacgccgattgaagatattcaaaagaatggaaaagaactgatcattcaattttcttcctccgcgaatattgaaaataaacccgaagatgtcttgatggtggaaggccttctattgaccgcgaaagatttcggcttcacaaaagtgaaatttaaaaacgcatccataaccaaggtcggcgcctatgacctgtcgaaatctgtacaggttccgtacgcaccgaatccgatgacgatagaaaactaa

SEQ ID NO: 3618 - DNA, 423 bp, Bacillus licheniformis
atgagcattcagatttccgggtttgacgaagtaatgcgaaacatccaacgtatgggcaatcgggctaattcgttaaaatccggcgcattagatgccggagcaaagcctatctataaaactatggaagataacaacccaagtaaaagatacaagatcgctgtcgaaaaaagtaagtcagacgaagtagtaatcggtcctgaaaaagactttttcacagcgcattttcttgaattcggcacaagcccacaccttataaaactgcgaaaagccaagatacaaacagacggccaagttgtttacggtaaggaagttaaccacccagggcacgctcctcgaccattcgttgagccgtcttttattgcgtctaaggaagatgcgcaacaagagattgttaactacctgagaaggaatttattgccatga

SEQ ID NO: 3619 - DNA, 423 bp, Bacillus licheniformis
atgaaaaagctaaagggtgtgatcaattttaaggaggatgttgtaatgacaaaacaacagcaaaatcagcagcaaaagcagaagcaacaaaaacaaaagcatgagcagctgctcggggccaacatcacagataccgaacttgctcaggaattcggaaacatccagcagcagcttgcccagctggagcaaactgttaatcaaatggggtcacagcagcagggccaaagcggccagcagagctctcaattgagccagggaatcaatcagctgaaacagcaaattcagcagttcagctcccaatctcagcagcaaatgcagcagacggatcagcaaattcagcaaagcattcagcaggctgtccagcagctgaatcaggctctttcaaggatccagacaaaccaggccatgaaccaaatgagccaa

SEQ ID NO: 3620 - DNA, 423 bp, Bacillus licheniformis
atgcattttttgggaagcgaggtattgcaaatgatcggttcaatcctgggagaaacgctggctttagatatcatgaaagttgatttatcgatgaagaaagaatttttggcagagctgaaagcttgccgcaaagagctggaaaaagacaaaacagagttctctgattcgaaaaagacgatcaccgaaccacaactgtcgtctcatacgtggcaaggcagtcttgctgactcctttgaccgtattcgaggtctgatgaagactgcttacaatgacataagcggaaaacagctttctgatgttttaagcaaaatcgatgaacgaatcaaatctttacaagaagatattcactcgctcagccaggaagttcgttctttagagaaaaagattgagaacgcgaagcgggaagcacgagacaaggagtaa

SEQ ID NO: 3621 - DNA, 423 bp, Bacillus licheniformis
atgaatgaaaaacaaccaaagaaaaataaaaacaaaacgctgctcggcggaatcattgtcgctgccgctttaattattggaggattcacggcctccctgttcatcgagaaaatcccgaacggatatgtcggcgtcgtttattccccgaatggcggggtaaaatcggaaacgctggatcaaggctggcatttagtcgggctgtttgacaaagtcacaagatatccggtacggatgcagactgtaaacaatcaggatattcaagtggctacttccgacggcaaaaacatctcaatggacattgcctacaactatgtcgttcagcctgataaagtcgtagaattgtttaataaattcggagcggtcgatattgaatcaatcgaaaacagctacttgaaaacagggctgtgggacgctgcgacatag

SEQ ID NO: 3622 - DNA, 208 bp, Bacillus licheniformis
atggctcaacaatctgtgaaagccaccgtgttcaaggcaaatgccccaagtgaaacgaccaaacagatttacgaagatcaattcgactataaaggaaatgacatcatcgagccgccttatagtttgaaggaattgaaaagcaccgcagagtattcaacgatcctgcagcagtgcatccatgcctataagaccaaatattctcggtttt

SEQ ID NO: 3623 - DNA, 843 bp, Bacillus licheniformis
ttgaaaaacttttggacatacgaagacgaagatccatacaaattaaaaagcatatcagagagagatattcaaaaagctgaaaaaaagttaggtgtgaaacttccggaggaatacaaagcgcttattcttgaacaaaacggcgggtatatcaattttaacgccttcccttctgaacggcctacctcctgggctaaagatcatgtccagtttgactacttattaggcttagggaaaaaggcagggattctcgagagcaaatacatcattaaagaatgggaactgcccgacaacctgatccttattcacggtgacggccatacatggatagcgcttgactacagagaaacgaaagaaaatccgcccgtgcactatttcgattcagaatttgaagagaattataaattagcggattcatttggagaatttctctctaaactttatacagataatcccatggatgatgacgactgccagcttatcgaaggcgtgcatcctgacattccctatgtctatccggaagatgccattacaaaagaagaagctgaacaaattctgactaaaaattcggcagccgagctgcatcagcttaattactaccctattgaaagtattgatgatttaaaatggcttttgacaaaaatgaaaaaatccgctttaaaagcagaccgtgacactggtttggcacttgccggcgctttggaagccgtcatttcttactataaaaatttaacgtttgaggatgaacaaacaagaaggtcagtccgcgatatcttggtgatattagagaagttgaatgactctactgtagacatatacttatcccaaattgacgacttattttaa

SEQ ID NO: 3624 - DNA, 420 bp, Bacillus licheniformis
atgagggccgtcacaggaaaagaccatggaaagagaagccctaaaggggattgcgaaacgccgaaactcagcagtgaacaaatgaatacgataatgtttaatgaggtcttttccttactggtgaatttaagccataggaccgtacagatcagcggaaaggttgacaagagattgagaatgaagcccttcatccaagaaaaccaaggggcaggcccggggaaccccgatattaaaccgaaggcaagcgattcgatcacacagacggcatataatgcggctgcgaacagtccaataaacaaaaccttagcaaaaagcatggctgcgaaaggctgcggcgataagattcgattcagccacactcggtttttcagttcatccttatgcaaaaatactgtgaccgaagagacaagccagggataa

SEQ ID NO: 3625 - DNA, 421 bp, Bacillus licheniformis
  misc_feature (1)...(421): n = A,T,C or G
atgcgagggtttgtcgaccgcctgaggnnntnntntntnnnnnttnnntntnnngnncttttttngnnnnttnnntttggttnnnggnnnnttnnnnnnnnggntnntnngtttnttttnnnngtttnttttggtgttggntttggnngtttttgttgtgtggntggtttgggntgtngnttggtttggtgtttggggggngnttnnttttnttttngngggggtttgtttntttggggnggtgggggttggngnntgttttttttttgnngggtttgttttttnngggtgttgggttttttttgttgggnggtttnnnntttttggnntttggttttggnnttnngtttnngncccnggggggnntnnnggttgtgggggnntgggggtggtttttgntttgnggtggttntttgttgta

SEQ ID NO: 3626 - DNA, 420 bp, Bacillus licheniformis
atggcagtcgaagcggctgatatggcagtcgaagcggctgatatggcagtcgaagcggctgatatggcagtcgaagcggctgatatggcagtcgaagcggctgatatggcagtcgaagcggctgatatggcagtcgaagcggctgatatggcagtcgaagcggctgatatggcagtcgaagcggctgatatggcagtcgaaccggctgatatggcattcgaagcggctgatatggcattcgaagcggctgatatggctctcgatccggctgatatggcagtcgaagcggctgatatagcactcaaagcggctgatatagacgtcgagcccgttgatatgacactcaatgcagggaatatgccggtcgaaccggatgacattggactgctaacagcttcagattgcaggctagccggctga

SEQ ID NO: 3627 - DNA, 242 bp, Bacillus licheniformis
atgtttggttttatttggtcattgatcattggcggaattttgggctggctggccggcctcattatcagacgtgatgtacccggaggaatcattggaaatattattgcgggatttatcggttcatggctcggctcgatgattttggggcgctggggtccggtggtcggcgggtttaatatcataccggccttgatcggggcgatcattttgatcttcatcgtcagcctcgtcatgagaagcat

SEQ ID NO: 3628 - DNA, 156 bp, Bacillus licheniformis
gatgattattattctgtatttaagcgctgcactcatcgctgttagctttcttatgttggtgatctatgtatcaaaaacattaaaatcgcttcaagtcacacttaatcatgtagcatcaacgctggaaggtgtggaaggacaaatgaaaggcatcac

SEQ ID NO: 3629 - DNA, 354 bp, Bacillus licheniformis
aatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcg

SEQ ID NO: 3630 - DNA, 207 bp, Bacillus licheniformis
tttaaatgaattgaaagtttgtcagatggacagggcgcttaaacaaagccttgatggtgatgaattaaagatcataaaggccaagtatctctctccccaaaaaataaaggacattgagatttatatggagatggggttgaaaaaggacaaatgctatcaggtcaaacggcgggccatttacaatcttgcgacagctctcgggataat

SEQ ID NO: 3631 - DNA, 417 bp, Bacillus licheniformis
atgttattaatagcttttgtattcgcgtattttatcaagcagccgatattaagttttgggacactttttcttttcatctacggatttagattttcttctaaaggcattaatgctgaaaaatgcgattattatattaatcaatatagacttatattttgcttcgtcatacctttccttaatttttatatgtattggtcaacgataggaggtaatgcaggattcgggtttacgtttagcccgcttaccctcatgcaaaagctgtctttcttgtcacaagttattttgatattcttaccagaaattcgcaaatttttatctcgaaaaaacttcattcatattgatgaaaagaagcaaaaattagcatcggttttgtatccaattgctttaatcctaacaatttgtatggcatattgttaa

SEQ ID NO: 3632 - DNA, 189 bp, Bacillus licheniformis
ttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaat

SEQ ID NO: 3633 - DNA, 417 bp, Bacillus licheniformis
atgaattggtctatccgccctttccacaacttaatcccatgcatagtatatatggaattttcactaaaaggtggtgctatttatgggctttggttacggcggcggatgctgcggcggctggggtggctaccctggcggatacggcggcggatacggctatggaggcggattcgcgcttgttgtggttctattcattcttttaattatcatcggcgcttgttacgtctgctaaatgaacaggaggggggctttaaagctcccctttcattttgccatttagtttgttcaaatgaaaaagagcagaaaacaaaccgttttctgctctttctcaataataccaataatgcggccaatacccgaagtggcgcaccatctccattctttggcgccggtacggattaccgtatccgtgcttga

SEQ ID NO: 3634 - DNA, 351 bp, Bacillus licheniformis
caaaaggattcatttatcccgctgctgttttcgcagctgtgatttgcatgctctgcgcgagtcactcagccgctttattaacgaatcagcgaacgtttgcacagcaaacaaaagaatttcacattcagcaaaaccttctccaaaatggaattctccatgccttgtcccatattcacgaagagacaaaagaaaaagttcaaaaacagcatggcttgatatcgtattctgtcagcccggctcatcagcagctcacacgagtccagattcaggtaacgacagcttccggcacagaaacaagcgctcaatttcaatatgatttaagaaatcaaaaaatcacgcagtggaaggaat

SEQ ID NO: 3635 - DNA, 414 bp, Bacillus licheniformis
atgaagtctgaaattaaaaagcatttgtttgaacttctgacaaaagaggaaatcgatgtcggttggtgggataaatatttggaattgcttttcgagttccgaaaagaaagagttgaagcactggcagaaaaggcagctcagacgaattcagcagcaggctcagaagctgtatcaaatgaacagccggctgaatccggagaggccttaaagaacgaaagctcaaccaatgtaaacagcaaaaatgaagtcttagacgaattaacagccagctttgaagaaatgaacaataaaattatagaaagcaataataaagtgcttgaagcgatcaaagagtcacttcctgaaaattacacacttccaaatgatactacattaaaattctttcaaacacaaaatgaaaccaaaacagaatag

SEQ ID NO: 3636 - DNA, 129 bp, Bacillus licheniformis
ttgcccgaattgcaaaagcaaaaacatcggcaaaatcggtgtaaatcaatattactgctggggatgctttattgagctgaccctatcaaaaggaaaaatttcgacccatcaagtcgaagaggacggaac

SEQ ID NO: 3637 - DNA, 414 bp, Bacillus licheniformis
atgccgaagtacattaaaaagcctgttgaggttgaggcgtttatatttgccgtagatgatacacctgagtggtttttagaaaaaacaaaaaatagttattgtgaatttcactatgactcgaatggcgtcagatgcatcctcccaacgtcggaaggttcagtaatgattatccgtgcaggagattttgtcataaagggcgtcgagggcgaaatcatcccgtgtgaatcgagtatttttgaaaagacatatgatcgtgtagaccccttgaaaaaagcccgcaaaatggcggagctgtccggaatgcttacgaaaaacggctttgatttcaccgagaaaaaaagcgaaattgacaataacgaaatggcgcgcggtaaattagaatcgttaaaacgtgccttgaagaggggaggataa

SEQ ID NO: 3638 - DNA, 176 bp, Bacillus licheniformis
gtgaatacgcagcgtgcccaggaaatcgtcgaatcacccgatatggttgatgttacttataacggcaggccgatttatattcagcgtgtcgacgaacaaaatgaaaccgcaagaatctttccgctcggccagccggagaacgagcaggaagtgccgctcgcaaatttgaaagaaca

SEQ ID NO: 3639 - DNA, 411 bp, Bacillus licheniformis
atggagctttatatcgaaggtgaattagaagagcataggaagctgccgcaccgaaaagttttgtttgccattttggctgttttgctagggtccgggattaccatcggatatatcgtgtatacgcatttttattcgatgaatcatctgccgaaaggaaattggtttcagtcttccggttcgccgaatcaagcatacaacctgaatttgtatagagtgaacaaaggcgggggaacgaactccccttccgtcagaggggaattgacaacggttgccaccggtgaacgaaagaatatctattggggatacgaagaagaacatgccaaaatcgaatggcaggacaaataccatgtgtccatcaacaacaatgtgctggacgtcagaactgatatatatgatggaagaagagagtga

SEQ ID NO: 3640 - DNA, 411 bp, Bacillus licheniformis
atgcggttattcatatgtgcatcgtgcctgttcggcttgattgttccgtcatttgaaacgaaagcgctgacgtttgaagaattgccggttaaacaagcttcaaaacaatgggaagttcaaatcggtaaagccgaagccggaaacggaatggcgaaaccggaaaaaggagcgtttcatacttatgctgtcgaaatcaaaaacattggacacgatgtggcttcggcggaaatttttgtctatcggaacgagcctaattcttcaacgaaattttcgctttggaacattcctcacgaaaatccggtttctttagccaaaagcttaaatcacggaagctctgtcaagcaccgcaatctgcttatggcagagaatgcgaccgaattggaagtggacatgatttggacggaaaaatga

SEQ ID NO: 3641 - DNA, 166 bp, Bacillus licheniformis
atgtatccccaagcttatatcgattacctcgccgaattccacggggcaagggattattttgagtgccacgaaattctaaaagaccattggaaaaaagaccctcccggcgagcgggaaatacactggggtcggggttgattcagctgggctgtcgcgctctatcatc

SEQ ID NO: 3642 - DNA, 139 bp, Bacillus licheniformis
atgagaaacgtaactttaatggatgtattcacccatccaatcgcacaaaaatatttaactcgttccggtgtagctcatgctgtagcctgcgcctatcactcataccgcctggcggtgcgagctggagtagatcccgata

SEQ ID NO: 3643 - DNA, 160 bp, Bacillus licheniformis
atgcgtcaggaagaaatctacctgtttttagaacgttttttcaccgcaaacggctgcacgatcaccgacaaaagtccaggccacatgaccgtgcagctgacggttgaggtcgataaacaaatcatgaacaggccgttttactggcactggcttaaaagac

SEQ ID NO: 3644 - DNA, 153 bp, Bacillus licheniformis
atagcgtaccattcaacaaagataaaaaagtcatttaaaaggaagcaaaaaaattaggaaaaaaagcttcccatggatgtatcaggcttgcgattccagatgcaaaatggatgtatgaaaacatacctgaaaaaacaaaagctgtgatcagct

SEQ ID NO: 3645 - DNA, 409 bp, Bacillus licheniformis
atgacgcctccgcccggtccgtctctcccccgtccccaggatttctttttgctcttgactccctccctttcggaccctctcttgtcatccgcgcactccttgctccacccccccccttccccccccccccccccccccccaccccctccccttcccttttttgctttgcgtctcctctcatctcttattccctcctcgtccttcctcacaccagctttggctctcacgggcatctcacttcctatatcccctctccagtttctccccttcttctttcacccctctctttccctacaactccattctcatttctccttcctgcgtccatccttccattccctctcccccttcattactctctctcttcttatcccttacatctcatccctcaaattaacaatacataaat

SEQ ID NO: 3646 - DNA, 409 bp, Bacillus licheniformis
atgaaaaccaaaaaacgaagtgggaaagaggttatcatatgtatccaaatcgttatccctacacccccgctcccggctatgcacctgaagatgtatacgccccttatcagccggctgcgcattatgaacagagaatttatgagccttatgaagggcagattattacagctccggcgaatacgagattttggcggagaggaactgaggttttccttcattcgtcaacgattgacccgtacggccgcgaaatgctgtatgtcgtctatccgatcagaagacagaacaacatctgcagcctccgggcagtcgcgatctctgccaatgaatacagaggcatcggtactcaaagaccggaattcgattatgccaaaagaggcttttccccggggaaaagcctcttcgaatgccg

SEQ ID NO: 3647 - DNA, 192 bp, Bacillus licheniformis
gaaacctattactatcaatgatgatcttagttttactggaacgatggagaaaggcaaagtccgcgttattgtggtggatgggaacaacgggacggcgcacgcaatggacgccccggaacacggaaaatcaattattcaaacggtaaaaggcacatttaaacgtgttgattttgaaataggtctaaaagtcga

SEQ ID NO: 3648 - DNA, 405 bp, Bacillus licheniformis
atggcgatgacaaggttcggcgagcggctcaaagagctgagggaacaaagaagcctgtcggttaatcagcatgccatgtatgccggtgtgagcgccgcagccatttccagaatcgaaaacggccaccgcggcgttcccaagcccgcgacgatcagaaaattggccgaggctctgaaaatgccgtacgagcagctcatggatattgccggttatatgagagctgacgagattcgcgaacagccgcgcggctatgtcacgatgcaggagatcgcggccaagcacggcgtcgaagacctgtggctgtttaaacccgagaaatgggactgtttgtcccgcgaagacctgctcaacctcgaacagtattttcattttttggttaatgaagcgaagaagcgccaatcataa

SEQ ID NO: 3649 - DNA, 405 bp, Bacillus licheniformis
atgaaaatgagaaaaggcccttcagtagcaatgagagtagagggagaacttgaaatcaaaataaatgaaattacatattttaaagaaaatatcgccttattggaattttatgtttctttaaatgagtggattaaaaagaacaagaaaaaaaacaaagttacggagtatagatattacacaatggagtatgaaaagggcgaacccattatttcattgataccatttgattataaggctcgactaacgaccatttgggaaactcaacaattatataatgtattcgaccttgattacatcaccgaacaaatggaaatttcacgcaaaaaacttggacgtgatattgaacatcattataggatttcattgaaaagctttgttggtaagatcccattaagaaaatattga

SEQ ID NO: 3650 - DNA, 405 bp, Bacillus licheniformis
atgcagaccgcgaaaaatgtctgcatgacattcgccgtttacggtcaagctaacgtatgtacaatacatgcggagcgaatagaaatgaaaaaacgatattgcacgtactttttttgcatattaacacttttatcattcccggcgaaaggccactttcaaacagatgttttcgatgcacctgaacggtgggaaagaatcgcctggagcgcgcttgaagaaaaatacaaaggcgcaaagctcgaggattatgaatatttagggcgcacacaagtaaatgatgaagagacaaaggatgtcttcagggtaaccgtcaatcaagaaggcaaatcattttcggcgcacgccgaggtgtattttcatccggtgaccaatgcgatcatcaatgtcaatatttttcccttatag

SEQ ID NO: 3651 - DNA, 405 bp, Bacillus licheniformis
atgatcacgtataatggaccggttgaagaaccaattgaaaacccgaatgatgattttataagaagtattgtatttgaaaaaggcgaggattattggaagcaaggaagcggggattcatgttttgaagtagagggctgtgatgaatggttaattttcttttatgatgaaccatatgggttctttataatgagacatccagactacctcgttccaatgaataaaaatgttgaaatagaaacggtggaacatttagtaggtggggagccaatgaagattccgtcttgcagctatgtagatcgtggtttagcttaccgtataattaatgagtttactaccactaaatcaatgccgacttttatagaatgggtagatttgtatgaaatagactttgaccatggattttga

SEQ ID NO: 3652 - DNA, 303 bp, Bacillus licheniformis
gtgttggaaagcatgcttgcgatgaagagggccggtgcggatcttattgttacatattttgcaaaagatatagcaaaatttcttcgggaggaatcatgaaacgggcagcgatcatattcattcgattctaccaaaaggcgatatcccctcttttcccgccgacttgcagattttatccaacatgctccaactatgggcttgaagcgattcaaaggttcgggtttatcaaaggcagttatctgcttattaaacgattactgaaatgccaccctcttcatccgggaggctttgatcctgttccaa

SEQ ID NO: 3653 - DNA, 111 bp, Bacillus licheniformis
ctaaaggtaaaaaacgttctggcgctcgccctggtcgtccgcagccgttgcgaggtactaaaggcaagcgtaaaggcgctcgtctttggtatgtaggtggtcaacaatttt

SEQ ID NO: 3654 - DNA, 402 bp, Bacillus licheniformis
atgaaaataataacaaaaaaaggagagatgatgatgggaattgaaaaggttggacaaatcggggtgccggttcaagacttggagcgggctgcggcattttatcaggatgtattgggcctgtcccttttatttcagacagatcgcatggctttctttgagtgcggcgaagtgcggcttcttctcagccttccggaaaaagacgaatttgctcatgcaggctccgtcatttattttcaagttgaagatttgccggctgtatatgatgaaattgcaacaaaaggcgtctcttttccaatagagccgcatgtggtggcgaaaatcgagcaaacggaaacctgggtggccttctttgaagataccgaaggaaataccctagctttgatgagtgaggtgaacatataa

SEQ ID NO: 3655 - DNA, 402 bp, Bacillus licheniformis
atggagggatggagaattagtcttcttgaaaaagaaaggacgatttttgtcgatgcagacgcatgcccggtgaaagatgaagtgctcaaaacagcggcggatttcgacgtaaaggtggtattcgtggcttcattcgagcattttcaaatcacaaggaaagaagaagagaattggacatatgtcgatccgcacaaagaagcagcggatctgtacattgccaaccatgttcgacctggtgatgtcgtcgtcacacaagatatcgggctggaatcgcttttgcttggcaaaaaggtctatgtgatgccggacagaggctatattttcgaacacaactgcgtcgatgatgctattttgcgccgacccgtttcccaccaattgccaacaagtggtcgttccctctaa

SEQ ID NO: 3656 - DNA, 399 bp, Bacillus licheniformis
atgagaaatggcgtttgggcactatacaatgataaagagtacgagattattcagcatgatcaagaaaactacgaattatttaccaaagatcctgaggcaattcaatttggttttattttagatgaaactggacattattgtaaacaagttcgaagagaacatatttcttcagtttatgatgtaagataccaagcaattattaatgatcttgagtttcctgtttttcgtgaggaagacaataggctcttaattggaagtgggctacatggcccggacattatcaaaaaatatggatttgttcaagttgatcgatttgaatatgaaaaatgggtaggaaaaagtgaagttgaaaaaattgaagaagttaaagtacctatgtggggttttcccgccccgtga

SEQ ID NO: 3657 - DNA, 399 bp, Bacillus licheniformis
atgaaatttgaaatagaaatgcagggctttaaagaattagattcatatttatcctcactcgcaaggaaggatgaaaaaataaataaagctactgtaaaagctgggggcgctgttcttgcgaaggaaattaaaaagaatgctccccgttccaatattggggggagccatccccacattgatgaagatattatcgttggtaatcgtacgagaaaggaccccgatggtgagatatatgcagtggttggtcctacaaaagatacgaagttccgtgtccacttgcctgaattcggaaccattcatcagccggctaacccgtctattcagcggagtatgctaagtgccaatgagaggatgcttcaggcgatggcaagcgttataaaaagagggtacaagctatga

SEQ ID NO: 3658 - DNA, 399 bp, Bacillus licheniformis
atgaaacatttcattatttgctgcatatcggttatattcgtttttttcgcccactttctcggcatttcgatcctgtttcatctgtcgggcgcgttttaccaaacagtcggatcattgctgctgtttacgctttgttataccggactgacctttgtcctggaaccggctgaaaaggtgctcatccacagtatgaaactgctgggcatcaatcggcggatcacggtttttgccgctgaaatgatcacgatcggatgtttatgggccgccatttataccgcggacgaattgctggacgacgttctgctgacaacctcggcggaaatcatgattgccgtttcgttttttacaattgataaaatcctttatccgcggcagaggtccggttcgctcttatattga

SEQ ID NO: 3659 - DNA, 399 bp, Bacillus licheniformis
atggaggtttttgacgtgaatattttcatatcgtttgatgccgaggctgatatgggctacattgctttaacggaaaggcgggccggatcggtatcagcaacagatgatatcggcgacacggctttgtctgcagactttgaccgccatcagcggatcatcggtgtcgaatttccgggggacgaggctccggaaatcgcgcggcttggaacgctgaccggcagaaaatataaacttgaaccggcttacctaaacgggacgcacgttcggcggtttcgaccgacggcacaggaagcggtcaaaacactttgtgtgaacggtgttcaattttattttgccgatcatgacggacggcacttcatcggctttgatgtgatggagcgagcgaaaaaaagcgaatga

SEQ ID NO: 3660 - DNA, 147 bp, Bacillus licheniformis
aaacaagcaaaaactccctcaagttcctgatcagtataagcgagaagctgacggagtgtatgaggaatattcagcagaactcgccgatcaggatgaccgcgaagcacaagcccgcatgcaggcagctgataagcgcgcgaaaaagcg

SEQ ID NO: 3661 - DNA, 395 bp, Bacillus licheniformis
atgactagattacactttttcattctcgttgtgattgtcactctatcaagcttttcacaagggatgctccttccggacctgtctggtgttccccaacaggaacgcgcttacggtgccctgatcggacttcatgccactggccctctcttccgcgtctctcgcccctcactcttcacctgtcctcccccctcacgcggacccccgccccacccccccgcttggccgcccgccccgctccttccgctccgccctctcgtcctctccccctcgcccttccggggccccccccccccccccgctgccccctgttcgtcccccccccccctctaccttccctcacctcaccgcgctctccaccccctgtcctccaccccacttcactcctaccccacata

SEQ ID NO: 3662 - DNA, 134 bp, Bacillus licheniformis
atgaacgtatcatacttaagaaattgttttgccgagatgaaacagtatgagacagactgcatgaacaaactgatggatttcgctaagtttttgtatatccagggacatctgacattaaacgaatttcgcacaag

SEQ ID NO: 3663 - DNA, 168 bp, Bacillus licheniformis
ttcttccatcagtgaagatagataacacgctcgcagacgctttgtatttggccggctctgcggcattcaccatcattacgtctgtggtcgcttggttcaaaaataactatgtcactggcaaaggaaagcagcaaaaagaagttctaaaacaaaaagggttaacgaaat

SEQ ID NO: 3664 - DNA, 297 bp, Bacillus licheniformis
tatcaacagagtatcccgtattgcatgcgattctgtgcacaaaaaccgattactgggttcaaaacttttctgaactgtggaagacgctgaggcaggaccgcgaacagctgcaggatgcatttcatattgccggcgatactgtccatattgagcttggggtgggagactcgcacaataaaggacagatggcagccatccttacatattccgatggaaaaaagattgtctataaaccgagaagccatgatgttgacgacgcatttcagcttcttctatcatggatcaatgaccgaaatt

SEQ ID NO: 3665 - DNA, 360 bp, Bacillus licheniformis
accaatgggagccgtccggatgaccgggcgcgggaaattcgtgaataaaaacgcacagcggtatttagcttataaggatttcataaagctgcacgcacagaagcagatgaaaggacagcagctttataccggtcctactgtagtaaaggtgcttttctccatgccgattccaaaaagttggtcaaagaaaaagcaacaggaggccatttcaacggtacacatcaaaaagccggacatcgacaatttagtaaaaggtgttttcgacgctctgaataaaacagcgtggcatgatgataaccaagttttcatggtcataggagccaaagtttacggaaaagaacccgggatcgaggttcaaat

SEQ ID NO: 3666 - DNA, 393 bp, Bacillus licheniformis
atgtctaaccatgctgctaaaatctcttctttggaaaaagatatttcttctttatctcacaatataaaggatacccaaagcaaaatcgctgaactgaaaaaagcaaaaacagctattaccggtgaacttcacaccctttcaaacaatgccactctcatcaatcagccagatattacatcacatatatggaatggcagacatacaaagcaatttatcaatattagatcaaacattgcacacagctatcaaaatatacagagagaaacagatggtctgatttcgcatattgagcaagagattgaaaatcttgaaatgcaaatttctaatatggagatgtttctaagtatacaaaaacaacagcttacagatataaaaaaacaagtcaatcattga

SEQ ID NO: 3667 - DNA, 393 bp, Bacillus licheniformis
atgccgagacctgcaaaatccgcagcccttcaattaatacagggcaatccaaataaaaagaatacgaaagagcttgcagccagggccaaacatgaaaaaaagttgaaaatgcgctctgaaaatatcaaaccgcctacctggctggataaggtggctaaaaaagaatttaagcggattgctgctttattatctgaggtggaaattatgacggaggcggatatcagcatgttagccgcctattgtaatgcctattctcagtacatttctattacaaaaattattgaggaagacggcatcatgattcatacagagggtcaaggtgaaaacgggaagccggtcaagttgattggagaagagcatcccctactaaaagacagaaaaattctagttagg

SEQ ID NO: 3668 - DNA, 393 bp, Bacillus licheniformis
atgcggaaaacacttgaggtcaaaaagctgattgagcggaaaaaagcggaatctgtagctgaagccgtacaaaaggtagatttgagccgaagcgctttttataagtacagagatgcggtttttcctttttatacgatggtcaaggaacagattatcacgcttttttttcatttggaggaccgctcaggaacgctgtcccatctgctgcaagtggtagctgaatcgggctgcaatgtgctgtcgatccaccagaccatccctcttcaaggaagagcgaatgtcacgctctctgtcagtacgagaggcatggatgaaaatatcgatttgctgatgaacaaattaagaaagctggaattcgtagaaaaggtcgaaatactaggttcgggcgcttaa

SEQ ID NO: 3669 - DNA, 393 bp, Bacillus licheniformis
atgcgaggccaattcgagcatttggcgcgggaggcgctacaacggaaagcttacgcgatgcagaaagaaagtgaactaaccggcaacgcaccgataccacacgacttatggcggcggttggttcctatcgcgagagaatacgagaaaggtaacggagccatggcgcaattgtatacgtaccttctggcgcacgtgaacgggcaggccgagaacgaacggtatatgagcgcgttcccttcggtggataagatcgccgaggatacgggaatagggcgcaacaggatagcgcggttggctaacgtgttggaggctgttggatactggagaaagcgtttgttttttcttcgaataagcgcgagaagttgtattatccgcaatattatagcgggctaa

SEQ ID NO: 3670 - DNA, 192 bp, Bacillus licheniformis
aattaatgaaggaaagaagcgtcgatttgagcggacagacggtcggcatcagccacggagatgacgaagagacggccgaagaagtcaaacggatgatcgaagccgaattccagccggaggagatcgtcgtcaacatgatcggttcagcggtcggcgcccacgccggacccggaacattggcggtcttttttc

SEQ ID NO: 3671 - DNA, 528 bp, Bacillus licheniformis
tggtgttgggttgagttttcgtcaaaatttttttaaggatttagatgtaattaagcaggatgttgattttttagagattatttctgaaaggtatttcgataaaaagaatgaagaggaattgaatactattagaaattattttcccttaattccacacggactttctctttcaataggaacttatgaacctttatctaaaaaaaaggaaaaacaaatatccaatttgttggcagaattacaaattaatagctatacagatcatttagcaatgagtagtgtaaaagatatcgaattactcgatttttttccagtaatgtataaagaagaaacttttgagtttttaataaacaaatatgatcaattgaaaaaaggaagattaaaaaatttgtatttagaaaatataacttatacctttaattggcataacaatgatttttcagagttggatttttggtataaattgcttaatgaaacaaacataggtatgttgctagatgtatcaaatttatatataaatagtataaatca

SEQ ID NO: 3672 - DNA, 393 bp, Bacillus licheniformis
atgctgaccacctgttattataagagctcagataattcggaagattttgcgcccctttttcttcgggtttggaacttgggggacgattatggattactcagagcgaaggaatgcgacaaactgcctctatctattgacggacacaccgacttgcagatgaacccctcgcgccgaagcgccatgaccgccattgcggcggttcatcgtcgccgatatcggacttgcatgcggctgagcacggactgtaaggctctgccgaagcggcacaccgacttagtgatgaagttcaatgaaggcgtttacgtccacctcaatgtgaatcccgtgctgattccgatcgatgacggactgaccgtgtatgaaaggcgagagctactatgcacatcagtctga

SEQ ID NO: 3673 - DNA, 390 bp, Bacillus licheniformis
atgagcttgaagcggatattgcacatgacaggcatttttttgattgcagcggcagtcattctgtccggattcattatcagtgatgtcgcctatgatccgtttatggaggattcgcagtcgatgcttttcttcacgatcggcacatacctcaccactccgtttttttgcttcatcggcggattcattttgctaggcatcggcaagttgatcgacttgcaggagaaacacaatgccatagtggccgagcggctcgacatcatttgccaaaacggtacagcgggcgaacatgcacgcgaagaaaacgaggccgcccaacttaccgcccgcacggttgaaacagattcattcactcttcctgcagccgaggatcgaaaatattggaacggctga

SEQ ID NO: 3674 - DNA, 389 bp, Bacillus licheniformis
atgaacaaggacaaattccaaacaacagatagcaaaagtcgtgtaaccttcgtaaatgagttattaaaaagagaagattttgatttacaaaaagtagcggatgttcttgaaatgaactattctacctttactaaactgatgcaagaagacgattatgtttatattaaacgggaaaaccagtattacaaatttgttcgtgacgaaagccagatatttactatttctgaccaaactgattctgagatggattatattaaagcgaatttttcccttctaaagagcataatagaacgatataaacacaaagatgacttcattattgataagcgtattttccgatctacctctaaaacctccagtaaaaacttcccgtatgccagacgcaccaa

SEQ ID NO: 3675 - DNA, 387 bp, Bacillus licheniformis
atgagggatatgtttgaggcgatgaaagaggatattttttcgccgcttgatatagatagcagcgggaaaaagccagaagcgtactggtatgtgctgcgcttttatcatcatttgcaacagaacagcggcgattttgcgattatcatcaacagaagatatgagctgaacattaaggagctgctcaatgatttttggaatgacagctttttgacgggaatcaaaaaaacggcagctgctgatactgaccgctcagtgcctctcgacattcagcggcggtttgtgatttccgcctttgcgggcacagccgcatggtggcttgaaaacggcatgccttatccgcccgaattgatggctgaatcgatgatcaagatcatccaaaaaaattga

SEQ ID NO: 3676 - DNA, 389 bp, Bacillus licheniformis
atgatcagaaaactattcactatcatcatcatggcaagtatcatcgcggtcggattcgtctgcaaagattcctggctcgacgtcatcagggacggaggcgtttattcggtattattcagcatgctgcttgtggcggcctgtgtatttttcccgatcgtcccgtttgcgctcattgccggattaaacggcgccttgttcggaatcgcaaacggcgtgctgatcacgctgacggggtctatgctcggcaccatgctcttgtttttcctctcacgttacggattcagagacatggctcgcagacacttaacgaaatacccgaaaatgagcgaatatgaagcgtattttaaccaaaagcttttacagccgtacatgggcagtgctatccgacg

SEQ ID NO: 3677 - DNA, 387 bp, Bacillus licheniformis
atgttgactctagaggatcccctttggatctacatccaaggatcattacggcaattgttcttggtgttatcgtcggaagctttgctccgctttggttcgtcaaaacggcagctactttcaatgatatttttggaagcttcattaaatttgtcattccttttattattatcgcttttattattcccggcatcggacaaatcggcagcggcgccggaaaaatcctcggcattacggcaggtatcgcctacacgtcaaccatttttgcaggcctcctggcgtaccttgtcggttcaaaccttcttcccgcgatcatttccggccatcagctgcaggagtttaaaaatccggaagaagtacggcaagcaggaattttcaccatggatatga

SEQ ID NO: 3678 - DNA, 450 bp, Bacillus licheniformis
ggaagacctgcagctcttgtcatgcaatcgagcggccctccattggctgaacatcttgcgcggctgggaaagcatcggcagcgaagccgtgccgagacccgtccgagccgtctgcacgcgcgcagcggatgaaactacagctccggcaaaaacggtcatctcgattccaggccattcctgcctatccattaaagcgagccgtttatacggatttggaccgtcaggccagatcgccgtttcatttgagcctgcttcacccgcagaaaccattccgctgaatacggaaagctacagcctgtccgaccggggaaaaaacatcgcttaccgggtcatccgccgactatcaacaaaagccatcggagacgaatgccatatatcggcttacactgttcaagaccacttgaaatcgttttttttgaagacgggcgcaggaaaccggagggagctgat

SEQ ID NO: 3679 - DNA, 206 bp, Bacillus licheniformis
atgtccgcgctgcgacttaaaaaaagcggaaaccgtcagcaaatcacccgttgaaggagcctgggaagtctatcaatgccagcactgctttttcacttggaggtcatcagagccggagacgatcacaaatcctgaaaaatacaatccggcctttaaaatcgatcccgctgaagttgaaacagctgtacaagtgccggcgattccag

SEQ ID NO: 3680 - DNA, 168 bp, Bacillus licheniformis
tcgatctcacgagcagcgagattctcagttcccagcaggcatgtgaagagtgggggattgattcgtctacgctccgaaagagagcgcatgattttcctgcgggaacaatcagaaagttcgggacaacctatgccgtgacaagagcgggcatgtgtgccgtatttggac

SEQ ID NO: 3681 - DNA, 384 bp, Bacillus licheniformis
atgatctgggaaaaaacagttttatacgggctgcaaggtacacttctcatcaaaaaacaacagctcgaacaactgaaaaattgccaaactgaattagaagcagataaaaaggaatttgacgattcaaaagacagtatcaaaaagcccgaactgtcgccgacgacatggcagggcagcctggctgattcttttaaaaacgtcagaagcgacatgaaaacggcatataatgatatttgcggaaagcagctaaatgaagtgtttaaacaattaaaggagaaaatctcttctttaaatgatgatattgattcgctaggtaaggatatcagctcattaaaaacgaaaatcgaaaaactggaaaaagaagaaagagaagcccgccgctaa

SEQ ID NO: 3682 - DNA, 225 bp, Bacillus licheniformis
gtttgccggaggtgacaggcgtccctttgaccgtgttaatcgagtggcatgaagaggtgctgaagatgttgaaacacaccgctaaaggcttttcggaaaaagacttgctgaagaaggttccgtatgagggagggttttcgacgatccgctgggggatctggcatatgtctgatcataaccgctatcaccaggcgcatattcaggcttgcttaaaagagttccgca

SEQ ID NO: 3683 - DNA, 384 bp, Bacillus licheniformis
atgggaacacatcaagagcctagtactgtagaagattccaaagcattcatccaatttgcatcacaaactccagaatttcaaacttacaatcagttaaatcaggatggacaagtacatactgcaggccttattggtggatctctaaaagccataaaagcatttggatgggtttgcagagttgggggaaaaactcttaaatgggcgattagaccactctctccttctaaagcgagactcgtcgacaaatatgcacgtaaaattgcatatgccacagaaagattaaatagtgcttcaaaaggcgctcttgtaaaagccttagtgaaagccggagttcctaaaaaaacagcagattcccttgcggaaatcatcttatggctcgtataa

SEQ ID NO: 3684 - DNA, 348 bp, Bacillus licheniformis
taagggagtgcaaggcctatgggtgtaaggcccttacccgagagggctactgccctgaccataagcacgtccagcaggaggaaacgaaacattacaacaaacattcaagaaacaaaacattaacaagtttttataaatcaacagattggaaacgaacaagagaacttgttttgcttcgagacaatcgtctttgccagcgatgcttgagagaacatcgattcactcctgccgacatggtccatcatattgtggaggtgaagcaggactggtccaagcgtttagacttttcaaaccttgaaagtctctgcaatgcttgccataacaaggttcacggcgaccgaagcaagt

SEQ ID NO: 3685 - DNA, 198 bp, Bacillus licheniformis
aaactgccattgaaatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacaggcagc

SEQ ID NO: 3686 - DNA, 381 bp, Bacillus licheniformis
atgttttttttcgtatgtccaatgtgtgaatcatcattggagccaattgactgccgcccaacaatcccatatcctgggaaccatcacatagggaaagagatgatggttatgaagtggttaggtaaaagtttagttgcttcatcattactggcgggtatccttgctgtttcgggaagtcccatgcatgtacaggcccaggagctctcgaagactgaaaatctctcttctcacgcatttgcacaaggaatcatcgcccctcaggcgatcgtcatcaacaggcagatgagagtcggacaggaggatcaatacgtcggcatttcgaacgtctcctacagcggcacgccattaccgtcagaatcacttcggaccgcgtatacgtaa

SEQ ID NO: 3687 - DNA, 381 bp, Bacillus licheniformis
atgaatcaactagaaggtcaagtgaacaatatttcgaacatggtatccatgaacaatgtcggctggcgtgaaaaggtaaatgtcatcttaaaaagaatcgcgaaaaactggaccggtgtcgagccataccgaagcgtcatgaatcttagttatgagcgtttggaacagcgggcaggctgtaaactcgacatccgtttgaacaatcgaaaagaacgcgcgctatcgcaaggcatgtccaaaacttatgtaaagaaaatcaacaaattagacgtgatcgcagaggaaaagcgcttagttgaaatctacatccaaatagtcaaggaaatggctattcaattcaaagtaaacatcaatgactttaaacttgatgaagttgtttaa

SEQ ID NO: 3688 - DNA, 381 bp, Bacillus licheniformis
atgaaattcagcaaaatcggtgccttactgctcactttggcgtgtttgcttttgcctttttcttcggcgactgcagcaggtgccggtgtatgggataatatcggcacatacggcatgacgtcgcaaactccgatcatcaaatcaagcggaggggaattttattttcacaacaacagcttttacggctttacatttacgctgtatgaagttgacggggcgggaagcacgcctgaaatcgcaagaaaaaatttctacgtcggaccgaaaagcaacagtccggcgatcgatgtcagcagttttgcagatggtgcgaataaacaagcagaactcgtcctgtttaaagggaatgatacatatatcaccgttacttgttatgattga

SEQ ID NO: 3689 - DNA, 381 bp, Bacillus licheniformis
atgactggggatggtatacgtaaaaaggaggttgaccctttgtttagaagaagatctggcatccatcccgctgtattagttttaggatcagctgcattaaccgcggctttttctcccgaaatccgcaaaagattgaccggcatgttcgcgaatggcatgagaggacggcagcaaggaagcggccgcaatcagacgatgatgaatccggctgacatgatcaagcaggcttttaatccgggaggacaatcacatgaacaccgccagtcaggccatacggcaaatgaccagcatcaatcaagccatatgactgctccggtgaatgtcatgaacgatcaggctgcagctcagacgatgttcgatgacgatcaaagctattcataa

SEQ ID NO: 3690 - DNA, 381 bp, Bacillus licheniformis
atgaaaaatcatttgtatgagaaaaaaaagaggaaacctttgactcggacaattaaagcgacgctcgccgtgttgacaatgtccatcgctttggtgggaggcgctacggtgccttcatttgcatgggtgaatccgggttatcactaccagtacccatcggaaggtggtacatggaggtatggattcgtaaacgccgggctccgttcagagtacaaccacccgacaaaggtccacggctcgacagtgcaaaagctcatcgatggaaaagtggataaaacgaatagaagtattgatacggctgcgggccgctactctaatgcctatgtcggagccataaactcacctggtcttaagggtcgttactactatcgcaccatctaa

SEQ ID NO: 3691 - DNA, 381 bp, Bacillus licheniformis
atgtcggcagcccttttccagaaagaagcggaaggagggggaaaaatgagtctcaaacgttccgcggtcaatgttctggtttggctcgccgcattgaccgcagggttagcattcgttgtattggcccagtccaatgcaaaaaaaatcttgctggcgtgtctaattttgattgcgctggctgtgatcgttgtgctccggaagtatttgtcgtccgagcaattgctgatgcccgtattatatctgctcatcgctgcaacttttgccaacaatgctttttttgcgattaaattgggctttttcagcctgtttccatatcgaatacttctgattctggcaggattcttattcatagcggaaaggttgaaaagcagccagcacctc

SEQ ID NO: 3692 - DNA, 381 bp, Bacillus licheniformis
atggttccctgtcgatacagtgtttccgacagccgccaagaagccagtcatcgggtcaagtccgagcagggttccggcgcagcttgcataatagctccgcatatcaacgcacaaaaccgaacgcgacggatattgactgtaatccatactctccctccagaagaactgatgttcgcacaattagtgtatgaatactatactccgaatatacgttcgatttccaggcgtaattttatccaaagaaaatcctggcggaaagcaataaaaaacaccttctttggaaagaaggtgacatggttgaccattccagttcggaatttcgccttattcagtttgatgattcaaattgaatgctctcttgagaacatcagtttttcttag

SEQ ID NO: 3693 - DNA, 381 bp, Bacillus licheniformis
atgaacattcagctcattccgttttattttgtcactgaatgggtgcaaatgtatcagcagagcggctttgattggtttttttggaattccgtcaagcttacattttttaatgttttattgctcattcctttaggtgtgtatctttccgttctatggagaaaaacttcgcttaaaaaagcggcagtttttgtttttttgacgagctttttgattgagagtctccagcttgtgctgtctgtgacaggattaataatggcgagaacctttaatgtggatgatttaattttaaatacggccggcggtgtaatcggtttctgcctgacgtctttcatgttcggagctaaaggatcagattcccgcaggaaaggtctgcatttttga

SEQ ID NO: 3694 - DNA, 381 bp, Bacillus licheniformis
atgaatgaacaggcgaacaaatttgctttcagcctattcttcacaccggaaactcccgccacactgttattcaatccatcaaggaataccgcaccggccccgtgcacaaagcccaggatctgctcccacaagcctaagaccattggctcggctgcccccagatttcactttgaaatgattccacaagaaagccgcccgggggaaaaaaatgagttacactcttgcttccccttgcctgccccagaacccactttgattgtgaccccccccccattgaaaggacctccctcgtttgaattgttgggggatctgtcctcaaataccaacaacgcttttcatctcacacctctcctggcccaaacctcccaacggggggattaa

SEQ ID NO: 3695 - DNA, 380 bp, Bacillus licheniformis
  misc_feature (1)...(380): n = A,T,C or G
atggtgttaacaatcgtttctgagacagggggtaagatgttgtttgctccggaagccattctccgtacgtggagaaaatttgactcttttccgatggaaacgctgacaaaagcatggttttatcatcaggcaggagatgggagacagcgggaagtatcgatgatgaaggagcactatcaagagtacgggattgccggcaattgttttgacctttcgatttggctgctggatgagttcacaaaagacggagtggaagcttttccaatcggccgttcgttcaaaacggaacgcgcgcatgccgcagtcatcgccttgatgaaagaggccggcgctttttgtgtgatttgggagaccaagtgcnntgcatccgattacttaag

SEQ ID NO: 3696 - DNA, 223 bp, Bacillus licheniformis
atgaagcatgagaaagaacgaattttaaaattggtcgaggaaggaaagctgtctgcaaaagaggcgctgatcctgatcgaaaaacttgaagaagactacaaggaaaccgagagcaaggtgacagccctgtctggagatgtcattgattcggaggacttctacagcgaaaagaaaaagacccgaagccttcgatcggttcaaaactgttcgaatggatggataa

SEQ ID NO: 3697 - DNA, 129 bp, Bacillus licheniformis
tggcagttactgtcgtggatgaactgcttgatatctacaatgactataaagtattgtatgaaatgtttcaggatgcggaatataaagatatgatggagtttgtgttaagcagcctgaaagaatatttca

SEQ ID NO: 3698 - DNA, 238 bp, Bacillus licheniformis
atggatgtgacttatgatggaaaggatcataatgaattatcgccgaatgtcggcgtttccagggaagaatcggccccgcatgtagagcatgcatatgccggtttttggatcaggctgtttgcttttctgcttgacggggttgttatcggcagcatcaacaacttagcggtttcacccgttttcagcttgctgaacgtccctaaagaatcagggttattgaccttttcggtctattctt

SEQ ID NO: 3699 - DNA, 378 bp, Bacillus licheniformis
atgatgctgggcatcggaatcacgatttactgtctgttttttgaacatagcaaactgagcgaactgacttcagacggggaatgggagctctcgtattctaaagaaaggggagatcaatattggaatggctatgtttcgaagaaaacgagtgaagatgcggagttaaagagagtcgtgttttttgtgaatggaaaagagacggttgattacgaaaaggatgagcaagaggaaggcggaacacattctgatatagtcaatgttgtctggttaggtgatgccccagaaaaaagtgagcaatttgaagctgtcgtggaaaggaaccagaatggtgaatatcataaggagaggattaaactgacagcaaaaaacgggttataa

SEQ ID NO: 3700 - DNA, 378 bp, Bacillus licheniformis
atgttgaaaaaggctgtgttgatagccgctgttttcttgctggccgcatttgccgggagtacagaagcctttgctatgccttccaaaggcgcggtgaaattcaggacggatgccaatacatatacgaaatcagccacttcgatcgttgtcactggaaaaagccctgttacgggaacgatgattgccgtcaggctgatcaataaaaaagggactgtcctgatctatcgagatgttcatttaacgcgcggaaagcctcattttcgggtgagctttccgacgaaaaagctgaaaccgggcaagtatgacgtctgggtggatgccgtcaaaggaaagaagtggcacggggaattgaagcgctacattgtcatcaagcattga

SEQ ID NO: 3701 - DNA, 375 bp, Bacillus licheniformis
atgttgaaaaagctatttgttttcatttcgattattctcggctatgccggcttcttttttattttcttattcattaacaaccaattgtccgagcaaaactaccctgaagcgaagcaaggaatcatcaatctggaaacatgggattttcagaaagacgggaacatcgcgctcaccggagaatgggcactataccgaaaccagcttctctccccaaaggacattcatgcaggcaaaggaaaagcccccatttattccgatgtgcctaacaatgtcaaacttaccgattcaggaaaaaacgtggattacggtacatacagactgatgatccggtcaaagcaagacaatgagatgttcggaatagcacctcttttataa

SEQ ID NO: 3702 - DNA, 375 bp, Bacillus licheniformis
atgagcaagcgctctaagcccgcgagcctttttatgggcaggattcggtgcgattccgaagccgacagtatagtctggatgggagaagatggaggttccgcgcgttttgaaatgaacattttcaaacgtttatttgaccaatctgtaaaacagccccgctttttcaataaagcgggttttttgtttaggacaggggaaagaaccattcctcttttcgtgagatgtgatagaaaaggagagagtgacaaaatgaaacacaacaaggtgagacgtctcgtctctatcagcatgctgagcagcatcgcatttattttaatgatgctgagctttccgatcctgggggcattcccgtatttaaaaatcagatttcagtga

SEQ ID NO: 3703 - DNA, 194 bp, Bacillus licheniformis
atgaaggtttatacggtatcaccaaatgccgagacagacgggtggtttttgaaactggaagatacggcgcctgttgagctttatgatacaaggacagaggccgtggaaaaaggagaagagatggcgaaagagaaccgtcctgcgaagcttgtcatctatgaccggcaggacaacaaagaagacgaacggtctta

SEQ ID NO: 3704 - DNA, 377 bp, Bacillus licheniformis
atggtggaaacccaggctaagttaaataaaattaagttaaggggggggggaggggggaaatttcagggggtaaaggaaggcccgccaatttttaatttaaggaaggtatttatgggggaaaaaaaggaaagcaaatttgtggaacaagtggggaaggggaaagggggttatattttttggaaggaaggggggggatttccctcccaaaattattattccggatggttaaatttgaattgttttttaacaaaagccgggggggggcggttttttaaaaacccggttcgggtttggggagccaaaaaagccaaaagaagtttcccggaatttggaaaacccgcccggttgggattttgggaagttataaaacccttcaa

SEQ ID NO: 3705 - DNA, 375 bp, Bacillus licheniformis
atgcgactcatcatccgcgcaacctctacctcactaagagttaagagtgaggatttatcacatattctgaaaagaggttaccagagaaattttgatctgtcaaagggaagtgatggaaaaaacggacagccgcgccaaaaggccgccttttttggcagccttctgaagaatggaagacgggctctctccatctgtcatttatcggttatttttctttttgttgaccgcctcttgcagagggtctcctttcagcgcttgtcctgcgtcttcaagcgccccccgaacggcgttttggtccttttccttatttcctctatctttattgaagaaaatacccaaatgaatcacctctttaaaaatgtggtacaattttaa

SEQ ID NO: 3706 - DNA, 375 bp, Bacillus licheniformis
atgctctggcgctcaaaccgccgttggtccttctatttgtttctgggtcgtccctcccccccctccctttgtggctggtccggtctattcgatcccccccaccttttggttcgccggcctagcccggttcccgtggttcttaccttctgtcccgcctcccgggcccctcggggggtctggcgcccctggttccgggtgctggctctgggctggcggggctttcgccggtgcgggcccgtggcacctcgccggcagctgcggcgcggtgggttgttgtggtcctgggcgagttggggcagctttgagcgggtctcgcgcagatacccccctagcagcagagggcccgttctgagggcgcaggagggaaaaaaaaaa

SEQ ID NO: 3707 - DNA, 154 bp, Bacillus licheniformis
atgaaaacgaacgattatgttaaatatatgacggaacagctcgtaaaatatatggacacgcctaagcaggaaagaaaagaaatgaaagaaaaacgtaaagaattaaagccgccgtccaggatatatcaatggttcggcattcttccccttggct

SEQ ID NO: 3708 - DNA, 143 bp, Bacillus licheniformis
atgtacgtaggacgcgatatgagcgagctcgaccacacgccgaaaaacgagtggaaagatgcggagcttctctattttcaccgcgccttccagcaaatcatgccatttctcaatgaagaagggcatgccgagtaccggaggtt

SEQ ID NO: 3709 - DNA, 372 bp, Bacillus licheniformis
atgaagacacgggcgggcggcctgattgccgcggttctgatcgccgttgccggcgtttttatcctgcagaaagcgacaggaggccttgtgccgctggccgatgattatatacaaggccagggaaagcctgaggcttattatctcaaagctgaggatcatgcagaaaagccggataacggaaagtacaactacacattaaccggctatgacgcgagcggacacaaacagcagattgaggcagaggcagacgaaaaactgcatcccggcgctttcatcaaagtattggcgtacggaacgaaagccaaaagcttgactgaagtacacgaagaagaaatccccgagggcgctttggctgccatgaaaaccaattaa

SEQ ID NO: 3710 - DNA, 258 bp, Bacillus licheniformis
cgtcattccgctgtcatgtacggctgtcatgccctctgcctacggggaaacacgcgtttatcaagagttgacggacaagcagaaaaatgaactggcttctttgcaaaaggacattatggaaaagaaaaaacagctgatcaataagtatgtggagtacggaatactcgatcaggaaaggggaaaggaaatcaagtctcatattgcaaagcgctatgaaaaagagcgtgaagacggatttccgccaaagtggaagcacca

SEQ ID NO: 3711 - DNA, 371 bp, Bacillus licheniformis
atgattgattactatttctacttttttgaggcgatgcatgaagcgtacaacaagaatgttgagcgggcgatcagtctgtacaaggttgccgagaaaaaactggcgaaggtgcccgatcagattgaagcggccgagttttattttaaagtgtcctggctgtatatgtctcttcggcaaaatgcggtttctctcaattatgcgagagacgcgatgaatatttacaaaatgcatgacgggtacgaaaaaaagctggcgatttcccaagttgtgatggggacaaattacatgcagatgcagcgctttaaagatgcggagaagtactttgaagaatcgattgaaatttccaaaaagattgacgattcatttttaga

SEQ ID NO: 3712 - DNA, 372 bp, Bacillus licheniformis
atgaaccatttttacttaaaggaagtatttgtgatcgcaagcaattcagctgctgactgccgtcaatatatgcctatgatttgcttttcagccggttacaaaaagcacgaaatcagcacatatgcaaatgaaggcatcatgtttcgctatgaaacgaaggacggaatggaaatatacgaatttcaagtaacgcttaaacagaaagagttgtcattccgtctgtatgcttgggacgggggctcatatgtccgcgtatactcagagcggtggctgtcatctcctgttttttttcagtttctgaaaaatacgtatttctcaaataaaaatgaaatgatttttatgattagtggaagaaaaaagcaaaaattatga

SEQ ID NO: 3713 - DNA, 135 bp, Bacillus licheniformis
cgagcctcgagcataaaatctactacaaattgaacaatgaagtgccgaaccagctcactgatgagctgaaagaagcggctgacatcgcgaactacttggatgaaaagatgcttcatattcgaacaaaagcggatc

SEQ ID NO: 3714 - DNA, 132 bp, Bacillus licheniformis
aagacgggtcccgtacgaaatcggtgaaaaacaaaggcggaaaaacgaagtacaagccgtatgtttcaaaagcgctttatgatgccaataagaagctggaccgcgataaagacaaaattgcctgtgagcgct

SEQ ID NO: 3715 - DNA, 369 bp, Bacillus licheniformis
  misc_feature (1)...(369): n = A,T,C or G
atgaagtttctatgggttaccgcgcctcatggctgtagagtgggcactntggttgattataactgcgggatcttcttaactgtgaaaccttatgatccttgtaaggcttacattgaagttcaccggtcaagtctactgagtattagcttggtgggtgtgtcttgtcatttaatgattccctttctcagatgtaatggtcccccgancaaggttgtttggtgcgggtacagagtccctttcctagcaacgttcataatcagttctgtgtttaattggaccaattatgttaaaacgtccgatttttaccgaaatcatgttattccatataataagattttgtattttctggttaatgtttgttttccataa

SEQ ID NO: 3716 - DNA, 369 bp, Bacillus licheniformis
atgatgctttctaactatacttgtgaaattgaccatacccacagaacttttatctctaaatctactaacatgccctatgttgagtgtcatcatcttgtccctatcgccaagcaagaggggttcaaatatgacttagatcaactggcaaacttggtaagcctatgtccacactgtcatcgtcttattcattatggccaagatgaggagaaagaaaaaatgttgaaaaaactgtatgatcagcggaaggatcacttgaaaaaggtaggaattgaaataaccttttcagaacttaaacgaatatataagtatcgaaatttagattcaaattacgggcctggacaagcgctaccaaggctttttgatgtttaa

SEQ ID NO: 3717 - DNA, 153 bp, Bacillus licheniformis
agcagatagatcatcttgatcaggtatcttcacatctcgtcatctatgacgaaaaagaaccgatcggcgctggccggctccggcttgtcgacggctacggcaaacttgaacgaatctgtgtgctgaaaagccaccgctccctcgaagtcggca

SEQ ID NO: 3718 - DNA, 238 bp, Bacillus licheniformis
gtgtatgttgacattaccatcgatttaaaacattacgacggcagcgtctttgacctcagactgtcggattaccattctgttaaaaaggtagtcgacattgcgtggcaagccaaaagcataccggtgcctccccgggaaggctactgggtaagggtgacaaataaagatgccgttttttcaggcgaatatacattatcgcaatgcggaattacgacaggtgaccgtctggaaatattat

SEQ ID NO: 3719 - DNA, 180 bp, Bacillus licheniformis
ttcgcaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttag

SEQ ID NO: 3720 - DNA, 368 bp, Bacillus licheniformis
atgcagaagacactgatcgatatactcaatcgctataatttacttgaaaataatcaagtaatcattcagtcgtttagcgcgaaaagtttgaaacaagttagaaaactcaacaaagaagttcccatcgtacaacttgtgcagacttgggatgcggagaaactgtccgaaagaattaaagactataaaaaatacgcgtatgcgattggaattagttctcagacgctgtctgacaaggaagtgaaaatgattcatgacgagaatatggaggtccatacgttcttccgtgtcgagttagagaaagaggaaacaaagcgaatgattgaactaaaagtcgacggtatgttcgctaataacccggcctatttaca

SEQ ID NO: 3721 - DNA, 369 bp, Bacillus licheniformis
atgatgttgccatttggtattttatcaacagctgcaattgtttactttgatagcttaccaattctgtatatgacactaattgtgtatggaattgtagagaaaattagcgttaaccccgttttaattgctgttgtagcaaataatgcaccaaagcaatcattaagtacagcatttggattctacaactttgttggaatgttaggttccattttagctccatatattactggctggctgacagacactacaggaagtatgaatataggattttattttgcagcagctctgttagtaatcgcgttgattgcaacatatttaatagacgaaagtaatttgccatctgttgataaagcagctaaacatcattag

SEQ ID NO: 3722 - DNA, 366 bp, Bacillus licheniformis
atggcgagtaatgatcagggttccggcggagggtttatagcgatggaaacctacttacagagaaagtgtggatttatatccactaatttgtgtgtggccctaaaaacaggcgagtttctaccccgcaacatgcagaggggagatacactttatctggaccattacataatgatcgtctctgtactcggcggtaaggagcggatactgcatatcaatttgtggctgaggggcttgtgcgatcaaacatcaggcgtcggccggaaaggccgagcctcattgggcatggcaaaaaggcagattgtgcggctcagtgtggggtcgggatcaagtcacctggtgctcctgaggtgtgaagagaagctctga

SEQ ID NO: 3723 - DNA, 366 bp, Bacillus licheniformis
  misc_feature (1)...(366): n = A,T,C or G
atgtctccctttccatctgttgtcccgcacacgtcttcctcgtgcagagcgcctggttttcccgctttcggtccccttccctcgatcttccctgaagtcggtgccgtccttaatggctctccctccggttctggttgtgtgtgccggctcccgctccgaggctcctcttggggcccttttttggggggactcctcgttccctcggctggttgtggctcgcgcgggcggtccccgggtgtccccctggctcggggcgcgggccgtggcgctttgggagtggggntctcgggggtgggtgcgccgggcctnnnctcggctgtgtgggggcgcgacgctcggcggnagnaaggggcgggacagggagaa

SEQ ID NO: 3724 - DNA, 366 bp, Bacillus licheniformis
atgaaagcagcctttgttttaatcatggcgggcgctctatccgctctgttattggccatttttgtcgtgttcagccaagagagccctgaggcggctgtgctttcgggaaaaaaagaaaaactgaaagaatcgctggaaatggtcaaatatgaaagtgtcagcatttattacgctgaaaaagataggccgattctggagctgacaaaggagacgcttcgggatgccgctgatatgaatcgggaactgtttgtcagtcctcttcaagacagcgttgatttgatctttttttcaaaccgcgatgatatggagtcattttcaaaattaaaggatataaccggatttattaaaacggtattaggagtcaag

SEQ ID NO: 3725 - DNA, 366 bp, Bacillus licheniformis
atgggttccattcttcctgcaccgttaagaaactccttttatcgtgtattttgttgcgagtatcacgtgatatcatgtttcggccgggatgagagaattccaataaatggtaaaatattactccctttcgtcacccagttgccattttatataagaagaacggcaaaacgaaagcgacctttaccttatttttcatcagcggccggcacgtgttcccggaagcacggaatctttcggcgtgccgtatttttatatcaattgcctcaggctggacaggtgccatcagatcaagcagcgcttaaagaaggaagcagaggttcgatgccgggttttgcagagggacaaagtctccctgtttttatatga

SEQ ID NO: 3726 - DNA, 363 bp, Bacillus licheniformis
atgtacgttttttatagaatacaaatattttctcattgtattattcgcacccactattattgtcatgttaatcaaccctcctttttccgaaaaaaaaggggtgtttcgtttcattgccggcctttatttgcttttattggcactggcaacatacttttggcttcgagcataaacagtccggatataaaaaacaaaagtggcttcagcccgcggagaaaaggcgaatttacgtttaacattgctgccaaaatctcaaaaatccggcgacttgacttgaaagagtcctcatcgccagaaaacagaatgaattgcataaaaataggacagaatataaaagtccgacctattttgtcaacgatctga

SEQ ID NO: 3727 - DNA, 363 bp, Bacillus licheniformis
atgaatgtcccgcccgccggatcaaagctatcccttttcggtttactcagggcttttaacacctgttcactacgagaaaataggcaatgccatttggctttttttatggtgcatcagttcaacaacaaaggaaatcgaacgcgatggggagacatggggcatcgtgctcggcaacaagccgctgaaagcagccgaactggctcttcaattcggcgtcaacgaaaaaacgatcagaagatggctcgctcttctcgaacgaaacggctacattgcagtcacaagagcgccttacggaatgattttgtcagtcagacattcaaaaaaatttgcctacgccagccatgtccgaacagaactgcctga

SEQ ID NO: 3728 - DNA, 363 bp, Bacillus licheniformis
atgaatttattatgcaatacgggaattagaatgcttattgaatcaatatgtatggtaaatggaattgataaaagaccgaagattaagaagggagaaccagtgttagatggtcataaaaacccggtaatggtcaatttaaatttggttcaaaagataaatgaacttaaagaaaagaatataattgatgaggaacaacgaaggatactcttggaaattaaagatgtaggaaatcagacagtacatgaaatatttcgaccgaaacggagagatttattgttatatctagaaacattagatttaatactatttaatatttatgaattacctcatattaaaataacaaattcaccaagccctagttag

SEQ ID NO: 3729 - DNA, 363 bp, Bacillus licheniformis
atggctcaaaaacatatttctattaaattatggtttgaagaagaaggaaaatataaaacgtttattgctccccgtacaaacacaaagacgttgtttgaagccttaaagttagatgagacagcttataaagcaaaaaatcttaaagaagtactcaaaagccttgaggatcgtatgaaattcattgtacgggtatttcacaatcaatttactttagaggattttcaagaaggattacagtcctttgaagtttccgatgaagtaagacgaattatgggagaaatcatgggctatgaagaaccagatgaggaagaagattttttgccagcagcggaaacggaggacttacagttgaaaacggaatag

SEQ ID NO: 3730 - DNA, 365 bp, Bacillus licheniformis
atgaaagatattatgaacgattacagaaacggtgaatcaaaagaagattatccgactgtcatcaaagaaaataaagatgcacaggcgttttacggtgtgacgaaagacattttaagtgaaacgaaagaagaacgtgcaagttacggtgaggatttgcttggagaattagccttgaagatggatgaaatcatcaaacagcatcagaaggtcgattggcataacaaccttcaaatccataatcgcattgcacaagatttggatgatctcttatatgacttttccaaagaacataacgttgagttagattatgacacgattgataaattaattgaacaaataaaaacggtagctatcagacgttatta

SEQ ID NO: 3731 - DNA, 364 bp, Bacillus licheniformis
atggaaatcttagtgacattgctgacattactatgggccagtcgccaccaggtaattgctataatgatatcaaggatggaactcgttcaatccatggaccaacagaatttactaattaatacccacttgtcaaacactggacatcgtaaccctacaaaactttgcgaagactggggatatattctttgcgtgccctcaggcaccttctctcggtcgtctctcaccccctctcgcccccctccctttccttcccccccctgtctgtccctccctcttcctctcctccgttttttcttccttttcgtgcgccgcccccccccccctctctcccctcctctccccccacccccctatactccaccca

SEQ ID NO: 3732 - DNA, 147 bp, Bacillus licheniformis
tatttcggccatcggggatgcggatgtgctgatgccggcgctgaacattgcaggagggcttgtggaccagctgagccgcgatcatatttcagtcagcatcgaaaaacaagataatatcgagatggagccccttttgaagcaagggga

SEQ ID NO: 3733 - DNA, 363 bp, Bacillus licheniformis
  misc_feature (1)...(363): n = A,T,C or G
atgacagaggtcggcagattgtttttatcggcggacccattcgatgaatttgtgtttgtcagcgggtttttccgccttttgatccggtcggcccagctccccacaatgtatcgccttcttgcactttctattttaacatattgctttctttcttcgatcttaccggcaaaagacaccaaacagaatacagcagctgatcacagcagtaaacagactgacnaaaaatcaatgattcttttttcatatccatcaccccagaatgtttgttcggtttttgtgacttcagtatacatacgaacaaatgtttctgtcaatcgtttttttcgaacctatgtttgtactcagaggaaaaacatgctataa

SEQ ID NO: 3734 - DNA, 363 bp, Bacillus licheniformis
atgagggtgtggggcaggtgtaatcaagggccgccgggttggcccgtggcaaagtcatgcgggttgtggtgtgtaaaggcggggaactcggggcccttttgtgatgttgtcaattacgggtgcattggctggtttgccgtgaaggggtcggtgttggtcaaggtgcggcgattctcgatgagcggcgacgatccccagcatgtttcaggcgactctaaatgtaaacgtatcggttttaatgtagttaccgtcaaattagccgttggtttactcacagagatatccgcggattcaaaagcgttatccacaaaatgtggacaacgcttgttttcttttctgtcatgtgggagactttcaacatga

SEQ ID NO: 3735 - DNA, 363 bp, Bacillus licheniformis
atggccgctgcagaaattcaaaaaacatttgcagatgatatgaaggggctcggctttgtcattgacgatttaacactcggcgtgccgaagcctgataaagcgactcaggaagcgattgacgcgcgcgtgaagtcttcgcaggaactggaaagaacacagacggagctgaagatcgccgaagcggaagcgaaaaagaaaaagatcgaagcccaaggtattgccgagtacaacgaaattattaaaaagtcgatgtcggatgaaatgatcaagtatcaatggatccaaaaatgggacggaaaaatgcctaaagcgaccggatcgaattccctgatccagattccgaccgatgagaaaggaaaataa

SEQ ID NO: 3736 - DNA, 363 bp, Bacillus licheniformis
atgatgaaatggtttttaggaattttaacggcaggactgataattttggtcgggggctactttttatattccggatattattcaacggaagattattacgtcaaaattacaacagatccaaaagtcgtgaaagaaaaagcaagtgatggatacacatatataaattataactatgatgttacgggttatgataaagatgggaaatccaaaaacctaaagctctcttctcaagaaaaaatgcagaaaggtcagtactatattattcattgggaagatagaagggaaatcatatccagcaaagaaaaagcgagcgagaagcaaatagataaggacatcctgcataaattagacaatcaaaattaa

SEQ ID NO: 3737 - DNA, 170 bp, Bacillus licheniformis
atgaaaacaatcgaacggttattatttaagatactcgtcgtacagacggtcattttaatcagcgtgcagcttctttttcatttctccaaggctgagccttatctgtcaaaggtcgtgcagtatgaaggcgtgaacaacatgaaaatcggcgaatggatcgagacatttaa

SEQ ID NO: 3738 - DNA, 108 bp, Bacillus licheniformis
gcgttgaagcggcttcagaatacggacggcccggaaatctgctcgacggctgcaatatagccggatttatcaaagtggcggatgcgatgatcgctcagggagtcgttt

SEQ ID NO: 3739 - DNA, 216 bp, Bacillus licheniformis
cgattcccgccgcaacttgggccgtctttgaggccatcggccccgtcaatccggctggtcaagccacatgggaaaggatcttctcagaatgttttccggcgactggctatgaactggcgaacgagccgcaatttgaagcctatcctgaggacggggatattatggcgcaagatcatatcaccgaaatttggataccggtggtaagcagaaataatc

SEQ ID NO: 3740 - DNA, 311 bp, Bacillus licheniformis
ttgaaagatcggggatcaatcaaatgaacagctatgatgctgtcggaacacctcagcctgctccgcgaattagaaagcaatcggaacaaggttaaaaggccggttcttgacatggttcaaatagaagacatggataagataatatgtgaagcaatggaatttaatttaacagttctgttctctgtatttaaaccgctgccctttttaaatagagcagaatcaggagagactattaacatagaaggaaaaattcattacataaatcatatccgtaaggtttttcatattgtggaaggagacaccaatttcat

SEQ ID NO: 3741 - DNA, 360 bp, Bacillus licheniformis
atgggtgaagaatttgaaaaacgatatctttactggattgatgaagccgtgaaggagagcgaaaagaaagacgatttcaagtccctccccggttatggaaaaccgctcagcaaagagatgctcgagggggatgcgctttcgtcaacccttaaaaacgcccgatatctgccggaatggctgaagctgcaaaaggaaattaaacaagagattgcagacgcgatcaaatcgaatcagcgcgaaacggtgattgatgccatcaaccaaagaattaggagatacaacctcacctgtccgaaccaattccaaaaaggccttgtttcagccaaaaacctcgaaagtcagctcaaatattggaggtga

SEQ ID NO: 3742 - DNA, 360 bp, Bacillus licheniformis
atgaccgtagctgaagccatcgaaagaaaaacctctatcagctacgacattcagcttttggataaactgaaggaagtgtacgctgatttagtcggcgaagccgagaacgtcaatcaaaaagtaacggaaagactggacaagcatctcgagacacttttcggaaaagacggcaaagtaaaagcggctgaaaaccaggaaatcgtcaaatctttcctcgcagaaaatgaagcaaaaatcatcgatccgctgaatctaaaagagaagatcgattgcttatcaaaaaagatcgaggactttgaaatggaagttgactttgcattgtccgagagcaatacactcaccaaaatcaccatcgattga

SEQ ID NO: 3743 - DNA, 282 bp, Bacillus licheniformis
  misc_feature (1)...(282): n = A,T,C or G
ggcacacagtcaatctttcactcgccatgcttgtcctcggcttcctgctgtctttctcctatcaattcgccagggaaaacaaagaccatgaagaaactgctgaaaattggaaagaggaatattccctgcgcgaccggctgatttcccaagaaaagcaaaataagaagctggaacagggagctttacaaaaaacagcaggaagtacagaaaacagagacggctttgaaaaaggaaaaaaaagagtactacaatattgtggnaagatgttgagaggtacagaat

SEQ ID NO: 3744 - DNA, 324 bp, Bacillus licheniformis
caaagaagagcttgaacattgtcgcaaaagtttctcggcagggagctgctgaaaaaaaagtcaagacctattcatacggacaaaagaaaaagctggccttaatgatcgctgcattaaacaaaccgtcattcttgtttttggatgagatatcaaacgggcttgactaccggtccatgatggagcttcaggagctcatcaatgactggtcaagcaggatgacgattgttgccgccggccatcagtttgagttttattcttcaatcgtcgatcaattatacgtgttgaaagacggttcagctatccacatagacaattttaaaacga

SEQ ID NO: 3745 - DNA, 711 bp, Bacillus licheniformis
gtgaacggcgtcagagctaaacttgatgaaaaaggattttctaatgatgcttattatacgacaggaaaaagcaagaacggaaaaatcgaaatctatgaaggcggtacagaagcgagaatcgggcgtaatgcattcgccctccagcctgccctttccttcctggtggaaagcaggggaatagacatcggacgcgaaaattttgcaagaagagtcgcggctcaggttgctacacatgagacgatcatcgacacgacagtgaagcatgcagccgagatcaagcgccttgtctccaaagaaaaattaaagctgatacaaaacggcgctaaagtgagcgataaagaccaagtggtcatcaacagtgagtttgcaggcccgtttaaagacacgcttaaagtcgctgatattgcctcaggacaagcagttgacgttcctgtccaatattacagcgcctcagaggccgttcctgtgctgtcaagaactcggccgaccgcttaccttgtccttccgggccatcaagatatcgaacagaagctgaaggatcagggattaaagagcgtgacactggctttcaaacaaaaactcaccgctgaagcgtatgaggttttatcgaaagaagcagcgggagaatctgagagccggccagtgatcaaggtagaaacgaagctcaaaaaacagaaaaaagagttgctaaagttaacaactacattctcc

SEQ ID NO: 3746 - DNA, 357 bp, Bacillus licheniformis
atgctcttaacgacttattatcagcttttgtttacgattgaagaggggttttgctatttaatagaagcgaatcaagatttggcgaagacagaaggagagcggatttttaacgatttaatctatgctttttttcagttggattcgtcgcacgctgttttgctgtcgattttggagacaagctgtgccaaatcttcgattcgtttttttgacagagtcttccgtgagtttgacagcttgatctactacaattatccgtctgctgaatttcagcatgacttgatccatcactttttaccgctttatcgggaatggatgaaaacgatccaccaatgcatgaaaccttatgtcatccattaa

SEQ ID NO: 3747 - DNA, 357 bp, Bacillus licheniformis
atgaaatcagttgttaaaaatatcttgaaaaatcggggagtaaccagcgataaagttcggacgctctcagaagaagaaaaagaaaatattttcaatatgctggaagatctaaaaaaacaaaccgatgctttggttcaaaaacagaaagaaaaagcagccgcaccgaatgaaaaagggacaaagagagaaaagaacgctgatgcgtcatcagaaaatggcgagagaccaagaagaagaagaaacagaacaaatagactgagagaaaaacttcgacaacggagggagcaagaaaacacagcaacagcggaaaattcaaccgagtcagatacttcagcagaaaaaaatggggatttgtag

SEQ ID NO: 3748 - DNA, 357 bp, Bacillus licheniformis
atgggccaggtccgcaggccgttttttatccggagcttggcacaggagccgaaacaaaatcaatcgttctcgcacccgggtatccttcagcttcaaaaggcttcggaccgcctgctttatttggccaacggatgcttgtctctgcggaggaattggagctttaccacggttttaaaatggtttcccgggagtggacggacaatggggaggaaatggaagtgtccctgcttaaccaggaggacgatatttatttcaaccttcttctgccttttagcgaaaggggaaaatacgggtctctgtcaagaacgggagaccatgacgaaaccttttatgaaagcacggtacaccaacatgtga

SEQ ID NO: 3749 - DNA, 120 bp, Bacillus licheniformis
agaaaaaaaaaaaaaaaaaaaaaaaaaaaaaaaaaaaaaaaaaaaaaaaaaaaaaaaaaaaacaaaaaaaaaaaaaaaaaaaaaatataaaaaaaaaaaaaataaaaaaaaaaaaaaaaa

SEQ ID NO: 3750 - DNA, 357 bp, Bacillus licheniformis
atgcggcggacttctgcttcccggcggcggagcaggcgaatggctgctttttttcctagctcacttcagccgcagtgggctatttcatgcggtggggccgtacaactgctcttccgcggccggggttttagatcaccctttttaaatgacaaccccccgtcttggggctttttttttcccccgtttccccaaggtgttggcgttattccttcccccccagtagcgaactgtgcctgggatcccccgcccccgccccggtattttatatctaatttgatggcactcctcccaactttgcctaccttcatcccgaaggcggacggtctacttttccccggaggagtcttagccgggtaa

SEQ ID NO: 3751 - DNA, 357 bp, Bacillus licheniformis
atgacaaaaagattactttcaaccttaaataattcaaaaaaacttgcaaagaaaactttgcaagtttttttaattgcatttcttccgcccaagtacgatcggataccggttcaacaaaaagatgcaaggcaccattacaagcaatgtcatgccggtgtaaagcgcgctccacaacagggagccgtatgtctcatcaagggaaacctgtgtgaagtagtagacgacggctttcagcatcctgatgaccggatagtgcagtacgagaatgatcagcgagtttttgccgaggaattggagaagccttgctttttcaaggtgaaagctgctgaaaatgacgcctgccgtccccagaaatga

SEQ ID NO: 3752 - DNA, 708 bp, Bacillus licheniformis
ttgcttcgtttccgccttggaacgaagcagaccggctccttattctctgttaaaggaaacatgctccttgatgaggattttttaggccgttatgcagaagctataaaagacaggctgaacgctccgaatcaaaaagttgcggcttcaatgctcgttaagcgcggcggcatgcttgctgcgctgcatttctatctgtttacggtttgcggaaaacggctcccagccgacccggcttccgtatcgtgggagatagaagcggatgatcaaggatggacgccgtcgttttattttcacaaaggtgctgagcttatcgaaggggaccgcaccgaagaactgaaaaaattgaccgaagatatcttcaggcgccatttgggcggcatgatcgaggcctgtcgacagacattctcgatttcaaagcacattctttgggaaaatattgcggtttatctgtattggatgtacgacatgcttcaggaagatccgaagctcaaggcacgggcggcgcgagatttccgttttcttctttacgaagcagagccaggcctttttgatgaaggtgaggacgaaaaccctctcaaaaggttttatcccggacagcatgcggaggatcggacacgcacgacttgctgtctgtattatgcaacagacgaaaacggcgtcaaatgcagaacatgcccgagaaataaacataaagaaagggtgtcgtga

SEQ ID NO: 3753 - DNA, 354 bp, Bacillus licheniformis
  misc_feature (1)...(354): n = A,T,C or G
atgacaaaaggctggagaatcatgttcgcattgacctcggagaacttaaaaaggtacgccagctcaccgagtgcactccagaagcagctccgcccgacaaagccagtcatgatcacccttnccggtgaaagtcatcggggtttcacgcttattctgctcaagctcttccggctgtttttgattgtcttcattacccatacagtccagatcacctccatttccagtatgtccaaaaacagccgcggcaacatcagctttcccagatttttaaaatccgagtgtaaaaagcatgaaaaagggtatactttaattagatttggctttgtaagaggttcgaatttcttaaatttttga

SEQ ID NO: 3754 - DNA, 236 bp, Bacillus licheniformis
  misc_feature (1)...(236): n = A,T,C or G
atttttcgactcgcgcaatcgtatatcggacaangtacctgagtaaagctttttcaggcattggaaaaatgggcctgtgaagaaaagattcacagacttgaactgactgttatgactcataatacagctgccgttcgtttatacaaaaaaacgggctttatcattgaaggcactaaaaagcatgctttgaaagtaaaagggcaatatgttgatgaatatgtcatgtccaaattaat

SEQ ID NO: 3755 - DNA, 354 bp, Bacillus licheniformis
atgttggtttgtactacgtattatggtggattcaataaaataaatgcgcgtttcaatctggtaaatgttgaaagacgaaaaggttatgattggggcaagctaaggaaaaaagccaggaggatgaagaagatgatgtgtccagtgtgcaacgggattctcgtccagacgaggcattgtccgaagtgcggcggggaaatggcggacgccgggagagcaaccgattttttcggtccttacagtccgtacatggagttcgattcatttaaacaaacgcaaaccgcgtgcgttcatttatatacgtgccaagactgcacttatgaagaaaccgttgaaattgaaacgaccgaagcatag

SEQ ID NO: 3756 - DNA, 351 bp, Bacillus licheniformis
atgatatcaatgatgagattacttattagttttatattcggggctttaggggcagttataatgtataacataaaatcaaacttttctttccctgtgacaacaattgttttagtggtttttgtggctgcttgtttgcattttgacctggttaaacgtaaaaagagcaaagatcagaatgataaaaagtatgagtttatatggtggatcgcaacaattctcatggttctagtgatgactcttaataccgtctttgtaaaaattgaccctaagtataatatcatcgttgtattgattcacattttgtttatggtgattattaagagtagatggaagaaagctaagacagactaa

SEQ ID NO: 3757 - DNA, 353 bp, Bacillus licheniformis
atgggcggcggcgcaaacggaaggcgggcagggaagatgagcttttctcatttcgaaaaacagaaggcaaagttattcagcggggtatccaccgtaacaagcaaccaaaatgaagcaaccgaaaaaggtaaaattccttccatgtggagtttataccgtgaaagatttccgcataaggaacgccaggacatgaagagagatacgattgcgctttattcagattatgagtcggaagaatatggggcgtatacattttcaatcggtacgttcgctgatcagcatgaaaaagcggccaatggatttcgctccctgcatccgaatatgcccgttttgtttcaaggcgggggaggaaa

SEQ ID NO: 3758 - DNA, 351 bp, Bacillus licheniformis
  misc_feature (1)...(351): n = A,T,C or G
atggcaaaaaaaggcgcggatnnnnnnnnnnnnnnnncnnnnntnccttttcttttccttcctctccttcctcccccttctccccccctcctctctcccctcccctccccctccctcccccctccttcccctcctcctccccttcccttccccctctctttcctccactctttccanctcacctccctctctctccttctcttctcctttccttccattttttcttctcctctctcctcttttttcttctcctctcatctccttttacttacctctctttaccatccttctcttctcacattttacttttttgtatcnccgtctcatttgtattacctctcccgtagttga

SEQ ID NO: 3759 - DNA, 351 bp, Bacillus licheniformis
atggacggatatggatactacaactatcaagcggcgaatccgaaagtaagcggagagactgtgaaaatttcacacaatggaacaataaaagcgcattcccatgcgaaagcgatcgaaaaacatgtcggcgattcgctcaaaaaagcaaaggaattgaaagcgtacgtcgaaagcggcaaatggagcgggaaaacccgcgacgcatttttaagctaccttgagctgattattgaattgaatgccgatatgaaagacgccttgaaagagcataccgctgcattagatgcgctggaaaaacacatcgacggtttttcgcagctcagtgaagtgcaggaaatcaaaaacttataa

SEQ ID NO: 3760 - DNA, 351 bp, Bacillus licheniformis
atgggacaggaggtcatcatcgaaaaagcgaaagccgagtgggcgcacgaatttgaagctgaaaaacaacagctcgcagatgtcctcggaaaaaaagttctcgctatcgaacaaatcggcagtacctctgttcccggccttgcagcaaaaccggtactcgatttgatggccggcgtgagcagtctcagcgaagcttcagttggatcgaaccgcttcaggagctcggctatgagcacgtatttcacgaagccttcccagccaggcgtttttttcgaaagggaaagcggagggcgggcacacgccatctgcacgtatacatttttcaaagcgaagaatggaaaaatcagctga

SEQ ID NO: 3761 - DNA, 104 bp, Bacillus licheniformis
ttggttagtaaaaagagtgttaaacgaggtttgatcacaggtctcattggtatttctatttattctttaggtatgcacccggcccaagccgcgccatcgcctca

SEQ ID NO: 3762 - DNA, 106 bp, Bacillus licheniformis
atgagcgaacagcaaaaaacgaatgaagccgcacaaacgcttgacggctggtatgcccttcacgatttccggacaatggactggtccgcatggaaaatgctttcaa

SEQ ID NO: 3763 - DNA, 348 bp, Bacillus licheniformis
atggcaaatgccgtctggcggaaagtcggcgacatcgcggacggggttaagaagaaaatcaccggattactcaacattcactcgccatcacgatggatgcgcgatcatgtcggaaaaatgattccggctggtgtggctgttggtatcgataaagcgggcggccttgtagaaaaagctactcagaaactggcgcagctcaccatgtttacgccagatcaaacgacattcgcctatgacacagccctcagcagtggcacattaaacgatgtccgcggtcagatcgaggcagaggtcagtgatttcgaaatttcagaccgtccgatcattattgaaatggacggccgataa

SEQ ID NO: 3764 - DNA, 159 bp, Bacillus licheniformis
taatttttgggtgtacgctctttattataattgggctgatactcctatggttaagcaagcactacaatacaatgacgtaacaattgaggagttaagagacggtgtagatcaaggatatgttacgcctgagcaattccaagaaataactggcgagaagta

SEQ ID NO: 3765 - DNA, 366 bp, Bacillus licheniformis
tgcaagtggttgatgctgcttttaaatacggctacagcacaccggaatcattatcgggaggccttcagccgccttcacggcatcagcccttcacaggcccgagaaaaaggcggacgctcagggcatttccacgtctatcctttcatattcaaataaagggagtggaggatatggattacaagattgttgaaaaagaaccgtttcaggtgatcggcaaagcgttggaggttacggtcaaggatggtcaaaacaaaaaggatattccggctttttggaacgaattaaatcacaacggctttaccgattctttaaaaccgcacatcggcccgcttggcttccttggcgtctgcatggattttaacgatc

SEQ ID NO: 3766 - DNA, 165 bp, Bacillus licheniformis
tccatgaaacattggagctgcatgagctgttaatgtttaaaaacctttgtctgacaaagtcatcaacaatgacgggaatggttcaggatcaagagcttcgcgacatcttggagcgtgatgcatcccaaacaaagcatcagatcgagcatttacaaggtctattgt

SEQ ID NO: 3767 - DNA, 345 bp, Bacillus licheniformis
  misc_feature (1)...(345): n = A,T,C or G
atgggcaagcattttgaggccatcccagaagccgatttggccttcatgcaggaaaaggaagagcccgtcttcgcccgaattaaaaanaatatgggctttgcagtcgggtgccaaaaggcttgcagctatgcagaaaggtttggacgcttttcaaacgtatatgacttccttctccgacgagaatttttgacaaaaaaaacaaagccgttttacctcgatgaagggatgacccaaagccgctggctgacggaaacgctcacccacatcttccatcacagggcccagctgtttaattatttaaaacagctcggctatgacgtcaacatgttcgacctgtatctataa

SEQ ID NO: 3768 - DNA, 345 bp, Bacillus licheniformis
atgatgtcaccagaaacttttgttgaatataccgaatacttaatcgccggtatgttggccgctcatttcgcttacagtttgtgttttttaatcattgcgagtcatatgatcattgaatatgaaaaaatgatctttttaaaacctgaaaaacggtcccataaaatcacaaatacattcgtttttcttcttgtcggcaccggctactttgtttacaaacggctattaagatacaactggttcctgagaaaactgtatttcgccctttatcttgtgggcagaggcatcttaagcatcatcatcttttatattttttcttttctggtccatctcattttcagcgtttaa

SEQ ID NO: 3769 - DNA, 170 bp, Bacillus licheniformis
atgagaaaagttacgtttattgtagtaggcgtcattgcagccattgtattttttcaaaaccgttatcgtgttatcaatttcattattggtcaaaaccaaatccgccagtatttcatccatttgatgatgagaattccgttttttcgcaataagtttatccagcaggcatt

SEQ ID NO: 3770 - DNA, 345 bp, Bacillus licheniformis
atgaacatgcagttccgccgcgaaaatcgccttttcccgggctgttttaggctttttccgggtaaaaacttaatgaaacggctttttcagcaaatggaagcgcttgcgaaaaccgttcttttattctattttacagcaaaaacgactgtttcaatattgaaatttgaacaacttgtgaaatttgtaaaaaattctctttgcgggaaaataagacaaaaaaaggacacggataagatcatccgtgccaataaaattcattataaaagggggtcaattactataccaatcataacgaataattgtttcactggtgttacaggccggttaaatcatgatgacgattaa

SEQ ID NO: 3771 - DNA, 342 bp, Bacillus licheniformis
taaacacattacatgcacgaatccccagtaatcctacactcatcgtaacatgcagcaagcatctcgatgagacttcaactaacgcagccagaacgttcgacactgaagggataccacatactgccatacaggggcgacaggcaaactttgacgaagatatgacaaaacgactccacagtaataacaacacaaaggacatccataaggacgcaatgcatcgcgctttgacgatttgactctattgcctgggagctgtcattgccgcactagctgaacatgagcatccgtttgttgtgatttggataccgatcgttatcattatcggtattattgcggttgcag

SEQ ID NO: 3772 - DNA, 154 bp, Bacillus licheniformis
atgaaggaacacaaagcagtcttactcgccaaagaaatcgttgccttagacaataagagagacgaattgctcgagacattgatgaaccttgccggcaaggatgcgtttccgctgctgagggcggtgcagaacggcttttatcaaaagtcctctt

SEQ ID NO: 3773 - DNA, 345 bp, Bacillus licheniformis
atggggagccgcacattgaaccacggtgtctgttctgtcagcatcaaacggaatttgcgtgtcgcgattcaaggaagaccgagccggggagtcggcatggaagaaatcatgttcgaatcgctcgatcaaaacggaatcgccttgaatatggccgaagtcgcaattttgcctgaagaagttccgctgtttacaaaaaagcttgtcgatcagggcatcattatcagtgctctccacaatcattggatttttacagaaccgaatattttatatattcattttcaatctgtagaaccgccgttaacattcgcgaaaaaaacagctgccgctttatccgtattgcgatga

SEQ ID NO: 3774 - DNA, 172 bp, Bacillus licheniformis
atgaaaaaacaccaaaaaagcaaggatatgcaaaaccataaaaaaccgatgaatcccgatgtgcttcaggaggaattttcgaacgaactgggcgatgtcaacgcctttaaatttatcgatgtgatcgagaacaataaaaagaagaacaaaaaggcggacggacagaagcggg

SEQ ID NO: 3775 - DNA, 342 bp, Bacillus licheniformis
atgaatgatgtaaagaaattagaagcttatcttaaattaaacgcagatggaactcttaccttagatccatcttatactaaactagatatttcacgttctgtcaccaacgaagttcaagactggattaaatacttgaacgatttagtgaaacaaaaagaagctgtcattaactccgattttagtgtgaaaattttagacaaagacggtagtgtattgacactggagaatggaaacaatcataaaatgaaagtagcgaaaaaaggctgcggtcgatctggtcatgatctctactggtggggatataatctttattttgactgtaatgaaacaagaaccatttaa

SEQ ID NO: 3776 - DNA, 342 bp, Bacillus licheniformis
atgacgccgaaagtatttgttgaatatgctgaatatttgattgctgctattttaagttctcaatttgtatttggactttgcactttatttcttgggtatataactatgaattattatgagcaggggactttcagacccccctcaaatatatttaaaaaaactgttaatttcggttttgcattgatttttggtgcaagttattttacatataaacgactatatagatataacttgttcctaagaaaattttattatgccctttaccttctggggagcggtattttaagtatcatcattttctatattttatcatttatccttcacttcattttcaaggtttaa

SEQ ID NO: 3777 - DNA, 342 bp, Bacillus licheniformis
atgcatcttttttcctttgttgcgcttatattctaccggttttgtcccaagatggctcggggcaaatttagactgtttgtcgtgttctctcggcatgtctatccctccttttcagcattaggattctcaaaaaggagcgtaaacatgaatcgatttttaaaaactcacttcagcttaaatttctcttcaagcttatcttccagccgatcaagaaactcctggttggtcatgagctcctttttattttccgagacaagttcttcaaatgttcgccttttcgcttttttcatgttgaatcacctccagcttgttttcattttcaccattttttgggcaatataa

SEQ ID NO: 3778 - DNA, 339 bp, Bacillus licheniformis
atgatttcttccaccgcatccataatgcgccgcaccactctcgatctgttggaatctctggttaaaagtatttcgatttctaattttccgttggtagttattactcgttccttgccgaccgtgctcgaaaattcaacaattccatgcttatcccaccagatatggcggtgtagtttaacagccatttcccttccacctttcgtctattttcgacaggaatcgacattctcagccgaaattttttacccgcgcttctcaagcgcagcccttaccttttttaaatcgcattcctcgccgtcaatctcgacatgctccaaatcttcgtttaaaaagccgtag

SEQ ID NO: 3779 - DNA, 339 bp, Bacillus licheniformis
atggatcagcctgatgatcatatttgccgcattttaagcggatgtaacttaaaccgtgtggggacggacgaatattatgttcacattactggaaacggggaggaagacacgtcgaaatttgacgacggcgaggaatactccgtcttcaaatatgaactgaccggttttgatgaagacggtcaagaaaaaacaatggaattcacagctgataaaaaccttcgcataggcgcgtttttgaggcttttctattctgaaaacaaaggcgtgaagtcatgggaagaggttgacaaagacgatattcccgccaaagccaaagagcaattaggtgtgaaaaattaa

SEQ ID NO: 3780 - DNA, 339 bp, Bacillus licheniformis
atgctcagtcagattaagtatgaagagactcattcactgcaattgcgcttcaagcggcacaacaaaggcgacagccagaggctgatagatgcaaataataaacaattcggaatcgtggtgttaaaattcagcagcgtctgcaaaacagcatgggctaaaatgacgctggacaaagcagtgtccttaggcttggaggcaaatgcatatttgaaaagaaacacagacggaaaagaactgagctgcagcccggctggaggaaaaggaaaagtgctcccggggcagacatcctgttatacaccgatggttgatttcgatccgcgttcttcatatgcgatgtag

SEQ ID NO: 3781 - DNA, 339 bp, Bacillus licheniformis
atgaatttaaaagagatacaaggcgaatatgatgcggttttcagcctagggcatttgtgcctgacagctcttcagctgagaaaaatgaataaaagaccttatgcaggaccttttgattgggtcggcacctcgtcgctgcctgatctgtgccgcttgatacgaaaccggtttgaagggtttatgaatcctataaatttgagagtgacgggctattctacaggagttgccactaaagacccttttatttcggttacggatgattattactgcattgactcgcacacgattttaaagcggatcgaaatacactcgacaacctggctacttatcatgaagtaa

SEQ ID NO: 3782 - DNA, 216 bp, Bacillus licheniformis
ttgtcagtctgctgagtttattttggctgaatgtacaaggggaatctttaaagcatttaagccaatttgcgaaaggcgtgctatgggggtttccagccacagcggttcttcttttgatcgtggttttgagtttaaaagcatcattcccggttatcatttctgttgtatttggaatatgcggatggggcgggtgtttaatgctgcaaaaggctctca

SEQ ID NO: 3783 - DNA, 339 bp, Bacillus licheniformis
atggcgggaaatccatcggagctgagtgacgagctttccgttacaacagagccgacgcctgttcctgatccggaaagcatcagcgtcagtccatcgtctaagacattaaacgtaggtgagacgcagcaaattaccgcaacagtatcgcctagtggggctgatcagggcgtaacatatacgtcaagcaacacgtcaatcgcaacggtgactagttccggtaaggtaactgcggttgcagctggttctgctacgattactgtaaaatcgaaagtgaagacaacagttaagaataccgtatcgatcactgtcgtcgacccggcgccgtctggcggtgagtaa

SEQ ID NO: 3784 - DNA, 339 bp, Bacillus licheniformis
atgagtaactactatgacaaacataagcgcgatcccgaagcacgtgctttctataagtctacagcctgggctaagtgccgagccttagtgctcaagcgcgaccatcacctgtgtcaagactgtctcgcaaataaaacgatcactaaagcagagactgtacaccacataaaggagctgcgagaataccctgaattagctttagatgcatcaaatttggtcagcctttgcaattcctgccacaacaaacgccatccggagaaggggcagaaaagtgccaaaacagagaagaaacagagaaaaatcagggttgtaaagacagaggctaaccccgaattatag

SEQ ID NO: 3785 - DNA, 246 bp, Bacillus licheniformis
ccggatcgtcatcacatatggggtgaaaaatcctttacatgattcagaaaaaaggccgcgtcgccaaaacatccacttcggtatccatgaacggagagcccgttgcctcggcttcacggtcggcgcactgacggataaatcgttgtcagggacatatgacggagtcgatacttttatctcatcagaagatctttctcaagatgaacttctgatggttgcaaaaagcatgcagggacagtcttcgaa

SEQ ID NO: 3786 - DNA, 339 bp, Bacillus licheniformis
atgcagcagcgtttggaacactcgttaatgctcgtttcggaagcggacggaaaaatcgtcggctttgccaactactcctttgtcagagaaggaggggtagcctatctcgcagccgtttatttagctccggaataccagggaaaaggcatcggaaccgcattattggaagaggggatgaaccatttaaagggagtgaaaaagatctttgtagaggttgaaaaagaaaaccgcaccggaaaaaacttttacaaggcgaagggttttgaggatgtcgccgaatatgatgaagatttcgaagggcatatcctcaaaacagtcagaatggccttgcacgtataa

SEQ ID NO: 3787 - DNA, 339 bp, Bacillus licheniformis
atggaagacccttttttggatcatgaagtgaaaaacgcggatttgaaaggggcggaaattgtctcggggctcaagctggaaatagataaaatcaccgtaagcatcagtgctatcgttcattggacaattgtacgctggacgattatattgataaaatatctaaagagcaaacaactaggcaaaacaccatcgactaaaagtagaactcattttgatgtaaattcaactgtcatattagaatcgcaaaaggccactatatttttaagggaagtacagtgggtcccgctcaaaaagagtacacctaaaactcttaggacatgctcaactaactcatgctga

SEQ ID NO: 3788 - DNA, 339 bp, Bacillus licheniformis
atgacgatatttacgcggcagatcaggtggcctgcggagacacggtatgcaaggaggacacggcgttcgaccgcccgcaagacaagacgggcggactcgcagcacggacagaaggaatgtactgaaaacgtaaaaagacaggaagcagcaaagagacgaagtagttactctctgatatcgataagtcaccacggggtaccggggaaacacgggaatgaaaacggaaaacccctaatagctattgtctgcgtgctcctctcccccacacacaaacaagaaacctacaaaagaaaatctggctcttccgttcatatccgtttgccttctcctatctcctag

SEQ ID NO: 3789 - DNA, 339 bp, Bacillus licheniformis
atgtcgcgtgacctgtcatataaacacttcttcgtagtcgcaaacggtagcttgcgtgtcaaggtgtggtctccacttgttcgcaacgatgcaaattggacaagagtgggtgcggtggtagggagcgatgaagtgcacgtagcgcatccgttgagaaccgtatggccagtagtggaaggttggattcggtataatcggttcctgggagcgctgttgaggcgcgactggggggtggcgcccgaccgacgcgtgcggtgggcacatgcgggcggccaggccatgcccgttcttcattgcgagctcagggttcaggcctctcagcgagagtccttgcaatag

SEQ ID NO: 3790 - DNA, 339 bp, Bacillus licheniformis
atgggatatgatcctttaatttcagcattaagaaagtataaaaataacgatttgataatagaatggaaaagtggattaaaggttattggagaacctgacacactctatgaaacagacaacggattggacgatgatgatgtcaattatatagaatatgacgcagtcgcatttcaagtaaataatattttatcccaacccactaataaagattgtggtgtatatgattggttaagacaaggagaaagttccttaattgaaatttcactttatgaagatacaccaagtgcagtatatttaacagacggtcagaaaatatgggagatggatagtgatgaataa

SEQ ID NO: 3791 - DNA, 341 bp, Bacillus licheniformis
atggaagtcgacaccccggatggatatttttgggggttaaatttttctcatcccgataaggatgttttcgccccccataaaaaaattctggggccgtctcctgggttttggggaagggaaggaaaaacctcttttactgggggatcgctcggaaaaaaaatggacaccccgttttttcccaaccttttttcccgcttttgtgaacctgaaacctggggaaacagggttcgtacggcaattctgatgggggtaagggttttcccgcaaatccttggctgggaattccggaaacggaagaggggttcccggtacacagggcctcttgggaccaccccccaggg

SEQ ID NO: 3792 - DNA, 218 bp, Bacillus licheniformis
  misc_feature (1)...(218): n = A,T,C or G
atggcttacagagtgatgaaaaacgccggaatggcggcggatgaaggcgctttaaagaaagaactgatgacgattgacgacttaatcgcaaagtgcgcggatgaagacgagcgcgacgnttaattgagagaaaaacagaaacccggctcaggctcgacaggctcgccgacaaaaaaggcatgttttccaagcctgcctcagcgttttataaagaaaaa

SEQ ID NO: 3793 - DNA, 335 bp, Bacillus licheniformis
atgcagaaaagggcaatgaagctatcgctgttattgatgatttttttcacttttacattgtcgcagcttgagcttgtcggatatacggtcgctgtattggctgtcacgtaccagctggcattaggcgcaagctccttggaagacaaaaacaacagtgacaaaatcctgatcagcttgcctattaaaagaaacatcatcgtattatcgaaatatgtatcggtttatgtctatgcggcttatgccattctcttctattctttgatcaatgcggtcggacatttgctgcacttgccgcttgatttcccattgacattttcaggaccgatggggtgctg

SEQ ID NO: 3794 - DNA, 163 bp, Bacillus licheniformis
atgtttttaaaaaagctgactttacttcgggaaggagttccttcttatgcaaaatatccattttcaattcctgctattcaacatttaaaagaactgacgtttcaaaaaaacgtaacattttttgtagggtcaaacggatcgggcaaattgacgctgctgaagc

SEQ ID NO: 3795 - DNA, 336 bp, Bacillus licheniformis
atgcaaatcacattaatgattgatggtgaagagaaggtatttcaagcacctttcgtaaaggggcgtatgttgcgggaagctattaaactttcgaagtcgagcaactttgatgatttggatgttgaagatttggacgcattggtaggttacgtagtccgagtttatgacgaacaattcgatatcgatcaattttatgatgggatttcttctgaaaaactaattcctacaattacggaaacaatccaacaagtcgttggaactgtagctgttccaaatgaacaagttggcgagaacaaagaaactgaagcgcaggcaatcggtgaggtaaaaaactaa

SEQ ID NO: 3796 - DNA, 248 bp, Bacillus licheniformis
atgaacctgttttggatcggacttggtttagcggctttaggctattttatcggtgacggcttgaaaaactttaaaaacccaaagggaatttattcaggctatccctatttaatcaaagaagacgatttacattattatttaggcttgagcaaagtagaaacgaaagaaatgctgcgtaaatatcctgacatacctaaaattgaattaaatggcacgacctattatccgtatcagcaattgatggattg

SEQ ID NO: 3797 - DNA, 213 bp, Bacillus licheniformis
ttaaaataattgatattcttggagtattaggcatacctaagtcaacatattaccgttggaaaaagaagtataaaaaagttgagctaacttcattagaagagctagtaatcaagctgtgtaagaaaaacttctatcactatggtcatcgtaaaattaaatccatcttgaacagaaagtaaagtataaattatgccactaagcatgcgaatcgat

SEQ ID NO: 3798 - DNA, 237 bp, Bacillus licheniformis
  misc_feature (1)...(237): n = A,T,C or G
ntccatcagcccgaagcttgcttttgaaggggaagaagtgtcgacgattttgggactagtatcagcagggctcggtgtagcaatcctgccgaaaacggcggagcacgtccattctccagtggcattttgccgagtgtcagactaccgttctgagaggacgatcggtctcgccgtcctgaaagaccattatttgtcgccggcggcacgcaactttaaagaatttgtaattgaatacta

SEQ ID NO: 3799 - DNA, 333 bp, Bacillus licheniformis
atggaaaatttcaacaaactggcttcactcaacaacttaaacggagatcaagaagataccctcttcatacggcgcaaccagcttcaaatgctgaaaacgggcatgagagtaacggccgcaactaagcttgaaggcattaaaacgacactaagaccgaagtttaaaataggcgatatacaaaaagaaatgaacagcgtttattcatcgcttctctacagcttcgaaggaaaagcgcaagaggcgcttgctcaacgaatcagccaaagcgcccagcagcttattaacacggagaaagacggagagagctttgtgaacggatttaagacgagatag

SEQ ID NO: 3800 - DNA, 333 bp, Bacillus licheniformis
  misc_feature (1)...(333): n = A,T,C or G
atgcctcctatctatttaaaccaacttttcacagactcaaaactgtttttaattcctttttcaatagaaccagcaactttttcaccagcatccttaattgcatcaccgtatgaagagctagncattgcttcagctacttcgnctatcgctccaccaacatcactcccacaggaccgccgacgcttcctattggtgctccaaattcacacctgtagaacagcaaaaatgtctgtaccacacctgctgcgaacgtnctgtttttctgcaaactttgttcgagtctcgggatcggtatcctgtaagttaaacgaagtactgcgtaccaccataggc

SEQ ID NO: 3801 - DNA, 139 bp, Bacillus licheniformis
atgtgaatgtcggtctgttaaaaatgtggtttgccttgggatcaatgggcctgatgttcttagcggtgattgccatatacataagcagatataaatttaaaaaccgttttttaaaaattatcacgtcgtttgtcgccta

SEQ ID NO: 3802 - DNA, 333 bp, Bacillus licheniformis
atgggcacaagagtacattacgcagaagaagtaaaatgggaagtaattaaaatgaaacaagctggaatgacaaacaaagaaataatggaacaactggggataaaaaataagactcaaattaaaacatggatgcgatggtacaaaacaggccaaacctatcgattttcgcaacaagttggaaaacaatattcctacggtaaagaatcggaggaaatgagtgagctagaagaattaaaactaaagaataaacagctagaggctcaattggcaattataaaaaagtaccaggagatcgaaaggagttggagccacgagtcattgtccaagttgtag

SEQ ID NO: 3803 - DNA, 165 bp, Bacillus licheniformis
  misc_feature (1)...(165): n = A,T,C or G
ttatgaaagcatcatgctcccgatcgcagatgaagcattgatcanagcatgccggaaacaatgtgagananagtcatatgagtggggagcaaacgctgcaccagacgcctttatcattgataaacaccggctgagggaccggactgaagtaattgccgagaggga

SEQ ID NO: 3804 - DNA, 333 bp, Bacillus licheniformis
atgaccattatactgaccatcatcgctgctgtcctcgtcattatcggtctggtggtatttaatgtgcggtcggcgtcttctcaggataaacccgaacatgaggataaagctgcatctgcggctggcattcctcaggttcaggaagaagaagagcctgagcaggttaaagccgatcagcaagatccgttcgaaatgaatgatcaaacctatcgggcgatcctgcaaaaacttcaacaaccaaaagaggaaaaaaaatatcccgagaagacggaaatggacgatatggattaccgaaacgcattaaaatccatgaaaaaacgggaacaggattaa

SEQ ID NO: 3805 - DNA, 333 bp, Bacillus licheniformis
atgcaggcgaaagggtctttcactccgaattcagacggacttacaccgattgagctgttggaagcttcattaggtatgtgcatcaccatttctttgcaaaagatgtttgaaagggatggtatagaggtgctggaggatgagttttccgtttctgtttccgccgctaaagcccccgaaggcccgtcccgtgttgaaaaatgttcggttagcgttaaattgcctgagcatcttccgaccgactataaaaagaaactaatcacctctgctgaaagggcatgtacaatcggcaatacgttaaagcgaggggtaacgattgataccaatatggtgtaa

SEQ ID NO: 3806 - DNA, 333 bp, Bacillus licheniformis
  misc_feature (1)...(333): n = A,T,C or G
atgccgagtttgactgcaaatgactgctacgtccatttaaacagttgtgtcgggaccaggataataccccctttaaaaatgaacggaattgcacacttagttgtagcttatttaaaaggggaactattacccttgaaaaaccccgtcctttggttnaaattaataaccgatattaaggggaaccgaaaatggcgaaatttacaaggaaaaccccagcctttaaaagtgaaatataacctccttctaaggaaagggttgggaagaaacaacatatatagcggaaaatctgaatattccctcctttgtggtaatgggcgcaaccaaaggtcttag

SEQ ID NO: 3807 - DNA, 333 bp, Bacillus licheniformis
atgaacgttttcagccaatccggcgtcggtgtatggcccaatacgaccaatataattcccacgcctttcgaaacatcaatccactctattcttttctgcaacacgggtatctcctttcagaccgcttcgccccataagaaagggtttacacataatgtaccatcatccccgcctttcttcctccgcgaatcacgcctcaaggcgatttttaatcgtcaggaaatattttgttcatcttcttgtaatgatcgattctattttttaacatactcagcacatactgcgtttcttattctcatcatgaggaaccagaccatgcaacccgtcttataa

SEQ ID NO: 3808 - DNA, 372 bp, Bacillus licheniformis
ttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcttttgcaactccgtacagagtgtcctacaaccccaagaggcaagcctcttggtttgggctgttcccgtttcgctcgccgctactcagggaatcgcatttgctttctcttcctccgggtacttagatgtttcagttccccgggtctgccttc

SEQ ID NO: 3809 - DNA, 330 bp, Bacillus licheniformis
atgacattacgcgatagagggacgatgaaatggacgtctatattcttgccggagcacatcgctagtctccggaaacttaaatccgaaattgatcacgcatatgagcggaagccatcgattgatccggagcagtggtcggactttgaatcgaagatacaatacgcgtacaggaccggacaggattgcgagatccgttactggcgtaattgggtcgcggagagggtgagcggcgtgattgaatccgttgatccggtcggagggacattgcggattgaaggcgttgacataccgttcagggagatcgtgtgggttgcgttggaggacgtgtga

SEQ ID NO: 3810 - DNA, 660 bp, Bacillus licheniformis
gtgaacgatttgtctaattccataaaatcattagaacctataaatataccgtgcggctggttcgttaaatataatgacttaaccgacacacatgaaaaagttgaaccaaataccaaattattagaattagaaaaacaaagatatcatgctgcggtcaaaatcattaaaggccaggatgaatatcttattcatatttatgacaatcatagagaaacgattgacacaatcaatgttgaagatcgcaggcagctagtaaaagagctggaacggatcatttggaaaatagaagcggcggcatttggagggaactttttcatttttgaagggcctcctgactatttacgtcttagaattcctcaaggatggaccgtctcttataataaactaattgatatcgatccagatcagttagaggaggacagtgatgactggtttaactttacgtcatcattactacagttggagcataaagaaagccgcttgattttagatgtcggctggtacgtggatattgagccttcaggcactttttatatgctattaattaagaatttggactgggaaaacccgttagaagacatggaaacgagaagaccggaaaaattagtggaccacatagaagccgcccttcaaaaagcagccgaacatcaatataaatag

SEQ ID NO: 3811 - DNA, 209 bp, Bacillus licheniformis
gtgcgaaaacgattgatcgaagagcgctctaagaggggatggacccagaagcaagtgtcggaaagacttggactctccgaggtttatgttcgcaaaattgaaaggggaacacgcaatcccggcagagaaacgatgctgaaattcgaaacgctttattcagtgcctgatcgtttgctgtttcccgatctttttcaggtctttatagatac

SEQ ID NO: 3812 - DNA, 327 bp, Bacillus licheniformis
  misc_feature (1)...(327): n = A,T,C or G
atgaaaaactctctcncggaaaaggaaatctctcngcgttctgtgtcngataaacgcaatctcaccttttatatatgtgacggtcanaccgctaaaaacaaacggaaatctgttcggttttatcttctccaaaacaaaagttntcatgcctcggggatactcaacgctctcccctnagatagcanaggaaaactnctcctgagattcccacggagatcctntctctttttgtttctggtgctcaaccccttcngaaagaccacatgttttgggtctcctctccaatcggagagaaataaatcttcttttaaacagtgggtttggtag

SEQ ID NO: 3813 - DNA, 327 bp, Bacillus licheniformis
atggaagcattggctccgcaggcaggattcgaacctgcgaccgatcggttaacagccgatagctctaccactgagctactgcggaataagaaaagcttcaattcatgcagggtaaagatatataacagcttggcggcgtcctactctcacagggggaagcccccaactaccatcggcgctgaagagcttaacttccgtgttcggcatgggaacgggtgtgacctcttcgctatcgccaccaaactatgccttcaggacgaaggtactgggcgttcctcacaggatgtgagggcctttagccgagtttccttgcctttggctttctga

SEQ ID NO: 3814 - DNA, 651 bp, Bacillus licheniformis
ttgatatttatcggcacaaatgaaaatgggaccttcccatttggaatcttgcttgactcacaaacgaagcaaacattaaaagcagatcttgaagtgggagatacatttcacgttcgcaatagccatctttcccacaattgttttgaactcaattttaatgcggaaatacttccgttatatacagattttaaacatgcaaatataaataaattaaaagaaaacgtgaaacaaatttcatttaaatcgtatgaatctactgattttgaatcagctcgcgtgtcggacttgataaataaattacacgatccaactgaaaatttggaggaagagcttcgttactttatcggtcggggccaaggtttaacgccgacgggtgacgatatactggtcggtatattgtatggacacttcatcaactcttttatcgccgaaaaacaccttgaaacattgggaagtctaatcagagaacccttaacaacccttgtcagcacgcgctttttaacttgtgctatagaaggcttgtttagttcaaaaattacaaaattacaacatgattcatctttgaaaagtataaaaagtcttataaaagtaggttcttcttctgggatggatactttatatggaatttatatggctttaacaaaggagtga

SEQ ID NO: 3815 - DNA, 127 bp, Bacillus licheniformis
atgcttagagatatgggaagacgcctggccatcaccgttattttaagcggtattattctcggggggatgagcatctcccttgcaaacatgccaagctcgccccccggccaaacggccaaaatcaacc

SEQ ID NO: 3816 - DNA, 324 bp, Bacillus licheniformis
atgaacaatgaaacgtacattgaagttaacagaacatcgcagcttatgaataaaatgagaaaatttacagtgctgattgatggtgtcgaggctggaaaaatcaaagatggcgggagactgcgaattgatttggagcctggcgaacatgagatccaagtgaaaattgattggtgtgtaagccaagctttgaggtttactttagatgaaggagaagtgttaaagtttagatgcggaagtccggttcgtgggtggaagatgttcttcggacttttttatgtattggccgatccagagaaatactcgtttattgaactggaagaatag

SEQ ID NO: 3817 - DNA, 151 bp, Bacillus licheniformis
ctgtgatgaaagaaaatctgcttcatgaaattgaggaaaaaagaaaagagctgctaaaaatcgtcatgacaaacggcatgacttcacatatcaccattcagcacagccagcagctggatatccttctcttggaataccaaaaactatctct

SEQ ID NO: 3818 - DNA, 369 bp, Bacillus licheniformis
ttgtgtgtctggtatcgtgtgtgtagtatttgggtctgtttgtagtgattttgtgttgtcagagtagttcctagttctgttgtgtgtgggttgctttgtgtgtggatttagtgtgtgtttgtgggtttgtatctgtgatttgggttgaggagtttgtattgttatgctttgtgtgtgtcttgtttagtagtgtgattttggttgatttgtttttgttgatgtattatgtgtgttttgttgttgttttgtttttttttggtttttttttttgtgttaattggttgtttggtgtggtgttgttgtaatgttgtttgttttttgttttttggtgtttgttgattggtatgatttttagttttattttggtcg

SEQ ID NO: 3819 - DNA, 372 bp, Bacillus licheniformis
cactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcttttgtaactccgtacagagtgtcctacaaccccaagaggcaagcctcttggtttgggctgttcccgtttcgctcgccgctactcagggaatcgcatttgctttctcttcctccgggtacttagatgtttcagttccccgggtctgccttctc

SEQ ID NO: 3820 - DNA, 129 bp, Bacillus licheniformis
agctcgcgagaccgactggggaaccgagtttctagcgccggtagtcagcatcaaaaccgttgccggagtcgatgaagccatccggcacatcagacagtacggcacacgtcattcggaagcgattctgac

SEQ ID NO: 3821 - DNA, 324 bp, Bacillus licheniformis
atgacaattgagactgtgagaaaaggtgagaataaaaatacaccccagacaggttccaacgcgcgccgccgccccggcaatcgttctcgaaacccgggcataaaagttccgggcgccttgaggcgcgcgaacaagttcggaaacacggaaaaaattggaaaatctcatatctccggccgcaaaaacttaaggaaattccgaaatctccgcccggatgtaaaccacgcgagaaattctacgaaagctaaaaacccccccggaggggggaggtttctttcaaaagccgaattcgacaagaatttcacaccgcccgggtctctcggc

SEQ ID NO: 3822 - DNA, 324 bp, Bacillus licheniformis
atgaatgcagaaggcggagcaggaggcggcggtacaaacatccatctcgagtttgaagaaatgatcaccatttccaataagctgaaaagcatctgcgatatttatacagaaggggttcagaaggaaatcaaaaacctctcagaatccgatttttataaagccggacaagcatcaaaagcgattgaaagctacgcggatattctcggaaagacgatggagctgtttgataattactgtatagcttcccacattgtcagttatgcgatggagaaaatgtatgaaacagataaagagctccaaaaactctacaagattcagaaatag

SEQ ID NO: 3823 - DNA, 1059 bp, Bacillus licheniformis; identical to SEQ ID NO: 3042

SEQ ID NO: 3824 - DNA, 264 bp, Bacillus licheniformis
tgctgttaaatatttattcccggatgcgattatcggtgaggactttatcataagagacgatggggatgggcgcggtcagtatattgagacttggcggataagcgctccgcaaccaagcgaaaaagaacttcaagaagcatgggaaaattacttggaaaacccagttacagatgatccacaactttcatatacatcccagcagcttttaaagttaggccgtgagatgtcttcactgaaacttgaaattctcgcgcttaaaggaga

SEQ ID NO: 3825 - DNA, 165 bp, Bacillus licheniformis
tcccctcctcgtgcttacaggaggcgatcctttaatgagagtcgacgtattcgccattattgaatatgccgtccaaaaaggggttcgcgtctccatgaccccgagtgccacgccgaatgttacaagagaagcgattcaatcagcaaaagaaatcgggttatcccg

SEQ ID NO: 3826 - DNA, 321 bp, Bacillus licheniformis
atgacagtgaaatggctttacaaatatgatgagaaattcaattacatgccgggagaagaaattcaagtcgaagacgacgctgagctaccggaattttattgcgaagtaaaaccgcctgacggcctatacctagccaaatttgatcctgcgaaaggggaatggtttgaatcggccaccaaagaatatattgaaagcttgcagcctccggagcctgaaccgggcataactgatctattgaaaaaacaaaatgctttactctcattgcaagttgcgcgcctgcaggctgatgttgaagcgttaaaagggggcggggcatcatga

SEQ ID NO: 3827 - DNA, 319 bp, Bacillus licheniformis
  misc_feature (1)...(319): n = A,T,C or G
atgacgatgaagcaagaggaaacgctttggcccgattcgccgattacggccggtaaaaacctggacgcccggtacacccctgccgtatattcgccttcgggtttaacgagaaactcttttcccggaaaaatcccattttttttttcntgggaggaaaaaaaaagggcgggggcgcagcacttcgccccgctcggcatttttatttttttgtctgtttgnnnnnnnntnnnnnntcgcccgccgctggcgggatggttacttnccacaatttcatttatctcctnctntcncccncntcttcnctcttgccttgctcccc

SEQ ID NO: 3828 - DNA, 321 bp, Bacillus licheniformis
atgacgagcgcagcgctggagcataaaagcgaaggctacgtcctcggcgtatggacaaacatgttcaagcttgcgggaaacgtcatcgtgttcggtgttgtggccgcttatattgtggggatgatccgctttgcctttgacaagctgttttatgaggaaaacatcatgaaattaacaggaaaacaaacatgggaattcgagaacccgctgtttgttaactcaagcggaacagcggtcggtcccaaagaaaaagaagtcctcttggacacttatttgacaaaagctatgatgaaatgcactgcaaccagaaaaactgggaaa

SEQ ID NO: 3829 - DNA, 321 bp, Bacillus licheniformis
  misc_feature (1)...(321): n = A,T,C or G
atgcccacattagaaatcgaaggaaaacaatatgaagcacgctgtgatttcaaattcgaaaggacagcggaagaaaaatataacgaaanagacgagagaggagacaaacaaggcggcttacgaaatgtatatctcggcctacttgagcaacgcagttcactttacttaatccggttctgggattgtgcactttctcacttgaaagataaaaagccatctgttgaaaaaatcgaagaagcgctcgcgaaagttattgaggatgaaggcgcaaaaggtgggaatagactttacaaaggagcgttgcatttcgntgtcaacggg

SEQ ID NO: 3830 - DNA, 204 bp, Bacillus licheniformis
ttctgaaacgtcttatccgccttcagccccgcaaatgcataccggtcaatcttcgcagcagatgaaccaaaggctgaaaaatctcgaagatcaaatggaattgctcatcaagctcatggaaagcaacaatcagctgctgcgttcgattgaagagcagcagaatcgcgtctgcacggccggcggcggttcggttatcgtcaggat

SEQ ID NO: 3831 - DNA, 318 bp, Bacillus licheniformis
atggtaaaagtattgacaaaagttaacaaatcgtatatgttcaatgtagataaaaagaaacataagagattagaaaggggagtaatcatggtaaaaaagattcatatcaaaagagattttgttctccagtacatgattgaacacaatctctccttaaatcagcttgccattgaaatcggcgtatccccggcgacactcagcagagttttaaatggcgaaaggaggcccggacaacttgtgatcggaaagatgattcagtatttcaacaaaaaatttgaagatctcttttattataaagatgttgacaaaagtcaataa

SEQ ID NO: 3832 - DNA, 318 bp, Bacillus licheniformis
atgatccaaatggaatcgaaatgcaagcattgcggtgaggttcatggagttttattgcgagaggagaaaagggagaatggcgttgaaattgggtatattcaatgccccgcctgccagcatagggccgtgttttctgtgactaccccacaaattagagtcctccaaaagcgtattagaggtgtaaagaaccaatatgcgaaagccaagaggctaaagaaagccgagcgccttttgacagagtatttcaatttaaaggagcgtattggcctacttatgcagcctttagtcgagcaagcaaatgaagatctgaatcaataa

SEQ ID NO: 3833 - DNA, 186 bp, Bacillus licheniformis
tccaaagattttaatggtgctgggcgccgtcatttttggcatcggtttattcatgcaagtcatcggcaggcttcccggcgacatttttgtgaaaaagggaaacgtgacgtttttctttccggttgttacatgcattgtcatcagcatcattctgtccgtcgtgttttcattcttcggacgaatgaa

SEQ ID NO: 3834 - DNA, 318 bp, Bacillus licheniformis
atgtttcgacaatgtttctccgtaaattggtccgatgttctcgatgttagtttttcgggagctctctcctgcccactttttcagtttcatcaatatctgttttcaagccgatttcagccgcttgtaccattgcgttttaagcggttttttcaactttgttttaagcgcccgtctattcctttgaagcgcttgtcgattgcgttaaagcgcttatctacttcaacgaagcgtgcgtccacttcatcgaagcgcttgtctatctcaacgacgcgtgcgtcgattttgtctaagcgcttgtcgattccatcaaggcgctga

SEQ ID NO: 3835 - DNA, 132 bp, Bacillus licheniformis
cgaactgaaaaggctgcagcaggctgtcaagcaggagctgcttcaggcgaagcagaagcgtgccatgcatcattcctatatcaatccgtacgccaacatgacgattgacggcacatattatgacaagcgcaa

SEQ ID NO: 3836 - DNA, 130 bp, Bacillus licheniformis
atgcattacggaagctacggctggtatgtagaataactgaaaaagctgggaatgacgaagtatgaaggaagaaagcttcaatgctataaacaacactttttggccaacctgcttgaaagcgtcaaacaat

SEQ ID NO: 3837 - DNA, 318 bp, Bacillus licheniformis
atgtttataaaatataatgaatatgatttactggaactttttgagagcgagccggtcagtatagctgatgatccagaggccggcgaattgatttatacttttaaagataatcaaaacttcaagttaattttaacgctggatgtttatcaactaacttgtagcctggatataacctataaagatttcttagtatttacaggtgtttttcaaaacataactagcattaagaaagttgaagatttcatggttataagtattggagaagaaaagagaataaaagtaaaattcactaagcaaattggagtagagttactttaa

SEQ ID NO: 3838 - DNA, 633 bp, Bacillus licheniformis
ttgggtagtaatcaaaaggtttataataaaggtggagcgttcgttaatcaagctaaaaaggcatatgaaaaaatcaaagataagacagaagatagcgaagacttatatgaaaaattacaggacatttttggaaaggcgtttcctatacctgaagaaatacaagagagtaatgtgattgaaaagagtgcattatttggtaggagtgttcgacaaacagaagaatttattgaacataagtttgatgttgacattcgttatcatctaaaaattgactgtatagtaaaacaagatggatttagaaataagtttctaagaaacatcttacgtgataagttaccgttaaaggcgaataagagcttagaatttttcataacagaaaatgaattcgaaacattgtctaaagatgatgaggataatctttattatgaagtgtattggaaagttcttaatcgtggagaggaagcaatcagaagagactgtataagaggacaaattgtgagagacaagggtacacacaagaaatttgagtctactaactttaaaggcgaacattacgtagaatgctatattgtatataaaaatgtttgcgttgctaaagacaggattagtgttcctatatctacaattaattga

SEQ ID NO: 3839 - DNA, 314 bp, Bacillus licheniformis
atgccgatgctgaatgacatgcgatatcgaatcaagtttcaaaagaaaaaagaaggcggccgtctccctgtggaaggtgactatgaaacggtcgttgaatgctgggcaaaagctgaaggattaaaaggccgggaatattatgcggccgctgccgtcaagaaggaagaaacagtaaaatttacgatccgacaccgtgaaggtattggtaaacatatgcggattctttttcaaaaccaatcatatgaaatagaatctatcataccgaactattcccggaaaaatttcaccacaattagggcaaaggcggtggaata

SEQ ID NO: 3840 - DNA, 315 bp, Bacillus licheniformis
atgcctcacattggcgttaagaccattataaggatttatagaatgacaagcactataaatcgggcagatttttcaataggattcgaccaaaagccggtgagcgccattcctgtcatgtgtttcatatttttaatcttcgcaagcgatttgcagggacgccggttatattttgctttcataaaaaaagcgccgctggcggcgcttttagaagagagcttgtccggtgacaagcagggttatgcggtgttttgtcaggcggctggcgaatttccgtcaaagctgtcgagaaagatcgatctgcccgccatcagatga

SEQ ID NO: 3841 - DNA, 315 bp, Bacillus licheniformis
atgggcgggatgattgccggctatttagccggaaaatatccggtcagccgccttgtcctgttgagtgcggccgcccagtacatcagcccgggacagctgatccaggatttgaagaatgtgatcaaagattcactgcaaggcaagctagaggataatctgctttacaaaaggtacaaacaaaagctgacaagcactccggtgtcttctgcatttcagtttcgcaagctcgtcaagatgacaaagcctgcattgaaaaacctacggatccctgtgctcattgttcagggggagtgtgatgccatcgtgccggtgtaa

SEQ ID NO: 3842 - DNA, 123 bp, Bacillus licheniformis
gggttcttcgttctcttaaacaaatcaacgttcttggcatcttgttcggcggggcggcttttttagtgttcggatggtttaccgtcatgacaattattaacagcgggtatccgacagtccact

SEQ ID NO: 3843 - DNA, 114 bp, Bacillus licheniformis
ctgccgaaagtcacggcgggctttaaccatttcctcgcgctgcaagctcgtgattcctaaaaaggatgacgacaagccgaaatcaaaagaggaagagcggttcgggggccggat

SEQ ID NO: 3844 - DNA, 291 bp, Bacillus licheniformis
aaaggctgacaattaaaagaggaagcttcctcgcctggtcaaaagattatatcgactggtactacaacggcaaaaaagtatcgaaaagcagcggatcgcaggatgtcggctacgtctttccgaatgtggtgagggcaaaggggattaaaaggtattataagtcatcagggcttcacaaatggaaagcgaaaaaaacgctgagcttcggaaccgttacaccgtggggagatgttgaattggccagctcaacctttacagacagaaggtgggtcaataaaaaaggaaaatacg

SEQ ID NO: 3845 - DNA, 315 bp, Bacillus licheniformis
atggaaaggaatatgagtgttccgaaagatgccgcttgctcgatgccccatgatcatcaaaggtctttgcacgatttatgccgcaaatacatgcactatcacgtcgtgctgaaaatgaaggacggcagttctgttcacggcattcttgaaggggtgaaccgtcaggaagcatctgtcctcattcccgaagacgtgacagatgaaaggcagttttacggcggttacggatatccgcgccgacgattcaggcggttcaggagaaggatcttcccgtttgtttttattgctgcgctgtatccttttccatattattaa

SEQ ID NO: 3846 - DNA, 315 bp, Bacillus licheniformis
atgtgcctgaaaatgaaagagaccatcaaagcactaccgcacgaatggatgagcagcatcgcgatgaagtcaaagctgatcataccgaaagccattgcggctcctgccggaagcgccgatccgcacaccgccgctgcggccgcttccttaaacgaccttatcccggtcatgttggattttttggagatccagatgcctcccgccagaacggccgttaaaaaaagcgagatgatgaaaaccgccgaacaggccagcatgatgataagcggcttatattgggcaaaccacattgcaccgataaaatcccccaaatga

SEQ ID NO: 3847 - DNA, 123 bp, Bacillus licheniformis
cgtctcaagaatatcggttgtctacaccataatggatttgggttttgcactcgcccacgcattctttatttcctgcctgttcggaatcctttgctacttcctgctgcttgttgcgcgctatcg

SEQ ID NO: 3848 - DNA, 212 bp, Bacillus licheniformis
atgaaacagaaatcggaagtatacgcctcatccgcctcccagcttcttagtctgattcaggaacaaaaaaggatgaatcaggagatcgtgaaccgattggaatcgatcaattccgctcctccgctttccagcgaaatccgctatttaaaggttctgctgaacagcagcagcacccatattttaaacagtatgagtgaagcgaccaaacacat

SEQ ID NO: 3849 - DNA, 312 bp, Bacillus licheniformis
atggggaatgtttgtatgaaatctaaaatgaagatcggtttagggattatgataattggacttggttttctcagtcatttttcgaacaacgatgatatgaacacagcttcaagaaacatcacagcgcaccctccagtcatgattttgttgtttaacctaaaagagtttttggaatatccttttagccgttttaatagcggcttttttttatgtatttcaaaccctcaacaaaggtttaatgacctgatcccaaggattcattttcacggattgtcaggatttattaaccaattcctttccgtaaagtggtaa

SEQ ID NO: 3850 - DNA, 313 bp, Bacillus licheniformis
atggttattgataattctaacataaagtatataaaatggaatcgctttatgcgggagggatggcaagtcggattgaaaaagaggcaagtagggtggaaacagagcctggcgccggcgaattttactataagggtgcaagccctcctttttgcaaaagagagcttaaaccgcttagcaagactggcttactttatcaacttcaactgtccagccgaatgtgtcaagcaaagcgcttttttgataccggtgatccgttggacacccttttggcgatttctccagtttgaccggtgtgtgatcacacaggctttcg

SEQ ID NO: 3851 - DNA, 311 bp, Bacillus licheniformis
atgatttgtgagacaaacgatcaaatggttcgtacagcgattaaactggcaggaggaaaagtggaacagccagtccttgacatacaaaaatttgaatatacccaagaagacttgacagtagacgaaaaaattatgtccttaatcaatacgaaaccaagtgtcatcaatattgggctgaaaagttttacagcagctgttcagaagagcggatcagagtgtgttcaatttaactggcggccaattgctggcggtgatgaaaagctaatgaaagtgcttcaatatctaaactactatgaaggagagacaatcta

SEQ ID NO: 3852 - DNA, 158 bp, Bacillus licheniformis
atgacacatagcgcattaaagcatttagattatcacaattgggcgaatcaaagggtgctcacccacctgaaaagcctgcctgaagagctgttcacccgggaaatcaaaagcgtttttcaaactgtatctgaggttgttacccatatgtgcggcgctga

SEQ ID NO: 3853 - DNA, 311 bp, Bacillus licheniformis
atgataaaatatgtccacacaaatcattcaattaaaaaaattagaatgcgaacaactgcgaaagaagtgagtgaaatgaaaccaaagtataaggtcatcattaatgacattaaaagtaaatactttccagagtttacagagcggggagacaaaattcctactgaatccgccatacaggaaagagtccaaagtcagcccgcccaactgttccgaaaagcacttttagaactatggaacgaaagggtccttaagaaagtgaaaaaagttctcggccccttatggtatttaccccgtttctatcaaaagcccgg

SEQ ID NO: 3854 - DNA, 312 bp, Bacillus licheniformis
  misc_feature (1)...(312): n = A,T,C or G
atgaaggacatgcctatcaatcccaaggagacgccaaaggggactcaccctccgacgaaaaagcgcctggtgcgctggcggacgcggccgaggagcatgatgggcgcctccaggcgacccgctagaaccaccccgccaaaccttctgcagcccgggcgcgcgcgatcgccaggacctcaacggcaatccgcgggacaccctcctagccagcttagcgattgcgttttagccgaacgaaccgccgacgcaatgtacgaacggtttgccgcaggcngcgccgcaagaaacctangcccacaaccgcacccacct

SEQ ID NO: 3855 - DNA, 168 bp, Bacillus licheniformis
cagattgtatatgctcatgcttaacgtgtttatcgtgatgcttggtataggcttgattattccactcatgcctacgtttatagaagaattcggcgcgtcaggcagcacgctcggattgctgatcgcggcttcggggattacccagctgctgttttcgcccgttgccgg

SEQ ID NO: 3856 - DNA, 138 bp, Bacillus licheniformis
tggtgaatttaatatcgactacgactatgaggatttatcagatgctgatgattatgaaagaagaattgtatgggaacacaaatatttaggactctggccagaagatgaagatgataaggaatttttagagcaatacct

SEQ ID NO: 3857 - DNA, 366 bp, Bacillus licheniformis
ccccttccgggggtgcttttacctttccctaacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcttttgtaactccgtacagagtgtcctacaaccccaagaggcaagcctcttggtttgggctgttcccgtttcgctcgccgctactcagggaatcgcatttgctttctcttcctccgggtacttagatgtttcagttccccgggtctgccttc

SEQ ID NO: 3858 - DNA, 313 bp, Bacillus licheniformis
atgaagaaactttatattagtgctgtcctgggtttattgtttgtttttgttggtggaacaaaaatacatgctcaagaaccacagaacaataacggggttttggatgagaataaattcattgatgaaacagtgtattcatatacgcagccaattagcatacaggatggtgaagtaacaacacaagcgaaaaaatatatcaaaaccgtgtcagttaataggagctataaaagtcttttaaacattgtagttgccagacattactctgatactactttcacttacggaagcggtaagttatataagagtcccagag

SEQ ID NO: 3859 - DNA, 312 bp, Bacillus licheniformis
atgagaaggcagagtgacggagcctacgagacagccgtgccccgatgtcgaaagcgcgcacaatccgaagcgcgactagattgcgataagccggagcgtcctagggtgactgactctggaccttcgttacgaatcgcccacttggttctctcacccctctgctcgtccgcacctctcctacgccgtgtcgcctcctatcatgctgagcggtgccgcgctatttgcgcccgcgtcgcgcaccctcgcagcggtactactgacgtcgcgcaatacactcctttcctaacctcctctctgggtgctgctcggtga

SEQ ID NO: 3860 - DNA, 312 bp, Bacillus licheniformis
atgaatgcttctaaaacgcctggcagccgtcgacataggtcgtgcgcatctatgctttctcttcaaccctctattgtatataagaagataaccaataaatgtttatatatcccagtttatcttgaggattttcaaatagtcggcagagaaatcccttgccattcgccctctcggacatgctgtttgaaaagggccgcaaataaaataccgactgcaaattctatcaatatatcccaaaatcgagccttaagtatgaaatgtgaacattttttgatttatttggaaaatagtctattttcctcattcttctaa

SEQ ID NO: 3861 - DNA, 621 bp, Bacillus licheniformis
  misc_feature (1)...(621): n = A,T,C or G
ttggacaaagggagccgggttttggacaaagggagccgggttttggacaaagggagccgggttttggacaaagggagccgggttttggacaaagggagccgggttttggacaaagggagccgggttttggacaaagggagccgggttttggacaaagggagccgggttttggacaaagggagccgggttttggacaaagggaggcggtttttggaaaaagggagtcgtttttttcaaaaaacgaggcgtttttttaaaaaaccgagtcccttttttcaaaaaccgagtcctttttttccaaacccgtgtccctttttccaaaaaaccggggtcgttttttttttgcatgaatgcccctttggtaaaaccctttctccctttttccccgcatctcgggtgtttaaaaaacgcccggaagaaaagtttcatttcagacccaaattggggatgggggaannnnnnnnnnncnnctnnctcttctctcattnttttttttttnntnnntngggtgtgtttttttccctnttntntccctctctctcttcaccccacctcanncatttggnttattttcttattggtttctcccttgaaatattctcgatgtatagcggtttttaa

SEQ ID NO: 3862 - DNA, 309 bp, Bacillus licheniformis
atggtcaatacaaaactcagcaagccgtttgtatatgaggcaaccggctgtttacatagacccggaaatgacataagggcgctattcagctatatcaattcaaatattcccgagggtgaagatatagaagtttactcttgctgggacggtgaggaagacaaagaaaaagacgaccgcttagactttttcattgatatagagaaccttcagctgggcaagcatgtcaagctggataaaaagaaatacatcgatgaaattgccggcctgttttatttcgaggagcggcagctggtcaagattcgcaaataa

SEQ ID NO: 3863 - DNA, 122 bp, Bacillus licheniformis
atgaagacaacgtcaacccatcgacttgaatctacctgtacattctgttcaggaaaaggctattttcagcttctgctcggcggttcggaaacgtgcagcaactgcaagggaacaggaaaaga

SEQ ID NO: 3864 - DNA, 160 bp, Bacillus licheniformis
atgaggtttaatcaaagaatgggcagggcgatccatgagcaagatgcgaatctgcatctaaaggagcatgcggacccggagcgcgccggcttcatggaagaaacggccactgagctggggctgacgtccaaaaaatcaattcagaataaaaagaaccgca

SEQ ID NO: 3865 - DNA, 393 bp, Bacillus licheniformis
tatatgtgtgctgtgagcggtatctccgcattaacggggggtcatacggttatgctcgcatgcacgggttaccttatgaaaaacaatgtgagccgaacgtgatcaaagcggcagacaccggtattgagacccggggctggcgcatttacatacgatccgtccatctgataatcatcagaaaaatatcctttcaagatcgacgttgtagaaccccgacaggtactactgagataccaaactggtccacctgtaagctgcatagggctgtctaatactacctgcctgaagattactggatacatgaaacgtctttctatcttcttgatccgcggcgctgtttcatatttcacgctgtatgcatggatgaccgttccatctacgacactataactg

SEQ ID NO: 3866 - DNA, 116 bp, Bacillus licheniformis
atggcttgggaagtgttgagcatcatcggaaccgtcgcttttgcgatcagcggagcgatcgttgcaatggaagaagagtatgatattttaggagtttatatattgggccatccgac

SEQ ID NO: 3867 - DNA, 159 bp, Bacillus licheniformis
  misc_feature (1)...(159): n = A,T,C or G
tgtcggggtctttttaggtccctcggtcctcttgatgtcggtgtttatgatcttgggggtatgtctatctntgttgagcacagcggtttatttttggatcggcatgctttcaacgaaagcggttcaagtcgtctgtccaaactgtgaaaaaccgaccca

SEQ ID NO: 3868 - DNA, 201 bp, Bacillus licheniformis
  misc_feature (1)...(201): n = A,T,C or G
acttccaantttgcggagcgcttcggctggcgcgatttaatattcaatcagagaaccaggattattttacaggccttccgatcaccgcagccggaacgattctggtatgcttaaaccttttctcagaaatcctgggcaaaaagccgttcattttgatcatgctgttcctgtcctttcttatggtcagcaaaatcaaagtca

SEQ ID NO: 3869 - DNA, 156 bp, Bacillus licheniformis
agagctggaccgttttacggacgaaccgacgaaacaaatgctccgcgccttaattaaaaggaagaaaaagtacgaaaactatgccagacagacattcaggtggcaggcggtggcggcgatatgcgcggtttcgttttgtgtgtttgcagcgtcaaa

SEQ ID NO: 3870 - DNA, 306 bp, Bacillus licheniformis
atgtttcattcttcttttactgtgttttggtcaaaaattttaacgatgaagggggatattaaaatgcaaccattccatgatgaactgcagtcgttggagatggatcacttccaggcagacgatatgacgcattgggatccggaccgccatcacgccaatgttaaacactgcgcaagctgctggagctgcggaagctgtgccagctgttggagctgcgcgggacacagctgttggagctgcatgggacacagctgttggagctgtgcgggacattgctgctggagctgctggcacggaggcatgtag

SEQ ID NO: 3871 - DNA, 153 bp, Bacillus licheniformis
ttattaaaacaatgcccggcaacgcccatgccatcggcgttcttcttgataagctcggaagcccggaaatgctgggctgtatatgcgggaacgatacatgccttgtgatttcccagtcacctgaggcagcccaatcattttatgaccatttat

SEQ ID NO: 3872 - DNA, 353 bp, Bacillus licheniformis; identical to SEQ ID NO: 3757

SEQ ID NO: 3873 - DNA, 306 bp, Bacillus licheniformis
atggagaatgcagaacatttacagcagacggcggttcccgaacagcatacgcatatcccccagtatcagcatcccgaaaccgccttgcaccacattaaatgtccgttgtttccccacttgaaacataagacgttgtgcacagtagcaccttttgttcattacggtttaaatgaagcccaagccacttcctatcaccatgccatggaagaagtagcggcaatggcttatttaatgggcatgggaatgaaccctcacttggcctactgtacagttgagtcatgggaaataaacgaaacattttattaa

SEQ ID NO: 3874 - DNA, 306 bp, Bacillus licheniformis
atgaaaagaatttccggcatgctggccggcggactgtttaacattaagcttgagggaactggaatggctgccattacaagccactacgagccgctcactttgatcgtaaccccggaaagccccgtctataccgatccaaacgcaacggttgcctggtctggaagccttcagcctgaatttgtgacagatgtttcttttaagacgttcatcggcaggggaagcggggaatccatccaaatgaagttttcagggaatgggtttgtcgttgtacagccatttgaagaagtttattactcggaatcttag

SEQ ID NO: 3875 - DNA, 303 bp, Bacillus licheniformis
atgaatttcgatccggaaaaactaaggaaatttcttaattgcgcgtcaaacccgtcaagcccaaagaatacaaagattaaaaattactgtgtgaatcaagaatgccaggagtttgtagcctttgatattgattttgaaaatgtagacatcgctctgcgtattgccggcatgttggggaaatccgccacgaaatttacgataaatcattttcttttccctggtacgaacaaaatagattatattcaatttataatttttgaaattaatgattcagaactattagcatttttagagcaactataa

SEQ ID NO: 3876 - DNA, 303 bp, Bacillus licheniformis
atgaagaagatactgttatcgctcctgttaatcccgttgttagctttaacagcttgtaattcagtcgattcttctaaaaacacagaagacgagaaaatagctgatactaaaaaagaagaaactttcgaagcgacagagaagaatataaagcttcttgttgcagacgagctgaaagaaaaaggcattgaagacaccgataagttggactcattcgaaatttttgatgatgtcaataaagataataagccgattaaaacgtacttatcacatttaacggaaatgataaccttacaaaaaacatga

SEQ ID NO: 3877 - DNA, 303 bp, Bacillus licheniformis
atgtcctccagaatacctcctcccgtttacatgtttcctccttcatcgttcatccactttcacctctttgttttctgtctcactccctctcttctcccttctgtgtccccaactcgacagaggctctttcggtgtcccttacggttcctccttagtcatactatccgtcgtggggtctctatgaccctctaccgccttccaacttctctttcgcccccagtcgtgccaaactcactgccggttgacccctttttattaacccccgcctcctgtgtagctatcccgcatgacgttcctccataa

SEQ ID NO: 3878 - DNA, 303 bp, Bacillus licheniformis
atgaatgacgggtgccatcaggccattgctgctgtcagctattacaaaacagaacggacgattgattttaaccggcaaacttatacaaaaaagcagaatcaaatgtacttgtacaacgataaaattttaacagcaagccgccagtatcgtttggagcacgtctatgacgtttcatacagacctttttccgaggccggtttgctttacctccatacgaacaagggggtatttgcttatgaagtgaacgttgaccccgggtatttcattgaggcttttaaaaaacagaaaaatccaattaaataa

SEQ ID NO: 3879 - DNA, 158 bp, Bacillus licheniformis
atgaaccgcaatccattgataccatttttgttaatcgccattatgggcataggactggtttttatcttatctataaaaggcctttatgacgcaaaagaaattgcaggcgaagggaataaaacagctcaagaagacaaagccgatgctttcgctgaaga

SEQ ID NO: 3880 - DNA, 111 bp, Bacillus licheniformis
gctacggcggtggctacagcggcggctatggcggcggctatggttcaacgtttgtattgatcgttgtcttgtttattcttttaattattgtcggcgcttcttttaaatatt

SEQ ID NO: 3881 - DNA, 159 bp, Bacillus licheniformis
aaaaactccactttcatcagcttgttcaaaaaggctacgaagaagttatgaaccggttccccggacgatttcggattgtggatgccagccaaagtgttgaacttgtgttaaaaagggtaaataacatcattgaggaagcattaaaagaaaatcagttgt

SEQ ID NO: 3882 - DNA, 327 bp, Bacillus licheniformis
tcgtgaaaacaggcgattttaacaagcgaatcacatttcttcggtttaccgaaacgacaaacggtgagggattcgaaataaaggaatggttaccggttgcgaccgtctggtcagcggttaagacggtccaggggcgtgaattttaccaggctggcgcagtacaggcggacagaacagcacgatttgttattcggtattcaaaacggatgaagtcgcttcttagaaatgacttgcgcatttcatacgcgggaaggacgttcgaaatagaaagctttataaatgacgatgaacgtaacgtcacctttacgttagtgacgaaggaggtcg

SEQ ID NO: 3883 - DNA, 300 bp, Bacillus licheniformis
atgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaa

SEQ ID NO: 3884 - DNA, 301 bp, Bacillus licheniformis
atgattcgggaaggcacgtatcatgaaacgcttgatgtgagagagagcgggtcggctgaaaagcgtatcacatttcaaaactatgagaatgaaaaagtcgtcatcagcggagaatctgttaaggacgcggaatatgaaacaccgctcattcagattcacaatcaacagtacatcacaatcagcggactgacgattcaagacctttccgtttcatcagaagaagcaacagccatgggaatttatgtgtcaggctccagcagtcatattaccatcaaaaacaatcacgtccgggatataaaaa

SEQ ID NO: 3885 - DNA, 300 bp, Bacillus licheniformis
atgccgggtaaaggctttcccattgtttcaacaaaaactgtaaaattttgccgtttcaaaaaccttttcacaaaagggcacgcttttttgggccaaccgatttttaaaagagaacccaaagcttttagacattttgcccaaaaaagttttcaaattttcccgcagtcaaaccctttaaattttcaacaaaggatccggcaaaaaggttccaattctttttcggccatccaatttttcaaaaaaatatttaagcttgggcctgttttggggcggccaaaaggtcctttttgccggcaataa

SEQ ID NO: 3886 - DNA, 300 bp, Bacillus licheniformis
atgacaatttctaaaaaacaacgcatcaacgcttctttagccttaggtctactttttacacttacatttttcacaatgttatacgcaacaacagcaccagttttaccgattgcagacctagcagcaacctatcctcagattccgggatgggctcttacttcaattagtgccatcttaaatgctgctggcactgttggagcaattgcagcggttctagggacttttggactcggagcgattgcatccctagttttttcctatgcaaaaaaatacggaattagatatgctatcgcttactaa

SEQ ID NO: 3887 - DNA, 189 bp, Bacillus licheniformis
tcttagtggtatgcattcgaaaattacgaaacaacttcacgaaaagctgaaggaaacagaaacagaagaatttaattcttctgcgaaaactcccgaaggtaagaatgatggtgtaatctataatattcatctgggtcaggcaacgggaaactcgcttcttggaaacctggggccgaaaatacctgtacg

SEQ ID NO: 3888 - DNA, 168 bp, Bacillus licheniformis
catttacagttaccatcagctggcaagagataaagtcaaccggatcaagctgggctactcggcttatgcggaaactgaaagtctcgcgtcccttatcaaaaaagagttaaaggcccaaaacatccatgtttatgaggatgtaacagatatcggatcatggtttatacc

SEQ ID NO: 3889 - DNA, 300 bp, Bacillus licheniformis
atgttgtcgatatatgtgaaaagagggctgttggcacttgcgctgttcagtctcctcacagctgttgccgggtgctcattcaattctgctgaaaaaagcgccaaccgtgaagaaaaagtaaagctgattgccgactccgacaaattgtacgtcggttttgccatcgatacgctgaaggaagaacgctggtacaaagataaagaagcgttcgagaaagaagttaaaacctcgggggggaagtcaagacgcttgccgctaacggaaataaagaagttcagattcagcaggccgagctcttga

SEQ ID NO: 3890 - DNA, 300 bp, Bacillus licheniformis
atggtatgtctcgtgccgcagaagatttctgcagtgctaaagccgttcgcgggagtcggacgtgtagcgttgacgatgtatgcagctcagtttgttgtcatatgggctcttgaaatctcgggggccaagtatgatatcggggcaattccattcggtgatctgttcgtcgcggccgtggcgacggtgacagggtggctgattgcacggcttcctaccggtccgctcgagacagcgatgcgacgctttgaccgggcattcagcaatttgggacccgtcacgggaccggcgagactgagatag

SEQ ID NO: 3891 - DNA, 155 bp, Bacillus licheniformis
atgacaattaatttaaaagtgatacaggagaagccgaaagggctttctgtggatgatatacaggatggattcttccttgttaaaggtgacaatgcgtgggtgatcagaagccacgctagagacttctctttaatcgatttaggaacttttgaaat

SEQ ID NO: 3892 - DNA, 333 bp, Bacillus licheniformis; identical to SEQ ID NO: 3802

SEQ ID NO: 3893 - DNA, 298 bp, Bacillus licheniformis
atgagaaaggagaccatcggattgacagacggattaaaacttacgggagctgagcggcgccagcagctgctggcttggctgaaggagtcagaggctccgcttacaggaagcgagctggccaaaagagcatctgtttcacggcaggtaatagtacaggatatttctttattaaaagcaaaaaacgaaccgatcatcgcaacaagccaagggtacatgtatttgcggtcagccctcggcaaaaaacagccggttcagcggatcatcgcctgtgaccacgaacccgaaaaaacggaagaaa

SEQ ID NO: 3894 - DNA, 150 bp, Bacillus licheniformis
agacaatgaacacttcttcaccactatttagggtggtcaacctaaacaaaggtacgaaacctgtgctgactacttttactccgatgtcctttcagctattcttgtcagtaagatcattccccatctcttcaacgcctcaggcatcaccta

SEQ ID NO: 3895 - DNA, 297 bp, Bacillus licheniformis
atgccgcagtcaaaagccgaccaaaatggcgtatatgaggaggagaaagacggcagccgaaaaatcatcgccacgtttgtcagcgagtcggagcaaaacattacaatcaaaacaaaagcaggggaaaaaacttatcagaaaacagccgattttgagagggatgtcgccgaagcacctgaaaaactgaaagggaaaattgtcaggcttgaaattgaaaaggatggaaaagcagaaagccttgatttggaatcggaagatcaaaagcttgaatggtatgagccgtctgcttcaaaataa

SEQ ID NO: 3896 - DNA, 86 bp, Bacillus licheniformis
atgagtcgcttttgtaaatttggaaagttacacgttactaaagggaatgtagataaattattaggtatactactgacagcttccaa

SEQ ID NO: 3897 - DNA, 174 bp, Bacillus licheniformis
cacaaatatcggggggattcccgaggtgatcaaaaacggagtatccggttacttggtcgatgtcggagatattgaaggtgcagctagtaaggcgcttcatttactgactgatgaaagccttactagctgcaccaatatcggggggattcccgaggtgatcaaaaacggagtatc

SEQ ID NO: 3898 - DNA, 220 bp, Bacillus licheniformis
atgaatataaatgggaagtccatcatcggcttttttctaatcctttttggcgtctccctgttcttcggcggaggccatttcggcggattggttacaggtgctattggagcattgcttctattctattccgtgaaaaaatggaaggaaggacgccagtttgccgcggtactggccgcgatcttcggcatcagttttgggagggtcatgcctttctgcacaa

SEQ ID NO: 3899 - DNA, 297 bp, Bacillus licheniformis
atgctgttaaaaaagaactatcttcctgtcggcagtgttgtcggcttatataatgattcaaggcgtctgctcgtcatcggccggcaaatgttttctgaaacaaatcacgtgatcagagattatgcagctgtcgactatccaaatggatttaccgatccaaaagagcagcttgttctatttaataaacaggacatagaagtggtataccattacgggtatgttgatcaaaaagaattgcagcttgatgaactgctaacagaagctgaagcaggaaaaaaagaaaataaggagcaatga

SEQ ID NO: 3900 - DNA, 297 bp, Bacillus licheniformis
atgcctctatatcatacacttataaaaaagggctattggaggagaggaaagatggaagagaggagatccggccggtatccttattccggccctggggcgcatattcaaacctttgggggaaaccatgaggcctatcatgcccggcagctgtgcttgaagccagaaaccgtggcgggcgcccattcttgccagcgggcgcatccctataaggggccgtttgaccaaaatttggacccgttttggattctattttcaggcttgttcaaggagaaaatccctcccgcttaccccctttag

SEQ ID NO: 3901 - DNA, 231 bp, Bacillus licheniformis
aaagagaaggagagggggggaagcgaggggggagaagcgagcggaataagcaaagcagccgggagggcgggaaaggcgggagaagcacggcggggagcacagcaggcgggggaaggcgggcggcacaggccggagggccgccggggggagagggaaggggccgggagggagcggcaggggggcatcggccggggtgcggtggagggcagggggcagcaggagcaggaggcc

SEQ ID NO: 3902 - DNA, 294 bp, Bacillus licheniformis
atgacaggaccgggaaaggcgacacaggaatacacagagcaacgaagattcgagagaagaggaaaaagagaaaggatagagagagaacggagagggggacgagggaaagcaaagaacaacaagaataaagaggtaaccgaagcagaagaaccaacagagcagaaggaaaagcaacaagcggaaccaggagacgacgaagaaagcggcacacgagctggcaccaactccagaaacagtgttcagaaacagaactcatcagggttgtccaaatgcaccatcaccattacaatatga

SEQ ID NO: 3903 - DNA, 294 bp, Bacillus licheniformis
atgatgacagaaacacatcagcagctcatgaaattaccagtaaatcaagtgttttttaaatatttcgtccctgcaacgcttggattaatcctgatgtcagcgaatattttaattgatggcctgttcgtaggcaatggcattggaaccgcagcactgcctggagtgaacccttcctatccggttatttcactcattatggccatcgctctttggattgggataagccgaccaccaaatactccatcaacatccgggaaaaatcgccccaagaaggccagcacatttttttcatag

SEQ ID NO: 3904 - DNA, 168 bp, Bacillus licheniformis
cagttatatcaatcggcccagatgatactcgcagcgaagaaaaactccgagaatacttagatgagaacttacctccagatgcaaaagagaaatacgaaattgaaattattaaaagaaatgtcgaagaaatgaagaaggaaatccgtgagaatttaaaacaagagcatt

SEQ ID NO: 3905 - DNA, 294 bp, Bacillus licheniformis
atgcggtttcatccgccccgtggatttcctgataaaaagcctgtaacagcgactctttattcacgactgtccctccttcattcatccgttttaatgatgttcaggtttaaaggttttgcaatccgtttcttcactattagaagctttttcaccttcagcatggctgacgacatagatggcgtcggctgtgcatttgttaccctcttcccaataggtgcagttgctgacttcacacagtattttttgctccatttagtttgggccccctttaaaagttgtacacatttagcttaa

SEQ ID NO: 3906 - DNA, 291 bp, Bacillus licheniformis
atggccggcaaatctgatcatcatagcagtcttcgccgacgtatctggccttcagattctgatcagtcgatcagagcagcagcttgtagagataatgaacatggtggcagtcgacattgcagatgcaagctcgccagagtgcgcggagtgggcatagctccgcgagcggcggtcgtcaggaagttcgtcgatgcactgtttgaggtgagcacatggtgcagagcgtcagttcgcagccctggtctaagtaggccggtgatcagtcatcctatcaggggggaagtttattga

SEQ ID NO: 3907 - DNA, 291 bp, Bacillus licheniformis
atgattaaaaaaactctcggtaccatgttcgcagtgactatgatctttcttttgatcctcactgtgtttacgctctttttcgggtcttattatttcggcgtcgccggtttttttgcgattttcggcgttacatacgaatcgccctggtcgctcttctggtatatccttttatcttttggcctcggcgcgctgtttgaaatcccgggaaaaattctgagctttatgattgggcataaagctgcgacctttatgatcgaatgttttttacttggcttgccatcctctcgctga

SEQ ID NO: 3908 - DNA, 291 bp, Bacillus licheniformis
atgaaaggtttgatatcatttttaaaattatggacagccgtgctgctgaatgcggtgatgcctgtcagagaaaatcagatgaaggtgacggcgttcgccggcggtacatatcaggctgccgatgcttatcaggcaggcggcttttcggaaaaaagagaagagaagacagagcggatgtcgggctgtaagagaatgaagcccggcagttatacgacagaacccagccgggctgtttgcaaaaaagcggtgaaaagggtaagagccggaccaactctttacacgggaacttaa

SEQ ID NO: 3909 - DNA, 153 bp, Bacillus licheniformis
caggttctaatcaaaaagtcaggaaaacttaatcgtaaacaccgccgggagaaagctacatcagctatgcagactacgccattgcagtggtggacgaggctgaaaaaggcgagcatgtcaatgagcgtttcactgttgtcggagaagctcaat

SEQ ID NO: 3910 - DNA, 255 bp, Bacillus licheniformis
tggcgatatcgtttgtcctcattctgcctgcggcagcggcctacgcacaagtaccttatccatgcagcgtcgttcttgatccagtccgagatattcccaatgcccgcggaacggctttaattgcgaaagtgaagaaaccgtataccgaagcccccgggagtcctgtcagggaaaggcagagtgtcggcatctacgctgattggcttccggaccctgcttcatttggagattatgatcaatttgaaggaagtgccc

SEQ ID NO: 3911 - DNA, 291 bp, Bacillus licheniformis
atgacgataaggaatgtttttaatgccgctccctactttttcacagaacctttattgaaaatcatcaatatgattccggatgctattaagcttataactaatgtagaggtatctaacctaaatatattttttatcccattaaagaaaaatgaccataaaatatatatcgtgatagcacttagcgtaaacattctgaaccatctggggattgcgaagcaagcctttaaaagtttagttgagaatttccctattttgttcctccttattcatacccccctttcaatatattaa

SEQ ID NO: 3912 - DNA, 288 bp, Bacillus licheniformis
atgctagaaatgatcaattcaattggtgctgtcgcaggatttgcggggtttatcggaatcattattttaatcagccttgacggaaaggatgaacgcggggcatatattcaaaacaaattctttcgggtgatgttctttttgcttacacttggaatatccgccgttatttttacaagttcatgggtcgatttgtcgttcgccaattataaaaacatggtcacactggctttttcgctgccgtatttcattggattcttcattttgttgggaattcgttcaagggtgtag

SEQ ID NO: 3913 - DNA, 288 bp, Bacillus licheniformis
atgattcttgaatctttcaacgatgctttttttctgattgagtttttcacaatcgtcctccccgcactgacggcgatcggtatcgccctgatcctgaaggattgcagtacgggagacagctggaaaacgaaacggtttgaagaatatcatgcaatacagtttgtttctgcagtcgattttctcatcatcctatatcatcgcattacggtatggataagtaaagtcattcgcatgaaagcttcatcgaacgacgatgaagaccaccgtttccttcttctttcaatttaa

SEQ ID NO: 3914 - DNA, 288 bp, Bacillus licheniformis
atgccgatatcgagccgggcattgctattcaattgtttttcggtcgtttctgaacaaaaggtgcatgagcacacagaccgacattgtcttttattcttccggcagcctttatttgaatccggccatgttccggccctattgtttttcggatatcagatatccatatactcaccgaattcctctaaactgccggaaacacgcgtgaacttttcatcatcgcccggcagattgtgctccgtttacaaaggtgcgagggatttcaaaatcggcctgaatttcctctcctaa

SEQ ID NO: 3915 - DNA, 288 bp, Bacillus licheniformis
  misc_feature (1)...(288): n = A,T,C or G
atggtctcgtctcacatcgctgcnttctcctatctcaactcctcccccagcgactctccgggcgaccaccctccctcggtgccggttnctctcgcgcctccgaaaaggtgccccctcctctcggtaggttccgcctcctgggctatctgcctaaagactaaaggctcccaaaccacttcaccagaattttcgccgctgcgatttctcggcgcgagctcagcactcggggcacagactaccggccatcgggtggtgccatcggggattcacggcaatcccagacagtaa

SEQ ID NO: 3916 - DNA, 252 bp, Bacillus licheniformis
cttctttaattacggttcacacctttgtttcgggcatctcttcaatactgcttgcattcacagggtatttattcttaaccattagatttgttctgatcggcgctatcttgcctagcctttctggcatgtccgcgctcaaaaaaaataccgtcagcccgtttgcaaaaccattagattctttataaaatattatctctttcgcagtcgccccgtccatcatcgcctattcgatcgttttttatcatgctccga

SEQ ID NO: 3917 - DNA, 288 bp, Bacillus licheniformis
atggctaatggatataccaataagggagtgaaatgggagctgtttcaatccatatgggtcctatttgtatttactccttttggctttttaaattgggtttcttttttctatattttcgctcgggcaaaacaaaaaaaatggttaattgccggatggatctattttgctatttttttattcactattctttctaatggaacacctttattcaatgcggccatggttcttttgatcatcggctgggggtgtcttaattgttacgctttaaagtgcggccggagtttttaa

SEQ ID NO: 3918 - DNA, 108 bp, Bacillus licheniformis
aaaaaaccttgccgtcatcatcgagtgggccgcaatgaactccagactaaagagaatggggctgaatgccgcggagccatttacccataagcttgcggatgtaattga

SEQ ID NO: 3919 - DNA, 147 bp, Bacillus licheniformis
caaatgccggcattgatgatgtgattcgtcatctggaggggctgtccattaaaattgaagaaggccccgcagagcgaatgggcgctgaagggccggtcgtttcggtttatatcagagatcccgacggaaatctggttgaaatatcat

SEQ ID NO: 3920 - DNA, 144 bp, Bacillus licheniformis
cagcgttgtcttttgctgcatccattccgccgtcttatgaagtggttgtgatgacaaaagcatctgttaaagacagcaattcaaccctcgctcagggaggaattgcatctgctgtattgcctcgcgattcctggtcgcttcatg

SEQ ID NO: 3921 - DNA, 549 bp, Bacillus licheniformis
gatctcgactaaagtgcacaaagagcaagccgtgatgattgtccatacgatcggtcccaaaggcacgaactgtgaaaaagccggcctgctatggctcaaaaataaaggggtccgcggggaagtcaggctttatgaaacgttggaagaagcgctgctccatgttaaatcgacagaaaattcagtcctcttaggctgcgccgtttacccgtttttgcatcaaatcgtatttgagaatctagcggacttaaagattatagacagttttgtgatgcctacatacaacatggtgtttgccgcaaaacagcacacgatggcatcggatattcaaatcgtcgcttcacaccctgctccggctcatctggcaaagctgttcagcagtcaagtccaatttgtcaccagcaatgctcaagcggccctggcctgcgcttcaaacgcggctgacggctgcatcacgacgattaaagcagccgatgaacaccgtttgaaagtcattaaagattttggggaagtaccgatgtgctttacaatccacgggcttaaatcaatcga

SEQ ID NO: 3922 - DNA, 240 bp, Bacillus licheniformis
gcgtgatgaagcggttttctttaaagcctacgacgaactgctccgccagctgaagcgccaaggcatgcaaaaagaagaaggccagacgctgcgcgagtttgcgaagacggttgatgaacgctttcaaagcggggacatggcggctttgactcttcaatatgaacgggctttgtatcgaaaggaagacgccgctaagctttggaatgattcggcggagttatgggaaaatttaattaaaaa

SEQ ID NO: 3923 - DNA, 285 bp, Bacillus licheniformis
atggatttcttgaagcggtatgtccatgattttaaagggagaaaggtgcaaatgcttgaggctgagaaggacgcggctgtactgtttgtgaatgatgcaatggaattcctctatacatatacatggggagaagaagcctatccgcatgaagtgcaggagcagttcggctattttacgccgtatgaattccgccgctgtatcgagaaagaattaggggaacgtgcgaacattctggtgttcgaacactatgtgcaggaaggatatgaagaacatcctttaccctaa

SEQ ID NO: 3924 - DNA, 569 bp, Bacillus licheniformis
  misc_feature (1)...(569): n = A,T,C or G
gtgtacgaattttggctgacgcaaggaaaggaaaagctgcgcctccctgtgcttccagagcagcttgacgtcagcaataatcttgcgaacgaatctgtaaaggtgtcaaagttcggcgaggtgacgtttatcaatgaaccgggagcgaagacgatttcattttcgtctcattttccgaaaaagtattctccgctctcggaatacaaagggtttctttcgccggagaacgcgattcttaaaatcgagaaatggatgaaagcaaaaaaaccggttcaatttctcgtgacgggaacgaagatcaatttcacatgcagcattgaaaacttttcgcatcgcgagggtgaaaaggatatcggcgaccgggattttgatctcacattgaaagagtaccaaacagcatcaccccggaagattaaacaaaaaaagaaaacgaagaaaaaacggccgtccaaactggctccaaaaatgtacaccgtcaaaaaaagcgatacgctctggcccatcgcaggcccgtttttaccgaaacagcccggaatggcgggaaaatttggaatgcgaanncagcagcg

SEQ ID NO: 3925 - DNA, 207 bp, Bacillus licheniformis
aatgattctttcatggaaaaatcctatgtatcgcactgaatcttcttatcatccagcagggaacatccttaaagaactccaggaagaggaacagcacagcatcgccggaggcacaatcacgctcagcacttgtgccatcttgagcaagccgttaggaaataacggatacctgtgtacagtgacaaaagaatgcatgccaagctgtaa

SEQ ID NO: 3926 - DNA, 285 bp, Bacillus licheniformis
atggagaaggagcaaaagaatgggctcgccgtcaaagaaagaaacgctgaatatcggatcgacgccgaaaaaaggctctatcaatttttgcttgattcgatggaaacggctgtctccgaattggatgaactcgagcggaagctggtagaatgccggtatattcataactggagcatgggcaaatgcgcgatggaaatcggctacagcgaaaaaacgctgtttttaatgaaaaaatcgctgctggacaagctgcttgtcagcttggcggcgatcacgaatatttaa

SEQ ID NO: 3927 - DNA, 285 bp, Bacillus licheniformis
atgatcgaacatgatgaattggatcgtagctatttatgttatgcgttgaatgaatcgtacgcaatgaaaaggcaaatggcaatttcgatgcaaggaagtgctgtgccaaaattaactccagcgattttgaaagagttggaaatcaagttgccaagtattgagaagcaaaggataattggaaaagcttatttctgtttaagaaagcgtcaagctttggcaaagaagcaagcagaacttgaagagaaactttttttagaagtattaaaacaattagaccaacaatag

SEQ ID NO: 3928 - DNA, 285 bp, Bacillus licheniformis
atgacatacgaagaactggaagaacaactcaacaggcaagctttaaaagcggcggcgtatagagaagaattaagccaagcgcatgatagattggcagaaagtcgaagcctatatatgaatgaattacagaaacggcagaacctagagcaggaaaatgaaaagctcaaaaaagagctgcaagaagagcggatcggcaatttgcaggcggaagatgaagtgatagaaatgaatcaagtcgaagcaaataaagaatatcacgaaaaaggagcagaagcggcgaaataa

SEQ ID NO: 3929 - DNA, 285 bp, Bacillus licheniformis
atgatttcgcagagctctgacgcttccccgtgggaatttcaaatttcggcgacagatgatgacatcatcattttaagggaatattttgatcagctgtattcagaagactgggtcaactttttcagagctcacgtgcctgcggtcgaatatcacaatgacagtgcaaatgataaaatggacgaactgcgcaaagacatttactcgatgctttaccgtctgggcaatgaagaaaccaagtcatttatcagtgaaaacggccttgccgaactcaattcagcagattaa

SEQ ID NO: 3930 - DNA, 285 bp, Bacillus licheniformis
atggcctttgtcaaagtattgttgacgaccgcttttctcacaggggctttcgcaggattcctgtgggcattttccaaagaaaaaggcgatggatttttctcggaaatggcggcggatggatcgggagtcttcacacttttcggtttgatcggtttactgaacgtcaaactgttaaaagcaatttccccaaaactgctgcatgacaggtcttttaggtgtatttcttttattctggccgttgtattattgatgatgtctatattcatatggctgatcgatttctaa

SEQ ID NO: 3931 - DNA, 282 bp, Bacillus licheniformis
atgtctgaattttctgccctttattgtttgcggccgtgtctcttctattataatgagcgcgtcttacagatgtatgttcatccctgttttatcaaatggtttgcccttctttacattgcgcttaacgcagctcatgaaggtctcctctcttggaacggacatgccgcaccggccgcagccgttgccggccttgggcttgtcaaaacagctgaagcaaaaggcgggttgcatccgcgctgctccgttacaaggacagaaaaggcgatcatcttccgggtttaa

SEQ ID NO: 3932 - DNA, 282 bp, Bacillus licheniformis
atggcctatttgctccatttattgtttttaaaaggttatacctatgaatcactcgtaacccgggaaatgaaaacgagggaggtatccagggaaacggcgctcaatgaggttatggacatgttgagaatgtttggtttgcctgcggacgatcgcaaccggaaaatcaccgccgcttatttggaacggacttatccaaacgacaaggtggaaatccgacagggcggccgttttggaaaagttctgatccgattacagaatcagaacatgtacatgaattcatga

SEQ ID NO: 3933 - DNA, 282 bp, Bacillus licheniformis
atgatcgaaagcgcttggtcagatgttcacaatgttctgcgggaaacagcctcaacatttgatcaagatgcgatccgccttgaaggcgatgaattgattcaaatgctgcatgaccgcggaattttacaagacgacgcggcagctgtgctgtcagagctatccgctctgcgccgcgatgcatctgacggagcgagtattgccggagccttggcatacaaaacgctttgccgggaggaagcggagcgcttgcgattattagctgaacaacagaccgggatttaa

SEQ ID NO: 3934 - DNA, 282 bp, Bacillus licheniformis
atgcgtgttgatgttcctctgcttgactatttaatatgcgatagctggaccctccaatatgaagcggaacatccaatttttctaaattcggcatgcctttttttaagaaaagctctttatcttgatatctctgtaaaacttctcccgcaatccactcttgatcgcccaaagtggaaatactgtgtactttacactcataagcaaaatatgcatcagttaaaatcggtacctcggcttttagcccttcttcgtattgaatatgaaatgcttcaaacttattga

SEQ ID NO: 3935 - DNA, 108 bp, Bacillus licheniformis
cggatattttgcatatcgcaggacatcaaatttgtccgattacatgcttggcggaagaaatttgggtcccgccgttaccgcgttaagcgcaggagcttccgatatgag

SEQ ID NO: 3936 - DNA, 282 bp, Bacillus licheniformis
atgttaaaccgcccatcactactagttggatttgacgatcgtgaaccgaatgttaccattcgggagattcggaaggcttcgaaaaccaataaggggcaaggatcagctaggaaaaggtggaagccctttttaccgggggggtggtcgttttggggaatacagggagcccattggttggtaaacccggggcaattaaacgggggcaggttgagtcaaaaaagaaagggctttttgggaaacccggccgggaagaacccccgggaacataattttttggattga

SEQ ID NO: 3937 - DNA, 132 bp, Bacillus licheniformis
ttcacagggcagtcgcgcttcctgctcccgtcagccgtgaaggaataagagcttcttataggaacggcgtgcttgaagtgagaatgccgaaagacaagcccgacgaaaaaaagaggatagatgtggaatttc

SEQ ID NO: 3938 - DNA, 279 bp, Bacillus licheniformis
atgactgtgaaaggtcccacacgtgcaggagaatcagacacaacaccaaaaaacacgctgctttcgtctacaaataagctacaaatggggcagtttcttttgatactcggttcatgtagctctctccgtgttattttggccgatgccgttccgttggtgacgtatcatgccgcgtgtgataggaagctgggttcccgggtgtgtcttacgacgccgttttgggagccccgaggattcacgggttgcgaggggtgctctgcttgggggcccttggggtga

SEQ ID NO: 3939 - DNA, 279 bp, Bacillus licheniformis
atgacagtaggagaaagaataagaagtagaagaaaacaactaaatatgtcagttgaccagcttgcccaaaaactgaaaaaaaacagggcaacggtttacaggtatgaaagtaatgaaattgacaacatgcccttgacagtactagaacccttagcaaaggcattgaatgttactcctgcatacctaatgggatgggaaagcacagaacctgttcagctatcaaccaaatacccatactaccccgataggcatatcccgccggccttcctttatgcatag

SEQ ID NO: 3940 - DNA, 279 bp, Bacillus licheniformis
atgagaatgaaaaaagctactgccacaatcgtaattctgctgcttgtcgcgttggcggcaggttgtgagtcatgggatagaatggtgaaggattttaacgcatccaataatggattagaacggacggcaactgtctacgatcagaacggaaataagatcaaaacatacaaaggcaaatttgatgttgaagtcaatgactatgggaataaggtgaaattcgacctggacggaaaacgaatcatgatcagcaatgcagttgtgattgtggaggaaaactag

SEQ ID NO: 3941 - DNA, 104 bp, Bacillus licheniformis
atgggtaaagggagaattaaagtggaagaacggattaagatcgaaaccgatgctgaaatgtttaaagcgactctccttgatcaaacacagtctcagaagaagaa

SEQ ID NO: 3942 - DNA, 279 bp, Bacillus licheniformis
atggatttcccaatcattcatacaaacttttgggatgctgttacggcagtgccgattattttgatcgtcacacagataattaaaatctttcttaaggttcccaaaaagtatgttccatcaattgcacttgcactaggcttaatcatatctgtttgcataagtcatcgacacagcctcatagctggagtatttatgggcggattctatggttgcgcagctattggttcatatgcatcattgaaaacgacaatttcatcatatagaaacaaaaaagcataa

SEQ ID NO: 3943 - DNA, 105 bp, Bacillus licheniformis
aatggatcatgtcggtttaaagggcgaaatcagggaatttctttttgaaaggctgacattgacagccagacatatggtaaatcagccgaaaatggaggatggttc

SEQ ID NO: 3944 - DNA, 276 bp, Bacillus licheniformis
atggcagatgaactggagcttttccaggcatataaaaccctttggaaaaaccggacgatggagggggaaggcagggaggcgcttcatcaggcggttgatgatgagctgaacgacctcggcacccatccaaggctcagaaagacgaagcacgaaaaatactatcaatcaatccggcgcatcgtgaattcacaattggaatcagaaatgaagctcaagctgattgaatgtcatacggaacgattggagttattaacaaacgaagaaagcagggagtaa

SEQ ID NO: 3945 - DNA, 203 bp, Bacillus licheniformis
atgatatataaagattccgaagtccatttcaatataagctcgcaaattaaacgaagtgtttccgcgaacattcaatttagtacgcaggacatcaatacggcaaagctaacgatcagcttaacgaaggacggcgtgccgttgccgataagccaagcgactcacggtaagttgtttatgcggtttgcggacggaagcaagttcta

SEQ ID NO: 3946 - DNA, 276 bp, Bacillus licheniformis
atgttatcgacgcgctttaattccttaacgatgtttttagcatttgccgaaagttctttgactctttttttaagctccgtcatgattgagttgatgtgcgactttgcatcagaccagacgtcatcgaatttttcccacggaaattctgtttcatacatcatttctctgagcattgtgtcaaaatggtgcaaaacttcatcaagtgtagatagatttgattcaaactttccggttgcctggtgtaacgattcaccgtttactttaatttcactttga

SEQ ID NO: 3947 - DNA, 102 bp, Bacillus licheniformis
tctttacggaagcaggccggtgcacagccgtctattatccgcatccgaccaaaaccggtttgttgaagccggcaaaagtacacgtgcaaaaaagcgaacaat

SEQ ID NO: 3948 - DNA, 309 bp, Bacillus licheniformis
gtttgatcgccaatatataaaagaccaaaatcaaaacctagatgacataggtaaggacatccgagaagttgacacaaaaataaatgatcataaaaaagccaaaaacgcccatacatccgaacaaatatcgcacgaaagcggactaaatgtcggacaggaaatcgaagtaacgaaggcgcgctttagaaatctcgtcctaaatgtcgacggaaccaacgttaaagaagtcgtcgatgcccgtgtcggccgggacgggacgatttatccgacgctcagggatcgtttagacgccgacggacagacggttga

SEQ ID NO: 3949 - DNA, 408 bp, Bacillus licheniformis
  misc_feature (1)...(408): n = A,T,C or G
ngagaatctgacaaccgagcttcaggaactgaaaactgaacacagcgctttgcaaaaggagcaaaccgcattaaagcagcaggtcaaacaggcaaacaaaaaactgaaggcagtcaaagcggagaatgacacattaaaaaaagaaaacgaaaaactgacaaaagaaaaagattcgcttacgaaaaaaacaaaatcgctgacagaaaaactggccaaggctgaagaaaaaagcggcagtgccgaaacctctgtaaaagaaaagagcgccgccgctcaggccgaagcgtcacacagcacgcccgccgccaagaaaagcagcgctgaaagcaaacaggagtgcaaaatcaaaggaagcgtcaaccatatttatcatacaccgggcagtacatattatgaccgcacgaaaaa

SEQ ID NO: 3950 - DNA, 273 bp, Bacillus licheniformis
atggggcttgatccaaacaccgatgcctttattattctattatttatttgctgtaaggcccgtttcataaaaaaaggaggccgttatcatgactggagcagatataccttgggcgctgctcgcccctttcattgtgctgcctttcattttagcagtgtccgcattggtcagttgcataaaacaggagaaaacgaatggcccaaagtggatgtggattttgatcattttcgggatcagttttgtcggtcccgtctcttactttatcatcggtaa

SEQ ID NO: 3951 - DNA, 135 bp, Bacillus licheniformis
aagacaagacgcttggtctgaggaaaatgaattactgcttgctgaaacggtaatgcggcatgtcagggtagggagcacacagctgaacgccttcgaggaagtcggagcagactgaacaggcatcagccgctgcgg

SEQ ID NO: 3952 - DNA, 84 bp, Bacillus licheniformis
tagagcattacaagagaaaggtctacctttatatcctagtcaaggtgctacagttgagctttgggaaaggaagcttaaacaatt

SEQ ID NO: 3953 - DNA, 177 bp, Bacillus licheniformis
cgacgaagtcaaagcggtgtaaagttatttggaatcccattaccaggaaaacattacgcttgaacatttaagcaggctgacaggctggagcaagtatcacctcctgcggtcgtttacgaagcagaaaggaatttccccctacagctacttggaaaccgttcgtatcaatcatgcgaa

SEQ ID NO: 3954 - DNA, 273 bp, Bacillus licheniformis
atgccgatggagacggtattaatttttgcatcagttttatcgccgatcattttggctttggtcgaattggtgaagaagacggtcaaaatgccgaaaaatttgattccgctcgtttcactcttgataggtttgctgatcggtgccgcagcatatccttttacagaccttgaactggtgctccgtttatggtcaggaggactggccggattaacagcgacgggtttatttgaaatcggtaaaaaccgcaatgcaagaaaaaagacaaatccctga

SEQ ID NO: 3955 - DNA, 273 bp, Bacillus licheniformis
atgaattatgatgaagcacaacatctacatattagttacaataaaaagggattagatcttgaagcggtaggattaaaacgcctagatatcgatgtgtgggacgtgtattttaactttcaggatcatgggatagatgagccacctttgagtttttcaaaaatcgatccattcggttgcaatatactttcaataacaagcaaagatttaaagattaatgaggctactcaatacttcgaactttggattaaacatgagttatataaagatctctaa

SEQ ID NO: 3956 - DNA, 273 bp, Bacillus licheniformis
atgaccgcggcttttttgactataagattgatgatgaggacggatacctgtttttgcggattccgtttgaggcggaggacggacagcttgattcgcaaaatgcgacggtcaagctcggcacgccgtttttgcttcgccatgtctatcaggaagcgctggatgactacgtcgttcaggggaatttccgcgcatcttttgaccagtttgccgaaccgaaagaaaaagacgccgatattcccggcgtctatgaaaagcttggccaatcgtatgtaa

SEQ ID NO: 3957 - DNA, 270 bp, Bacillus licheniformis
atggcagaaataaaggtaaaagcagaagaagtcaaaacggtgttttcaagccttcagacaaaaatcagcgcactttcgatatcaggttcaaaagccgatatctctaattcttcaatggatgtagtgaacaaaataaaaaaaatcgaaaaggaatacgagcaactactaaaaaaatacaaggaggcgctatcatcagttgaaaaggacgcatggtcaaacattaaagtcttgattgatactgataaaaacatctctcaaaaaatgaaataa

SEQ ID NO: 3958 - DNA, 270 bp, Bacillus licheniformis
atgcggctgtccgcattattaacaattttaaattttttgcacaaattttatacaaaggcagacaaaaaccttgatatatcaatggttctatgggtatattcaaccacgaccaccgatatcgctaaaaaccgtattgccaaacgacgaaagagcgttccttacacaaggaatgctctttttgtttattcctcatcaaagcggagagccgccaacataaacgcaatgaccaactgttgtccgcattctcactcttcattcagcgcaccgtga

SEQ ID NO: 3959 - DNA, 270 bp, Bacillus licheniformis
atgaaaaggagcctgacaccggctccttttcattatatgatattcaaatatgagaagatcgttcccaatatcagcacaattgttaagatgccgacgactcccgccgcagtcaagacaatccggtccgtaattttctgtgattttggaagcggtttttcgcatccgcatgcctcgcagacttttgaatcgtacggcgtaagcccgccgcagcttctgcagttgattttttccatggttgaaccccttttctttactgggcttggacactaa

SEQ ID NO: 3960 - DNA, 135 bp, Bacillus licheniformis
ggataaacatgtcaaaacggaagattaaaacctttcatcagcttgtcgaagaatataaaaaagaaatcgccaagaacccgaaagaaatggaagtcatttatgacaagatcgaccgcagacacgagaaccgccttt

SEQ ID NO: 3961 - DNA, 318 bp, Bacillus licheniformis
tatcgccgagggaacgaaggagcagctgaaatcgatcattaccaacacaaaagatattcaagtcgttcttaaatctgcggaaaatatcgatatcggcgaactgaaaacgatcagcggcgtggaagcggccgttcttgaagacaatacgatcaaaatcaactcggatgcaggcgtcaataatttaaaccagattattgaaaagctgatgaaaaacggggccgagattcgttcattggaagaaaaagcgcctaatttggaaaccgtgttcctgaccttgaccggaagacagttgcgcgattagaaaggaggtccaaggtt

SEQ ID NO: 3962 - DNA, 270 bp, Bacillus licheniformis
atggccaattgcagttcctgcgctcattgcgggattgttgacagcgggaatcgcaaatgcctggaggctggaacagaatcagctgtgctcctgggcctttctttaaagaaaacaaatgctcttttatttttcatctctgcccttttaaccgcaggggccgtttcgattgttggagcaattggctttattggtttaatcggccctcacattgccaaacttgatcgttggagaggatgcgagaaaaagtcctatcatttccaaatctattaa

SEQ ID NO: 3963 - DNA, 267 bp, Bacillus licheniformis
atgttaaaaaaatccccgcagaagtacctctgcggggtccttctattccttaaaaaattaaggagaaggcaaagggagaggagaaaccggaggaagaacttatggggaaacgtaagtcttctccgcggttggcaacaacatcaatcgatgctgttgctattattatcaccaccgagcctttttgctatacatatgaatttgcactttgggtgtttgtgccagaaaacactttatgataagataggaatgatttttttcgagttttaa

SEQ ID NO: 3964 - DNA, 267 bp, Bacillus licheniformis
atgctgaaacagatttcatcatttctttttataatacagaataattatttaatcgttcctctaactcatgaatccttctttcaagctcagagaacttcttgtcgttgtatctatgatcacgttcaatgtttcttattgattagtttaagcatggatatgactttttcaggatcgttttcctctatgcgtgttaatgttttgttgattgtatctaaccgctcgtttacgcttttgaagtcttctttcatttccttttgcatttcgtag

SEQ ID NO: 3965 - DNA, 267 bp, Bacillus licheniformis
atgtactgcttcgcaaactcgacatctatagattcaaccactggtggacagtcctttaatttccgcgaattcttccacactctcacaaacccggcgatagcgatcaattgtttctttcgtaagtccttcagacatttttacgttacaaatttgtttacacacatcagacagagtcttactttcgtatgtatttttctcactatgtttaatcgccggtcttcgtctcccccgcatatacatctcatcccctcctcattgtcagaataa

SEQ ID NO: 3966 - DNA, 267 bp, Bacillus licheniformis
atgcagctctttgatatgcttctttcaaaacaaattgatgcagcagtttggaatgctgatgacaaaagaatgattcaaacgtttaaagcaatcgattttttttcaccgaaagcaaagaaaatttccaaggatacaacagaagccgttattgttattgaaggagacagagaaaaagaaatagcagaaaagtggaatttggttaatgagaaacagatattagacacccaaaaaagcgtagaaaagggagagaaaataccgcgctactaa

SEQ ID NO: 3967 - DNA, 138 bp, Bacillus licheniformis
taaggtcagggagcattcatgagctccgtgtgaaaaaagaggattttctttctttcagagccatcttaacaaagcaggaagattttaagcattttcgcggcattgcccagcatggcggagatattatatttcaatata

SEQ ID NO: 3968 - DNA, 126 bp, Bacillus licheniformis
ttcgatcaatgtccctgcagccctgccgctgtactggctgacaagcggactgcttctgacgattcaatcggtcgttcttcatcaagtttaccaaaaaaacaaaaaagccattcagcctgctgaatc

SEQ ID NO: 3969 - DNA, 111 bp, Bacillus licheniformis
tcctaaaaaaatagaaggtaagtcagcgatttacgattatataaaggattttcccgaaaaaatcgatattgtccgctttacagcgccgactattcatcaaacggcaaaatc

SEQ ID NO: 3970 - DNA, 150 bp, Bacillus licheniformis
aagcggtcgatctcatgggagattatcagatcagaagggtcccggttacacggggaaaaacgcttgccggcatcattacgctcggcgatgtttcaactcacaataaatcgaaccgccaggctggcgacgcgctgacatttatatctgaaa

SEQ ID NO: 3971 - DNA, 530 bp, Bacillus licheniformis
ttgaaatcgctggccggaatcaaaaaaattccctatttcccagagcatgtgacactgaatcggaagcatatttcagatcatgatcttgatgctgattttcccattaatccgactgcttatcaaatgctgaaggaagtcgacgggaaaaaagacgagctggagattgccgaagctctcaaaggtgtgtttaatgtcagggaagaggtgctgcagaaagatttgcacgaattgctgacagggctcaaccgccgttatttgatcaattggaggtacggagagggcccgtcttttgcgggagtgctttatcaattcttcagccagtatcatatccgctacaaggagaggttttcaagccattctgattcgtttctgctgttgtacataaagtttctgcaagtgatttctaagaaaatcatcgtgttctggctcgtctttttgatgttgtcgcttgcagcgtacaccgttgttccggatggatcgatcgtcggcatcgcggcttattttccgtcgtctatttcgggttgcaccaa

SEQ ID NO: 3972 - DNA, 252 bp, Bacillus licheniformis
tatcaaaaatcccgcgattatcgtcatcggcgacatcgtatcattcaggcagaacagctggtttgaagaaaagcctttgatcgggctgaacatcatggcagtcaaaagctgtgaagaagaacaaattccagtggaggcgcttcgtgaacaaggcgctgaagttgtggaatggccgaaatggaaatcggccgaaacggtgcctgacgatgcacttttaggtcgaatcgcttgttttgacagcctgctgttcac

SEQ ID NO: 3973 - DNA, 120 bp, Bacillus licheniformis
cgagcaaactctcccagcttcgggaaaacgttgaatctgtcggcggacgcagcctgacagaacaggaaatcaaagcgctccgcttttatacaaaacgcgacgtgtacactgcgcatcgcg

SEQ ID NO: 3974 - DNA, 264 bp, Bacillus licheniformis
atgtcaacgctgtttgtatcattaataatgaacgaacgctctccaatcggttggccttcatgctgcgtttataacacggtgaccttggacgccattaccgtgaccatcgccactggggccctaccgctcagacgggattcatcaagccgtcggccatggcttgtaagtgctctcttgcatgcggactggaggcatcttcctgatcgtctccctgatttaaggagaagccgtgctcttaggggctgtcatcaaccactaccatga

SEQ ID NO: 3975 - DNA, 264 bp, Bacillus licheniformis
atgaaacttttcacctatttttcggtgaaaaaaacaaaattttcatttaaagtgaactgtgagcagaaaatgaatttatatcaagaaaagcagataaaggcaaacctgcggaaacgcagggacgcaaagccatggcctaaggtgctgacggtgctacggttgacaggttgccgaataaacagggagttcgcccgtttttattcgggcgggctcttttctttttatttccaatataatgttttattggaaacgacaaatctgtga

SEQ ID NO: 3976 - DNA, 264 bp, Bacillus licheniformis
atggccgtggccaacttcattcatcccgatcattatggcgatgtgcgccgtatggaattacaggccttccgtgacatatacatcaatgcccatacgctgtgcatgaatgatgtaacttttttgccttcaccgactaatacggtttccatacaaactttcgtatcatacttgcccacctttcgcgctttgttcttttttaaaattttccttgacataacgtgcatacgcctcccaattgttttacaaatccttccaattttatag

SEQ ID NO: 3977 - DNA, 264 bp, Bacillus licheniformis
  misc_feature (1)...(264): n = A,T,C or G
atggaacctgattctttattcaaaacattattaaaatacaaagatagagaacttatattagaatgggaaaatggattaagagtaattggtaaaactgatacatttttcgaaacagacaacggtctggaggatgatgatatcaattataaagaatattacgcaacggcttttcaagtaaataaaggttttatctnnctnccgttaataatgaaagaagatagtctatataattggctattggnaagagaaacactccctagttga

SEQ ID NO: 3978 - DNA, 261 bp, Bacillus licheniformis
ggttgcgggggtgttgaacgaatcccaattggccaataaaaagcacggtaccgagcaggccaagcatctttttggagaggcgaaatcgatggtttccgagatggaagagggtcagaaagtgctggcttaattttcgctacttggaggacgggaccgggtgaggccttaaggagcgaggggggaaccggtggcgcggggggcctattttaaggaatcgcagaccgagtgcatcgagcagacggggccaaggattgggaccaa

SEQ ID NO: 3979 - DNA, 261 bp, Bacillus licheniformis
atgtttgacctcgtcattttaaagcgggcaaacctcgccgaattcatcagacttgtcggacttgccctccgcggcgaacatatcaatgacgagcatatcatctatacgaaagcgaaccgcgtcaaagtgacggtcaaagacaaaatgctcctaaaccttgacggcgaatacggcggcgaactgccgggcgaattcgaaaacctctaccgccatatcgacgtcgtcatgtcaaaagaaaaagcgagaaaattggatgattga

SEQ ID NO: 3980 - DNA, 261 bp, Bacillus licheniformis
atgttccatgtgaaacagtgtcagtcgagaaaccccgatttttctttatttttctttctcgcctttctgatcagcaacaatataatcaaaactgcgaccagaagcgtcacgcgaagccctccgctcaaaaatagaaaaaagtccttcaacatatccaacacattgatcacctctcactgttgtcacttagatgcaaaaatcccgtattatttgacttcccctttccaaaacggtctaaaacgtccctcagattcttcttaa

SEQ ID NO: 3981 - DNA, 261 bp, Bacillus licheniformis
atgtgccgaaacagccagaatagacgccataacatgcggatttccgtgccgttttactgccgatttctctttctctcggatcaaacggaaacaggtaggcaagccagcgttcatgttgagggtgtgaaaactgcgtgttcatattctttatttttccggaaatcgccgatctatcctcatctattgcctaatcgaaaagcaaagatcaggatcatttatacaattctacatttcagcacaaattcctccacgaaaccataa

SEQ ID NO: 3982 - DNA, 261 bp, Bacillus licheniformis
atgcttggatatgtattggctgatgcaatatcttatacaatttacaaagcatataaatatcagaaagatgagtatttacctgaaaccatcgaatctattgattcttacgagttatttgaggaatttcatagtcactttagtttattatctaaaaatccaggtcaaaaagaaaaagcttttttgaagtttttgaaaaaagagggggagaaaaaaatttccagggagagcattcaagattttttacttaatagtgtagaataa

SEQ ID NO: 3983 - DNA, 261 bp, Bacillus licheniformis
atgctgaatctgtcgacagcaagcagacaagtttcagccttggaacggaaaaagctcatcagacgttttcctgatcccaacaacggccggatcagccttgtggagatgacttcggagggcattgatgctctgaaaaaagtgcaaaaggcccgctatcatgtatacacggaggttcttcaagactggacaacagaagaactgaacacgttggaaacccgcttgatcagactgaatcaggattttaaaaagtggagcaaataa

SEQ ID NO: 3984 - DNA, 522 bp, Bacillus licheniformis
  misc_feature (1)...(522): n = A,T,C or G
gtgaagaaacgttctttattcttatctctattactttccgtcagtctcattcccggtgtgacggccggtgccgccaagacgggcgggcatgagcacgagcacgatcatgaagcaagaggaacttatattgattctttgcctaaagcgaaagattttaaagacttgaaaggaaaagttcaaattgaaagaacggtcaatacgaaaatactggatgagaaaggaaatgtgacgggaacgaaaacgtttaaaaagaatacgggcaaagggtcgttttcaacccangcaggcacgggaaaccacaaaatgagcgtccttgccgtggctgacgctcagtatcnggcgaaatacaccgattgggagacaagaatcgtccaaattattgagcaggcggatgtcttgttcaacagggatccccatgttgattttgtcctccaanctgttgcgcccttggaccccttccggcancaacaactcctcaattctttccaaccttcaaaacatttcccccggccccccttttaa

SEQ ID NO: 3985 - DNA, 259 bp, Bacillus licheniformis
atgccattaatccgttgcctgccgactcttcctaacgattcgggagccgattcagctgcctcttacacaactgtgatgacatcgttcgcttcatccagcacccagtcgacttacatggccctgatgggagatgatgatgattctacgctcatcatgaaacgagtctaccaggcgctctatctgctttataagatcatgacgggtgtggcaattcctctcgaattaatgacgccgctagtttccggatgcactcccagtc

SEQ ID NO: 3986 - DNA, 87 bp, Bacillus licheniformis
gagcggaggttacggacacggaagcggttttgctttaattgttgttctgttcattctcttaatcatcatcggcgccagctggttcgg

SEQ ID NO: 3987 - DNA, 345 bp, Bacillus licheniformis
ttaagtacaaagctcccgatttctagttaattaaacaagcatcattttttaggtttcgcctgtttcaaaagtggagtcggtacaaaagttgatattatgatcagcggctatcgttttgaattatttcagtgagggttttatcctgatgtcggggtggtcatctaaacggccctgacagcatcggtacggtaatgggagatatgttgtgctatttcaagtctacaggcgctgcggtgttcatatcctgggccgtcaatacattgaagactgggtatatgttagtcggaaaaatttatgtgccgaaaaagaggcgaatggagcaaaaagtgcgccatcatgcaggtt

SEQ ID NO: 3988 - DNA, 259 bp, Bacillus licheniformis
atgcttttcgatcagcccgaagccgggatatgggaaatgacagccgtggagcaggaactgtccgttataagcctgtcgggccagcagtctccttgtcttttctccctcgataggatcatgctcaagcgaaacccgcagcttcggattggagatactttccggaatatgaaatacatcattgatgatctgacagacgccgtcttttgtatgcaattcaatggtcaggtgtccaggcgtagtccgggcgtaggcatcaagg

SEQ ID NO: 3989 - DNA, 171 bp, Bacillus licheniformis
tgaaaaaaaaattgtatgaacagcagatcagagcaaaagggctttacacatttgaagagtacaaagatatgcgcaatgtgctgcaaacgctgcggatgaaatttgcggcctatgaagaatgggatttgtaccaacatgcgaccgatttgatggtcagcattcccttgaaaa

SEQ ID NO: 3990 - DNA, 169 bp, Bacillus licheniformis
ttggatattgctgttttatcaatggccatgagtcaggcggctctttatcaaaacgtgcaaatgtcgctgacaaatacggctttggataccgccgaacaaatcgcacagcagctcgtagacatggtgcaggcgccacatcccgtttcaggacatcatattgacttgaaac

SEQ ID NO: 3991 - DNA, 261 bp, Bacillus licheniformis
atggacgtgattttatttcaaaagatcgtgctgcagcgtttaaatcaggtcacggctgacgaggtgctgaagtacgctaaacaatacggaattcaagtaacaagaaaacaggcgcttgaagtggaaaagcttgtgaaaggaaaaaacatcaatatttttaatgaagaagaacgcaataaactgctcaagcaagtggaagcggtcacttcaaaagaagcggtgcagctattgaaccagctgtttgctcaatacgtatcataa

SEQ ID NO: 3992 - DNA, 257 bp, Bacillus licheniformis
gggaaagggggaaaggtttaaagtttagggggaaaatttggtcaagttttggggaagggggggaaaaaagtttttgaaatttttaaatccgggggagtttgcagggttttttttggttcccgggcaaaaattgtttaaggggggaaggaacccccgggaaggtttaaaattgggaaacccggaagtttttggggggaaggggtttccccccaaatttggggttttgtttggaaccccaaggttaacccccccggggg

SEQ ID NO: 3993 - DNA, 100 bp, Bacillus licheniformis
atgagaaactgattgaaaaaatgctcggacaggcgctgaagcagtacggacgcaatgttgcaaccgatccgctcagccccggcgaaaaaggaatcctgaa

SEQ ID NO: 3994 - DNA, 258 bp, Bacillus licheniformis
atgggatatttgccgcctgtccgcaatgatcaatatatacagtatgccaatcgaagcatcagccaaaaatcgaactacgcttatatacaaaaaaccgccaatatcccaagcgagcgcgcctaccgcgaagtcgaaaaaagagaggaaaatcagactgcggcttttaggcgggtcgaggaaaaaaagcggaaaaaagcgctcaaccgccgtgttgcgaaaaaggcggaaagcgggcgcttcgtcaatgaatccgtttga

SEQ ID NO: 3995 - DNA, 123 bp, Bacillus licheniformis
ccgaggacctaaaaaaagacccccgaccatacataataatgaagcctataaatacaaggctcaacgcaaacgttctgattttgttgattttactagagtatttggccatatccatccccctgt

SEQ ID NO: 3996 - DNA, 162 bp, Bacillus licheniformis
tgaggacaccgtctataaaatgacgaaagcgctgtttgaagccgataaaatcaatcatgcgaaaggcgagtttatcaagcctgaaaccgcgcttgaaggattgggcgatatcgacattcatccgggagcggctaaatacttcaaagaaaaagggatcgaaaa

SEQ ID NO: 3997 - DNA, 258 bp, Bacillus licheniformis
atggaagaagtattattatttgcgactgtgttggcgcccatcctaacggcgcttgttcaacttgttaagaaaacgattaacatgccgaccaatgttgtgcctgcggttagcttcgttttaggaatcgcactcggagccgtggcctatccgtttacggacctcgaactagtattgcggttgtgggccggcggttttgcgggactggctgcgacggttcttttcgagatcggcgcaaaacgtgaaggaacgaccaagtaa

SEQ ID NO: 3998 - DNA, 118 bp, Bacillus licheniformis
gtgaatgaatttgaaaaagacgtgcaaagcaaacgtaacgatcttgtagattcaggtgtcggttttatcgtgtcttttggctttttcgctacaatgtttattatcgctactgttatac

SEQ ID NO: 3999 - DNA, 207 bp, Bacillus licheniformis
tgaagcattgatcccttcctatcacagagaaatttccgggctggttgaacaaaaaaaccgctcaagctacaaagaagccgtcaaacaattaaaaaagctgcgcaccctttataaaaaagcgaaaaaacaggatgtctggaaccggtttatggagcagttttcagcccgctataaacggctgagagccttccaggaggagcttaagaa

SEQ ID NO: 4000 - DNA, 258 bp, Bacillus licheniformis
atgacgggatcgaaccgccgaccctctgcttgtaaggcagatgctctcccagctgagctaatcctccgaagtacaggacgtacaagtgcatgcgttgcaacaggacgttgcgcttttagcatgccttccttgcatttgaagtacaagtgcgcgttgcaacagaatgttactccctttagcatgccttccttttcccagcgtgccgtccaaaaaagaatggtgacccgtacgggattcgaaccgtgttaccgcccgtga

SEQ ID NO: 4001 - DNA, 258 bp, Bacillus licheniformis
atgagcagctacgaagagtactatgacaattacgatccatacagccctgagcgggaaaaagaaagacagtcaatgaaagcgcggcgttcggcggatagtaataaaacagataaaacgaataaaacagataaaacagctaaagcggataaaacggataaaacccgcagctctgacgatgaccggttcaaatgcagaaaaagaaagtgcttttctgatgacgatgacgaccgcttcaaatgccgcagaatgaagtgctga

SEQ ID NO: 4002 - DNA, 168 bp, Bacillus licheniformis
tctacgttgctcgtcgagaacgtggattgtatcaaaaagatgtcgctcgaaaaatcggtattcatccacagacctaccatgaaaaggaacgtgggaaaaaggaatttactttaagagaagcaaaggcgcttaccaaattgtttggctgcactctgaatgatctatttc

SEQ ID NO: 4003 - DNA, 144 bp, Bacillus licheniformis
cagccgctcgtatttccagcgcagaaaacagcttgtttcgattcatacatcaacaaaatcgtctgttttaatggagaagttttcggtggctgatgttgaggagaaagattcggacgatatcattgcatggtattcatatgaaaa

SEQ ID NO: 4004 - DNA, 255 bp, Bacillus licheniformis
atggacttcatttatgtggaagtactcaatgattcaaatattactaagtacatttcgttattaagaaaaacatcatctaaacctattaacgaactaaagcaggcgattgaaacaggaaaaccagttattgaatgtgattactatgacacagaagaattgaaatcactagtaatcattatagaacagttactctcattgggagctagcattaaaatttatgaaaatgatagagaaataacacttgagatgtcttga

SEQ ID NO: 4005 - DNA, 255 bp, Bacillus licheniformis
atgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtga

SEQ ID NO: 4006 - DNA, 251 bp, Bacillus licheniformis
gtgcaagtcagaaaaataaaggattcagatgccaaaagctatctcaaactctgtgaaacgatcgatgaagaatctgaattcatgctgtttgaaccaggtgaacgaaagcttcacgcgcaacggcaaatcaaacagatcgaatccggaatgtgcgaagtttttgtttgtgcggctgacgacggaagcttaatcggatatgttgcagcagccaaggggcaggttcagagagctcgccaccgcgaaccagtggt

SEQ ID NO: 4007 - DNA, 179 bp, Bacillus licheniformis
atgaagcaaaacatcggactgtttgacgccgtttttcgcattgcctgcggactgacgatcctgtcggcggcagcggcaaagtttacgagaaaaccgtggtgcagaatgacgcttttctgcatgtttatgggggcgatgaaggccgcttccggcattttacgattttgtcccatgacata

SEQ ID NO: 4008 - DNA, 123 bp, Bacillus licheniformis
cagcatgctgtttaatattacgatcggagcgcttatctttagttatgcggcatggacgcttataaaatttgtcaaacgaagccggaaaggaaaatgcgccgcctgtgaattaaatcgcacctg

SEQ ID NO: 4009 - DNA, 255 bp, Bacillus licheniformis
atgaaaacacattcacaacccgttgacgacaaactccggtttttgtttgtcgatcagtacactagcgatgtttttgacgcatatcatgccaaggttctgtacggcatctcgggtataccccgcgatatgcggcacggcgataaaacggtccagctcaaagagagggtgctgcttcagcggttcggtttgatacacgtcaagcgcaggctccagcgatgcccccgctcgccaaggcatcatataacgcacactcgg

SEQ ID NO: 4010 - DNA, 255 bp, Bacillus licheniformis; identical to SEQ ID NO: 4005

SEQ ID NO: 4011 - DNA, 148 bp, Bacillus licheniformis
atgctgtttgccatcatcgggctgatcttttttatcgagagcatcctgttaatcgtatatgctcataaaaaaaagaacggcttcttaaaatatattgggatcgtcctcagcatcgcgatcattgtgatgatcgtcaccagtttgacac

SEQ ID NO: 4012 - DNA, 288 bp, Bacillus licheniformis
ggggagggcgggagggacagggcggcgcgcggggcgcggaccggagacccggggccgccacgacacgggcggggcggccgggcgcaaccggaaagcgaacagccggagacggaaaccgaagacacaaaccaagagaaggagggagagaggacagacacaggggaggagggagaccaaggggaaggttgggggggggggaggagggcggggaggaggagcaaggaaggtggagcggcggcggaaaaaagggagcgaagagacgcaaggcccaattcggggggggggaag

SEQ ID NO: 4013 - DNA, 188 bp, Bacillus licheniformis
atgaataagctgttgtatcgttccatggaagacggcattccggtagaaatcatatacatgaaaaaaagcggtttttctaagcgggcgattcttgtgaaagaaataaaaaacggttatgtgaaagcattttgcttccaaaaacaacagatcagaatgtttaaaatagagtccattttgtccgtgttccc

SEQ ID NO: 4014 - DNA, 90 bp, Bacillus licheniformis
caccaaggcgacgatgcgtagccgacctgagagggtgatcggccacactgggactgagacacggcccagactcctacgggaggcagcagt

SEQ ID NO: 4015 - DNA, 249 bp, Bacillus licheniformis
gcggagaaaggcgggaaggggcgaaaaacggaccggcacggggggcacaccaagcggcacgacggaagaggaagagagagaaagggggacgcggaggggaagaccggggaaaaaagcagcggccgcggcgggcgaaagggaaacggcacaggcaaaggggaaggagcaaaaaaggccgggggaccatggagcgcggcagcgggaggagccagggaagaaaaaagcggaagaggggaggggccgacgcgc

SEQ ID NO: 4016 - DNA, 252 bp, Bacillus licheniformis
atggagcggaatgcaataaaatcgtataagggcatgcagtatgaactggaggatacatttttgaaatataaaaaagcagcagcacttggaattggtttacttttatttataggcggatgtcagaagagcggggaagctgaaatcagcgtccaagattacacaggacaggattttcatattcatagtaaaggttatcagaaggaaaccgctgagatcgcagaagcgcatcgagatgaagttaaaaaacggtaa

SEQ ID NO: 4017 - DNA, 110 bp, Bacillus licheniformis
ttgactgaagaaaaatccaccaataagaaaaactctctctttgaatgggtaaaagccattattattgcagtcgttctggcgttattgatcagggcatttttattcgaacc

SEQ ID NO: 4018 - DNA, 252 bp, Bacillus licheniformis
atgatcccctttacttccttttctatatcataccatttttccgtctgctgttctttgaaaaacaccttccgaaaaacccttgcaatctatgataaaatatttcatcccggaaagaacggctctatttcttctaaatccgactttttattgacatttataaattcccacggctctgcaccaaccgcatctgcttcaatgtacttgacgcgaatgcggtcgagaaaactgctgatcttcagttcgttctgctga

SEQ ID NO: 4019 - DNA, 252 bp, Bacillus licheniformis
atgagggcgatacacgtatcgcagcataccttttcacatagcggcctttttaagcttgcagagacactcctgttttctgcgggctttttcttttggataaaaaagacctcccttataccttttcataagcctttactgtgtggcttggcttcacttgaaacacaacatctttcggacccgttgtttgaaatggaccccagaggctctcgggagcgggcggatttccgcccatcattgcagcacgtattgtaa

SEQ ID NO: 4020 - DNA, 99 bp, Bacillus licheniformis
  misc_feature (1)...(99): n = A,T,C or G
tccaaaacaattaaactttgagaaatttttgcacgccgcagaggagctaaaatcagccggaatcgatgcactgacattggcggacaactcccntgccac

SEQ ID NO: 4021 - DNA, 294 bp, Bacillus licheniformis
aaaatataaattttgagttgagctacattattcttgaagctcaaaaaacaaaaacgagaaaaggccgtatgattccattagataaaaatacaatgcagctgcttaaaaagttattgttaagaaatacgcgatttaagcctagcaagtatgtcttcattacggaggaagggacaagattaacgaccgacaattttagaaaacggcttgcggattacgctcatcaggcaggaataaataaaagagtccatccgcatttatttagacacaccgcggcgagcatgtttttgcaggcag

SEQ ID NO: 4022 - DNA, 237 bp, Bacillus licheniformis
ctaatatcccaagcattacttaacccccccctacagctctccatcacaccatgaattaatgccctttcggtcttccaagaaatgccccccctgccaccactctagattttccaggatatagcctccccctatgacctcccccaagacccccccttaataccccccgccaagatccccccgtttaagatgccccctctaaaatccccccccaacgaaactaccctccccgaaagccct

SEQ ID NO: 4023 - DNA, 252 bp, Bacillus licheniformis
atgaaagtatttatactgttttatctatggattgtcccgctcgtcatcgggctgatatttttccgggttacccagcggacaagttttaaaaaaaggttttatccaggctacatcatgatcgttcttgctgcggctgtatttgccgtctgctacttgatcggacagccttacctcgggaatttcttcggcggtacgatgctgttcggcaccctgctgccgtttatggctgccgcaatgaagaaaaagaaataa

SEQ ID NO: 4024 - DNA, 252 bp, Bacillus licheniformis
atgtgcatgtgcacgcttgctgatgacgcctgccgtttgagctcagatttctaccctgagatacgactgggcctcgtgatatatatgccctctccgacaacgtaccaagctcattttcatggctgtaccggacgctttccaaagatacttatgcgcatggggcccgaatattaccttttaaaaaacgggctcgggctccccttccacaagggatgtgtctttgcttcgttggccttctggctcgggctttaa

SEQ ID NO: 4025 - DNA, 252 bp, Bacillus licheniformis
atgatttttttactggttttattggctctgtttattttgtattcattcttttttgacaagaacaacaaaagttcttataaaaaagcggcaccgaaaagcagaatattgatccgccaggcagctgcgccgaccggagttttgagggtaatcgaaaccgctcccggacagacggcaaaccgccgaacctccgaaggtatgcgcccgaatctgcggcttgtcatgagcccgacgcaccaaaacgaaaaaaaataa

SEQ ID NO: 4026 - DNA, 83 bp, Bacillus licheniformis
atgaaaattaaatcgatagaaccgacaccgagtccgaatacaatgaaggtgattttgaccgaggaactgccgggggaaaaagc

SEQ ID NO: 4027 - DNA, 270 bp, Bacillus licheniformis
  misc_feature (1)...(270): n = A,T,C or G
gatggttcagccacatatnaacagggggtatacccatacacctattctgccgggggacggcatcgacgatgtttcgcaacagatcanaggagaagccgcccctcngtagacagatggctgaacgttttaaaagcaggcggtacccatgaagccgctggacttgttgaaacacgccggtgtcgacatgttgacagaccagccgatccgccgggctgtgacgtatgtcggaacattggttgacgagcttgaaaaactgtacgataaaaaaga

SEQ ID NO: 4028 - DNA, 75 bp, Bacillus licheniformis
aaacgagctcatccaagcaggccgtttccaaagagggacgacattccgccagggagacatgtccaggttttttca

SEQ ID NO: 4029 - DNA, 249 bp, Bacillus licheniformis
atgagcccgacgagctaccgaactgctccaccccgcgataatataaacagcttggcggcgtcctactctcacagggggaagcccccaactaccatcggcgctgaagagcttaacttccgtgttcggcatgggaacgggtgtgacctcttcgctatcgccaccaaactatgccttcaggacgaaggtactgggcgttcctcacaggatgtgagggcctttagccgagtttccttgcctttggctttctga

SEQ ID NO: 4030 - DNA, 248 bp, Bacillus licheniformis
atgagaccaatgaaatcaaatgcttctttcattatgtattttgtgtgtatcagcgcttttttcgcatcgttgaatcaaaatatttattcacctatcattcctttaatcagagactcgtttcacgtttctgtttcgatggtaaacctgtccgtctcgctgttcatcttcattacagctgcgatgcagatcattgtcggctcgattgttgttttaaaggagcgaataagtaatgaggtcgagcattacgg

SEQ ID NO: 4031 - DNA, 249 bp, Bacillus licheniformis
atgcgtcccccctcatccgtttgttgttcgtatctatttggcaaaaagggttgtccttcccggagtctttttgaaggccgagaaataatcataagtttgcggaatggccccgtatgttcctttaatgcgaatatccttacattcgccttcggaattttcaaaataaagcctgtaggttcgaggcatcaacgtgatgacatcctgagcggttcggtcaggccagtccccttcaaaatctttaatgcttaa

SEQ ID NO: 4032 - DNA, 249 bp, Bacillus licheniformis
atgaattgtactcttgtgccctttggtaacttcaaactcctggacagcgctcatttctgtttcaggcagatgagagacatgatgctcaacccttttttggctgtattcaaacatgcttttgatcgatgcggccactgttttttgaccgtagctgccaagaaacgttttcaattgctgtttggcaccatgcaaacatgtatacatggcttcaagatccgctttaaaagaagcgggcacccggctgtttga

SEQ ID NO: 4033 - DNA, 249 bp, Bacillus licheniformis
atgaagacgcggccgcgtttcgtgggaaaatcacgctctcatctctattctattggaggaccaggcagatggcaacagaaaatacaaacatacgttcctgcgatgataaagaaaaagagaaactgcttctcctgcatagcgctgaattgcttgaaaacatcagtcaatctaaagagaaatatcgaaaaattattcaggcaggtatcacccaatgggtcaaagattttcaaagcggtcatattaaggtga

SEQ ID NO: 4034 - DNA, 249 bp, Bacillus licheniformis
atgattccctgcatcaccgctttaatccgggttgaatcaccggggcctatacaaggagaagtgcttggctataatgtaagtttcagatttttaggcaatgtcatcggcccggtgctcggcggcatcctttccagctttttcggtatttcttccgccttttacgcaactgcagtcctctttttcggcggagcatgccttctgatgttccaaaggtcccagcaaaaaaaatcagaggcgaaagcaagctga

SEQ ID NO: 4035 - DNA, 563 bp, Bacillus licheniformis
atgaacacccaagatgcgattgttgaagcagcatttactcttattgcccgacacggcctaaaaggcacgagcctttcaatgattgcatcggaagtcggcatttctaaaccggctatttactattatttcccttctaaagaagagcttatcgattatctatttcacatcgtatttgatgatcacaatttctctgaatatttttcaatcaataagtacacgaaggagaactttaaaaaacgattaataacagacggcgtacgctattttgaagagtataaacataactctcctgctttaaaagtggtacacgagtttgttttaagtgcagcacaaaaaccaagatatgagaaaaagcttaaatctatcatggaacaattcttagaaggttttgaagcattgctttcctacggtgtcgaactcggtgtcatctcttctaaaaacaccaaagtgaatgcacactcccttgccctgatcattgataatttgggtaactttatgattttaggaattgagatggattataaaaaagtatgggaaacagcagtcagtaatgtaatgaaagg

SEQ ID NO: 4036 - DNA, 156 bp, Bacillus licheniformis
aaaagcaaattgaacttgctagacgtccgcagggcatacctgttatggccgatttctgcataaaaggaccggcacattgcagcaagcaaaaatacggtgtagcgcttgtatatacgctttacgtgtcagtggccctttatatgagaggtaccatga

SEQ ID NO: 4037 - DNA, 79 bp, Bacillus licheniformis
atgaaattttacaccatcaaattaccgaagtttttagggggaatcgtccgggcgatgcttggctcgggtcgcaaagact

SEQ ID NO: 4038 - DNA, 249 bp, Bacillus licheniformis
atggccggtgcagctgggactaatgccgaggacgctatgaatgcagttgctcctaacgtgtggagaatggtagactgtgtcggtcaacgtaatggatttttttgcttgtactacggagagaaaaaagacgctgctggtgacatcgcgggtccttgcgatttgtgccaaaaccccggcgccttggatttaggcggagtggcgcgcccctacagttcccactgctcatgctggcgttcggagcgtgtgtga

SEQ ID NO: 4039 - DNA, 249 bp, Bacillus licheniformis
atgttctttttctgtaacgcgcctggatcattgtggtgcggaatttcctccgcctgggtttcccctctgggcatctgtccgccgatcgcctcttcggtgtctttctcgtcgcccgggcgcatcactgttttgctaacaccctttttggccttgacgggaatctcatcctgggtcgtccttccatgtattacgtctggctttcacaatcgactcttatcgccatcacccgaggggttggattgtcgatga

SEQ ID NO: 4040 - DNA, 249 bp, Bacillus licheniformis
atgacgggatcgaaccgccgaccctctgcttgtaaggcagatgctctcccagctgagctaatcctccgtttgcacttgcgtgcaacagcttggcggcgtcctactctcacagggggaagcccccaactaccatcggcgctgaagagcttaacttccgtgttcggcatgggaacgggtgtgacctcttcgctatcgccaccaaactatgccttcaggacgaaggtactgggcgttcctcacaggatgtga

SEQ ID NO: 4041 - DNA, 249 bp, Bacillus licheniformis
atgaaggagccataccgcatgcagctcgagtcttttcaaatgacaattttatctgatggagcatttcgggtttcaagggatttttttttggcgggaggagactccaaggaaacagaacgttatcctgaagaatttgaagcagcgctgaactttgcctgtctggagacgaacggcaaacggatactgattgatacgggatttgggggaaacaggcggacaagaaagcgggcacttgccttcatcacctga

SEQ ID NO: 4042 - DNA, 249 bp, Bacillus licheniformis
atgaaaatggatcaaaaacagattgactcagtattgcaccttgtcgaatatgcattgagaaatggtgggaggattgacattgtctatcactgtaaaaatgaaaaggcagctcttcaaaacgtgaaagatgccgctgaaaatttgaacacagagattaatcagcgttcctatgataatagcttttggtacgagactgaaattaacaggaaaattcaaatgactgcattttatccgtcagcttatgaataa

SEQ ID NO: 4043 - DNA, 246 bp, Bacillus licheniformis
atggtaaaccgccgcaatgagccgcagaaggacagacttacatacgcatttgtcacgagacgggctcttcatcatgagggagcctcggtcgttcggaatcgcctcgaccacatcatagaggcagccaggatgaacctcggcgcacgccgtacagtctccggccatcagatagcgatcagatccagatccgagcggaaggaaatacagcaacccgcctcaaagacacggccgagactcgcggaatga

SEQ ID NO: 4044 - DNA, 321 bp, Bacillus licheniformis
gcgacgaacacccttccgccgagcatgtactgactgacaagccaatgccaggtgttgcctacggcaaattccaggagcctcctccgcctcgtccgaatgcctaaaacgggtcgctccctgtcgagccgcgtccccataaggcctcccactgtgcctccacttgcctcaatccccaatgacttccgccaccatcccgccatcctcccccccaccgtgccccctcgtaatactagcctcaaccgaccccaccaacaccccaacgcaccccccccctcatccccacaaccaacgcctcctctccttcatatgcccttcatccgc

SEQ ID NO: 4045 - DNA, 246 bp, Bacillus licheniformis
atgtatagcgttcctctccctgaaagtaattctccgctttcacaaacctgtacccattctgcttcacacatcaaaccggcatccattttattaaacagctcatgctcgtcctcccccttcatatggatcagcccggccaaactctctttgcctgacccgggcgctacattgatccataccgcttcccggctcgccgataacaactctgcttttttcaccacgttcacgcatagtggcgctacttga

SEQ ID NO: 4046 - DNA, 246 bp, Bacillus licheniformis
atgctgaaaacgggcatgagagtaacagccgcaactaagcttgaaggcattaaaacgacgctaagaccgaagtttaaaatagacgatatacaaaaagaaatgaacagcgtttattcatcgcttctctacagcttcgaaggaaaagcgcagcaggcgcttgctcagcgaatcagtcaaagcgcccagcagcttattgcgacagagaaggatggagaaagttttgtgaatggatttaagacaagatga

SEQ ID NO: 4047 - DNA, 246 bp, Bacillus licheniformis
atgataggtcagagcggtctgccgaatcatccctttttcccacacatacgattcgatcacttctgtccgatggatggaatgcgtatagaccacatcaaagcttttcttcttttggaggggaagaaaagcgatgatctcgccgctgtcctctttctcgaacacgacggcggtctgataaggaatcaggcatgccgctgcaaaaacggcaatgatcagcgccggcacaagccgttttatgatttttaa

SEQ ID NO: 4048 - DNA, 246 bp, Bacillus licheniformis
atgaaaatgataagagcacgaggaggtctaaatatgaaatcggatattgaaaaacgtgcggaatgcggtttgcaaaacggaacggaagcaatgatgaaccgggagtcgcaacggcttgatgctgctttatacggggccgtcctcaatgctttcggctgtgatgataggagccgactgatgagcggggaagcgggggcgggcggtaaagcgggcggagctggcgaaaggctgctgtaccctaagtaa

SEQ ID NO: 4049 - DNA, 243 bp, Bacillus licheniformis
atgtactttgtttccggatttgtttcagttttgcttggtctcgtcatgctatttaccttacggttgttatctgttgctattcctcatgttataactgatgcagctggcaatgatgaagcttcagcttattttcaatcctctgtattattttatcctgtgctgctgcttattttaggcgtagtcttgattatcgttcatttgcgaacaaatgataaggaaaaggattcattcaaaggcgagtaa

SEQ ID NO: 4050 - DNA, 174 bp, Bacillus licheniformis
agctggaatgacaaacaaagaaataatggaacaactggggataaaaaataaggctcaaattaaaacattggatgcgatggtacaaaacaggccaaacctatcgattttcgcaacaagttggaaaacaatattcctacggtaaagaatcggagggaatgagtgagctagaagaat

SEQ ID NO: 4051 - DNA, 552 bp, Bacillus licheniformis
  misc_feature (1)...(552): n = A,T,C or G
tttgtatgtgctctgttggttgtatcgttggtggtattcttcttccttattattggtctctgtagataatcgtattatttgggttgcgtctatacgngttctntgttatcattgtgttctgtgacttnatatgttgttctttggtctgttctttctcgtatttatgatgttttgtttctttgtctctgttgttttgtgttttgttagtctttgttatattgttgatttcttgttgtcgtttgctatgttgttctcgtgtatattgtttagtgatattttgttttatgtgatcttttctcgtagttatcgcgtgtatatgtctgtctagtctcgttgtgatatgtatatagtgtcgagttgtgtgaganttctcgttgtgtattagatggagtgtgtagtcgtttgtgttgtgttgagtgatcgatctctatgtttctctatgttgcttaattgttgtgtgttgttcgtgttatagtttatggttgggtatcggttgtgtagttgtgtatgtggtgtgtatgtttatatcgtgatagttatgtttatatgtgt

SEQ ID NO: 4052 - DNA, 243 bp, Bacillus licheniformis
atgagggatgggagcggaatgtcctgtttaatgaggctctttttcatactgatcggagtccagttgatggcggcgtcgtccattcaattcatttttgatttaaacgccgtgtatcattcctctgatgaggtgttctggagggaatttttcaaggagctgttcactaggccgcctttatacttcatgatttcaggaatggtgctgatctttatcggggtttgtttgccgcgaagaaacaaatag

SEQ ID NO: 4053 - DNA, 243 bp, Bacillus licheniformis
  misc_feature (1)...(243): n = A,T,C or G
atgagcctatcgaacgaaacgtctaacgcattatcggcttatcaacggtctgatgattcgcgtcatggtcatccgcatgtctgttcgcaacctcgattcaacgacggcgatctgatcggggcgacggangacatgcgttatacagaccaacgtcgatctcaaatccaatctcttccggtgaaatcggaaaaaggctatctctcaataatcccgccaaaattcaaatcctatggaaggcggtaa

SEQ ID NO: 4054 - DNA, 372 bp, Bacillus licheniformis
ccccaagttttggaaagccccttttaaccgatccgaaccaaggaccccccccaccataaaaaaaaacgcccctttttaacccctcccctttttttcaaaataaaggagggcccccccccctttctaaccgggtaaaacggaaaccccctccggttttttggccgggtaaaaccccctttttttcgcccggcctccgggtccaatattcgggggaaaaaaaccgcccttgggccaaccaaaaaaagtttttaccgggcccttttttccaagcgcgggttgggtttccccggtaaaccccctcccttttaaaaaaagcccccccaaacccaaaaaattgtggccaaggccccccgccccacccccaaccccccc

SEQ ID NO: 4055 - DNA, 96 bp, Bacillus licheniformis
aaattgaccacccagcgacacagaaattgaaaaaggaaaagctggacaaagccgggtttcacatcccggaccaccttcattttattcctttggact

SEQ ID NO: 4056 - DNA, 318 bp, Bacillus licheniformis
accaaaaaacacccccataccacacacagcgacacccacacgcctatctgctacgcccgtctccctgatcgtccctctccgcatccgccgtctccggccgtctgctacgcgcgcccgtgtcgctcccctcgctccgttcccctttgtgctcctctcctgccccggtggcccccgccgcaggcttgttgcctgtgccccgctccgcgcttcggcccctcggcctgtccccggccccgcgccgcgcccgtctgcgccatgtcctcttatcgcgcccctcccctcccttctccgccgtgccgtttctctcccccgtctgcc

SEQ ID NO: 4057 - DNA, 90 bp, Bacillus licheniformis
cggccatctggtatgccctcgatgattacgaggtcaccgatctgaaggagaaaccgaaaatccggcagcggccaaatagagagaggaggt

SEQ ID NO: 4058 - DNA, 240 bp, Bacillus licheniformis
atgcgtagcgctcggttctcagcgccatacaaaccatttgttccacggcttccagccccgaaatcatatcacccgtcatcctgcctgtttcaaaatcaattttgtacgtttttgaagtctcaatcacatcgctgtcatcctcgatatcttcaaaagatacttccggcgaaagagccatccgagccacctcctactcctacactctgtctattacaaaaaaagactgccctccaggcatag

SEQ ID NO: 4059 - DNA, 240 bp, Bacillus licheniformis
atggatatatctctggatgaggtaaaagaatatctgcgtattgatggagatgaggaggattcccttatctccttttttatttccgcagcgaagacgcatcttgaaaacgccggtgtaaccgacaaggaatctgaattatataaattggccgtcctcatatacgtcacagacgcgtatgaaaatagatcaacggcattgagtggaaataaagtagctggaatcgtattgcaactgaggtga

SEQ ID NO: 4060 - DNA, 240 bp, Bacillus licheniformis
atgttaagaagtcaatttaactggagtgacataaaatgtttttttcctttttttattccatcactcgaagatgatgcccccagccattcatttgtcaccggtttaaacgaggtcatcattctgtcggcattcatggccattcccctcatgaccttttcgttttttattccttccaaaaaaacggttgcatttaaaacttacgtatgtaatacttcaaaagactacacttgtaagatttga

SEQ ID NO: 4061 - DNA, 278 bp, Bacillus licheniformis
aaaaaaaaaagggtcctcctaagaaaaacctcccgaaaaaaaacaaaaccctaaaatttttaaacccatttttttttttaaatggaaaatttcctaatttttttcaaaccgaattcctgaagggcttctttttaaccccccattttttcctaaagaaactgcaccttttccccaaccctccaaacttccccaaccaaaccaaagggcgaaaagaacggaattttttaacccgttcccaaaaaaaccttaattttaaatttaaatttttgaagggcaat

SEQ ID NO: 4062 - DNA, 155 bp, Bacillus licheniformis
atggatcaggagacacccgttcatatctatgtgaaatctgttatccggaaggatcggacacggagacgatcgagttccgacaactgattttattatatgaaaaaagataaaatatatctttcttatcatgaagagcaggatgctggaagtgcaag

SEQ ID NO: 4063 - DNA, 198 bp, Bacillus licheniformis
ctgtccctgttcctccaccacctgctcctcgtcttcctcgtggtttacccacgattattatccctcttccctctccccctgttagcattttcatgaagtaatttccaactccggccccatatttttcggttgtccttcctccgccggattccggcttctttattcccttcccccgtcgtccccccccattccttccga

SEQ ID NO: 4064 - DNA, 360 bp, Bacillus licheniformis
  misc_feature (1)...(360): n = A,T,C or G
gtacatcggacctcgccttcttatggacgtggaacgaaggagaggagaaggaggtgtcaggagaggaatacgatataatcctgttagagattgacgtgagaaagaacgatagacagatggtagtacttcagcagaacggcaatctaaggaaggataaccatcaggacaatagaacagcagaagggtccatagacaagagaaaaaaaaagataaaagaacaaagatagcggcccgaagagggaccgagacgaaagagccaagaggaggaaaaagaggagagaagcagggaacaagaccaaagacaccaaaaaaccaaaaaaacccaaaaaaacaaaaaaaaaaaaaaaacaaaaaccaaan

SEQ ID NO: 4065 - DNA, 74 bp, Bacillus licheniformis
tacaaccaaatcatcatttccatgggatccggagcaaacgctgctttaggcgcgtttgactacctgattcggaa

SEQ ID NO: 4066 - DNA, 138 bp, Bacillus licheniformis
gagtaccagagcttcgatttgcgggatttgctggagattgggaagagcgtaagttaggagaattagtagaaattaaatctggttggacaccttctgattttgttgaaaccccaaaaatgtaatggaaaactccagggc

SEQ ID NO: 4067 - DNA, 137 bp, Bacillus licheniformis
ccatcagttcatgcagcgcgtccatcagttcatgctgcgcgtccatcagttcatgctgcgcgtccatcagttcatgctgcgcgtccatcagttcatgctgcgcgtccatcagttcatgctgcgcgtccatcagttca

SEQ ID NO: 4068 - DNA, 123 bp, Bacillus licheniformis
gcggtctcgccgccttcagtttcgttgatgaaaacatggacaagatgtatttgaacatcgggtattgtgcgttgtttttaagcattatgatttttactcttgatgcaaaaaacacaaaaaaac

SEQ ID NO: 4069 - DNA, 237 bp, Bacillus licheniformis
atgactttcttagttttaatggcagggttatttcttttcatttacatgaaagaaccattcagcaaaaaagtgtatgcttatgtttacgtggctttttatttaatggttttagccctatatattattaacactacatttgtaaatttaatatctagcagactattattaattgtaacagtaattgtcatttcaccattgttcatcagttaccttaaatcctcaaatgaatctcgttag

SEQ ID NO: 4070 - DNA, 209 bp, Bacillus licheniformis
ttgaaattaatcggaatcgggcttttattattagcttccttagaggcttttgccgtcatgctggatgtatttcaaggcatgaccttgcaaagagccattgtaaactccctgacgtttgccatcctggaagtgggcgagtggatcatcatccttttatttttgtttatcatttttctcgaagcctcggaaagctttcgcaaaaagagaaa

SEQ ID NO: 4071 - DNA, 69 bp, Bacillus licheniformis
gtttttagacttttttaaagaaaaagggcatgccgttgaaccgagcgcctctcttattccgcatgaaga

SEQ ID NO: 4072 - DNA, 147 bp, Bacillus licheniformis
tggatcagccgctgaaacacgaagacatcgccaaaatcgcatattgttcgaaatttcattatcagcggatgatctacatgctgacgggtgtcacctttgccgattacattcggaaaagaaggctgacagccgccgcgcaggagctga

SEQ ID NO: 4073 - DNA, 237 bp, Bacillus licheniformis
atgacctgcctcctttattcaggtagtctgcctaaaaaacgggaatattatttaataaaagcgcggcggcggtctgaaaccaaaaaagaggatatggaggagacaacggctaataaagcaatggagtatgtttcactaatcaattggtgcgggaattttgggaaaaccgatgaaaacgggatcgcccgttttaacaaacacacggaaacgattgccctgaggatctattttaaatga

SEQ ID NO: 4074 - DNA, 234 bp, Bacillus licheniformis
atggtaaaaaaatcatttcagggaggaagaaaaatggcgccgtttctgattcagtttatgctctattttcctgaagacaaaagagaatatatcccttcttttattacgctggccgttttctttatcatcgcgatcgctgtattccggctgattatcaagcattccaaaaaagaagctgaaaaagcggaaaagctggaaagagaattgaatgaaaccatccataaacgctcttag

SEQ ID NO: 4075 - DNA, 234 bp, Bacillus licheniformis
atgaaagagaaaaaatcgtacgctgagctcatgaagtcccgcaatacccaaaaggtgaaagaacttgatgtaaccatcacggatatctacattcaaatggtccttgatgaatcgctttttaaacggcgtttgcacacgctgagcaagaagattaatgaagcattagacaaaggagataagcaatctttccttgagctttcaagagaatatacagcgctgaaaaagcacgcataa

SEQ ID NO: 4076 - DNA, 234 bp, Bacillus licheniformis
atggaagagatcggacaacaggctgctgtcagtatcatcgttcatcttttttttattgcattgacttggtgggctcttctggcggtcaatattgatccgcttatcaggaaaggaaaagtcattcaggcgagggtgttaatgatcatcattacaatcgccgtcggctccaccgtcagcaattttttcttggactatctttattattccagacagcttcaaaatttattttcatga

SEQ ID NO: 4077 - DNA, 174 bp, Bacillus licheniformis
gaaaaaaccttttcaacatagtattcgaggcgattcttcgttttgtaacgatattttaaaaataacttcgccggatcatgaaaccgttcggctgagctgggaaatctcagaggctgcgctttcagcggctgaagcggtgctgtttgaaaatattagagacgtcgaaaagcaaat

SEQ ID NO: 4078 - DNA, 234 bp, Bacillus licheniformis
atgtgcggccgtagccgtatccataaccgccgccgtacccgtatccagggcagcaataaccgtacatataaagacctcctccgttattttacgcacagccttttctttttagtaggcatggcgtctaatataaactatgtaaaagtccaaaggttgtatagtcgaatgcccagcttcaaggaattttccctaaaggtttggtctaaaagcgaaggcggttgcataccgatctga

SEQ ID NO: 4079 - DNA, 441 bp, Bacillus licheniformis
  misc_feature (1)...(441): n = A,T,C or G
aaaagtgctcggtccttttattcaggcaggagcagcatctgcaaatgatttgcgcgacctggccggcagagtgctcggcaagacgctagatgaatggccggaggaagaattcagcaggccgctcgtttaccaggaaagctcacagcgtgcggaagcggaagcaggagcattgctgcctgaactgcaggaagccgtcgagacattgaaacagatcactgaaaggaggtggacactcaaaatcaatttcgtcagctatgtcgacaaagcggcgaacaaaaagaaatttttcatgtaccaagtcgagtgaaccgccgacattcaaaagaagcaggggggcgagccgaattngtcaacatccggtttccccccccaaaaccccccccccttccccccctcccctcccnnccccncccccccccccccnccccccnnnccncnccc

SEQ ID NO: 4080 - DNA, 234 bp, Bacillus licheniformis
  misc_feature (1)...(234): n = A,T,C or G
atgagcgatcaggggctgatcaaaaccggcttttccgaccagcctgtttacttgtcggaatcgcttggcttgtggatggagtttttgatcagcaaaaaagacggcgagcatttccatgagcaatatcagcacctgaacgaatccttccttatgaacaacaacctggtgtcatggcaaatccaaaacggccaggcaagcggggtgaacgnccctnatcgnatgaaccaaggcttg

SEQ ID NO: 4081 - DNA, 234 bp, Bacillus licheniformis
atgaaaaggaaagcttttgtcagcctaagtttattttgttcgctttttgcgggagcgtttatgatcaacagggaaatgacgcgtgaacagactccggggatcggaacacccgaaggccctcaataccgcggtgattacacgccgctacagacgggagcggaagatcagtccttaacgggaacagaaagagctccctttaaaccgagagaatatatcagagttgagaaacgctga

SEQ ID NO: 4082 - DNA, 234 bp, Bacillus licheniformis
atgaagggcgggagagatcctgtccttctttttatgttcatatcgacgctgttgattagaaattccacgatttgcagtctagaaagggtttgtttaaatacaccgaacgtaagggggcgaacgttaatgtctgggtcagttgatctcatgctgctcggcttcttgcatgcgatcgcctactttacgaacgacattgtgaaaaaccgaaaaaagacagtttttttagaaaaatag

SEQ ID NO: 4083 - DNA, 234 bp, Bacillus licheniformis
atgcttgaacaaaatcaagatattcatcatgattcttcgtttttgaaaagtgtggttattataaagatatcatgcccaagatcacttgaacaaagaaattcatcctcatttaacgttgcagtgggagcagggcgtaatattcagaatgatatagccgttggtggtctttttaaaactgggatcattaccgctaaaattaatggtatcccttattataagttccttcttagatag

SEQ ID NO: 4084 - DNA, 234 bp, Bacillus licheniformis
atgaaacatcccaaggaatcattcaccaaagtcaaatcgtatcgcccgtttcacagcgcctttgatccgtgtccgccgatcggcaaaagatactacagaacccctccaaatctatatctaggttttcagccccgcggccttccgcagttttccccgatggaggcgctgcaaaaagggacgctttggcccgtattttacgatcattatgaaaatccgtatgaagatgggaggtaa

SEQ ID NO: 4085 - DNA, 234 bp, Bacillus licheniformis
atggaagctcgattttcagctaatctccgatttccagctcccctgttctgcgaaaaaccgtatccctgtggcctgaaagaacaatttgcccgttttgttttggataatagctgcctttataatgaccgacgcctttttccaaatcatcgggactggtcccttcaacgatgggaagctctgcgcccagtttgggaatatggagtatgcctgccgcttcgccggcggcgggcttaa

SEQ ID NO: 4086 - DNA, 234 bp, Bacillus licheniformis
atggaaacagccggagaagacggtgcgaggggaatggctattcttgcttcttacatgatgaacaaaggtctagaagagagcttggaagacttcatagacaatatcgtgtttgtagaggatgccgtgcaggaaatttaccttgatctattagatgtagaaggatttgaagcatttatcgaacggtacaaaaaagtttttatgattgagcaggccgctgtagacaatttgatataa

SEQ ID NO: 4087 - DNA, 231 bp, Bacillus licheniformis
atgcttccttttgccacggcgaccaaacagccgctgcagattgtgagaataaaagcgttccagaaatcaagagttgacagtgtaacaatggttttgaatagttttttcatgagttattccccttcccggctcgcgccgatgtttatttctctgcatcatgctccgccacgtgcaagaatattgctgataccattggcaaagagactaatagcattacaagcagttgtttga

SEQ ID NO: 4088 - DNA, 231 bp, Bacillus licheniformis
atgcttttgttttttgctaagtttgtcttgttctacgtattctgttcagttgcattcgcccttttcaaagtcatgtacgacaatatcagcaaaaaatgggttacaaagacggcggagggcactaaactgaattgggctttgaatgtctttcttaaacacggcaagaatatggacagcaacgactgctttgttatggggggtttagcgggatggtgtgcgatttatttataa

SEQ ID NO: 4089 - DNA, 231 bp, Bacillus licheniformis
atgctggtgttgatggtaaagtttattttgctctttattttatgttccatttcgttttctttatttaaagcatgtgtttacacagcgggtaaaaaactgattgaccggaccgcggaaggatcggcactcaactggacctgcagtgtattcatcaaaaacggcgtggccatgacgggcgatgactgctttatcatggctgtttcagcggccttgttggccatttatatataa

SEQ ID NO: 4090 - DNA, 396 bp, Bacillus licheniformis
caagagggctgtttattaatagaaacacgaatgaaatcgtcagcagaagctacaacaaatttttcaacatcgaggagcgtctgacgacgaaaatgcatgttctcgttaacacgctgcgctttccggtcaccgtctatgataaggcgaatggatttttgggaacggtcggctacaattctgaaaccgatgagcttgtcttcacctcaaaatcctatacatcaagcggacaaaaagacggccatgcgaaatgggtggaagagctgttttacaaaacgtttgacgcatctcaaacagaggctatgaaagaatatgtgaaaaaacgcaatgtttcgttagtgttcgaagtcgtgctgccagaaaaagatccgcacattatcgagtacgaatcggacaagc

SEQ ID NO: 4091 - DNA, 375 bp, Bacillus licheniformis; identical to SEQ ID NO: 3702

SEQ ID NO: 4092 - DNA, 99 bp, Bacillus licheniformis
  misc_feature (1)...(99): n = A,T,C or G
aattgaatttaaggggaatcagctattgaagctcggcntgtccttcccgcaaaactggctcttgatagccgatcaatttaatgttgttaaagagacgtt

SEQ ID NO: 4093 - DNA, 231 bp, Bacillus licheniformis
atgatgtaccgcacttttcctgcgcactctgttccccgcgtgcgccaatacccgggatacttcggctacccggttacttatgtctataatccttcagcacacgggccatatacctattatccgtacggcggggtgttcaccactccgacgctcggattcggcatcggctacccgggaatttccgttccggctgtacacgcctttaccggtggattcagagacaatgaataa

SEQ ID NO: 4094 - DNA, 231 bp, Bacillus licheniformis
atgaaaccaagggggaaaaacccgggcttaagtgcaaatgagcctgaaaaagcgaaagacatagcgatggatgaacggggcacgacaccgcgggagaaagaaaggtcgaaagccaatataccaaagacagtgcgagaattttggtggaggcaactcacggatggccggaacccccacagcgtggagggggcctgggccaaggggcgggcgataacgggttggggagggttg

SEQ ID NO: 4095 - DNA, 231 bp, Bacillus licheniformis
atgatggtgagtcttcttgcagcgatgatggtcggggcgtttgcggccgcatttgtcgcgttttttgcagtcgtgatgttttttgcttttgtcaggcttcctacagtcgtctgggttcttgctttgtcaggctttttgcagtcatcgggtttcttgcttttgtcaggcttttttgcagtcatcggttttcctgcttttgtcgggccttttgcttttatccggctttcataa

SEQ ID NO: 4096 - DNA, 231 bp, Bacillus licheniformis
atgtggatgtctcctttttcatacgtgtatagtttccattgtagcgttttttcgccgaaatgcaatgcgctctgtcggcgaatgtggtttttgccaaacatgaatattgatttggtttcattccctgttatagaatggtggtgtatagttccaaaatcagaaatatatccctctttcatccgcgtaatgaccgaactaaaagacaaaccagcaccaagacaactcacctga

SEQ ID NO: 4097 - DNA, 276 bp, Bacillus licheniformis
caagaaggcagcacggcgggggacacgggagaggcccgcagggccggatgggaaccgtgcgggcgggaaggagacggggggccggagacagagcccggacgcgggggacagggggaagagacgggggacaggagcgacacagccggaagcacgggaaagccaaaaggcgggcaaagcgcagccgagaaccggcagagcggcacagaggggagcacgaaggacgggccgggggaaagcggccaagggggcggaaagcaagccccgggggccggggag

SEQ ID NO: 4098 - DNA, 460 bp, Bacillus licheniformis
gtgaccggtgaaaaggctcacttgagcgagtttgaggacacgctgaaaagtgaaggcgtgaaggtcggtcgcggggatgcgtccatttttaaaagccttgaattcgttgtgcgagaaagaggatttgctgccgctgttcttgcagcatttgcgctgattgcggcgcttgcgttgttctggttgtcgttaagagcgcgtgggcgtgctcttcgggttctgggcgggtgcccgacctcgcggattcaggttcaggacctggccgggttcgggggggcgctgctggtttcggcggtggctgtagcactggttgcgtcttgctacgtaggtttgtttcatggctggatatatgtcggtaccttcctcaatgcgctgttcagtctgcaggtcgctgttattaccgtatccctgttggctacgctgatcatgtcagcttccgcaggcctagcgctaccagtcccaa

SEQ ID NO: 4099 - DNA, 174 bp, Bacillus licheniformis
ttccaagcggaaaccaattgtccatttgcgtaacggcagccgatgtttcttcggccaagcggcttttcggcaagctgagcgagcggggcgaggtcaagcttgagctgaaggaaacttatttcagtcccgcatacggcattgtcactgatccgttcggcgttgccttccaaattt

SEQ ID NO: 4100 - DNA, 72 bp, Bacillus licheniformis
ttgtcgtatacagacacaggacgaacattaaacgcatcatcgataaaaccgagcccaaaatcaagtggatgt

SEQ ID NO: 4101 - DNA, 139 bp, Bacillus licheniformis
atgaaaaagctgtctgatgaacttttaatagaatcatacattaaagcaaatgagatgaatttgaaccgcgaattcatcgagctgattgaaaccgaaatcaaaagaaggtcgctcggtcatctgctttccgtctcttcat

SEQ ID NO: 4102 - DNA, 228 bp, Bacillus licheniformis
atgggggattttaaaaagatggtcaaaaaaattgtaaatggattcaattcattttcactactggggacaatcttttttatcggcagttattttacgtacaaatttaatggcgtggagctggtcgggttcctgtacttaggtattatttttttgacagctctgatcgcaaccaccgtaatgttaatcaggctaaaaagaaaaggaatcaataaagataaacaggcttaa

SEQ ID NO: 4103 - DNA, 228 bp, Bacillus licheniformis
atgttatcacataacaagttcatttctcaaatgaataactatagcgggtttcgaaatatttcgaaatggcttcaatgcgcgcgaagcatactgggcaatttcggtcctgcttggttttattttaacccccacttctttgacacagcccaagttggatatatcgctgggaagttttcttgttgtttccgcaagaaaagggcaagctcccaccctggtttattagaaaaa

SEQ ID NO: 4104 - DNA, 228 bp, Bacillus licheniformis
atgtatgttcattcaggaaatgtcaaaaatatagatgtaataggtagagcgtttccatcgttgaagagggaggaatgtagcatgaacctgttcattgcagccaaagagaaatttatggaagattaccacaagcagctggaaacggaacgaaaacaagaggtgcagcagtcggctgacggatacaatcaattgaatcagacggaaaatgcagcaaagcggctgaagtag

SEQ ID NO: 4105 - DNA, 321 bp, Bacillus licheniformis
  misc_feature (1)...(321): n = A,T,C or G
aaacaccagggtcggcgttttccccctatccgtccaaaaaaacgggtttttcccccccccccgaagcatcaacctcccctcccgccccgccggcgcaccccgccccaaccctccatcacccccatccaccagnccacacctcacaacaacacccaacacaaacccaccacatccacctccccaagcagattggccgccactcccgcattttcgatccacacgctcgcccccgcaagaatcgccacggtccgcgtggcagagcttgatcgcctcaaagccgagaaaacaggcccttccgagcagcaggttaacaaacccatc

SEQ ID NO: 4106 - DNA, 252 bp, Bacillus licheniformis
gggacttcgccaacgattttgatggcgaacgggatgaggctcatacatctatgtacaacatcgtgaacggaaagtacgaaggctatatttcccagctggagagaaaaatttttgcgctcgaagttgaaaagcacagccttgaattggcgggagcggcagctaaagaggcggatcatttgctttctctgggggaaaaagcggttgatcagttgagcgataaaatccgctcaatcaaaaacagttggagctggt

SEQ ID NO: 4107 - DNA, 165 bp, Bacillus licheniformis
  misc_feature (1)...(165): n = A,T,C or G
acaaagccgaaagcggctgctcgagtccgctgcaaacgaatttgcnacccggggattccatgagacaaaagtgagtacgattgtgaaaagagctggactgactcagcttctnttctacctatatttcccaagcaaggacgccatctatgacgagctgatcaatgg

SEQ ID NO: 4108 - DNA, 69 bp, Bacillus licheniformis
ggcgcggcggcggtatagggattgctgccatttgcagcggcggcggccagggagacgccgtgatgatcg

SEQ ID NO: 4109 - DNA, 228 bp, Bacillus licheniformis
atgagatattttttaaagaagcatccccatttcatcaataccatcagatattttcttttcactggggttttcttcgaataccctcatcaaaataaccttcataaagaggatgtcctatgtttacaccccctcgacaaatttcagctccctattgcaatacggcacatttttttcaaattcagtcccatatgtttttacaagtcgccgctcactgcagtcctgctttaa

SEQ ID NO: 4110 - DNA, 228 bp, Bacillus licheniformis
  misc_feature (1)...(228): n = A,T,C or G
atgaagctttccacctttcaagagcttccagaccggctttttctttcagctgtttttccgccgcttggacaccttcttcaatggccgcgcagtatccgaacaaataatagcgcaatgcggcattcangattacnngttttctttcgtattccgtatccgccgattcatctgcggcgagaacggctgttattttttccgcctgctcttcagcagacagcggtttgttga

SEQ ID NO: 4111 - DNA, 153 bp, Bacillus licheniformis
  misc_feature (1)...(153): n = A,T,C or G
tgtagaaggcgacttcaatgaaggcgatgagctcatactgggcggcgagacttacaaaattacagccgttggcgnagccgttcgtcaaaacttggcgaatctcgggcatatacggctaaaatttgacggatcagtttcagccgaactgccggg

SEQ ID NO: 4112 - DNA, 225 bp, Bacillus licheniformis
tatctgacgcactttcaatggaggatgaagaaactttcgctaatcactatgttcagattagtatcttcacaaaagacccgacaaaatattcagaattagaaaaagaggtaaagagccggctcaaacgagctggcttttttcgttcaaacgagcaggacctttatgaaaacgaaactgagctttttcacaaagtcttgcgttatgggacgacactaaatacggaag

SEQ ID NO: 4113 - DNA, 174 bp, Bacillus licheniformis
ttaccatgaccattgcaagaaagattatgactatgattaccacaagaaagaccatgactgcaagaaatactactactactattattactactattatccatgctttaagaagtatgattatgactatgactacaagaagtttgaccactttgatcactgcaaaaagaaaaaaca

SEQ ID NO: 4114 - DNA, 75 bp, Bacillus licheniformis
acgatcagtacgtcaaggatccagaaagcttggatgctgatttaaaagagatgtttgacgaacttggagctcccc

SEQ ID NO: 4115 - DNA, 148 bp, Bacillus licheniformis
atgaaattcaaaatcgaaacacttccaaactaccgcattgcatatatgcgccgagttggtccatacggccccgccaacattgaggtaatggaaagattaaaaaaatgggctaagaaaaaagatcttcttgaatccgccatctgtttgc

SEQ ID NO: 4116 - DNA, 225 bp, Bacillus licheniformis
atggtgggatttgatatgagaatcatcaaaaaagaagtcaattcacagtacggcggactattcaaaaaggtatttattcgaaaaatggttaaggaaaacgaccgcgaattgatccaagaaacaagcacgacctacatcgtgggtatcccggttagatcggtgacggaaacgcgaccgccgagtttgaaagacgcttttaagcaggcgtggggatcggcgaaatga

SEQ ID NO: 4117 - DNA, 225 bp, Bacillus licheniformis
atgatattacagttttgtttcaatgccgacctaagttataggaaaaacgcaaaatcagccaaaaaatttgtactttgggccttatttaagacaaaagaacccgttaattccgttttcccaataggcaaaaagaccttttcaacaaaaaaagaacctttttcacctgaacgtgaagaaaggtcttttcgcctcctgactggcaaggcatgcttactttttctctga

SEQ ID NO: 4118 - DNA, 225 bp, Bacillus licheniformis
atggtttgtggtttaaaaaaatcacaatccaacttcttatacatgtattttaaaaattcaatttttcctttttttatattcataaatctaaaaatattaacgaagatattcaagataaataccaaaaactctttattgaatctgaaaaagctaatgttagaaaatgtgttcaaaatagagaatttgctaaaaagattcttaaccaggctcgttttagaaaattaa

SEQ ID NO: 4119 - DNA, 225 bp, Bacillus licheniformis
atgatatcctactttaagaattccgatcataataatcaaaaaataaatatatgtttctcttatccagagaggtggagggaagtgccctatgaaacccggcaaccatcaacacgtgttgaaatggtgccaattcacgcgaagcgttatgctttgaaagatgagagaaaggcccagacttttccaaagcctttctgctcatgtgtgcagaaaggcttttttcgttga

SEQ ID NO: 4120 - DNA, 225 bp, Bacillus licheniformis
atgttttggacgcacatggcgatggctttaactagaattaaggagggagaaagcgaagaagttcctgcaaatgccatcatcaatgaaatgtatgaaacaccatataaaagtgcaatagaagaagtgatagactttatacattcactggcaggtctagaacttccagaaggtgagctcgtttatttttatcttcatcttcataaagtcatagaatctaataaatag

SEQ ID NO: 4121 - DNA, 225 bp, Bacillus licheniformis
atgatcaaactcaagccggccatgacaaggtgctctttgaacagcagaaggaactggagacatttgaccgctcggccgaacagttcggcaggcagatcgaagcgtttgcggagaatgccgaaaaatggctgggagaggacgggagtctgccaggcatttttaaataatccacagaagccctatgcatcaatccaagccaatcctatcaactgtcatatcgtgtag

SEQ ID NO: 4122 - DNA, 75 bp, Bacillus licheniformis
gcttcggctacggcggaggatttgctttgattgtcgttctgtttattttgttgattattgttggagcggcatgga

SEQ ID NO: 4123 - DNA, 129 bp, Bacillus licheniformis
cttgctgcatcgccatcacggctacaccccttttgactaccagattcaattggctgaacttgaccatgttacgacttcaacggcggccgctcaaagtcttgccgagaattacgtcgggctgccgcttga

SEQ ID NO: 4124 - DNA, 225 bp, Bacillus licheniformis
atgagaaagggcgggaaacctgaccttgccttaccggacttatctgtaaaactgaccaggttttctttcagctggcatggacacaaaaagattcagaaaaattttaggaacgacgctgctacgggggctttacttctcttaattccaacctggagggtgttcccctcaatattggcgcaaaaaaagacggccactggccatagggagaagtctcaccgcctttaa

SEQ ID NO: 4125 - DNA, 225 bp, Bacillus licheniformis
atgacgcaagcaaaactagatagaattttctgttttttaatcgtaaaggctgatggcatcatcattactttagacccaatgctcattatagcagagtattatctttattcatacataaaaatgcgctttcatttcaaatgcgctgcgaaaaatctaatgttgtcaataattatttgcaaactgtcacaaaataatcatcttttattatataataaaatatgctaa

SEQ ID NO: 4126 - DNA, 447 bp, Bacillus licheniformis
ttgtccgtattgacgctcgtctttggttcatcgtccgtaagctttgcgaaggacattcctgaagacaggtatacaacacctacagatgctgaatttagccagattaaagagattttaaacgaggctgatgtcgaaaccggcaatttgcagaaggattacggtgtgatcgtcaatgatcctgctgaaaaggtcggcgtcatatcggacattcctgccgaaaaagatgactggagccatgtcagcttccattcttactatgtcgacctcaacagcggcacactcattgctgatgttcaatttgaattcacgcaaaacgatgacggtacatcagaaaccgagtacaaaaacgtaacaaacggaggcaggtacttcgtcaaaatggatcaagacggaaatgtcattgatgaagcaacaaccggcgacatgtcgattttgtggaaatactag

SEQ ID NO: 4127 - DNA, 225 bp, Bacillus licheniformis
atgaatagtaatgatacggtaaccatgttgaatgaggaatttgagaatgatcagacaggtgaaaaggtcgaaggcattacgattatcgtagatggacaatttaaacaagttttagatatcattaaagccaaaagcgacagttaccagaattacactgaaatcatacgggacgccctttttgaaggtgtaaacagcatgacgatgaagctgagaaataaagaataa

SEQ ID NO: 4128 - DNA, 225 bp, Bacillus licheniformis
atgcaacagttctcggggtgtgtaatgatagagataacgcacattacactgtgcgctgcttctcactgtttgctcaccatgaatgaaaactggcgcgcgatgtggattaatgatatcttacccatgtgcggggagaggcacaccgcatatggggcactcttacactatcttgctctgacaccctatgctctaggcacgcccagactagccgccagcaccctctga

SEQ ID NO: 4129 - DNA, 222 bp, Bacillus licheniformis
atggtattactgacggttcttgttgggatcattaagccagagctttgcccgtctgtgtggtgggagaaatcggtgtggagtcgtgaactactacgttctgttcacgatctggcatgtggccagagttctacggtccctggtccgcctctttgtggatgtgaagccgcggccagtgtggctggcggcccctggagctgggctaatacgtctattgtagggtga

SEQ ID NO: 4130 - DNA, 222 bp, Bacillus licheniformis
atgaacactggtattcacttactctctagtatagagttccttattgaaatgtctttattgcttttgttgtcgaaaatgaaatggaaaccttttatagccataacagaaagagactatgcaacaaaaaaggctaacaaaatgaggttgcaagctgcagcctttttagttgaaaaaagtcagtacaaatggaaagaaatcatccaactcgctgctgtactttaa

SEQ ID NO: 4131 - DNA, 126 bp, Bacillus licheniformis
tttaatgatatccgttttgtccgttggcgcttccgctcgttttgttcttcggactttgctttgaattttgtttattatggctgccgccttttttcgtgtgtttccccatgatgatccctccgcttt

SEQ ID NO: 4132 - DNA, 222 bp, Bacillus licheniformis
atgtcgattccgtctgtcggggggtggatcaaacggcagttaaaagggctagaaaaaatgggaccgaagcgagataaggtatctgtcatcggaggggctgtcacgggtgctataggcgcgggaagcccggatcagagcgtattgccggacgttgtggttgtggacattcggcaggaggataatccacgcccaggcgaaagcgagttgatatgcgcgaagtga

SEQ ID NO: 4133 - DNA, 222 bp, Bacillus licheniformis
atgactccaatgaaaatacaagtaccgacgagaaaatataataaagcacctaagaaccaatacatcttcattcctctttttctttacgcttgttcttggattgacgatttttgtatctatgcttgtctgttttttcgttcgcattgcttaatcgatcagggcactgattttttgacactttctcagttcggattccttttctttttaatgataaaattgtga

SEQ ID NO: 4134 - DNA, 101 bp, Bacillus licheniformis
aggggggaagacgtgtgggggtaatcaaaaggtacatggaatttgtgaagccgtataaatggaaaatcgttttgacggtttaaatcggtattataaaattt

SEQ ID NO: 4135 - DNA, 246 bp, Bacillus licheniformis
ccgtcagactttcgtccattgcggaagattccctactgctgcctcccgtaggagtctgggccgtgtctcagtcccagtgtggccgatcaccctctcaggtcggctacgcatcgttgccttggtgagccgttacctcaccaactagctaatgcgccgcgggtccatctgcaagtggtagctaaaagccaccttttatgattgaaccatgcggttcaatcaagcatccggtattagccccggtttccc

SEQ ID NO: 4136 - DNA, 130 bp, Bacillus licheniformis
atgagaaaaccttagttctggggagtgattcatatattaacgggtgtgctgtatacggatctcgcggaaaccttccccagaagcatgaggtcttttgatacgatcctcctgatgcttttcgcagcctata

SEQ ID NO: 4137 - DNA, 222 bp, Bacillus licheniformis
atgaagggattcggaggtggaatgatgtccaaaaaagtgcagattaaagtgatggacaacggcggtttccgggtcacgggagacgtcgaactgatcgacatggaaggaaatcctttccctgaaaaaccggctttttcgctgtgcagatgcggaaaatcgctgaaaatgccttactgtgacggaagccataaaggaatgttcgactcttgtgtcagagcttga

SEQ ID NO: 4138 - DNA, 76 bp, Bacillus licheniformis
atgagaaatttagtcttgctcggtggcggatacgggaatatgcgcatcattcatcgtttgctgcctaatcacctgc

SEQ ID NO: 4139 - DNA, 222 bp, Bacillus licheniformis
  misc_feature (1)...(222): n = A,T,C or G
atgaagatggaggttanagctgtgatgagaggaacctttcttcgaggttttcattctgatcaggccgcccgaatgcatttgtctcattccccgttttgttcaattccggttttcttacatatgcacggcacatatccgcatgatgtttcatttttttcatccttttgtagtgtatcttgtttaacctttcgaaaacaagacatttttcgagaaaaggcgtaa

SEQ ID NO: 4140 - DNA, 222 bp, Bacillus licheniformis
atggcgaaattcgtcatattgtttttcattatttttggaggaacgcctttttttaaatttatagacgcggacgagaacttgccattgagccaaaaattaacggcttttctgagcggaatgtcaaatgcgggtacattcatccttttggttggtgtactgctcgtgatgatctccgtttcatacgcgatatcgctcagcttttataataaaagagaattttaa

SEQ ID NO: 4141 - DNA, 219 bp, Bacillus licheniformis
atgaaaataacggtaagaccgcgactgtcggaagtaatgaacgcgaaagggtggaggcaaattccgttgtctgaagcgtcaggagttccgcaaggcagcataagccggttcgataagaacgaaaggcatctcgattggcacgtttttgcccttgcgcgaacactcggcgtaggtgtcgaggagttattcgaggtgaagatcgaagacgctgacgaatag

SEQ ID NO: 4142 - DNA, 219 bp, Bacillus licheniformis
atggaaacagatgggcagtcaggcgatcgtgatcgccgcctaaaaaggcagattaatccctgcctttttttagttctttcagcccttattaaattaagccgctttacccttttgataaatccaaaatacagaaaacaaccctttctgcacatgtttaatttactgttttttcataatattcaaaatactcgtttacattcagcaagctcgcatatatga

SEQ ID NO: 4143 - DNA, 219 bp, Bacillus licheniformis
atgcttgacggtttaaaacctgggctgctcaacccgctgttggaaaaattcttgacggaatcaatatggcaaatgttgtcaatacccctggacaggacatatagggccggcataaacaattgcttgaaaggcttggacaagaaaccatgtcgaaatgtggaatggttatggcggaagatggcgatgaaaatggggggccgaataaaaaagcggccttaa

SEQ ID NO: 4144 - DNA, 219 bp, Bacillus licheniformis
atggtatcaaaaggattaaggccaaaagctccgccccctttcaggagaaaggcaatcgaaaccgatacagaagaaagtgtatggggctgctggcatcagcgttggtcagcaatgcctctaaaacgccttaatcaatccggtctggtaccccttaagagagtgaagctggaaaaagtgaaacaacctatgtacagggcaaaaggtaaggctgctccttaa

SEQ ID NO: 4145 - DNA, 219 bp, Bacillus licheniformis
atgcctatcaccgcacatctcgaggcaaacatgccttgtcaacgacttcgacatgctcccggccccctaaacctccacggtgcgagaaccggagagaagacagtatggttaatgacaaatctcaaatggcttttctggcaactatctatgcaagcgagaccaacctgtcctgtgcgagctgggtgcccggatcgttttaaaggctcgtctggatgctga

SEQ ID NO: 4146 - DNA, 219 bp, Bacillus licheniformis
atggtatgtaactttttaaaacctgttttgcttcagtcaaaacctgaacacctaactttcatttacccgcatttatctcaagtgatttcattcatggattcattatataattttttatacaaaaatgaaacaaaaatatatttttttatacacagaattgatcattcattaccttcagtttgtatctttttattttgtcatcaaacaggaactatttag

SEQ ID NO: 4147 - DNA, 220 bp, Bacillus licheniformis
atgatgtccgcccacgcctcctatcttacacactcctcgccccctgcggtcgtccttgcacaaatgacccccccgttcgcgtcatccccccattcactcccctttcaacgtgccgccctggacttcctcctgccacgcatttcccactacactgtgcacattcgtccctccacatctatcccttccctatctcctcctctatcctccccttctcgctcct

SEQ ID NO: 4148 - DNA, 219 bp, Bacillus licheniformis
atgatagttccaatccctacacgcacgcataaattctccccaacgacaatccaagggcgggccactaaggcagctcaccgatatcaatctcctcaatggttcaaggcccacaatcgtaatgtccccatacgtacctcaatctattatttatcatggtttaatccatcctcatatatcaagtgcatgtggaaatgcaaaagaatggttaaaacagtataa

SEQ ID NO: 4149 - DNA, 219 bp, Bacillus licheniformis
atgccgcggagcttcaattcttgctcatccattaagcggatcatatcgtatttctggcgaatggctttcaaccgtttatccgttacacgagtgagcgcctcctcgatattcaaaatatcatcaatagcccgcatctcggtttcttcaatttcagtcacaacaagacgctcattcataaccggaacaggtttgactagtccattcttatccggggtttga

SEQ ID NO: 4150 - DNA, 219 bp, Bacillus licheniformis
atgcgtttttggtatacttcggatgggcagtatcctctgggaactgcacctggaaagcatgcaacttataaaaaaacagtctgccttgatccaaaaagactgggacagagggatgattcttgccgaacacggacgataccgaaatccttctccttgccggaaggtttttttgctgtccgaaaagatgcagatgcaagcacggcagctcatctcctctga

SEQ ID NO: 4151 - DNA, 218 bp, Bacillus licheniformis
atggcgacgttttgtccattggacaatgcttcaagaattggccacaatgctggattgatacggcggtctccttgtaggcatatcggtcggtatcagcgaacagcaaggtgcatcagacaatgccatggtgcatcaggcaatgccatgctgcatcaggcaatgccatgctgcatcaggcgatgccatgctgcatcaggcatgcgatgtgcatcgcgacg

SEQ ID NO: 4152 - DNA, 163 bp, Bacillus licheniformis
atgcaagatattgtgaactttttggtcgaaaatcctgaagtattaaaaaaagttgttgatggggatgcttgtttattaggcattgatccagaaaaaacaggagtagtggttgacagtattagattattaggtaagagttggggtggaggaggattttggattt

SEQ ID NO: 4153 - DNA, 216 bp, Bacillus licheniformis
atggcccatcagcttggatctgagaattttttcgcccaggttcgctcccccaaaactatgatacatccaataatagtacagggctataaacctctgcgccaagcgcaagaaataaaccgatatagccgagcatgccggccttggaaaaagtgcccgcctgcatatcgtcaatcgcgttgccaagcagcttcggcggaaactttccaatacgtttag

SEQ ID NO: 4154 - DNA, 215 bp, Bacillus licheniformis
atgaatgaaaaatccgccggatatcacgaacggcttcccgtcgcccaaactcaatccccgctcgtaaacgataagataaagtattggcgttcccttttcggcgatgatgataaatggctcaataaagcagtttcattattaagccatgaccctttgtcctccatcgcacaatcctcggtatcccagtcagtcgggctgaaagacagccgtcgcgg

SEQ ID NO: 4155 - DNA, 216 bp, Bacillus licheniformis
atgaaagacaagcagaaatggggaatttccgggcttcatgctgatgattttcaaatttctgaagcgagcatccatgtgtttcatgccgcttacaagatggaaaataccggtcagcccggaacgattgcgtttcggatacgcaatgatcccgataaaggcgttatgattgatttcattggatacataaaggaagcgaaaaagcaggaaaacaggtga

SEQ ID NO: 4156 - DNA, 216 bp, Bacillus licheniformis
atgccgcaatgcgagaataaatacatttcaaagcatctcacatcgggatgctttctcttatctcagtttcccgaattattgtttcaagaagatagacgagatatgaaaaaacacaaagccaaacgttgccgatgcagaaaacacccatcaagaaaaggggctcaatataaaaacgaaaaaaattttctatataaaaaaataaacgaagctattgaa

SEQ ID NO: 4157 - DNA, 216 bp, Bacillus licheniformis
atgccggtcttcaagccgcgacaggagattatgtcgggtttgtcgacggtgatgattttgtattgcctgccatgtttgaaaacatgtacgccgctgccaaaaaagacgacctcgatatcgtcatgtgcgggtatcataaacattccgatacggaagacgcatagttcccgccgccgctaccgactgatcgcttgggttgagcggggtcatgattag

SEQ ID NO: 4158 - DNA, 216 bp, Bacillus licheniformis
atgaattatacgagtattttcggtgactatgaaaattactctgaacattttcttccgtttgattatgtagatattcatgacgagattgaaggagacctcacaatgtgtgctttaaatcggttggtcaatggaaaaacaaataatttttatgaaaaggtttttgagttatataaagaaggcggatggcccttgcggttggaagggaacatatcctaa

SEQ ID NO: 4159 - DNA, 216 bp, Bacillus licheniformis
atgaacgtgtatctgaacaggcatcttctgattccgccaggatcaacggcaaataccgaagggccggagtcttgcggaaattggctcggcggcggggggagcagctgctgttgctgctgtcctcctgctcccggaggcggccccggcggaaattgctggcgatacggatcatatagtgaaggatcgtatggatacaataaaaacgctcctttctga

SEQ ID NO: 4160 - DNA, 342 bp, Bacillus licheniformis
aacacgtgactcagacgccagaaaagggcctacaacatcgtcaaggacgccgttgctggctttcatatatatgctgcggcccgctgacgagcattagaaagatctaatctgaagtgacaagtggcctgtccctggaggactgttaccatacccgacgtctccatcttgaagataacctcttacctgatcctgatcggaccctgcccatataccggatacactgtacgactttctaccttaaagaagcaaggctgtggcgcataactgcacgctgtaagtatcatataatcggagtgcgtctgatgtgcgtcgaatcatggagctgtggagaacgtaaccccg

SEQ ID NO: 4161 - DNA, 119 bp, Bacillus licheniformis
atgaaaaaattaattctttgcttgtcgttaactgctatggtcttaggcggagctgctttatcccaaagccacaatcaggcgtcaggcggcgttcaaacagcggagctgccggttggggg

SEQ ID NO: 4162 - DNA, 105 bp, Bacillus licheniformis
attggtcgtggtggcgcttttgatattcggcccgaaaaaacttcccgagctgggaagagcggcgggaaacacgctgcggggagtttaaaaatgcgacaaaaggtt

SEQ ID NO: 4163 - DNA, 216 bp, Bacillus licheniformis
atgaacacctcttttcaatttttacgggtcaaattgcggtttttgcggtgtaaggcgaagggatggttttttataagggccgaaatgcgtgtcggtctattgcgtgtttttcggtggcgcatacccgatctgcgttccgtgaacactcaagtttttctattccccgctagttactactttagactcaaggttgcaaaacgaacaaaacacaactga

SEQ ID NO: 4164 - DNA, 216 bp, Bacillus licheniformis
atgatttcagcattctgtaaatacattttgaatgtattagtgactacatgttttagtggaaaactgttgggcgattgttgtctaaccctaccaacaatcatcattttcattcagaagtcatcagatgtaccattcaatagcgcttttttgaccacatatttaagcgtgatcaccaaaatcaccacaaatttttcaaaacacgttaaaaaagtatga

SEQ ID NO: 4165 - DNA, 216 bp, Bacillus licheniformis
atgagcgctcagaaaatattcggctatcaaaaaatcatccgggacatttccttgttgatctacgatgcttatggattattcgaggcgctgttcatcaagagcggcttattccagaaagtgcagagattctggagcatttctttaaatgctgatttcaaatttcatgatgaacagccagaaaggagacgaagaacgtctctatttaacagagcttga

SEQ ID NO: 4166 - DNA, 216 bp, Bacillus licheniformis
atgctaatttccattgattcctcaacaggagttatctctgtcagttcttgcaataactcttcattcgaacagctaatgaagttatggtcaaaactgtttgttttactctgctcgcaggaacccttgtctatacctgtcaaagaaattgccgctccaaccaaagtgcctgccgaaacgttatttgttatagtccccttgtacttctttgtatgctga

SEQ ID NO: 4167 - DNA, 216 bp, Bacillus licheniformis
atgaacactcattcattttgtccatcatcttaccgcgttattcgcaatcggacgttaaaagcccaaaaaaaacgatattccgccgcccagcaggtttggcatggcgaaaatggcgagagcgtttgccagcttgctgttccactccccgtgctctttcgtttctgcatcgtgatttcccctgaaccggtcaccgctgacaaatacgcccgaacataa

SEQ ID NO: 4168 - DNA, 180 bp, Bacillus licheniformis
ttcaccctggacatgggtagatcacctggtttcgggtctacgaccacgtactcatgcgccctattcagactcgctttcgctgcggctccgtcttttcaaacttaaccttgcacgggatcgtaactcgccggttcattctacaaaaggcacgccatcacccgttaacgggctctgactact

SEQ ID NO: 4169 - DNA, 216 bp, Bacillus licheniformis
atgcgagctgttggttacgttcgagtaagtaccgataaacaattagacaatacttctattggaaaacaaagagaggaaattgaaaaatactgcaaaaataatgatatttccctcgttcacatctttgatgagggggcgaaatcggctgaatcatttaaaaatcgtactgaatttaaagagttgtactcatttgttttagataaaaaaacaaaatag

SEQ ID NO: 4170 - DNA, 214 bp, Bacillus licheniformis
atggtgtgccgtgcgcgagcgattgactcgctcacggtcactataacgtcctcttctttgtacttctacagatattacctctctatatttttcttggggatatatttttttatttttttgggttcacaaagcacccccagacttgcgtacttcacttcttttactactccacacctctctctcctaatactattacctcgcgaccttcttacat

SEQ ID NO: 4171 - DNA, 156 bp, Bacillus licheniformis
ggagaaaagaaagtgccggaggaccggaagtgataaaaatggggcagaaaaggtgcagaaggagagagaagaaaaaagagaagaagagcataaaacagaagatgaagaaagagagtaaaagaaaaaagaggatcagaaagagaaaaagtaagaaaa

SEQ ID NO: 4172 - DNA, 213 bp, Bacillus licheniformis
atggtgaagctccaacaagaaattggttcaaaggagcaggcgcaagatattataaacaataagagagcaaagtatgaagggaaaactatgcaaggacatcacagttatagcgcttctaaattccctcatttaagtgacaaaggtgaagttatatatccagcaacaacaagtgaacatttacacagatggcacggagggaaattacaaaaatag

SEQ ID NO: 4173 - DNA, 426 bp, Bacillus licheniformis
ttgtcgtggaaccaatccggccatggtgcgccatatttaaacgcctcaactacaaccggctttttcttgtatttcgccacccttacgtccctcccttcgaattcacacgaaattagcgcttctaaccgtcaccctaccgaataccctcggagaatactaaaacgtctaatttcgtgtgatttgtgcgtgaaaatcgttacgctcttccgctttgtagtagtcaataactccgcaaatgtacgcatcaacaccgttataggatttgttagtggtccgttcttcgaaatcagcgagagcatcttcgtaattgtcgtagatcgcttggcctgcgtcgcaatagtcgctgaagactgcgtatttcatacgagaacacctccgtttatatcgccgcaatatgtactaaaaggacgccaagtgtgcggctag

SEQ ID NO: 4174 - DNA, 212 bp, Bacillus licheniformis
  misc_feature (1)...(212): n = A,T,C or G
atgaatcaattaatgaactctgaaatcaaaatgacaagtttagatntagcagaattaacaggcaaagaacacaaacacattatgcgcgacattcgagaagaaattaataaattaggaaaagaattaggtgagtccatttttggactgtcctcttataaactctacagaacaaagaattaccttgttacacattcggcagaaaaagtgccatg

SEQ ID NO: 4175 - DNA, 213 bp, Bacillus licheniformis
atgtccatgaaaagaaatgaatatgagcgaatgacggcaaggggagagaccggcagagggaaacctaaaagcggcgccgaaggagcaagctggggaaacagtgaatctctcaggcaaaagaactcttgcttgacgcaactctggagagagtttgtatcatattatgttttgcaaaccaccaaaggggacatctttgcttttgatgcaaagtaa

SEQ ID NO: 4176 - DNA, 213 bp, Bacillus licheniformis
atggtggatagccccacagtttatttgaggaatagaaaaaaccctccaaaaatccaactgcaagctctttcttattggaggtacggaacgttgtttcgggaaattgtggggggaagtttgtcacaataccgggcagcgcgggcattttataacgggggcaattcatcgcgggagcgggcggtgccaaggggaattttcagggcgagcgcatga

SEQ ID NO: 4177 - DNA, 213 bp, Bacillus licheniformis
atgaagacagaccgacatgcacaagacctcatacataaagcggaaaaactcggtgtgaaagtttatccggtatccgatttctggattaagcctcatgaaagcagctcttcaatcgtcatggcgggatttgggggtcttactgcagcggaaattgaagaagggatcagcagactgcgtaaagcttggctctcctcctcaaagcaggaacagtga

SEQ ID NO: 4178 - DNA, 213 bp, Bacillus licheniformis
  misc_feature (1)...(213): n = A,T,C or G
atgcagnaagccaaagagcttgagagggtgctctctgatttggttacaaacgatttcagcgttcttttgatcaatcatacaaatgtatccggtattgttgaaaatcactggccgctgaagaacgtatgcgctgttgaacttcctgatcaagaaatttggcaatcaaacgacccgtattggagagaaatgttccaaggcataacaattcgttag

SEQ ID NO: 4179 - DNA, 213 bp, Bacillus licheniformis
atgattcagcggatacaaaccatgaatgtaacttactcacagcttatcctaaggataaacacatattacccacaggatatatccacatatccacatacttattcaatatttagtataagaacgtatattccctacaatatctatacacaagtttattcacttatacacagtaaattgtgcataaatctagagaaattcactccaatacattga

SEQ ID NO: 4180 - DNA, 213 bp, Bacillus licheniformis
atggaaaaatattctcctgtagaaaaagctcatttgaccttttttggagagcaaagcgagattattgaccttcttcatggcgacatttcattgcagcatctcgtacagcgcggcactgttaaagtaaaaggctcttttagagctttattgaagcttgaagcgattttatggctgacggacggcttctttaaaaacagcgatctttattcatag

SEQ ID NO: 4181 - DNA, 102 bp, Bacillus licheniformis
atatcaaaaacgctcggctgttgtttccgctttaagagtcaaagcggatgagtcgcaaagcgatctgaaacgttatttaaaaaagcaggaaaaacaggggga

SEQ ID NO: 4182 - DNA, 204 bp, Bacillus licheniformis
cgtagctggatttatcagaaataagtatggatttttaatagattctcattctgaacctgttcataaagaagtatggaaactagccgagtatattattaaaaaagctcctgtcaagggggtcatattagaaagagatttaaattatcaaaattatcatgatgtgaaaaatgatataaaaattattaaatcactagtatataaata

SEQ ID NO: 4183 - DNA, 213 bp, Bacillus licheniformis
  misc_feature (1)...(213): n = A,T,C or G
atgctattttggaagccggtctatgctctcttcaatgggttccctctttaccggagaagtgctctccgaaaaaaccccctcctctgctacaagtgtcccgtcgatattgtctctccnaccgccgacttcgtgttctgtgttctgaccnactacacctgtcatagccccctctgcgcaattctctcgcctctctcacgattgcccctgtgctaa

SEQ ID NO: 4184 - DNA, 213 bp, Bacillus licheniformis
atgacatacgcagcacctcaggttgactattctgtcaatccgtcgatcgaagatcaggcttggttcttggtgtttgttgcagtgcttttggcacttggagcaactgttgttcttggcgccgctgtatggtgtgtggctaacggaaacggcagcttcacgggatccgtcaaatgggtcagcggtttgcaggtcagcatcgaatgtaggaaatag

SEQ ID NO: 4185 - DNA, 213 bp, Bacillus licheniformis
  misc_feature (1)...(213): n = A,T,C or G
atggcggtcggatggatctggatgaatcttggttcgcatagtttgcacccgcctgtggacaatcaaacggcgatctgtgttgatatccatttctcgatatcgacaataataccggcccngtgcgcgatnatgaatcttaagggaagaatcctatatcctcttcctctattttttgggggaggaaaacccccggctcttgtctctctcttctaa

SEQ ID NO: 4186 - DNA, 210 bp, Bacillus licheniformis
atggccgccgaagctgaggacgcccaggaaacgatcgagcgcgaatatattgtcgaagataaagactacgcggtatcagcggacgacggcggcttctctttcgatccacaagccacagacgcaaagccaggcgatcggatcatcgtgacttttacgaaggatcagtacgaaaatggcagcggatttaaggcgattaaggttatcgaataa

SEQ ID NO: 4187 - DNA, 210 bp, Bacillus licheniformis
atgaagtcaatccaatcaatcaccgttcattcaaagcaatatatcgtcggtgagcgatgccatccgccaggatttagagacgaagcgaccgtaatgaaaattacagaaaaaaacaagttctatggattaatcagaggctttgttgttcattttgatacaaaaaaagagctgcatattcatacagagcccgtcaatgttcattggaggtga

SEQ ID NO: 4188 - DNA, 210 bp, Bacillus licheniformis
atgaaacacctcatcacatgtacatcagaagaactagcgcttttagtagggttatgtgactatcctggtgttgcaaaaggaattcttgaatcatcgttaggaaaaaaatcaaaaaaagaatgggatgcaatcttagaggcaactgtcaaccagctcattttaaaacaatactgggacgaagaaaaaagttcaaaagacgaaaatccttaa

SEQ ID NO: 4189 - DNA, 210 bp, Bacillus licheniformis
atgattcctgttgtttgttttggccggccggttgtctttgctgaaagaatagaacaaatacacggccattgtcaaaatcaagataaacatcatcataaatatcccctccaaattttttgtcttcactatataagacgaacaagcccggaaaaggtttcagaaaatttatatttttctacaaatatttccgattgccgactttctgtatga

SEQ ID NO: 4190 - DNA, 210 bp, Bacillus licheniformis
atgccgatgcgtcttcgtctgaaagaactgctcgaggagcacggatatgaacaaaaagaaatcgcagaggaattggagttatcaactcgcgctgtgagtgaattatgttcggggaaaaccaaaaggtacccaaaagaaacgcttgaaaaaataattgataagtttaatatcacagatatgaatgaattgtttgaggttcacgaggattaa

SEQ ID NO: 4191 - DNA, 210 bp, Bacillus licheniformis
atgtataaggaaggcactctttgcaataccgttcaaatacatgctcttcttttgcgtttttgctgtaatcgcttagaaacaggaagaattcgcttagtacatcgcgtatttcccggtacggtttatccagtctgcagaagccggccgccagctgctcaaggtgttcataccattttttcaggcgcttccagtcctttttggcggtcatga

SEQ ID NO: 4192 - DNA, 210 bp, Bacillus licheniformis
atggtgagggagtcgacagtcaaaagccttcttacatatttggagcttgacaagcagacaatcgccatcgccacctatgaaattgaacaaatattggatgtcgtcttaaatggccgaattgaagcaaaaaaggatgtcgaacagctgcgcgaggaatccggaatgtcgcttttggaatggctgaaacggtttattaaagaaaaaaattga

SEQ ID NO: 4193 - DNA, 171 bp, Bacillus licheniformis
tcagaaacgatttctccccatctgtgcaattgtcttcggcatctcgatttctctgttgttacccgcagggaactggaagaaagacatgatgatcggaacttggcttggattgtcatcagttggattttactccggttcaaaaaacgtcttgaaaccattatcaaaggagga

SEQ ID NO: 4194 - DNA, 81 bp, Bacillus licheniformis
ggcactggaccggctttattgtcgttctgctcttgacggttgtgcttggactccggcttccgctgggctttaaagtgtttt

SEQ ID NO: 4195 - DNA, 249 bp, Bacillus licheniformis
cccagaatctacggtacgacagtacgacagattctattacagttgaatgggatcccgtagatggggcgacttcatacaacgtttacagaggcgcagacaagaaattcgctgaaaacgtgacgcaacctaagtatgtaacaaccggcatgagtccggatactaaactcacaattaacgtaacggctgctaatgagtccggcgagtctcctatgagcgaaattgtgacacaaacgaagatgaaaatagaaa

SEQ ID NO: 4196 - DNA, 207 bp, Bacillus licheniformis
atgctccgtttcaaaaggattaaagcttctttcacctactcttgccgtcacccttgctgtcttcaaaggatttatagtccgcaaagcatatttagtattgagaaacgtataatcgttggtatatcaaagtttataggatgtttatgttcggagtctaaaaatattttattcatatatcataatgtcttcacaacaaggggtgtttga

SEQ ID NO: 4197 - DNA, 207 bp, Bacillus licheniformis
  misc_feature (1)...(207): n = A,T,C or G
atgatgcgggtcatgatgaagaggtgtggcatttgctcaattgtaaagcagggcaagggtttgtactcanaatcaggcaagttacagcataaaagtttactagtaaacaatagtcatttagtccctatcttttccagctgtcaacacaattcaaattcaaaatatgaaaatattcgtaactttttttgtgaatctgaggaattgtaa

SEQ ID NO: 4198 - DNA, 207 bp, Bacillus licheniformis
atgcaccacctgtcactctgcccccgaaggggaagccctatctctagggttgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgtttgctgcagcactaa

SEQ ID NO: 4199 - DNA, 207 bp, Bacillus licheniformis
  misc_feature (1)...(207): n = A,T,C or G
atggccaatggtctgtgtgaaaggccttggcagaactgccttcaaaaaaaaacaccattataccaatcagnaggnctgctttggaatgccgcggcaaaaacggaaagccgggggcccggaagtttccaaatcgagtttttgaatcagcttgctgccgttgaagctatggatataaaagaacgcggcaggatcagagaggtggaataa

SEQ ID NO: 4200 - DNA, 414 bp, Bacillus licheniformis
ttgtcggaggcgctcacgcacggatttccgtgctgcaattcccacaaacccgcccatttcttggtcagcttccccaaaagcaaaacccaaactagggtaactccaaaataccccgtcccacaaccccgctcaataaatttttcgccatccctcaaaaggtttttccatttgccacctttccttccaaaaaccccctcacttgcccaaaaaaaccggcatcggccccatggcaatcccaattcgcaaaacggttggttttccgcccttttccatcccaaccgttcccattcaaagattccttcccctttttcggaggattcccggtggtttcaccacaaaggcccaaaatcgttgatggtcattccaaggtcaactccaatttcataccttcgacaaaagggtaacacgttttaa

SEQ ID NO: 4201 - DNA, 207 bp, Bacillus licheniformis
atgaaacattgctgctcagtatacattcatcgcgtttcggcaggaggggtcgtcaacttcggcggtgcgtacaaaatttgtccgatcacaatggaaaaagtggtcgagggatctggaggcccggatgtcgcgacagctgctgccggctttcttgatggagcgcttgcgccggccgttgaggaagggacagtcaccgaagacagctga

SEQ ID NO: 4202 - DNA, 207 bp, Bacillus licheniformis
atgtatattaaagctgtacattattcccttctcgtttggaccggctttctagccggtttttttaacataaaaagagctgcctttatgacagccctttcctttaatcgcccaaaagcaaatcttcgtgcacgatctgtccgatcacccggtccgcttgatccggcagcccgtcgagacagccgtattcataatcccataagttcatga

SEQ ID NO: 4203 - DNA, 92 bp, Bacillus licheniformis
aattttgtggcacggcttcacgattgttccgcaaacaaggctaccatgccacaggcttaagccaaatcacagccgaaagcggagcgccgcgg

SEQ ID NO: 4204 - DNA, 93 bp, Bacillus licheniformis
cggccgtgcttggatttttgctgggggttttgattacgcttttaaaaatcagttcgatcaagcccctcgcatggattgcagacttttacactt

SEQ ID NO: 4205 - DNA, 107 bp, Bacillus licheniformis
gtggcagatctatttacaacagtgcagggaaaagtagcaggaaaaggagttaaaatcgtatttccggaaggtttggacgagcgtattcttacagctgtcaacaaatt

SEQ ID NO: 4206 - DNA, 108 bp, Bacillus licheniformis
aggcgttggtctcgttaactgtgcaagagtgggcatcatcgatgaagcagcgcttttggaagctctggggagcggacatgtcgctggcccttcattggatgtattcga

SEQ ID NO: 4207 - DNA, 204 bp, Bacillus licheniformis
atggcagccactcgacttccacatctttgccttcgatcggtttttcgagctggtcttttcccagtcatcagaatggacagacactatcggacatacactttaatatttattgtcagtttttcttctttcttgtcacccaatcaactatatgtaacaataatagttacaattatgtcatctgtcaaacttttagtatggagttaa

SEQ ID NO: 4208 - DNA, 204 bp, Bacillus licheniformis
  misc_feature (1)...(204): n = A,T,C or G
atggaagtaagtgcgggcttgcccgcggcatctgaaacgncgggcatgaacagcgagccgattaacaaaccgcttaaaatggtggaaaacgcctttttctcagctttcttttcaaatgaacatccccccttttttatgaaattagctgaattttcctgtccccccctccttgtggacgccttgtctgactttgatgtaacttaa

SEQ ID NO: 4209 - DNA, 204 bp, Bacillus licheniformis
atgtcaacaggatccgatgttattgtcgtcaagctgggcgcttggactcttcagcagcacagctctcaattctatcaaccctcagagcatttcagcgggcgcagctataatttcgtcgtcggatttacggcgaacagtaatttgacgcgggcggcatcgcatacgtatacaacagcaagccgaacggcagcgccttcagcgtaa

SEQ ID NO: 4210 - DNA, 171 bp, Bacillus licheniformis
taaaattgaaaggctgctgggaagaccttgtgccgaagatgcgctgcgatgcatcgtccattataaccaacaatcccgaaagcggcaaaagccggcgggatttcacagcggaaagaaaaaggtaccgtgagcgatacggataccctccgatagaccgacaatgccttggta

SEQ ID NO: 4211 - DNA, 129 bp, Bacillus licheniformis
ggaggctgaatccgtcaaaggggaggcttaatccgtcaaaggggaggcttaatccgtcaaaggggaggctgaatccgtcaaaggggaggctgaatccgtcaaaggggaggctgaatccgtcaaagggga

SEQ ID NO: 4212 - DNA, 203 bp, Bacillus licheniformis
atgaggcctctccccgtttttaaaaaaaaagaccgctttcacaagcggttttttttttatgggaaaaaagtggtgccggcaaatttttgggttttgaaaaagggggaaacccccgcgaggggtaacaacggaaccacccaccccccccaaaaaaaagcaccccccgcgggagggaaagaccccattttgggggggtgtgtgaa

SEQ ID NO: 4213 - DNA, 204 bp, Bacillus licheniformis
atgaaatacaagacagaaaaggagctgatcgagttgcttcgcaagctattgaaggcacttcaaaacggcaaaaaccgacgatacagcagcagcgattacggacggaaatcatacaaaaagtacagcagcagcgattataaaagaaaagggtacggtcatcgccattacaaaagaaagcacaagaaatttttcggcagcagctaa

SEQ ID NO: 4214 - DNA, 204 bp, Bacillus licheniformis
atgaccgggtgtatgtttcagcaatacacccggtcatctaattgtgtatttttatacgagaaatttcgttatttatcaagacctaaatcaaaaaaagtcataaaaaataaggagttatatatattttacatgactaatatgtataactcctttagttcttgttcaataatcgcgcccgattgtggaagatcgttattcaactaa

SEQ ID NO: 4215 - DNA, 204 bp, Bacillus licheniformis
  misc_feature (1)...(204): n = A,T,C or G
atgaccttagatctttggagagggccnctaccttttaaanaattatacgcacaagggaaaccctcttctttttgtacgcctttttaccttttcgacctgcggaaattccaatgccacaaccggatattgtccctcttttttaaggaggccccggtttcttccccggttttaaatccatatatccggttcataactgtactataa

SEQ ID NO: 4216 - DNA, 204 bp, Bacillus licheniformis
atgcaatgttaccgttctgacacgctgctgcacggaccactgcccggttatacagtcatcttcctcattactaccattttcccgtactctctcccccacttcctccctctcgctccaccctctcctgttctaccgcgcccgtcccctcacctcctccgattggtgtcccatcgactcgtttccctctccaacctactccaatga

SEQ ID NO: 4217 - DNA, 205 bp, Bacillus licheniformis
atgaatgtttgtcctttcatgatgacaaacaccaatgacgccacaaagatgatgagagtgattccctgtaagatgagcgtttttgcacttcgttttttcaagtcgtcccatacgttcaccagcacgaatacgagggtttttgttgagatgatgtcattcgctgtgccggttatcttgagcccaaacctgggaaaaagatttaaac

SEQ ID NO: 4218 - DNA, 104 bp, Bacillus licheniformis
ttgaacgtgctgcttgtcgatgatgaaaaccggatgctcgatctgctggagctttatttagagcattattcgtgcacaaaagccgccaccggaaaagaagccct

SEQ ID NO: 4219 - DNA, 201 bp, Bacillus licheniformis
atgagactatcctctgtttctaaagcaaatcgatcagcttctcctcctattctttatatatttgcaaagtattcgacatcatctcaccaacagctttccatttcaatagatgtggcgagaaagaaaaaaaggcagatttcaggtctttctcaacttttgggggatgacacctactgtaagctgcatcatataacaggttaa

SEQ ID NO: 4220 - DNA, 201 bp, Bacillus licheniformis
atgacgctttatataaaacgcttgtggtcggacacaccgccgctgaagccgcagcagaccgaccagcttctcgatctataccaacgccctgttgcgacgtttaaagacgccggcaaagcgtatcagatcggcttcaatacggcgcttacgtgtctcggctatttaatcgcaaacaaatacggaggtaatgacgatgaataa

SEQ ID NO: 4221 - DNA, 201 bp, Bacillus licheniformis
atgcgacagagagatgcagatcagaagaaccggacgacaaacgacagcgcgcagttgacttacgacggtatcgaatgccatcaggcccggaagacgatctatgcgtggaagaccaccgtacataccctgtggcacccgacagtttttttcggattccgtgttttaaagatgggaaccgagttataccttgacgacaattat

SEQ ID NO: 4222 - DNA, 201 bp, Bacillus licheniformis
  misc_feature (1)...(201): n = A,T,C or G
atgggagagaagnggagaaggtctcttcttctctccgtaataagaaggccctccacaccaggagggggaaatatggaggggcaccgattccccgagaaaaagagaagtaaagattgtttcttctcgccgaggagagaggtgagaaagttattaaaagaggggagaatggagtctcaagcatttacattgaagcgaagttaa

SEQ ID NO: 4223 - DNA, 201 bp, Bacillus licheniformis
atgctgctttcagtaatggtgctttgtcggattcgctgtcattcacgtaatcaaaccatacgagatcgtatttttgaatggattggtcatctgcgacctcctgtgaacggtctgaagcggatgatgaacatcctgataagggaacggctaaaagcatcgcagccgcggataaagagatcagtttcgattttttcactgtga

SEQ ID NO: 4224 - DNA, 201 bp, Bacillus licheniformis
atgagaagacagagcagaagaccaaacagaacgattatactgaaagcggcgttttccgcctcccgaaaggcaaagcgatcggagaggaaaagaaggcggacacggacttctggacgccgcctcgcgaagcttccatccattctcctttctctccagcggcagaaacggctccggaaccggtctttccgaatgtgccgctga

SEQ ID NO: 4225 - DNA, 201 bp, Bacillus licheniformis
atggaatcgaaaggaaacagcgaaccaagccccaaaatcgtaaagcggctcacctggatcataccgatcgtgttgatcggagtcatatttctcttaaaaaatataagaaaccctgtgactgatgttttattttatattgtatgtgcaggtgttatcaccctagtgattttcagcatcatgaaagagacaaagagcagatga

SEQ ID NO: 4226 - DNA, 201 bp, Bacillus licheniformis
atggtgcgcatgatgaggaccggaattcggcgcgccgttttgcggaaagggtcagtcaggatcgtctatgttcctttgcaggccgatcagtcccggacgcttgtgtttgcttatcctgaaaaatgccatttgagccgggcggcaagggcttttatggaggtggccaaaaaaaatcagacctccatgtatcaagaggtctga

SEQ ID NO: 4227 - DNA, 201 bp, Bacillus licheniformis
  misc_feature (1)...(201): n = A,T,C or G
atgggtattncagtaccccgggacctgcgaaataaaagccggttgttttcttcaggctgtgggtggggganagccacggtctgtggatataaactctggcccagcactcttggtgcaaggcgctgtactaaaaataccgcggtaaaaaactcggtaaacataacaagtttaagggccaacaaggcatgctttcccccttaa

SEQ ID NO: 4228 - DNA, 402 bp, Bacillus licheniformis
ttgatatcggcaatgtccaaagcattttcattgaccgggagaacaaaacgtttatgggggttgccgattcaagcagaaacggaacggcggttggggtcaacattaagacatcggctaaatagcggagcaaggcttggtctaaagtatttagatcaagccttcttccgtcagcggggaaaagaggatttttttcgaaagaatagaaatatattttttgaaagcgtttaccaatttataaaggaggggtaccatgattcacacgttggcaaatggattttaccgcttttgcgagtgggtgatgcggcttgcctatttgaatctgctgtggatcggctttacgctggcgggagcggtcatcttcggtttagcgccggcgaccgccgcgatgttcgctgtgactag

SEQ ID NO: 4229 - DNA, 201 bp, Bacillus licheniformis
atgttctgtacttataagcctagtagattgaaggaaaagaaacaagcggaacgtgataaaaaatgtgatgaaatgttgaactttaacatcgcggccaaagccgttgaatcgtcgtcaatgggtactggtcaaaccgtcctgtttctaaaattttttgtcaggaaatgtaacaggtttgcacgctttagcgatgcaatgtga

SEQ ID NO: 4230 - DNA, 201 bp, Bacillus licheniformis
atggtcaggtacaatgttgaaaagagcgggtggatcttgatgaaaacatgggctttgaagcttctctctcatgtgcagcgtgtgccggctgcaaagcggtccgctgcatgtcaacaatgtgccgattggttatcaccagggattttcgatggaaaaaagtgtccaaggttttcgaatgatggcagaacggatcaggagtaa

SEQ ID NO: 4231 - DNA, 740 bp, Bacillus licheniformis
atgctgctattttatcaattccttgtttggcttattgttttggcgctggctctgtacgtagctgccgtgtggcgttttgaaaaacagctcgccgaaaaaacggtcgccatcagaaaaacgtggtaccttctttatgtcatcggcgccgtgatatattggacgcacgatccgcagtcaattttcacaaacccgcttcattacctgatcgttgccgtttttttcacgttgacagacgcttttattttcttaaatgcctactttaaaaagctcggcagctctgaactcgcgacagatacaagaatgcttctcgaagaaaacaacgacctcctccacacgtatcaaaacaggctgaaaacgtttcaatacctattgaaaaacgaaccgatccacatctattatggaaatatagaagcgtatgcagaaggcatcgaaaagctcatcaaacggtttgccgaaaaaatgaatatatccgctgcactttgcgaatataattcagaagaaagcaaggatcatttgcttgagcatatggaaaaccggttcgatgttcaagaaaagcttgaccgcaaagacgtttattatgaagaaaacggaaaaatggtcctcattcctttttccatccacgattttgactatgtcatgaagttaacctcagaagaccttgtcacagaatttgattatctcctgtttacttctttaacaagcatctatgatcttctgctaccaaacgaagaggaaggtga

SEQ ID NO: 4232 - DNA, 1822 bp, Bacillus licheniformis; identical to SEQ ID NO: 2634

SEQ ID NO: 4233 - DNA, 961 bp, Bacillus licheniformis; identical to SEQ ID NO: 2788

SEQ ID NO: 4234 - DNA, 529 bp, Bacillus licheniformis; identical to SEQ ID NO: 3018

SEQ ID NO: 4235 - DNA, 178 bp, Bacillus licheniformis; identical to SEQ ID NO: 3404

SEQ ID NO: 4236 - DNA, 2458 bp, Bacillus licheniformis; identical to SEQ ID NO: 2626

SEQ ID NO: 4237 - DNA, 1888 bp, Bacillus licheniformis
atggatatattaaaaaagattgaacagtatagagaggaagagcagcgtctgaaatgggaaggaaccttcgctgaatatctggaaatcgtaagagaaaatccgactgtcgcgcaatctgctcattcccgcgtttacaatatgattaaagacagcggcattgaagagaaagacggcaaaaaagtatacagcttctttgacaaagagctgtttggtcttgaagagcctttggaacgccttgttgaagaatactttcatccggccgcgaaacgccttgatgtcagaaaaagaatcctgcttttgatggggcctgtcagcggggggaaatcgactttggtcaccatgctgaaaagggggcttgaagcatactctcttacagatgaaggggctgtctatgcgattaagggctgcccaatgcatgaagatccgcttcatttaatccctcagcatctgcgggacgatttttacaatgaatacggcatccgcattcaaggaaacctgtccccgttgaacatgatgaggcttgaacaggaatacggcggaagaatagaagacgtgaaggttgaaagaatctttttttcagaggataaacggacggggatcggcacgttcagtccgtcagaccctaaatcgcaggatatcgccgatctgacgggaagcattgatttctcgacgattgccgaatacggatcggaatccgatccgcgcgcataccggttcgacggagaattaaacaaagcgaacagaggaatgatggaatttcaggaaatgctgaaatgcgatgaaaaattcctctggcaccttttatcgcttacacaggaagggaatttcaaagcgggccggttcgcgctcatctcagcggatgaattgatcgtagcccacacgaatgaaaccgaataccgttcatttatatccaataagaaaaacgaggcgctccattcgcggattatcgtcatgccgattccatataatttaaaagtatcggaagaggaaagaatttatgagaaaatgatcgctgaaagcgatgtgtctgatgttcatattgcgccgcacacgctaaaagtggccgcgatgttttcaattttgacaaggctgaaggagccgaagaggtcagacattgatctcgtcaaaaaaatgaggctgtatgacggagagagcgttgaaggatacaattcagtcgatgtcgaggatttgaaaaaagaatacactgatgaaggaatgagcggaatcgatccgcgttatgtcatcaaccggatctcgtcgacgatcatccgcaaaaatatggagtcgatcaatgcgctcgatgtcctccgttctttaaaagaaggactcggccagcatccgtcgatttcggcagaagaccgcgagcgctatttgaactttatttccgccgccagaaaagagtacgacgaaatggcgaagaaagaagtccaaaaagcgtttgtatactcttatgaggagtcggcgaaaacgctgatggacaattatcttgataatgtcgaagcgtactgcaataaaattaagctccgcgatccgctgacaggagaagagatgaatccggatgaaaagctgatgaggtcaatagaagaacaaatcggcatttccgaaaatgcgaaaaaggcattccgagaagaaattctcatccgcatttctgcctatgcaagaaaagggaagcgatttgattataattcccatgagcggctcagggaagcgattcagaaaaagctgtttgcagacttgaaagatgtcgtcaaaatcacgacgtcgacaaaaacgccggacgaacagcagctcaagaaaatcaacgaggtcgtcgcccgtctcattgatgagcacgggtacaactcgacaagcgcaaacgaccctcttaaaatatgtaggaagcttatta

SEQ ID NO: 4238 - DNA, 2028 bp, Bacillus licheniformis
ggggaccgccctcttggatttgctgctgaaaacaaagacgatgcatatcgaggcggtcatcgataaaaatccggaagctcccgggcttttcgtcgcgcagaaaaacgatatcgaaacggcactcgactggacgccatacatcacagaacagatcgacatcatcattgagacgaccggagacgccggcgtgttaaagcagctgatgcgaaaaaagcacgacagaacgatcgtggtgccgggatcgctcgcttatatcatctctcagctgatgaatgaaaagcagcagctcatccaaatgttaaaagagcagacgtataaacacgaccgtattttcaactcgatgaatgacggcatgatttttatcgacattaacgaagagatcattttgtttaacaaaatggcggaggttatgaccggaacaaagcgcagcgaagcgatcggccagcatattcaaagcgtgatcccgacgacgaagctgccgcgtattctcaacacgagagagcctgagtatcatcaaaaacaatttctccatccgaacaggcagattgtcacgacccgaattccgattattgatgacggaggaacgctcctcggggcgctcagcatatttaaggacattaccgatgcggtcgagctggctgaagaggtgaccaacctgaaggaagtcagaacgatgcttgaagcgatcattcaatcttccgatgaagcgatttcggtcgttgacgaaaacggaaacggaatgatgatcaacagggcatatacgaagatgacaggtctgacaaaagaccaggtgatcgggaagccggctaataccgacatatctgaaggcgagagcatgcatttgaaagtgctcgaaacgaggcgccctgtcagaggggtcagaatgaaagtcggcccgaataaaaaagaagtgatcgtcaatgttgcgccgattatcgtcgacggcattttaaaagggagcgtcggcgtcattcacgacgtatctgaaattcaatcgctcacaaacgagctgaacagagcacggcagattatccgtacacttgaggcgaaatatacatttgccgacatcatcgggtcaagcgagcagatgctcgtcgcgctggaacaggcgaaattgggggcgaagacgcctgcgacgattttgctgagaggcgaatcgggaacgggtaaagagctttttgcccatgccatacataacgaaagtgaccgaaagtataataagtttgtccgcgtcaattgtgcggccatatcggaatcactgcttgaatcagagcttttcggctatgaggaaggcgctttttcatgtgcgcgccgcggcgggaaaaaaggattctttgaagaagcgaacaacggaagcattttgttggatgaaagcggcgagctctcgctaaacacacaggcgaagctcctgcgcgttcttcaggaaaaagatatcgtcagagtcggcgggaccaaaccgatccctgtgaacagtacggtcatctcggcgactaacgtcaatattgaaaaggcgctcgctgaaggccggtttcgcgaagacttgtactaccggatcaatcgctatccgatatcgattccgccgctcagacagcggaaagaggacattgaagccttgagcaggcatttgatagggaagatcaaccaagagtacgggcgcaatgtaaaggggcttacgaaaaacgccctcaaatcgctaaaagcgcggaagtggccggggaatgtcagagagcttgaaaatgtcctcgagcgggcgatgatttttttaaaaccgcaaatggaatggattgatctagaacatcttcctgaagcggaccgtccgagaaaaaaggtggaagccggcgaagctttccctgaaattgaagatgaaaagctgtctgatgcggtcgaacggtttgaagctcatatcattaaagaaacgcttgaaaagcatcaatataacagaacgaaaacggcaaaagctcttggaatcagcattcgcaacctctattacaaaatggataaatacaaccttgcaaaagatagcatgca

SEQ ID NO: 4239 - DNA, 1845 bp, Bacillus licheniformis
atgaataaagtaagtttttttcgctcgattcattttaagtttaccttaatatacgttctgctgattatcgtcgccatgcagattatcggcgtctactttgtcaatgagatggagaagtcacttcttaaatcatataatgactctcttgatcagcgggtgaacaacctatcgtattatctggaacaggaaatgacgaaggatagaagcacatcttcctcgtctaccttgaaggaagatgcagagcggattctaaatgatttcagcaaagaaggcgaaattctcgaagtcagtctgattgataaaagctatgaagtcatcgcgacctccaatccttataaccgggaggtggcggggaaaaagacaacagagggcattatcaaaaggacgctgcttgtcggcattccatacgaaaataaatttttcgacccggagcgggacagcaaagtgcggatttcggtcacaccgattaaaaaatcgaatcaagagacaatcggggccatttacgtcgtggcatcgatggataatgtctacaatcaaatccggacgatcaacaccattttagcgtctggaacttttattgcgcttggaatcactgcttttctcgggatttttgtcgcgcgaacgattacacatccgctgtcagatatgagaaaacaggccattgaactggcgaaaggaaatttctcaagaaaagtcaggaagtacggaaacgacgaaatcggccagctggccacaacgtttaattatttaacaagagagctgaaagaagctcagtccatgacagaaggcgaacgaaaaaaactatcttctgttattgcgtatatgacagacggagttatcgcgactaaccgaaatggcgcgattattttgcttaatacgccggcgctggagcttctaaatgtttcacgtgaaacggctcttgaaatgccgatcacttcgctgctcggccttgaagacgaatacacgtttgaagatttggttgaacagcaggattccctgcttcttgaaattgaacaggaagaacggacgtctgtgctccgcgtcaatttctcggtcatccaaaaagaacacggaaagatcgacggattgattgcggtcatttacgatgtcacagaacaagagcagatcgatcaagagcggagagagtttgttgcaaatgtctcccacgagctcagaacgccgctcacaacgatgcgaagctacctagaagcgcttgcggaaggggcatggcaggatccaaacattgcgccgcgcttcttgaatgtgacacagaatgaaacagagcgcatgatcaggcttgtcaacgacctgctgcagctttcaaagtttgatagcaaagattatcaattcaataaagaatggattcattttatccgtttcttctcattgattattgaacgctttgaaatgacgaaagagcagcatgttgagtttatcagcaatctgccggatagagaattgtatgttgaaatcgatccggacaagattacgcaagtgctggataatatcatttcaaatgcattgaaatattcccctgaaggaggccatatcacgttctctgttgatgtaaatgaagaagaagagcttctttatgtcagtgtcaaagacgaaggtgtcggcattccgagaaaagacgtggagaagatcttcgagcggttctaccgtgtagataaagccagaacaagaagactcggcggtacgggactcggtcttgcgatcgcaaaagaaatggtacaagcccatagcggcgacatctgggccgacagcatcgaaggaaaaggaacaacgatcacatttaccctgccgtataaagaagaacaagaggatgattgggatgaagcgtga

SEQ ID NO: 4240 - DNA, 1545 bp, Bacillus licheniformis
cggggctgttgtggatcctgatcggagcggtcatcgggggcgccgtgcatgatattgttgttttatttgcgtcgatgcggaggaagggaaagtcgctttcagaagtggcgaaagaagagctcgggcctgttgcgggattttgcacggggcttgcgatgctgtttattattacaatcacgatggcggggctgtcgatggttgtgcttcatgcgcttgaacgcaatccgtgggggacgttcgccgttgcgattacaattccgatcgcgatgggggtcggcttattttataaaaagacaggcaacttaaaattagcgtctaccggcggatttattttgctgatggccggtgtcttcatcgggccctccattgcagagacgccgcttggagacgccttgacgctcgatacgaaaacgcttgctgtcgcacttcctgtctatgcattttttgcagcggcgctgcctgtatggctgctgctcgcaccgcgcgattatttgagcagctttatgaaaatcggggtgtttatcgctttgattgccggggttttcgttgtcaatccggcgattccgtttccggcgtttaccgagttcacgggcggagggggacctgtttcgcctggtccggtctggccgttcatttcaattacgatcgcctgcggtgcgatttccggtttccatgcgtttgtcggttcaggcacgacgccgaagatgcttgacaagtggagcgacatgaaattcgtcggcttcggagcgatgctcgttgagtgtcttgtcggcatcatggctttaatcgcggcaacggcgttgcagccgggcgattattttgccatcaacagttcgccagaagtctttcggacgcttggcatgaatgtcgtccatctgcctgaactcagccgcgaaatcggtctcgatcttgaaggaagaacaggcggagctgttacccttgccgtcggcatggcttatattttcacggatattccgtttttcagccatttggcctcttactttttccaatttgtcatcatgtttgaagctgtctttattttaacggcgatcgatgccggtacaagggtggcgcgttatttgattcaagactttttcggggaagtgtacaaaccgctgaaaaaaacggactggcttccgggttcggtcgcagcgagcgcccttgcctgtttcatgtggggatatttgctgtactcaggcgatatcagctcgatttgggcgctgtttggcgtatccaaccagctgatggcatccgtcggtttaattatcggagcgacggtcattttaaaaattgcggacaaacggcgttatatgctgacatgtctcattccgctcgcttatttgtatgtgacggtcaactatgcgggatactggatgatcaaaaacgtttattttaatgcggaagctgccggtttcagcgttttaaacggcattttatcgatcattatgcttgtgttgggacttgtgatcatggctgcagccattaaaaaatggacggagatttggcgcgatccggcattgcggatggagccttctatacctggat

SEQ ID NO: 4241 - DNA, 1815 bp, Bacillus licheniformis
atgatggaacaaaaaacaaaacgttttgagcaatataagcctcatatgaatttacaggcagtcctgtcagctaacggccgttttatatacatatctgcaaattgcaaagagctcttaagctacgagcagaatgaactgatcggtacgtatttgaaggactatttacacgaagacgatctttttctggtagaaagctatttttacaatgagcatcatttgctgccctgcaccttcagatttgtgaaaaaagactacacgatgatctggatcgaagcatcgatcgatttcgtgacgacccatgttggagaaaaagaacgcgaaattgtactcaaaatgaaagtgtttgaagaccgtccctctaagaaaagcagctccataaaagaggaagacgctccggaagaagcctccaggctgccggcaaaagaggaattcgaagccatgatcgaaggcttgccaaaccctctgtgcatcagcgttcaaggggaaatagtctacgtaaatgacgccatggtcaacctgctcggagccgagcataaacggcaaattatcggaaagtattcctacgattttatcgagaaagagtaccatgacatcgtcaaaaaccgcattaagcggatgcagcagggacttgatgtcggaatgatcgagcaaacgtggcataagctcgacggcacgcagattcacctcgaagtcaaggcggcgccgaccatttatcaaaaccagaaagcggagctgcttcttctcattgacatttcatcgagaaaaaaatttcagaccattttgcaaaaaagcagggagcgatatcagctcttgattcaaaactcaatcgatacgatagccgtgattcataaaggaagatgggtctttatgaatgaatcgggcattcgtctgtttgaagcaaagacgtatgaggatttaatcggcaaagatatttacgaacacctgcacccatgcgatcacgaagatgtcaaagcgaggctgaaacggatcacagaccgccaatccgaatctgaaatcataaaacagacgtggtatacatttgaaaaaaggctcatctatacagaaatggtttgcatccctacgacatttttcggggaaacggcggttcaggtgattttaagggacatttctgaacgcaagcagaccgaagagctgatggtccgttcggaaaagctgtcgattgccggacagcttgcagccgggatcgcccatgaaatccgcaatccgctcaccgcgatcaaagggtttttgcagctgatgaagccgacaatggaagaaaatgaacattattttaatattatcttttccgagttaagcagaatcgaattgatcttgagcgagcttctcatgctggcaaagccgcagcaaaacgcattgaaagaaaagcttgatctgatcaggctgatccgcgaagtgacggcgcttttagaaacgcaggccaacttaaacggcattttgatcaatacgatcctcacagacgacaaaatttacattaaaggggatcaaaatcaattaaagcaagtgtttatcaacctaatcaaaaacgccgtcgaatccatgccaaacggcgggacggttcatttgacggtcagagaaaccgacgattcggtcgtcgtcgaggtggaggacgaaggagaagggatacctgaacatgtcctgaagcggatcggcgagccgtttttgacgacgaaggaaaaaggaacaggcctcggtttgatggtcaccttcaatatcatcgaaaatcacaacggaaccatcgaagtcgacagcaaagcagaaaaaggcacgacatttaagattctatttccaaaataa

SEQ ID NO: 4242 - DNA, 1572 bp, Bacillus licheniformis
ataaaatctggaacgctcttttcagaagagggaaggcaaaaggggagcttcctgtccgcctcagatcaggagaagacaggctgtttgagctgacgataacctcgaatattttaaatggcttttacatgtcgattatgagggatattaccgaaaagcgctcaatggaaaaacagctgtttaagagcgaagaacgctttagggaagtctttgaaaatgcgatggatgccatcattctgatgaataacgacggccgcatcgtcaaagcgaaccagtcggcctgcaaaatcttcgaactgccgatggaccagctgctcaacaagaagatgactgattttatagatcgaaccgatcagcggtatcatgccattcaaaagcagtacgatcaaaaaggggaaatccgggcggaactgctgtttcgtatggcaaccggacaatataaggagcttgagttcacatcaaaacggattatgttcgacagccaggacttaaccattttgagaaatgtcagcgacagaaaacgaatggaacaagaattgcgggaaagcgaattgaagttcagaaaagtattcaacggatcaatggacggaatcgttcttttcaacaaccagtacgatattatcgatgcgaacccccttgccggaaaaattctcagcatccctcttgaacagctgaaaacgtccaatcttcttgatgtcatctccggctatcacatcgaaaacgcggcttctcccgctaaaacgatttcctttgaagaaatggacaatgatatcccattcctgctgagcgaccaaaaacggatacttgaattttcatttaagcgaaacatcattcaaaatatgaatctggcgatgctcagagacgtgacggaacgaaaagagcttgaagagcggctccgcaagtctgataccctccatgtcgtcggagaactcgcagccggaattgctcatgaaatccgcaacccgatgacggcattaaaaggatttatccagctgctgaaaggcagcatccaaaatgaggatcacgcgctttactttaatgtcatcacatcagagctcaaaaggattgaatccattattacggagtttctcatccttgcaaaaccgcaggcgattatgtatgaagaaaaaaacatcgtcaaaatcatgcaggacacaatggatctgctgcatgcgcaggcaaaccttgacaacgtccagatgcatctgaagtgcgaagacggcattccgctgatctactgcgagccgaatcagctgaagcaggtatttatcaacattttgaaaaatgcgatcgaagtaatgcccgacggaggcaatgtatatgtgtcgatcaaaccgaaaggagacgaccatatcattgtctcgcttgctgacgaaggaatcggcatgacagaagacaaattgaagaggctcggcgaacctttttacacgacaaaagaacggggcactggactcgggctgatggtcagttataaaattattgaagaacataaaggaaaaatcgaagttgaaagtgaagaagggagaggcacgacattccacctgactctcccgatcagacagcagcatgaggagg

SEQ ID NO: 4243 - DNA, 1220 bp, Bacillus licheniformis
ttgctgataaggaatcctttcaaagaaaaatactactcacatgataggcgggcattaaatatgcttgcactcagagtgccgggcctggcttttattctcatgatctatgtcgcctctatcgtgctgcaatttcttaatgggagctggtccattttattgcttaatgtgtttacggtattgaccgccatctttgctttgttgcattggcactcatatcgctgggttaagaaaagggtgattctgtacttcgtattacaaggtttgatcacttttacacttgctaatgtcatgtcaggctttttagtgctaatcatcattggcctttatgcatttttgatcggacagattataggaatggcagacagaagaaagacgttcctcatcctttatttattgcttctgctgtcaatcactgtactatatcatattcacaaaggtgaatatttgcattttcttgtcatagcagtacctattatgatcgtgattatcacatatgccgctacattttttgcccaagtcgatgaaaagacaaaagcgcagctgactcttgaaaggctggagctggctcatcagcaggtagaacagctgacgctgcaaaacgagagacagcgtatggcccgggacttgcacgatacgcttgctcaggggctggtcagtttaaatatgcagctggacgctattcatgttcatctcgccaaagacaacacagagagagcaaaagaaatcgttcaacaatctatgaatagagtgaaaagcacactagctgatgcacgttcagcgattgacgatctgcgcagcaaatcagaagaaatcggttttttaaaagaaagaattacctcattaatggatcattttcaagagtcgacaggcatggcttgctttttagactacagattagaccaagtgccggacgttcgaacagctgaaaactgttattacatcattggagaatgcatagcgaatgccgtaaagcatgctgaagcagaaacgatctcagtgtccatttgggatgatgataagaggaggctccatttaaccgtcaaggataacggcaaaggatttgatgttgaaaaaggcaagaaaaagagaggacattatgggcttctcggcatagaagaacgcgtcagagcaatgaaaggccaattcaatataaagagtacaacatctaaaggaacacaaattgatatcactgtaccaattcagggagagatgccagatga

SEQ ID NO: 4244 - DNA, 1716 bp, Bacillus licheniformis
cgttctccactttgtcagtcagatttttttgattctcggtcttgttctcgcgaccttgctgttatccttcatttttttcgctctccgattaagcgagagcgaagcggatacaggcttggcaaaagccacttcagacacgtttgaaagctgggtcagcgtggatgacaataacaattggcagatcgaagatatcttgaaatcggctatcgacaaacagggaggctggcttcaaatattagacggcaaggagaaaaccgtttattcctaccgtcttcctgcggaaattcagaggcagtaccacagggaagacctggtatccgtttttgataaaaaaagaattaaaaaatatcaagtcaacttctggtctgccaatttcaatggtgaagactacgtgattttattcggatgggagtcgaaaagcgatacgatcctgtcctatttggaaaaagaagagaaggatatggcagacctttcttcctataaaaaaagcacgcttgatttcattaagaaaaacaaagggtccgtctatttgttcagcgaaaaagggaaaatgctggactcgatctaccaggacatagattacagccagggaatcaatgagctggagcttttaaaatacggatcaaagccatggaactacgagcacgagttttcatacaggcgattaagcgcgacagaatggctgatcgccgctacgccgaacccgatttttaatccggatcatgagttcaacaggacgatgatcgggctcgctttaaaaatcgttctcatcgtgatcggcgttctgatcttattgatgtcttctatgaccatttggtattctttcagattcggcatgccgatcatccatacgattaaatggatcgtcaacctttcaaaagggcgatttgaagaaccgagaaaccggaaaggccgcccgcgaagccggaacaaaaaagggaagcgaaaacagccgtaccggctgttcacagaagtgtttgaatcgatggagcagctgacggaaacgctgaaaaaagacgagcaaaaccgcaagaaaatccaaacgacccgggaggaatggatcgcagggctctcccatgacttaaaaacgccgctcagcacgatttacggctacagcatgatgctggagtctccaaactatgagtggtcaaaagaggaaatccgcgaaatcggccaggcgatgaaagaaaagtcggactacatgtcacagctaatcgaagacttgaacttgacgtacaggctgaaaaacgacgctttgccgattaaacgccagacagtgaggctcgtgccgtttttaaagagcttcgttgaggagtttaagcgccattcattttcagaagggtacaacgtgtcttttgaatacaagcaagtagataccgagtttgcgatagacaggggctggttccgaagagtcttggaaaacctcctcgccaacgccgtcaagcataacaaaaaaggcactgacatcaaggtgatccttgaagaatccaagcaatatattattcttaaaattcaagacaacggaagaggcatggactctgaaaccgtctcaaatttattcaaccgctactacaggggaacgcatacaaaagatgcgacagaaggaagcggtctcggccttgctatttctttggaacttgtccacctgcacgacggctgcatcgcagttgacagccggacaggccgagggacggaaattacgatggaatttaagaa

SEQ ID NO: 4245 - DNA, 1285 bp, Bacillus licheniformis
  misc_feature (1)...(1285): n = A,T,C or G
ttgagtaaaatttatgtgctagatacgaatgtgttattgcaggatccgaattcaatcttttcttttgaagataacgaggtcgtcatcccggctgtcgtattggaggaagtcgattcaaagaaacgttacatggatgaaattgggaggaatgcaaggcgcgtatctaaattgatagatgatttgcgtttaaaaggaaagctgtatgaaaatgttcctctccctaacggaggaagcttgagaatcgagcttaaccatcgctcttttcagcagcttcaggaaatctttatcgaaaaaactagcgacaaccggattttagccgtagcgaaaaacctcagccttgaagaagaaacgaaagaaggcggcagaccggttattcttgtcagcaaagatatgctgatccgcgtcaaagccgatgccatcgggttgatgtcagaggattttttgcacgacagggttgtcgacaatgatgatatatacagcggttatacggacgtgtacattcgctcggatcagatgaattcattttttgaacatcattatttgcagcttgacgaaatcagcgaggagccgctgtgtccgaaccagtttgtcgtcatgaaggacgcgctcggcggatcatcttctgcggttggaatcgtagatcaaagcggaaaagccgttaaaaagcttgtttttgaccaggagcaggtttggggcatccgttcccgaaacgtacagcagacgatggcgttggaacttctattaagacaagatattccgcttgtcaccctgatcggaaaagccggcacaggaaaaacactgcttgcgctggcagccggattgctgcagacagaggatctggggaattttaaaaaacttgttgtcacaaggccgatcgttcctgtcggaaaagatctcggctatcttccgggtgaaaaagaagaaaaacttcgaccgtgggtccagcctatttttgataacctggaatacttgttcaatgcaaaaaaaccgggggaacttgatgatattttggcggggatgggctccattcaagtcgaagcccttacttatataaggggcagaagcattcccgaccaattcatcatcattgatgaggcccaaaatctgaccaagcatgaagtcaaaacgcttctgacacgcgtcggggaaggcagcaaaatcgtattgatgggagataccgaacagatcgatcatccttatttggatgcgatgaacaacggcctggcctatgtagtagagcgcttaaaagatcaaannatttccggganacgtgaagcttttaaaa

SEQ ID NO: 4246 - DNA, 1221 bp, Bacillus licheniformis
atgttggatccactcgatattttaacgaacattgaagatgtcattccatactatcagccgatcttcagtgctgaagaacaaaaggtgatcggctatgaagtgctggggcgcatcaaggtagaaactgaagtgaagagcctcgggccgtttttttctgatccgacaattccggaagaatacaagaaagaggttgatctcaaggtgatccgccaggcgctcgatcattttctggacagcgggcgcgacctgctcatcttcgtcaatcaagatgcaaatgtgctgatgatggatcacggcgaatcgttcctcgacctgttgatggaatatcaggataaagggctcgagctcagccgtttcgttatcgaaatcacggagcaaaagtttgaaggggatattgaacagcttcatcatttgctgacctattaccgtacatacggaattaaagtcgctgttgataatatcggtaaggaaagcagcaatctcgacagaatcgctcttctttctccggatctgttaaagatcgaccttcagccgctcaagctgtcttctccttcgccttcctatgaatatgtgctttacagcatatctctccttgccagaaaaatcggagccgcattgctttatgaagatattgaagcgagctttcagctgcaatacgcatggagaaacgggggccgatatttccaggggcagtatcttgagctgccgaaggataaatttatcgaacgggatgtattaaaggaccggctgcaggccgagtttcatcaattcatcacgcatgagaagaagaagctaaccattctgtacgatcactccgagcagttttacaaacgggttcatcagcttgtcacatcgctaaagaaaacggctcagtcagacgatgaatttctcttcaatctcggaaaagaactgacagattgcagctttagaatttacatgtgcgatgaagacggtattcagctgacgaaaaacgtgtttaagcatgacggagcatggatatttcagcctgagtacatcggcaaaaattggagctggcgcccttattttctcgagaatatcatgaggatgagaacgatgagaaaagggtttttcagcgatttgtacagcgatatcgaaacgggggaaatgatcagaacgttttcctatccgatggatgaagaattgtatctgttcattgacctgtcctactcatatttatacgaacaagacggattaatttaa

SEQ ID NO: 4247 - DNA, 1744 bp, Bacillus licheniformis
atgattaaattccggacccggcttttagctgccctgctgacgcttttgattctcgtatttgcttcactcggttttctgctcgttcacttgtttcactcctcttacgatgccaaactgagcagccatattgaaaaagaggccgctttggtcgcttcattggcaaatggtgaaaacatgaagtcttcggagcaaggagctattttagagaaggcaagccgtgaactggacagtcgtgtatcgcttattgatacaaaaggtcaggttctttttcattttgggggccgcgccgaagagcaatccgttatcaaggaagcgcttgagtcggatttaaacggtgaaggaggaggcttcaggatcaaccctgatgacgagtccgtttaccgttacgtgcagccgctcaaagatgacgggaatgtgaatggatatattctgatcagcactcctgtcgattcattgcaagacatcaatcaaaagatctggattctcctcggcgtgagccttggaacggcctttttaatcatcgccgggcttggggcgagaataacctctcaatatacgaatccgattgagtctgcgacacaagtggcgattgagcttgccaaaggaaactataaagcaagaacattcaacgaagatgaaacgatgctgagccagtccatcaatatgctggcgcagaacctgcaggacatgacaagagcccaggaaatgcagcgcgaccgtctgcaaaccgtcatcgaaaatatcgattccggtctgatcttaatcgacggaaagggttatattcaccttgtgaaccgcgcttatcaaaagcaatttcacgtagaagccgatcagcttctttaccatttctatcacgaagtgctcgaacacgaagagatcattaatctcattgaagaaatttttatgacggaagcaaaggtccgcaaaatgtttaaactgccgatcaaaattgaaagaaggtattttgaagtcgacggggttccgattatcggcatcaatgatgagtggaaaggcatcgttctcgttttccatgacatgacggaaagaaagcagcttgaagaaatgaggaaggactttgtcgccaatgtctcccatgagctgaaaacgccgattacatcaatcaaagggttcaccgaaacgcttctggacggagcgatgaacgaacgggagacgctgttgcagtttctatcgatcatcttaaaagagagcagccgtctgcaaaccttgatccaggacctgttggatctgtcgaaaatcgaacagcaaaacttcaccctgaatattcaaaattgcaatatcggtgaaatcctcgccgaaattgagatgcttttgaagaataaagcggaggaaaaaggaatcaccttgacactggaaaagccggataagccggccgttgcttccggagacccgcacagactaaagcagatctttttgaatttggtgaacaatgcgctcacatatacgcctgaagatggaagcgtgacgatttcggctgatgttctggaagatgcagtgcaagtcaaagtgagggatacgggcatcgggatcaagcagtccgaaatcccgaggatatttgaacggttctacaggatcgataaagacaggagcagaaattcaggaggaaccggtctcggtcttgcgatcgtcaagcatttagtcgaagcccaccaaggcgaaatcgacgtcgaaagcgagcggggaaaaggcaccgaattcacggtccgcttaaaacgcgcatccgagt

SEQ ID NO: 4248 - DNA, 1149 bp, Bacillus licheniformis
ggcccaggacttggcgaaagggaagtttgatacgaagattccgattctgacccaggatgaaatcggcgagctggcgattgcctttaaccaaatggggcgccagctgaagtttcacattacggcactcaatcaggaaaaggagcatttgtcgaatatcttaagcagtatggccgacggcgtgatcaccattaatatcgacgggacaatccttgtgacaaaccctccggctgaacgctttttacaggcttggtattatgagcagaacatgaatgtaaaagaaggccatgaactgcctcccgaagcgcgagagctttttcaaaacaccgtcagcacggagaaagagcagatgattgaaatgaccctgcaaggcagaacatgggtgctgctcatgagtccgctgtacaatcagtcccatgtacgcggagcggttgccgtgttgagggatatgacggaggaaagacggcttgataagctgagaaaagattttatcgccaatgtcagccatgagctgagaacaccgatttcgatgcttcaagggtacagtgaagcgatcgttgacgacatcgcaagctctgaggaagaaaaaaaggaaatcgcccaggtcatctatgacgagtctttaagaatgggaaggcttgtgaatgatttgctggaccttgccagaatggaggcggggcatatttccttaaacgttgaaccggtggagctccgcgagttttttgagagagtgttcagaaagttttacggagtggccggggacaaaaatattacgctttctcacaatcttgatctgcatgaagcaaaatttgtgtttgatccggacaaaatggagcaggttttaaccaacctgattgacaacgcgatccgccatacaaatgccgggggcaccgttcatgtcgatgtgcagtctgctgaaagcgggctgaagattgccgtgaaagactccggcagcgggattcccgaagaggatctgccgtttatttttgaacgtttttataaggccgataaagcaaggacgagaggaaaaggcgggactggcctcgggcttgcgatcgtcaaaaacatcgtcgatgcacacaacggatcgatcaccgtccacagcatgctgaacgaaggtacttccttcacgttctacattccaagaaataa

SEQ ID NO: 4249 - DNA, 1347 bp, Bacillus licheniformis
atgaagaacaggtcgctcgcctttcaaatttggagtgtcatttgcggcatcctgttaacggtctcgattttgctgacgtttctattctcgacgacactgcagaactttttcactgatgaaatttatacaaacattgaaaatgagcagcatgttctgacggaatacggattttccgattcaccggaaagaggcttcggcggaagcagcggctcgcgaagcacaaaccgccacgttcagcacgtcctgctgcctgagaaaggaaccgtctatcagagcccgcagattctccccgattcatttatcgagaaggtgcagaagctcgggaaaaggcaggacgagtcatcgaaaaggtattcggagaatgtcaacggagagcacgttttctttgtgctcaaaaaaatccagacccaggaccagacgtttctgttgttatcctatgcgcttgattcatacagggacgatttgtctcatacgctgtttaagcagctgctgtttattttgatcgtcgtcattttgctgagctggattccttctatttggctggcgaaatatttatcaagaccgctcgtcacgcttgaaaagcacgtcaaacaaatctctaaacaggattgggatgatcccgtgattgtcgacagggaagacgaaatcggcaagctggggcacaccattgaagacatgcggcaaaagctcatccagaaagatgagacagaacgcacgctcctgcaaaacatctcccacgacctgaaaacgccggtcatggtcatccgcgggtatacccagtcgatcaaagacggcatctaccctaaaggagatttggaaaacacgattgaagtcattgaaggcgaagctgaaaaacttgaaaagaaaatcaaggatcttctttatctgacaaagcttgattatttgctgagacaagaaagacagtacggaacttttgatatacaagaggtcattaaagaagttgttgaacgcttgagatggtccaaaaaagaattgaactggaagattgatcttgaagaggaaacaatgttgacgggcgatcaagaacaatggagcaagctgttggaaaacgttcttgaaaaccagatccgctatgcggagacattcattgacatcagcgtcaggtcgacgaaagaacatacgttgatcaccattaaaaatgacggaccgcacattgaagaagagatgctttccagcctgtatgagccttttaataaagggaagaaaggcgaattcggcattggactcagcatcgttaaacgaatcttaacgctccaccatgctgacatgaccattcggaatgatcaaaccggtgtgtgctactcaatatccgttccgagaaattag

SEQ ID NO: 4250 - DNA, 1412 bp, Bacillus licheniformis
atgaagattaagtatctctatcagctgctggccagtcacatcagtatattagtcttggcttttctcatcacgggggcgctgttttcacactttgccaaagactttgcatacgagagcaaagtcgatgagctgtcttcctacggctaccgcatcatgggcgaaatggagatgcggccgaaaggagcgccggccattatgaagccgtttgaggaaattttgcgaagcaggaagatcagcttttttctgtttaatgaaaagaaagagatcttgatgacgccggccgatttgcggccgcgaaaactgctgctcagtgatgaagaatggaaagagcttaaagatggaaaggccgttgtcgtcaaaaccgactttaaccgttttaatgaggaagtatcggtcgtcgctctgcccaacatcgtcaacaatgaatttcagggaggcattctgctgaccgctccgatcagcgggaccgaagaaatgatcagcgacatgaaccgctttatgctctttacggcggcgggtgtcatcttagtcgctattctcttaagctggctgacgtcgaaattccatgtcgcccgcattcagaagctccgcgacgccacgaaaaaagtcgcggccggggattatgacatccatatcgaaaaccgcaataaggatgaaatcggtgatttgggcgacgactttaacattatggcccgcaagctaaaaagctcaagcgaggaaatcgaccggctcgaaaagcggagaaggcagtttatcactgacgtttcacatgagctgaagacgccgctgacgacgatcagcggtttagtggaagggatgaacagccagacgatacccgaagaccagcaggataaatgtatgaagctgatcacggaggagacaaaaaggctgattcgcctcgtcaacgaaaaccttgattatgaaaaaatccgctccaaccagattacattgcaaaagctgcattatccgctgatcgaagtgtttgaaatcattaaagagcagctggcgcttcaggcggaggagagacagaatcagctgatcctcgatgtggaagatcatgtaatggtcaatgccgattacgaccggctcatccagattctcgtcaatattacgaagaacagcattcaattcacaacgaacggaaccgtttggctgagaggccgggaagactacaaggagacggtgatcgaagtagaggataccggaatcggcattgatgaaaatgatatcgaaaacatttgggatcgtttttataaagcggatttatcacggacaaacacaccttacggagaatacgggctggggctgtcgatcgtcagacagctcgtctcccttcacaacggcacggtagagattgaaagcgagaaaaacaaaggaacaaaatttatcatccgcctgccgctgacggcgag

SEQ ID NO: 4251 - DNA, 1506 bp, Bacillus licheniformis
agagtaaaaacatgcgcaatttgaaaagtatatggaagaaaatcaggctttatttgatcttggtgatgatccccgccttcattataagcttttttgtatacgaacaagaacgagaaaatatcactgaaaagcaccgtcagactgcgactctcatgctcaatattcaccgcaaccaaatcaattacctgatcggcgaaacagaagcaaggctcagctcccttgccacggccctcaaccaccctgttaatgagcagcatatcaaacgaatcctgacggaaacgtataaaaaagaaccgcgtttttcggctttataccttttaaatgaagacggcgatgtcatggtgagcacgtctcccgccaaagaaaaaaaggcgctttcttacaagagcattctgcaaaaagcggaaaaatcaaagaaatccgtgatcacagacgatatacatacagtgtcggacgggctggagctgaatatttttactccggtctttgacagcgaagggagaacaacaaattttctgctcgcttcgatccgcgtcgattatctgaaaaatatcatgaacgtcttgagccctgagctttatatcaaaattctcaatcagaagaatcagatcgtctttacggcaggccattctcctcctgagaagccggacggcggtaccgtcgacgcttttttggaccagatcgactggaagcttgaagtctatccggaaccggtccagcttgatgaaatcgttcacagtcttctgctgtcatttttgagtattttcattctgctgaatattatgttcctcctgctccagtatgtcctgctgaagcggcggaccaagcaggagcgcgcccaaaatgaagcgcagaagctcgaattaatcggcaccttggcggcgagcaccgctcatgaaatcagaaacccgctgacaggcatcagcggctttatccagctccttcaaaaaaaatatcaatcaaaagaagatcaaatgtatttctcaatcatcgaccaggaaatccggaggatcaaccagattgtcagcgagtttctcgtgctcggaaagccgacggcagagcagtggcagctcaactccatgaatgaaatgattgacgagatcatgccgattattcattctgaggcaaatttatataatgtggaagtggaatttcaagactgcggagaagatccggcttatgtgtattgtaaaaaggatcatattaagcaggttgtcttgaacgtcgccaaaaatgctcttgaatcgatgaaaaacggcggaaagctggtcattcaaatcgaacatgatcaagagaaggcgcaaattattgtgaaggatatcggagaaggcattccacaagaaatgatggaaagtattttccagccttttgttacatcaaaagaaaaaggaaccggactcggccttgtcgtgtgcaagcgcatcatttccatgtacgggggaaccattcatatcgaaagcgaacggcataaaggaacgactgtaacgattacgctgccgacttcaa

SEQ ID NO: 4252 - DNA, 1137 bp, Bacillus licheniformis
aggcgcgggccgttcagacccataaggtattttcgatagcggatcagacgcttccttttttccgccggggactgaatgaggattcctgcaaaagcgccgctctcattatacaccgcatgacagggacggatgccgtatcgattacggatagagagaacattctcgctcatgtcggagatggagcagatcatcatattccttcgaaaaatctgatcaccggtttatcgaaaaaagtcattcaaaccggaaaggtcatgaaagtgaagtcgcgcgatgaaatcgagtgtgcgcaccgttcctgtccgctgcaggcggcgatcgtactgccgctcttctccaaccgcgaaacaatcggcacgctgaagctgtacttcaagcacccgtccggtcttaaccgtgtgacggaagagctggccgaagggcttgccatgcttttttccactcagctagaactcggtgaggctgagctgcaaagcaagcttttgaaagatgccgaaatcaaggcgcttcaagcgcaggtcaatccgcactttttatttaatgccatccatacgatttctgctctgtgcaggacagatccggaaaaaacgcgaaaacttctcttgcagctgagcgtttattttcgttccaatctgcagggagccaggcagctgatgattccgctttcaaaagagctgaaccatctggaagcctatttatcattggagcaggcccgatttccgggcaagtatcatattgattttcatatcgaggacggccttgaaaatatggaaatccctccttttatcttgcagctgctcgttgaaaatgcgcttcgccatgcatttccgagaaaacaaaaggtatgcacggtaaaagtatccgctgtgagagagcgggacggcgttttgatgaaggtgtcagacaacggcaggggaattaatccggagatgcttggacagctggggcaggcgcccgccccttcaaaggaaggaaatgggacggcgctttacaatgtgaaccagcggctcaccggtttgttcgggcaccaggctgctctgcagattgccagcgaacttgataaaggaacagagatatccttcaagattccttttcaaaccgaaagagaggggaacagagatgctcaaggtattaatc

SEQ ID NO: 4253 - DNA, 1367 bp, Bacillus licheniformis
atgggaataatccgcaaaaaaaagacactgcgcagagaactgatcaaatatatgctcactttgagcttcagcctgatcgcgatcacggctttatatgttttggtcaatatgataggaatgaatgcagggctgttttatcctgccaactacaatgaaatcgaagctgaaaagcttaagcccaggcttcaatcggctgaacagataacggaagacatgataccggatacaatgctgtacgccatactggacaaaaagtcgaaacaaaagacagcgggaaacatgaaagagacgaatctttcgattgtacggaaaaagatagagagcaggccttatgtcagctttagtcaaaaaggctatatgattatcgaacgcaaagacgagtattgtgtattggagtatcctttgcgcgctgagtttcggtctccactgctgagacggtttctcccgaactatgagctgacaagcatatgcatcatcgttcttcttttaattacggtcgtttttacggtgacaacccgatttgcaaacagattaaaagaacattttcaaactttaaacaccattgccgagcaaattaaaaaacagaatttaaattttactccggagttctcgaatattaaggaatttgatcatgtaatcagttccctgatggacatgaggaatgccctccaagcctccctacgggcgcagtggcatttagagaaaacgaaaaaagaacagatcggcgcattggctcatgatattaaaattccagtgaccatcatcaaaggaaatgcggagttgctgagcttatctccgcaaaatcaagagcagtcggaatatatcagatacatccttgacgcggggcaaaaaatcgaacagtacattgaccaattaatccatctctcaaaaactgaggaagcattacataccgagtacagagaaggcgctgtgaaaacgctagtcgaaagtgttctccatgagactgaagcatatatagggaacaaatcgattgacattgtgttgaaggagcagaaccttgaaggaaaaaaagcagtgtttgacaaacagctgcttcaccgagcgttgatgaacatcatgacgaacgccgcagatcacacaccagaaggcgggagaatcgattttgaagctgtgtgtacggctgatcaattgattttcacaatcactgacagcggaaaagggttttctcaagacggcctgcagaaagctgccgagcttttctatatggaagataaagcccggacatcgaatggtcattacgggatgggacttacctttgcacttcgtgttgttaagcttcatcaaggcgatttggcgattaaaaacagcgaagcaggaggcggacaggtacaagtgaccatccccct

SEQ ID NO: 4254 - DNA, 1219 bp, Bacillus licheniformis
atgagggtattcgttgccagacagccaatattcaacagaaaagaacaagttgtcgcatacgagcttttatacagggaaagcgagaaaaactttttttccggtattgacggtgatcaagcgacaacagaattaatgattaacagctttttaaacattggaatcgataaattgacagaaggcaaaaggtattacgtgaattttaccgagggtcttttggcatcagggctgccgacgtattttgacccggatcagctcgttgtggaaatccttgaagatgtgccgattacccttgagcttatcgaaaggtgcaggcatttgaaaagcctcggctacacgattgcactcgatgatttttgtttaaagcatcgcgtgaagagggacttgctccatcagcttttggcatccattgatattttgaagatcgattttttcaaaacgacgcagcaggaaagacagagcatccttcgatcatgccgtaaccaccgcctgacgttcctcgctgaaaaagtggagacgcgaaaagaatatgagcaggctgtaaaagacggatttcatctgtttcaaggctatttcttcagcgagcctgtcgtgattgacggtcaggacattacatatcatttccacgcttattatgagctgctgcatgaattaagcgaagatcagcctgatattgaaaacgtcacaaatattatagagcgcgatttgtcgctttcttaccagctgctgaagctgttgaattctccagccaaccggccgatccaaaagattaaaagcatccgccaggctatcgtgcttctcggatttaaagaaatcaaaaggtggatcttcatcctctcatttaaggatttaacgaaaaagcaaaactccagcaagaacgaagtcgtcaagatttcgctgatccgcgcgaagctttgcgaattgctggcaaaaaaaacgaaccgccctcagccggcttcttatatgctgacaggcatgttttcatttatcgatacactgctgcacaaagaactaacggaagtcgtcagcgaactgccgctgacagacgaagtgggccaggcgctgctcggaaaagaaaatgattaccgaaaaatcttgcggcttgcaaaatcgatcgaacgaaacgaatgggaagacaacacaccggagacagaaggcttaactaaagatgaagcgtaccagtgctatcttgaagctgttgattggtgtcaaaagctcttat

SEQ ID NO: 4255 - DNA, 1098 bp, Bacillus licheniformis
aaatcttcgccctctatatacggtcatcgtcctcagcatcgtcgccggaatcatcggagctgtcatcgtggcgaggaaagtgaaaacgattatgttcggcatggaaccatatgaaattgcaacgcttttgaacgaacgaagcgcaatgcttgagtcgacaaaagaagggattctcgccgttgatcgaacaggaaaaatcaagctcgccaatgcggaagcgaagcgcctgtttcaaaaaatggggatcgaagagaatccgatcgaccgggatgtactcgacatcttgccaaacagccgactgaaacaagtgatcgaaacacagaagcccgttcaggaccgcgatgtcagaatcaatggccttgaacttgtctttaatgaagttccgattcacttaaaaaagggaaacatcgtcggagcgattgcgacattccgcgacaaaaccgaagtgaagcacttagctgagcagctgtccggtgttaaaatgtacgcaaacgcgctcagggcgcagtcgcacgagtttatgaacaagctccacgtcattctcggtcttgttcaattaaagaactacgacgagcttggaaactatataaaagacattgcgatctatcagcagtctgaagcgagcggaattatcaaccatatcaaaaactcggtactcgccggctttttgctcggcaaacagagctatattcgggaacagggggcctcgttggaggttcattgcagcacgaggattccggatacagccaacacagcggtgattcacgatttgatcaccgttatcgggaaccttctcaacaatgcccttgatgccgtttccgccactgagaagaaaaatatttcgatttcattccgccatcatgacggacagcttgatattgaagtcacggatacgggagtcggcatatccaaggaggaacagcagaaaatgtttgaccaaggcttttcaacaaagggccccaatcgggggttcggtctttatttcgtcgaacaaagccttgaaaatttaaatggacatatcgtcgtgacgagcgaaaagaatgaaggaacgacattcagtctccgcattccgtatgaaccaaaggaggatgaccatga

SEQ ID NO: 4256 - DNA, 1699 bp, Bacillus licheniformis
atgaataaacaaactgaagacctatatctgacttttcatcaaaagctgtttcaattttttttaaaaaagccggccgtctcgtacgacgactctgttgcctggctaaaagcggcagcagagtcatttttttcgtttatatctctaacagtgcagccttcttcaagactgcagggatcgagaggcgacggtgatccgatcagacgagtgagcgattatcataccattataacaatagaagaaaacagcaaatatatagaactttcatgtcaaaagaaacataaattaccagaacgtctcgcggaatccattcatctgtttttggtgcattgtctggagcttgacgcattatttcgtgatgagcttaagaaaacaaagatttatgaaaagacggagctgctgcatgagctgatggatcaggagcaggtgctgaagacaatgctcgaaagcttaaggagtgtgtttccttttttaacgtattgtcttttcttgtcatacgatgaggatcaatacatcaacctccctgcgatagagttggatgtgcaaagcgaatcgaccgattcttttgccttggaggcatacttatcaggacaggagaagagcaaaaatgaagcggaagtatacattccgattaaaggccggcagggaacgtacggcgttttgaaagcctttggaccaggcgctgccgatacggcagcggatatatgcattatttcgaatgcggcagggaaagcatttgaaaattcacggctttacgaacagtcgcagaatatgatttcaaatttggagctgattaatgaaacatcgcatcagctgaaccggacgaaacgccttccggatatgatgaagagcttgtccgaaaggctgatcagttcattcggcgccgaagaggtgggctttttttataaaaatcacttaggaaaggaaaccctgctgccggaaagcactagtttttttcagacggatgaggcccttccatacatccgctatgtcaaagagaagatatcagaggaaaacggggtgtttgtcggaaacggttcttcgctttttgggaatgaaggatatgcttcattaatgggcgttccgatgctggaaaataatgaaaacaaagggtttgtcatcgtgttgaaaaaaaacgtctgctccttttcgtttgagatgtttaagctgtttcagacgctgatcaggcattccacgctcgccgtatcgaatttgatgctgcgcgaccggctgaagtatcttgttcagacagaccgtttgacagagttctactcgagaagccatctcgatgagaaaatcgggtacagtatgaaattggacgagagcggcgtcctcgtattgatcgatatcgatgattttaaacagattaacgatacgtacggccatcagaaaggcgatgatattcttatacaagtcgcccgggtgatccagcgaaacatccgcgatcaggatgtcgcagcaaggtggggaggagaagagcttgcggtatacttgccgaaagcaaggctgaacgccggtgaaatgcttgccgaaaggctcataatgcttgtcagggaatgtacggatccgacggtgacgatttcgtgcggggtatcccattggtctcaggatcgtccgaaatctttatccgacctttttaaagaagcggatgtcgcgctgtacaatgcaaagcggaacgggaaaaacaagtttatgacacatt

SEQ ID NO: 4257 - DNA, 1058 bp, Bacillus licheniformis
atgagaacgaacagacttgcaaacattcaatggcgcgccgtccgcttatcccttggtgtcagctttacgatttttcttgctgtattgggctttatgctgttttattaccagctggatccgagggtgctcatcgtttccaggtggttcgggattccgtttatcgcgcttctcgcattgatcagcacagctgtcgggttcggctcaggatatatgttcggcaatcagctgaaaaaacggcttgaaaagctgatcgagtctattctaaagtacgaaaacggcaactttgcctaccggattccatcgcttggagacgatgagatcgggctggccgccgaccagctcaatgagatggccgaacggatcgaaagacaggttgcctctttgcaaaagctgtccaatgagagagcggaatggcaggatcaaatgaaaaaatcggtgatctccgaagagcggcagcgtctcgcgcgcgaattgcatgatgcggtgagccagcagctgtttgcgatttccatgatgacttcagctgttttggagggaatcgatgctgcggctgatgaaaagctcgctcaaaggctgaaaatggtcgaaaaaatggcggccgatgcccagaatgaaatgagggcgctccttttgcatttgcgacctgttacgcttgaagggaaaggtctacaagaagggcttgcagaccttttgaaagaatttaaagcgaaacagtcgatcgacatcgattgggagattgaggatgcgggcaaacttccgaaaggtgtggaagaccacctgttcaggatcgttcaagaagcgctctcaaacgtgttccggcattcaaaagcgacaaaagtcaccgtcagactgctgctcaggaacaaacagctccagttgaaagtcattgacaatggcgaaggatttaagatggatgccgtcaaaacatcttcgtacgggctgaactcgatcaaggaaagagccagcgaagtcggcggagtggcagaaatcatttcatttacgggaaaaggaacacaggttgatgtaaaggttccgatttttgaacaacaaaaaggaga

SEQ ID NO: 4258 - DNA, 826 bp, Bacillus licheniformis
atgtcgtatcaagcggtgttaaaatttatctcggaactccaaaatgtactcgtcgggaatttggcggttattctgaatgacttaaacagctacatgactatcgtgaagctgactgaacacatgtatgagacgatcagcaatgaatatattcatatcctcatgaatgagtccggggacgggaatgaaaaatcgatcgacaccatctaccagttctcttcaaaagccgtacagctcggcgttccgctgaagctgctgtcgtcgggattatcagctttttggaagcacctttactatgaaatgaacaaggatgtgccggaagatcagcagtgctatgatttgatttgggaaatcgataaatttatcgaaccgatcaacagcgaaatcttgaatcagtatgcgatctcctgggagaaaaccgttgctctgcaaaaggtcgcattacaggagctctcggcgccgctgatcccggtttttgaaaatattacggtgatgccgcttgtcggcacgatcgatacggagcgggccaaaaagattatggaaaacctgttgagcggcgtcgtcaaacaccggtctgaagtcgtgctcattgacattacgggcgtgcctgtcgtcgatacgatggtcgcacaccacatcatgcaggcttccgaagccgtcagacttgtcggagctaaatgcctgctcgtcggaatccgcccggaaatcgcgcagacgattgtgaatttgggaatcgatttaactcaggttattacaaaaaataccctgcaaaaaggaattcaaaccgcattagaaatgacagacagaaaaattgtttcattggaggaat

SEQ ID NO: 4259 - DNA, 913 bp, Bacillus licheniformis
gtgttaatcggcagacggatcagcggacgttacgaaatcctgcgcgccatcggcggcggggggatggcgaacgtttatttagcgctggacatcatcctcgaccgtgaagtcgcgattaaagtgctgcggtttgacttcgttcacgatgccgattttatcaggcggttcagacgggaagcgcagtccgctgcaagcctcgaccacccgaatatcgtcagcatttatgatgtcggagaagaagatgacatctattatatcgtgatggagtatgtcgaggggatgaccctgaaagaatacataaatcgaacaggcccacttcatccgaaagaagcggtccaaatcatggagcagatcgtatccgccatcgcacatgcccatgataaccagattgtccaccgggatattaagccccacaacattttgatcgaccatatgggccacattaaagtgactgatttcggcatcgccatggcgctcagctcgacgaccatcacgcacaccaactcggttttgggctctgtccattatttgtcgcccgaacaggcgagaggcggattatcgacgaaaaaatccgatatctactcgctcggcatcgtgcttttcgagctgctgacggcgcgtatgccgtttgaaggagaatcggcggtcagcatcgcgctgaaacatctccaatcagaaacgccgtcggtgaaaagatggaacccggccgtgccgcaaagcatagaaaacgtcgtcctgaaagcgatggcaaaagatccattccatcgctatgaagcggccgaagagatggaaaacgatttgaaaacggctttcgacccggaccggctcaacgaaaagcgcttcacgattccatccgatgatgagatgcacgaaagcagttccgatcatcaagtatctgccggaaaacgggagc

SEQ ID NO: 4260 - DNA, 1014 bp, Bacillus licheniformis
atgatgagaatgctgaaagcgtttttgaccgagaggcgaagctggatcgccatatttgttttgcagcagatcctctttctgtttatcgcttatgtcgatgcatccattccttttacgtcgattttgtatatgacctatttgtcctcgtttatttttatcgtttttgtaattgtccgctttcggaaggaaacgaagttttataaaagtcttgaagaatgggaccacaatctcgatgtgacaaacattcgagaggcggaaaccccttttgaaacgatgattgaaaaaagcatagccgaacaaacgaaacagttaaagcaagaggcggcacagcatcgcctggcattggagaatgaaaaagatgagctcatggcctggatacatgaagtcaaaacgccgcttaccgccatgcatttgatcatggagacgattgaggatcaatctttaaaagcgaggcttgcgtacgaatggctgcgcatccacctgctgctcgaccgccagctccatcaaaagcggatgtcatttatcgaaaatgacttgtcccttgaagtcctagagcttaaacctatgatctttaaagaaataaaagatttgcaatcatggtgcattccaaaagggatcgggtttgatatacagctggaggcgggggaagtgctcagcgatgcgaagtggctgtcttttatcattaggcagctgctgacaaacgcggtgaaatacagcgaagcatccgatgttttgattaaaagctatgagcaggatggcaaagtgcatctcgctgttcaagactttggacggggcatcgatccaaaagatatgccgcgcgtgtttgacaaaggctttacatcaacaacggagcatcatgatcaggccgccacgggaatggggctgtacttggcaaaaaaagcggcaaagccgctcctgattcatatcgaggttgattctaaaccgggaacgggtacaacctttacgctgatttttccaatgcggaatgaattttcccgtgtgctgggcgtgtga

SEQ ID NO: 4261 - DNA, 714 bp, Bacillus licheniformis
atgaacatttctgttagaaaatcagacacagatttgctctcagacgatctgcatcacttgctggaatcgatcagtacgcgacgaaaaatcaggcaggacacattcctttttcaagaagggatggatgcagaggaactgtatcttattcagtcaggacttgtccagatcggcaaattgacgtccgatggcaaagaactgacgcttagaatgtgcaaaaaaaatgatattgtcggggagcttacgctttttacagaagatgcgaaatatatgctgagcgcaaagatcctctctgatggcgaagtgttggtcatcaataaagataagcttgaaaaagaactcattcaaaacggtgcgctgacgtttgagtttatgaaatggatgagcacgcatttgcgaaagattcaatcgaagatccgcgaccttttgctgaatggtaaaaaaggcgcgctctactccaccttgatccgtctcgcaaacagctacggcatcacaagaagcgacgggattctcatcaatattgtcctgacgaaccaggatctggcgaaattttgtgctgctgcaagagaaagcatcaaccgcatgctgagcgacctccggaagaacggtgtcatttcaattgaggactcgggaaaaatcgtcatccaccagatcaattatttaaaacgcgaaatcgactgtgaaaactgcccgctcgaaatctgcaatatcgactga

SEQ ID NO: 4262 - DNA, 1128 bp, Bacillus licheniformis
ctgtgctgtccggctttttaacgggggcggcagtcgtcggatttcgtgtgctgcttgatggatttgggccggggcagatcgattggctgtcatccttttactaccattatccgacttttttcttttatttcacatatgcgtttctattctacttggcaaaagtgaaacgatttcaatttcgcccgctctacatcgggtttctcggcttcggaatcgaactgattgccgatggagccgaactggccgttcaatatatgatgttcgagtctaccgtcaccccgggaaaaatccgcgacatgatggcgattgctttttcccacagctttattgtgctgagcttttttaatgtcatgaagctgtatgaaacgcaatcgcgggaaaagcagatccgcgaacaaaatgagcacatgctgatgatcgtttcaaacttatatgaagaaaccgttcatttgaaaaagacgttgaagaatactgaagagattacaaacgagtcctatcagctgtacaggctcttaaatagacagagcgataacaattcctccgtccggcagatcagccagaaagtgctgcgcctcgccggtgaaatccatgaggtcaaaaaagacaatcagcgcattttcgccggactttcaaaattaatttccaaagaaagcttcagagactacatggctgcagaggatctggtccggcttgtgaccggcataaatcgaaagtatgctgaatcgctcgaaaaagacattgactttcattattcgatagacggagaacatccgaaataccatgtgtataccgtattatccgtaattaataatattatggcgaacgcggtggaagcgattcaaaagcagggctccatcagactcagcctctataggcgcggcgatgacatgctggaatgccgcgtggaagatgacggaccgggcattcccgagaaagtcggagatgtggtgtttgagccgggatacacgtcaaaatatgatgaattcggaactccttcaaccggaatcggtctgtcttatgtgaaggaaactgtcgaggagcttggagggagcattcgattccggaatgatgcaagcggtgttgtgtttacgatcagacttccggttcaacaattgattcagaaagggt

SEQ ID NO: 4263 - DNA, 674 bp, Bacillus licheniformis
atgaagaacaaagacatcgtacatcagctgaaaaagtttcctcttctcgcttccctgaataaaagagatctggaagatatgaaacagtttatctattggcgctcttaccataaaggccagatattatttatggaagacgacccccgggaacgaatgtaccttcttctcgacggctttatcaaactcgaaaaatcaaacgaagccggatccatgttttataccgactatgtacgtcctcataccctctttccatttggaggcttgtttcgggatgagcattatcactatgccgccgaagccttaacagatattgaactctactatatacccatgaacatcttcgaagatctcgtccgggacaacaaaaacctgctttacgatattctcaatcatttatcagacatccttgcccttcacgaggaaaggctgaagcgcatcacactctcccatgcccacgacagggttacacaagccatttattatttaaccgaaagcctcggtcaaaaagaaagcaactcaaccgtcatcaactgtccgatcaccgctgccgaaatcgccaaaatctcggggacatcccgcgaaaccgtcagcgccgtcctgaaaaagctccgctgcgaaggcgttatcagtcaaatgaacaagcagatcatgatcaatcggccggaatattttat

SEQ ID NO: 4264 - DNA, 1479 bp, Bacillus licheniformis
ttttagaaaatctttaaaaacacaaatccaggccagagcgctcgatatggcgaaaacgctcgcccacatgccttccgttcagaaagcgtttgaaacggacgatccgtctcgaacccttcagccaattgcagaaaatgcgagaaaacagtccggtgcgcaatacatcgtgatcggctcggcggatgcgattcgctatgctcatccggaccctggaaaaatcggcaaaccaatggtcggcggagacaatcggcgcgcccttgaaaaaggtgaagcatacgtttcggaagccgtcggcacgcttggcccggccatcaggggcaaagcgccgatccataatgaaaacggcgaaatcgtcggcatcatctcagtcggttttttaatagaaaatattcaggacatcgtctatcaatatcagtcaaaattcatatttttattgggatttgtcgtgctgatggggattttgggagccgtctatatttcccgcaatgtcaaaaagtccattttcggccttgagccttatgaaattaatcaattatatactgaaaagcaggcgattacagaatctgtgcacgaggccttgatcgccatcaataaacatgaagaaatcacgcttttgaatagaaaagcgtgtgagctgcttcgtgtcgaaagcgaagatcagtggctcggcaaaccgatttccgagcttcttccggatacgctgctccccgaagtgctgaaaacgaaaacggcgcaaaaagatcaggaattaacgatcggaaacgaagaattaatcgtcaacagagtgccgattttcgaaaacgaaaaaatccgcggcgccgttgcgagcttcaggagaaagacggatattgacgaactctccaaaaagctggcgcaaacttcgcaatacgcggaaggtctgagagcccagacccacgaatattcaaacaagctgaatacaatcgcgggactgattcagctggaaagctatcctgaagcactcgagttgatccaaaaagagaataaaagccatcaggatatgctgcaatttctcatccattcgattccagatccgcttctttccgggttgctgctgggtaaggtcaaccgtgccaaagagctgcacatcaacctggaaattgatgaaagctcaaaattgaacgctttgccggacgaaatggataagggaaaattcattacgattttaggaaatttgattgagaatgcctttgacgccgtttcccacaaaaaagaccgcagcatccttgtctttttgtcagacggtgcagatcacatattaattgaagtcgaagactcgggagacgggattccaaagggggaacaggagcggatctttcaaaagttttattcgacaaaaacggcaaaccaccgcggcctcggcctctttttagttaaagaagccgtcaatgcgttaaacgggcaaattaaagcggacaaaagcgaccttggcggagcattgtttactgtcgtgataccaaa

SEQ ID NO: 4265 - DNA, 1015 bp, Bacillus licheniformis
atgctgaaaaaaagaattatacgcatcgcactattgctcgttatcatcgtggccgcgctgtcatttgtgaagctgccatattacatcaccgaacctggcgaagcgaccgagctgaaccctttaattaaagtcgataacggctatcctgaaaaagggagcttttctttaatgacagttaaagtcggtcctgccaatccgcttacatatatatgggcaaaaatgcgcccttaccacgaaattcttccggaagaaaattttaaacaagaaggcgaatctgatcaggaatatatgaagcgccaactgcaaatgatgagagattcccaggaaaatgcgatgatcgccgcttataagcgggccggaaaagaagtcagctacacgtttaacggcgtatatgccatgtcggtcgtcagcggcatgcctgcagaagggaaaatacaagtcggggacaaaattaaaaaagcggacggaaaatcgttccggtcagcggagagcttcgtccgctacatcgagtcaaaaaaagccggggaccgcgtgaaaatcgtagttgaacgggataaagaagaaaaaacatatgagatgaagctgaaaacattcaaagaagatccaaagagagcggggctcgggcgtctccctcatcacagaccgcaatgtcaaggtgaagccggaggtcgatatggatattgaaacatcggcggcccttcggcagggctgatgatgtcaatggagatctataaccagctgacaaaagaagacgagacgaaaggacaccatattgctggaaccggaacgatcgacgacgaaggcaaagtcggtccgatcggcggcatcagccagaaagtcgttgcggcagacaaggcgggagccgacatcttttttgccccgaacgaaggcggaaaaaaaggatcaaactatgaagaagctgtaaaaacggcaaaagatattaaaaccgatatgaaaatcgtccctgtcgacacgatggatgatgcgattcattatttggaagataaagtgaaaa

SEQ ID NO: 4266 - DNA, 1035 bp, Bacillus licheniformis
atgaaaaacgcttcgacgagtttggcggctagtctaaagccgggtgcagccgttgttggaaagtggaacaatcattcctacaagatcatcagacagcttggaaaaggggcaaatggggttgtttatctggccgattcaagaaagggccgggttgcattaaaagtgagcgatgacagcctgtccattacctcggaagtgaatgttctgaaatctttctcaaaggcccaggcaaaagcaatggggccttctttttttgatgtggatgacatgatggttacaggcaccggcaaaaaactttcattttatgtcatggaatatattgaaggtccgcttcttttaagatatgtaaacgaaaaaggcgaggaatggactccggtgctgatcagccagcttctctcaagcctgtcggcgattcatcgcgaaggatgggtgtttggagatttaaagcccgagaatttaatcgtgacgggtcctccgccgcaaatccgctgcattgatgtgggcgggacgacaaaagagggccgggcaattaaggaatatacggagttttttgacagaggctattgggaattcggcactcgtaaggctgagccgtcgtatgacctgttttcagtcgccatgattatggtgaactgtgcggtgaaaaaagaattcaagaagacagcaaggcctcaggagcagctcatgtcagtcattgacggacatccgtttttaaaacggtataaaccggttcttgcttctgctttaaaaggaagctatcgaacagctgatgaaatgaagggagatcttctggaaatcggccggccgccacgaatgcaaagcagccgccagtcgagaacagcccgttcctcatcggcatctgccccgtcgcaaggcctgcggcataagcgggggacgcctcagcagcaaaggttaaggagcgggcgcagaaagcaaagaaacccttctaaatccggcggtgtttttgaaacgctgttgatcgtcgtaagcgttcttgccctttactttgcgtatatcgttctcttttttatttag

SEQ ID NO: 4267 - DNA, 931 bp, Bacillus licheniformis
gtgcgtttttttattgcagatgatgaccgtgctgtgcgatcgattttaaaacaaatcattgaagacgaagatttgggtgaagtggccggagaagcggaagacggctgcgatttggaaggacacgtcctgaatttgcagcaaattgatattttatttgtcgatcttttaatgccgctccgcgacggaattgaaacggttcgtcatttgcacggcgttttctcagggaagatcatcatgatctcccaggtggaatcaaaggaaatgatcggtgaagcctattccctggggatcgaatattatatacataaaccgattaaccgcattgaaatcttgaatgtcattcaaaaagtcaaggagcgcatcgagctggaacggtcgatccatgacatacaatcttcgctgaaccggcttgtgagcctcggcggcggggggaaaaacggctttagggaaaaaagcattcaggaaacgggcgaatttctcctgtctgaactcggaatcgtcggggagagcggatcccaggatttaatcgccatccttcagtatttgtttgatgatgaacagacctcattatatgaaaaggactttccgccgctcaaacagatttttcatcagattgccgtgcaaaagctcggaccggctgcttcacccgcagagatcaacagggaggttaaagcgtctgagcagcggatacggcgggcggtcagccattcgctaaaccattttgcatcactcggtttaacagacttttcaaatccgcggtttgaaagctatgcgtcccggttttttgactttaccgtcatcagcaaaaaaatgaaagaactgcagaaagactctgccgccgtcttgccctccgcccgcgtcaacacgaaaaaattcattcaggttttctttttggaagccaagcggttgagtgaaagcgctggaaaaagag

SEQ ID NO: 4268 - DNA, 951 bp, Bacillus licheniformis
  misc_feature (1)...(951): n = A,T,C or G
tttattccgagcaaaaaaaattatttacttattggctggccatccagctttcaatcattttaatctacactgtattttatgatatcaacttagtatttttaggctttttttcagcgaactttatcggctattaccgggaaaaaaagacgttccggtgcggccttgccagcctggttgttgtattggtcgccccttttatctatcatctgctgaaagatccatccctgcttaatcggctcttttattttctgccctttcttgtgattatgctcatttcaccatacggcatccgctccatgaaccgccgcatggaactggaacaaaagcttgatgaagcaaatcagcatattaaggaactggtcaagcgcgaggagcgtgtacgaattgcccgcgatctgcacgatacacttggccatactctttcactgctcacattaaaaagccagcttgtccagcgcatcatcgccagcgcccccgaacgggcgcgaaaagaagcaagagaaatggaaaccacatcaagagcagccttaaaacaagtccgggaactcgtgtctgatatgaaaacggcaactattgcagaagagctcatccacatccagcaaatcctgcgggctgcagacatcacattcgaatacatgggaggttccgatttttcaaatatccctcctgtcacacaaaacattgtcagcatgtgtatacgcgaagccgccacaaatatcgtcaaacacagccgcgccacccattgcaccatttccatctctcaaacagatgataaaataagcattaccatcaaagacgacggaatggggatggatcagcaaaaaacaccatttggtaacggcttgcgcggaatgaaggaaagacttgcattaatcgacggcgctctcgacgtttcaacccatgacggcacagttttaagcatcgccgttccaaatgtanagaaagctgaag

SEQ ID NO: 4269 - DNA, 756 bp, Bacillus licheniformis
ttccttttttggggacgtctgaattttgctcagagctctatgaaaaacatatggagctgagccggctccaccaccgcaaaatacatgatatggagtccaagctggaagatagggtaacctacatgaatcaatgggtgcatcaggtgaaaacaccgctttccgtcatcaatctgatcatccaggaagaggacgaacccgtttttaaacaaatcaaaaaagaagtccagcagattgaatacggactggagacgctcctctattcatcaaggcttgacctgtttgaaagagattttaaaattgaggccgtgtcactagacgagctgcttaattcgctgattcagcgctataaacgctattttatacagcatcgtgtctatccaaataaacaggttcccgctgaagacgccgttatttactccgatcgcaaatggctcagattttccactggccaagtcatcactaacgctgtgaagtactcgtcaggaagaagcgaacgcatcgatttgacgatattccgtaaaggcgaacgcatcattctggaaatcaaagattacggaatcggaatcccttcacaagatgtgaaacgcgtatttgagccttattacaccggggaaaacggacggcgctttcaggaatcaacaggcatcggcctctaccttgtaaaagagattgccgaaaagctcaatcatgatgtgagcatcgattcagaagaaggaaaagaaacgactgtgcaattttcatttcttacaaaaatgt

SEQ ID NO: 4270 - DNA, 582 bp, Bacillus licheniformis
ccaaaatggactccaaagttttagattcaatcattatgaagatgttaaaaacggttgacgggagcaaggatgaagtctttcaaatcggagagcagtcccgccagcaatacgaaggcttggtagaagagctgaaacagattaaacagcaggtcaacgaagtcatcgatcttggagacaggctggaagtgcatgcccgccatgcgcggaaccgcttgtcagaggtcagcagaaactttcataaattcagtgaagaagagattcgcgaagcttatgaaaaagcccacaaactgcaggttgaactgacaatgatccagcagcgggaaaagcagctgagagagaagcgtgatgatctggaacggcgccttttggggcttcaggaaatcatcgagcgttcagaagggcttgtcagtcagattaccgtcgtcttaaactacttaaatcaggatctgcgccaggtcggcgttctccttgaagatgcgcaggccaagcaggatttcggactgcggattatcgaagcccaggaggaagaaagaaaaagggtctcaagggaaattcacgacggtcctgcgcaaatgctggccc

SEQ ID NO: 4271 - DNA, 703 bp, Bacillus licheniformis
atgacagaacacttacttgcgattcatcagcaactggaaagtccgaatgaggctcaagcgctgtttgggaaccaggattcccatttgaagttgatggaggaagagctgaacatttcaattgtcacgcgcggagaaaccgtgtatgtgacaggagatgaagaaacgtttgaaatcgcggacagcctgcttgcctctctcctaaatctgatccgcaaaggaatcgagatatccgaacgcgatgtcttgtatgcgatcaagatggcgaaaaagcagaagcttgagttttttgaaagcatgtatgaagaggaaattacgaaaaacgccaaaggaaaaccgatcagagtcaaaaccatcggtcaaagagaatacatcgccgccatgaaaaggcacgacttaatcttcggcatcggcccagcaggaacggggaaaacctatttggctgtcgtaaaggccgttcatgaactgaaaaacggacgcatcaaaaagatcattttgacaagaccagctgttgaagcaggggaaagcctcggatttttaccgggggatttaaaggagaaagtcgacccttatttaaggccgctgtacgatgcgctccatgatgtgctcggaacggaccatacggcacggctgcttgaaagaggaacgattgaaatcgcgccgcttgcttacatgagggggcggacgcttgacgacgcatttgtga

SEQ ID NO: 4272 - DNA, 582 bp, Bacillus licheniformis
atggcaatttcattagcaaaaggacaaaaaatcgatttaacaaaaacaaatcccggattgtcgaaagttgtcgtcggccttggctgggatgtcaatcaatatgacggcggtgctgattttgacctggatgctagcgtgttcctgctcaacgcagaaggcaagtgctcttctgaaaaggactttattttctataatcagaccgagggcgcaggcggagctgtcatacatacaggcgacaatcggacaggggaaggcgaaggagacgatgagcaggtaaaaatcaatttgaatgcagtgccggccgatattcaaaagatttcttttgtgattacgattcatgaagcggaggctcgccgccaaaatttcggacaggtgtcaaatgcttacgttcgcgtgatcaatgaagactcgaacgaagagttaatccgctatgatctgggtgaagatttctcgattgaaacagcgctgatcacgggagagctgtaccgccacggaggggaatggaagttctcagcgatcggctcaggctatcaaggcgggctggcgaggatcgccaccgatttcggcctgcaggtcggctga

SEQ ID NO: 4273 - DNA, 596 bp, Bacillus licheniformis
ttggctatttctttagagaaaggtcagcggattgatttaacaaaaggaaaagcggggctttcgaagattttagtcggtctcggctgggatccggtagcgtccggaagcggcggtttttttggaaagctgtttgggggaggaaccccgaatattgattgtgacgcatccgtgctgatgctggaaaacggaagagtcacagagaacaagaacgtcatttatttcggaaacttgaggagcagatgcggcagcatcgaacataccggagataatctgacaggcgaaggcagcggagatgatgaacaaatcattgtagatttgcaaaaagttccttcgcatattcataagcttgtctttgtcgtgaatatatacgattgcgtgaaacgaagccagcatttcggaatgatcgaaaatgcctttatacgcatcgtcaacatgaatgatcgcagtgagatggtcaagtacaatctgcgggacgattattctgggcggacaagcctgattgcgggcgaaatttaccgtgacggcgccgagtggaaattcaccgctgtcggagaaggcacaaacgatacgagcattacggaaatcgttaaacgcta

SEQ ID NO: 4274 - DNA, 721 bp, Bacillus licheniformis
gtgctaacaaaagaacagttgacaaaactcgaaaatgaactgaaagccggaaaagaacagatcatcagccgctttaaagaaaacggacattttggcatcgatgcgacgcacccgttcaactcgacgggcgatctttcggcttatgacaatcatccaggagatgaaggtacagaactgtacgaacgcgaaaaagaccttgccctttttgaacatgaaagagagcatttacacgatatcgaacatgctttagccatgatcgaaaaaggaacatacggccgctgtgaagtatgcggaaaggacatcccgtatgaaaggctgtccgtacttccaaccgcaacgacgtgcagtgaacattcgtcaaccgtctccgtttcaaaagatcggccgattgaggaagaagtgctgaacccgccgtttggacattttgaacaagacgaggacgatgaaaatgtcgcatacgattcagaggacgcttaccaggatgtcgaacgctacggcaattcggaaacgcctcaagatctggccgttccgcctctgtcatacagccagatgtacatggagtatgaagagccgctcggatatgtggaagattacgaaaactatgccgcaacagacattaccggaaaagatgttaccgtctatccgacgaaagaacacgaaaaatatgaagacctgcttgatgaagaaggcatcatgacctctttcggcgatctcccggctt

SEQ ID NO: 4275 - DNA, 1596 bp, Bacillus licheniformis
tcaaaaaacgggtcaatttttctctgcaaacaaaaattatgggcttgattgcagcactgcttatcttagtaatcggcttgctgacagtcacgtttgccgttcagcaaacaaaagaaggaagaaaacagtccgaacagcttgccgttcagactgcaaaaaccatttcttatatgcctccggtaaaagagctctttcaaaagaagcgcgggcataagggagaggcgcaagaggtcattgaacaaatgaaagaacagaccggtgcctatactatttatgtcctcaacgaaaagggagagatcaaaatcgcctcggaaaagagaggtcaaacgaagctgacaagaagcagaaaaatcttgttcggcggctctcacatctctaaaacaaaaaacgatggccgcatggtgatcagaggaagtgcgccgattatccaggaacaaagtggttacagcaaggtcatcggcagtgtgtctgttgattttctgttaaacgagacagaacaacgtattaaagagaatgtgagaaaattgagcttcatggctgttctcgttttgctcataggatttgcgggtgccgccgctcttgccaaaagcattagaaaagatacgcttggccttgaaccccaagagattgcatctctttaccgtgaacgaaatgcgatgctgcgtgcgattaaagaagggatcattgccaccaaccgtgaaggagtcgtcacaatgatgaacgtatcggcagcggaaatgcttaggcttcccgaacctgtggtcaaccggccaattgatgacatcctgcccggagccggaataatgtctgtccttcagcagcggcagatgttgctgaatcaggaggtctgcgtcaacgatcaagtgtttattttaaatacaaaaatgatgctccaaaacggtcaaacttacggaattgtcgtaagtttccgtcaaaaaaccgagttaaaaaggctcattgacacgctgacagaggtgcaaaaatactctgaagatctccgcgcgcaaacacatgaattctcaaataagctttatgtgatcctaggcctgcttgagctaggtgagtatgaagcagcgatcgacctgattaaagaggaatacgccattcaaaatgaacagcacgacattttattcaaaaacattcattctcagcaggtgcaggctatcctgttgggcaaaatgggaaaggcttcggagaaaaaagttaagttgtccattgatgaaaacagcacgcttgagccgcttcctgagcatatcgggatgtctcatctcattacgatcatcgggaatttaattgataacgctttcgaagccgtagctgagcaaaatgtgcggcttgtttcatttttcatcactgacatcggccgcgatattgtcatagaagtggctgacacaggatgcggcgtagcgcctgataagatgaaagccatctttgaacgaggatattcttcaaaggggatgaagagaggctacgggctggccaacgtaaaggaatctgtacgtgaacttggcggttggattgaagtggccaatcaaaaaggcggcggagcggtatttaccgtttttataccgaaggagaagcaaacacgagaggggg

SEQ ID NO: 4276 - DNA, 1569 bp, Bacillus licheniformis
atgggcttgattgcagcactgcttatcttagtaatcggcttgctgacagtcacgtttgccgttcagcaaacaaaagaaggaagaaaacagtccgaacagcttgccgttcagactgcaaaaaccatttcttatatgcctccggtaaaagagctctttcaaaagaagcgcgggcataagggagaggcgcaagaggtcattgaacaaatgaaagaacagaccggtgcctatactatttatgtcctcaacgaaaagggagagatcaaaatcgcctcggaaaagagaggtcaaacgaagctgacaagaagcagaaaaatcttgttcggcggctctcacatctctaaaacaaaaaacgatggccgcatggtgatcagaggaagtgcgccgattatccaggaacaaagtggttacagcaaggtcatcggcagtgtgtctgttgattttctgttaaacgagacagaacaacgtattaaagagaatgtgagaaaattgagcttcatggctgttctcgttttgctcataggatttgcgggtgccgccgctcttgccaaaagcattagaaaagatacgcttggccttgaaccccaagagattgcatctctttaccgtgaacgaaatgcgatgctgcgtgcgattaaagaagggatcattgccaccaaccgtgaaggagtcgtcacaatgatgaacgtatcggcagcggaaatgcttaggcttcccgaacctgtggtcaaccggccaattgatgacatcctgcccggagccggaataatgtctgtccttcagcagcggcagatgttgctgaatcaggaggtctgcgtcaacgatcaagtgtttattttaaatacaaaaatgatgctccaaaacggtcaaacttacggaattgtcgtaagtttccgtcaaaaaaccgagttaaaaaggctcattgacacgctgacagaggtgcaaaaatactctgaagatctccgcgcgcaaacacatgaattctcaaataagctttatgtgatcctaggcctgcttgagctaggtgagtatgaagcagcgatcgacctgattaaagaggaatacgccattcaaaatgaacagcacgacattttattcaaaaacattcattctcagcaggtgcaggctatcctgttgggcaaaatgggaaaggcttcggagaaaaaagttaagttgtccattgatgaaaacagcacgcttgagccgcttcctgagcatatcgggatgtctcatctcattacgatcatcgggaatttaattgataacgctttcgaagccgtagctgagcaaaatgtgcggcttgtttcatttttcatcactgacatcggccgcgatattgtcatagaagtggctgacacaggatgcggcgtagcgcctgataagatgaaagccatctttgaacgaggatattcttcaaaggggatgaagagaggctacgggctggccaacgtaaaggaatctgtacgtgaacttggcggttggattgaagtggccaatcaaaaaggcggcggagcggtatttaccgtttttataccgaaggagaagcaaacacgagagggggaatccatttga

SEQ ID NO: 4277 - DNA, 1545 bp, Bacillus licheniformis
  misc_feature (1)...(1545): n = A,T,C or G
atggatgaaattgggaggaatgcaaggcgcgtatctaaattgatagatgatttgcgtttaaaaggaaagctgtatgaaaatgttcctctccctaacggaggaagcttgagaatcgagcttaaccatcgctcttttcagcagcttcaggaaatctttatcgaaaaaactagcgacaaccggattttagccgtagcgaaaaacctcagccttgaagaagaaacgaaagaaggcggcagaccggttattcttgtcagcaaagatatgctgatccgcgtcaaagccgatgccatcgggttgatgtcagaggattttttgcacgacagggttgtcgacaatgatgatatatacagcggttatacggacgtgtacattcgctcggatcagatgaattcattttttgaacatcattatttgcagcttgacgaaatcagcgaggagccgctgtgtccgaaccagtttgtcgtcatgaaggacgcgctcggcggatcatcttctgcggttggaatcgtagatcaaagcggaaaagccgttaaaaagcttgtttttgaccaggagcaggtttggggcatccgttcccgaaacgtacagcagacgatggcgttggaacttctattaagacaagatattccgcttgtcaccctgatcggaaaagccggcacaggaaaaacactgcttgcgctggcagccggattgctgcagacagaggatctggggaattttaaaaaacttgttgtcacaaggccgatcgttcctgtcggaaaagatctcggctatcttccgggtgaaaaagaagaaaaacttcgaccgtgggtccagcctatttttgataacctggaatacttgttcaatgcaaaaaaaccgggggaacttgatgatattttggcggggatgggctccattcaagtcgaagcccttacttatataaggggcagaagcattcccgaccaattcatcatcattgatgaggcccaaaatctgaccaagcatgaagtcaaaacgcttctgacacgcgtcggggaaggcagcaaaatcgtattgatgggagataccgaacagatcgatcatccttatttggatgcgatgaacaacggcctggcctatgtagtagagcgcttaaaagatcaaannatttccggganacgtgaagcttttaaaaggagagcgctcccggcttgcaaggcttgcagcagacctgctgtaaataaaanaaacgggcttttaacccgggtttcaacttgcatggcacgccgnccgggtcgtctgcaaaagccgaaaacccggccgggaaaagaagaggcggagttttttccccgcctccggcgcacccgttacagtgttgccgctttaaataatgtgaatttcttttactcgtttcacaggattcatcttgttagaaccgtcgggaaaataaacgtgtacaggcccgtcttcgccaagcggcttgcctttgttgctgaagcagagaatcatgccgcccgcttcttcaattggaacggaaacgtcttcaccttccgttttgaagaggcatttgacggcggagcctga

SEQ ID NO: 4278 - DNA, 1125 bp, Bacillus licheniformis
ataataaactatctttaattattattttgctaagcctctccttggttccttatattatctatgtaaatctgcattctagttaccttggaatgacaatgcaatttaatgaaaaaaacgaataccaagtattcgagattgaaaaagggtcactggctcaatccctaggatttaaaaaaggggatgttattctagagataaatggtaaaagtgtagaaaaattaagggctgatgatgggaaattagctgatgaattaagtgatgttaaatcgatgatcgttgaaagagatggagagatagggtttgtagagaccggatatgaattggtgagttatgaaagtctatttctatttattattccaatgatgttttatctcctttctcttttttgtgtttatttcataataaaatcaaacaaaagattaaattcggcttcagcttttattttaattgtttttctgcttgttacatcaacagcttattcttgttctgtgggatctgcaaagggagatagtttaagtatctatataacaatgataacttttcaattcgttcctgttttgtatctccactatatttatcaatatttcaaggaaaaaggaaaagagtttttcaataataaaatatttcttttcctataccctgtgggtttattgaatttgctattggaaatttccagtgataatttgcagatttcttatagttccattaagctctttaacctggtatctttcttggttgttaccattatagcctttgctcttatcatttatggtgtaataaaaaataaagcttctgagcaagcctattttttaaggatacttgttatcacaaattttgttgcgtttattccgttcttaattttctatgtcattccatatgtatttatcggtgattatatattcccggcaatgtttgttgtaccctttttgttgattattcctttctcattagtgtatcaatttattgctaccaaaatatatgacattgaattcttattgggacgttttaaatactatggattgttagccattttaccaagcttgacagctgtaggtgtatttactttaacacaagaattaagtaatagtctaaatacagttaaaaacactatatttatctatttga

SEQ ID NO: 4279 - DNA, 708 bp, Bacillus licheniformis
cggacaggggaaaaatacgccagcacaatgaagacgatgccggcattttcacagaaaaaaacggactggtattagctgttgtctgcgatggaatgggaggtcatctggccggcgatgtcgccagcaggatggccgtctcagcccttcgtgatatttgggaggaaaccgaagaagtcccggcttcgccggctgaaagcgaagcgtggctgaaagagcagatttcagccgtcaaccaaaaacttttcgaccattcgagggcccacgaagagtgccagggaatggggacaacggtcgtctgcgctttatacacgggaaaaacgctgacggtcgcccatatcggagacagccgctgctatctcctgcaaggcggaagtttcatacagctgacggaagatcactcgcttgtcaatgaactcgtgcggactggggggatttcgaaggaggatgctgaacaccatccgcggaaaaacgtgctcacaaaagcgctcggcacagatcccgaagtgaaggtagaagcccacacatttgaaatcgaaccgggtgatcaagtgctattatgttctgacgggctgacgaataaagtggatgatgagacactgaaggatatgctcacgactctttcttctgcggaggagaaagcggatcagctcgttcagctggccaatgacaacggcggcgaagacaatatcaccgtcgcgctattggaac

SEQ ID NO: 4280 - DNA, 402 bp, Bacillus licheniformis
atggcagaccaatcctgtgtgaagattttgactgaatgggacatagtggccgccagacagcttgggcgaaatgtcgcaaaagaactggggttcggcacagtggaccaggccagaatcacgacagccatctcagagctggcgcgtaatatttatttgtatgccggaaaaggccgaatctgcatcgaacaggttcaggaagaaggaaaaaaggggttgaaaatcgtagcggaggatgaggggccgggaatcgctgacatcaaaaaagtgatggaagacggtttttcaacctcaggcggcctcggagcgggcctgccgggagtaaagcgtctgatggaccaatttgaattgcattcggacgcggaaaatggaacggatatacaagccgtaaaatggctgcggtag

SEQ ID NO: 4281 - DNA, 977 bp, Bacillus licheniformis
atgaagctttttttcaaagagcactatttgttgattgccgtgcaggcgctgcagtttatcacaatgctgtcagtgtactggcttgatgggtatcagcacatcagaccggctttttatgccgtttttctcggctttttctttcttggcttctatcttttctaccattactatacgcgccggaagttctacaaacggatgacgagcgggctggagtcattggatgacaccttcaggcaatcgaatcagccccaatcccctttgtcggaagcgcttgaacagctgctgaaaagccagtacaagcaataccgccaagaattaaagaagctggagcttggccaaaaagagcatttgactttcatggatcaatgggtgcaccaaatgaagacgccgttgtcggtcatcgaactgacggctcaaaatttggatgaaccggaatcatccagcatccgcgaggagaccgagcggatgaaaacgggcctcaatacgattctctatatggccagactgcggacgatcgaacaggatttccgtataaaaccggtcgcattggcggatatcgttcacgaggtcaatcgcgaaaataagcgcttttacattcgcagtcaagtttatcctaagttcaaagaaatcaaaaaaggcatcaccgtcgaaacagatgaaaagtggctgtttttcatcatttcccagtttgtcaacaatgcggtcaaatattcggcggggaaaagcaatacagtcattatttctgtatacgaaaatgattcggaagcggtattggaagtggcagatttcggcgccggcatcccggatacagatcaaaagcgggttttcgacccgtttttcacaggagaaaacggacgccgtttcagagaatcgaccggaatgggtctttacttggcaaaatcggcggctgaccagctcggccaccggatcgaacttgattcacaagaagggaaaggcacgacaattcggctgatttt

SEQ ID NO: 4282 - DNA, 813 bp, Bacillus licheniformis
tagcgaaccgattattaaactgaaggaggcaaccgaaagcatcaaaaacggtcaagcttcgattccgcttgatatcaaaaggaatgatgaactcggagagctcgccgcatcaatcgaaagcctttcctcaaatctcagcaggcttcaaaaagagcgaaacgattttctgtcaagcgtcgcccatgagctgcggactccgatcacatatataaaaggctacacagatgtcgcgatgagagataagctcgaaccgcaagccagaaatcagtacttgtcgatcatcaaagaggaagcggacaatttaaacacccttgttgacgatttatttttgctgacaaaactgaaacagcccggatttcaaatcaataagaaacaggttcacctttacacattcgtgaaaaaagaaattcagaaagcggcggtcgctttttcggaaaagcgaatcagcgtttcgttcgacatcccgacggatctttatgtcacagtcgacgaggtccgcttttcacaagtgatctcaaatttgctgaacaacgcccgccaatactccgatcctgaatcaacagcggccgtcaccgcatcaaaattggaggaccaggtcaagattacggtagcggatgaaggctgcggcattccggaagaagaacgggattatatatttgagcgcttttaccggatcgataaatcgaggtccagacaaaccggcggtaccgggctgggtctggccatcgtgaaagaaatcgtcgagcttcatggcggtcagattgcagcgaaaaacagaaccccgaaaggaagcgaatttatcatcacgctgcc

SEQ ID NO: 4283 - DNA, 1233 bp, Bacillus licheniformis
atggccgatgaaatggtagataatttaaatcactccacaggaagcaatgtcggtgtttatacagtagatggcgcattgttgtcttcttctgatcagaaggtgttttccagagggagtgatgaagatcttcaacaggcgatcaaaggaaagactgcctatcatatcacctataaccggaataaagcaaaagtgtttttctcatatccggttgtcattgaaggcacaaaagtaggcatattacgcttttcgaaaaatttcgacctgctgtataagcagagcggagagattctggatattgttttttatatcgcgcttgcaatatttgtggcggcgttccttttctcctatatcctgtccagacatatcacgattccgctcgtcaagctgacagatgccacctcacaagtcaagaagggtaagctggatatggatatccactttaatagaaaagatgagattggccagcttgccgtcaactttaacgatatgatcagcaggattcgggaacaaattttaaccatcgaaagggatcgcgaccgtctaaaagaacttaacgaacaagaaaaacggttttttgataatatgacgcatgagctgaaaacacctctgacttccatccaaggatatgctgagatcataaaagataaaggggaagcggaccggaaattttttgataaaggaatgaaccacattgtcgaagaaagccggcgcctgcataatttggtgatcaagcttcttgaagtatcccgggaaacgtccaagagtgctcaatttgacaggatcgacgcaggcgaaattttaaaagatgtttgcgagtcgatgaaatttcgggcagaacggtataagaaaaggatcacctgtgacattgaagatggcctgtacgttcttggtgaggtgagcaggctgcgccagctttttatcaatctgctggacaacgccatcaaatacagcttatctcattcggaaatcatcattaaggccgaaatcgttggagaaaacattctttttacattcaagaatccaagcgatccattggaaaatgaccaacacaccaaaatgttccaacctttttattcagtcaatcagaagattaaggaagaaggaagtgtaggtttgggattaagcattgtgaaaacaattgttgacgaacacggaggaacaatcgagatgttctacaaagaaaaccacacagtgattcaagttgaattagcttacgcaaaggttgagaaatga

SEQ ID NO: 4284 - DNA, 1182 bp, Bacillus licheniformis
atgctaggtgttttttatctcaaagaaattcttgattttcgtttccgtttaaaaaggttttctgaaaaatttaattaccaagatagtgtatttaagtttacccaacttatacggagctcgacatcgttagcgcaagtgctaagggaattgtctcaaacgattcttgatgttttacctgtcagccaggcttatgtactggagttaaagagtgatggaaccgtagggttacttgaaaataatgcaaacgatcaagtttggaagccttatgaaaaagaagcttttagggctatcaccgacatcggcaaaatcgtcgaagtcgaccgtgggtttttgattaagatcggtgaacggggcgggacgtcttatgtcatgctgtgtttgtcggttttaaatacgcctaggctgacgcgcgatgagatttcatggcttgagacgctggcgttttatacgagcgtttccctggaaaacgtgctgaaaatcggcgagctgatggagcatctggaaaatgtgaaaaaagaagggccgaatccggcgtggctgaataaattgatgtttgcgattgaagagaagcagagatctgatttagcccgcgatctccacgactctgtcctgcaggatatgatttccttgaagcatcaaagcgagatgtttctggctgattttgaaaaagataaagtctgtacgaatcaaatccggcaaaggctcatcaatatgaatgagcaaatgtccgccgtcatccagacgacaagggaaacgtgccaggagctgaggccgcagctgttgtacgatctcggacttgtcaaagccctttcgaaactggcggcgcagcatcaggagtcctcatcgatcgataagatccgcctcaatacggaaaggttctcaaaggtgctcgacttggacacgcagttgaatttgtacagaattgtgcaggagcttttaagcaatgcggttaaacattcgagagctaatgaggttttgattatgcttgtctgcataaaagaaaaagttgttcttcattatgaagatgacggcattggggttgacccggacaagctttatcaaaacagcgcaagcatggggctgtcgggcattcgcgagcgcgtccgcgcactgaacggcagtctggatatacagacagcagaagggaaaggctttagggtcgccattgaaatgggattgtaa

SEQ ID NO: 4285 - DNA, 1170 bp, Bacillus licheniformis
atgatgtataaagtgctgttggcggacgatgaacggattattcttgacggcatctccagcatgatcgagtggaattcgttcgggacgtctttgatcggggccgcacagaacgggattgatgcttaccgcctgattatggaaaagcggccggacattgtgatcagcgatattaaaatgcctgggatgggagggctcgaactgatcgaaaaagtgtcccgcgaccacccgtcaatccggtttattttgctgacgggcttcggccagtttgaatatgcaaaaaaagcgatgtcatacggagtcaggcattatttgctcaaaccctgcaatgagagccatattacagattcgcttcaaagcgtgatcggcgagctgaaaaaagaggaatcggcgcaaaaagtgaaaaccgatctggagatgatgaagccgcatcttatgaagcagatgttaaaagagctgatcaccggaggcggcatcgaggatgaagcgtgcctgcgctttttttcagagcaaaaggccatcaggctgatcctgttttccgtccgggacggggaggataaagattatgcacaaggcgttgaatccattgcggatgaggtgctgaacggtgctgtcatcgcctcggcccgggttcagcaattgcttgtctgtgcagtagacggaacattggcttctgctgtgcttgaggaaaaaatgaaaagcgtccaagagctttcacgccgcctgctccgatttgaaccagaagcatcactcagcgaaagcggcaatatcagcgaagcctccgcgatgtacgaaaaggcatatagaaagatcgtccaagatgaaggggagacatcggttttaatcggaaggatgcttgatctcatcgaaaaggaggcctcaaatccgaagctttcgctaaagtgggcagcccgcaacatgctgtatatgaatccggattatctcggcaagctgtttaaacaggaaaccggtgagaagttttcaagctatgtcgcaaaggtgcgcatcgaaaaagcgatcgcgaagatgaagaagtctaaaaacacggccatcggcacgctggcagaggaactggggtttggccacaatccaaaatacttcagccttgtctttaaaaaatacacgggactcaccccgtcagaatttcgaaaaaaagaagacaacacgttttaa

SEQ ID NO: 4286 - DNA, 375 bp, Bacillus licheniformis
atgaatgagaagattttaatcgtagacgaccagtacgggattcgggttctgctgaatgaagttttcaataaagaagggtacaaaaccttccaggccgcaaacgggattcaagcgcttgacattgtgaaaaaccagcgccccgacctcgttctgctcgatatgaaaatccccggaatggacggaattgaaattttaaaaagaatgaagatcatagacgaggggatccgcgtcatcatcatgacggcctacggagagctcgacatgatccaggaatcgaaggagctcggagccctgacacactttgctaagccttttgacatcgacgaaatccgcgatgccgtcaaaacgtatctgcccataaagtccaacggatag

SEQ ID NO: 4287 - DNA, 1164 bp, Bacillus licheniformis
atgcttgcactcagagtgccgggcctggcttttattctcatgatctatgtcgcctctatcgtgctgcaatttcttaatgggagctggtccattttattgcttaatgtgtttacggtattgaccgccatctttgctttgttgcattggcactcatatcgctgggttaagaaaagggtgattctgtacttcgtattacaaggtttgatcacttttacacttgctaatgtcatgtcaggctttttagtgctaatcatcattggcctttatgcatttttgatcggacagattataggaatggcagacagaagaaagacgttcctcatcctttatttattgcttctgctgtcaatcactgtactatatcatattcacaaaggtgaatatttgcattttcttgtcatagcagtacctattatgatcgtgattatcacatatgccgctacattttttgcccaagtcgatgaaaagacaaaagcgcagctgactcttgaaaggctggagctggctcatcagcaggtagaacagctgacgctgcaaaacgagagacagcgtatggcccgggacttgcacgatacgcttgctcaggggctggtcagtttaaatatgcagctggacgctattcatgttcatctcgccaaagacaacacagagagagcaaaagaaatcgttcaacaatctatgaatagagtgaaaagcacactagctgatgcacgttcagcgattgacgatctgcgcagcaaatcagaagaaatcggttttttaaaagaaagaattacctcattaatggatcattttcaagagtcgacaggcatggcttgctttttagactacagattagaccaagtgccggacgttcgaacagctgaaaactgttattacatcattggagaatgcatagcgaatgccgtaaagcatgctgaagcagaaacgatctcagtgtccatttgggatgatgataagaggaggctccatttaaccgtcaaggataacggcaaaggatttgatgttgaaaaaggcaagaaaaagagaggacattatgggcttctcggcatagaagaacgcgtcagagcaatgaaaggccaattcaatataaagagtacaacatctaaaggaacacaaattgatatcactgtaccaattcagggagagatgccagatgaataa

SEQ ID NO: 4288 - DNA, 350 bp, Bacillus licheniformis
atgagcctcggaatcgatattcacgtcaaagaatccgtattatgcattcggttgacaggtgaactcgatcaccatacagcagaaaccttgagaaaacaagtcagtgaccatctggaacaaaccgacattcgccatattgtcatgaatcttgcagacctttcgtttatggacagttcagggcttggcgtcgtgctcggcagatataaggagattaagcagctcggcggagaaatgatcgtctgcgccatttcccctgctgtcaaacgtttatttgatatgtccgggctgtttaaaatcattcgccttgagcaatcagagcagcgtgcacttgaaacgttgggggtggcgtc

SEQ ID NO: 4289 - DNA, 534 bp, Bacillus licheniformis
ccggaaagattactttgacattattttctcagagattaaacgaatcgattctgtgctcggagaactgcttgtgctggccaaaccgcaccaggttcaatttaaaaagatcaaaatcaattcggttcttcagcaagtggcaacgcttcttgagacgaacgccgtgctttcccacattaagatcgaaaaagcgtttcagcacggggaggagtgggaaataaacggtgatgaaaatcaaatcaaacaggtattcatcaatttaattaaaaacgggatagaagcgatgcctgacggcggtaaaattacgatttcctcaaaggcagaaggagactgtgtgaaaatcagcatcaaagacgaaggcgggggcatttcccaagccgacttggcaaagctcggggagcctttcttctcaacgaaagaagaagggacaggtcttgggctgacaatttgcctgaatatcatcggcgcccacaacggagaaatgaaaatcgacagcaaattgggcgagggaagcacattccacattttgcttccggt

SEQ ID NO: 4290 - DNA, 1119 bp, Bacillus licheniformis
atgaggactttagtactgcttagaggctgccctggcaccggaaaatcaacctggatcagggatcatcaattgaatcaatatacgctgtctgccgatcagctgaggctgatccatcagtcaccagtgttaaatttggaagggaaatacgacatttcccaaaaaaatgacggcaaggtatggaagcttttgttcagcctgcttgaagaaaggatggagaggggagaattcacgatcgttgatgccacacatgcaaaacaaagcatgatttccggctataaagctctcgttttaaagtatcgctacagagcgtatgtggttgattttcccaatgttccgcttgagaccgccctgttgagaaaccgcgagagggctgagcataagcgggtgccagacagcgtggttcacgccatgcacgagcggattttatccgaaccggcgccttcctggacaacagtgatcaagccggaagaatttgccgatgctatgcagtataagccgaggcggcttgacagctacaaaaaaatacatgtcatcggggatgtgcacggctgttttacggtgcttgattcctatttgaaaggcagactcgaagatgacgagttatatatttttacaggcgatatggttgatagaggaatagaaaacgcaaaagtcgtccaattccttctccgtatcaaagaccgcaaaaatgtgattttgctcgaaggaaatcatgataaatatttaaagcaatacgggcatgacgaagtaacaagaagcagcgtattcaacaagaagacaaaaccagaattagacgaagcaggttttgacaagagagatatcagggaactggccaggcgcttccaccaaattgcctacttcacgtatggacaagacacttacatcatcacgcacggcggcatttccgcgctccctgacaaccttctgtttacggctaccagccagctgatcaacggtgtcggcggatatgagacagatatcgacctgtctttacgaaaaatatggaagggcggaacatcattcaaatccacgggcacagaaacatgttccgacttccagtgcatgcagctgcaaaatcatataacctggaagggcaggtggagcacggcgggcatttaa

SEQ ID NO: 4291 - DNA, 363 bp, Bacillus licheniformis
atggcttacaagattttagtagttgatgatgcagcatttatgagaatgatgattaaagatattttggtgaaaaacggctttgaagtcgtcgcagaagcgcaagacggggcacaggctgttgaaaagtataaagagcattcacctgatcttgtcacaatggatatcacgatgccggaaaaagacggaatcacggctcttaaagaaatcaaggaaatcgatccgcaggcaaaaatcatcatgtgttcggcaatgggccagcaatcgatggttatcgacgccatccaggcgggagcgaaagactttatcgtcaaaccgttccaggctgaccgcgtcatggaagccatcaataaaacgctaagctaa

SEQ ID NO: 4292 - DNA, 1083 bp, Bacillus licheniformis
atgatgtgtcaaaacccggctcggtatacagaagaaggaatgtcaaatgaaagcggctatttaaggcagatcttcgaccatttgcaggatgggatcatcatgatggatcaggaacgcacaattctggtgattaatccgtccgcagagaagatgacgggatggaaactaggggataaggttccgtactgttcctactgccaaacgagaaaactggaagcgggagaagagcgttgttatttgctggccaagcgggaaattccttattttctctcctcgatgcccacctatgaagggcgattcgtcgacatggagatgagtacggctgtcatttccgaaaacggcgatcaaatggaagttcttttggtcctgaaagatttaacaatgaagaaaaaggaggaagaagcgaagatctccaagctggttctgcaaaaaacgttagaggcccaggaaaacgaacacaagcggcttgcccaggaactgcacgatggtgtagggcaatcgctttattcggtttcagtaggcattcaagcgattcaatcgcgcatggagcaggaagaaacatttaaagattacatgcaggacatcatcgatgaactggaaaaagcaatccaagacgtcaagctctactctctccagctgcgcccgcacagtctcgatcaattggggctgatccctgctgtcaagcatcttgtttccagcttaaacaagacgcatcaggatgtttctattacgtttgcctcaagcgatatcagcaatcgcttgctgccgatttttgaaatcaatttgtaccgcatcattcaggaggcgcttcataatgccctgaaatattcgcaggcgacacttattgaagtcatactttacaaagaagacggcgagctcgttttgatcattcaggacgatggcattggttttgaacgcgggctgacagaggaaggcctggggttcaaacatatgaaagagagagtcgatcagatggatggaagtcttcgaattcactctgcacttcagagtggcacgacgattaaagtgaaagtacaggacaaggaggggaaggagagtgatcagggtattgctggtcgatga

SEQ ID NO: 4293 - DNA, 364 bp, Bacillus licheniformis
ttgagggtacctaacattccaattttgaagctgtataactgtttattggtatccattcaagtagagctcgatgaccaaaccgctctgaaattccaagaggacctgctgaacaaaatatatgaaaccggttcgaacggagtggtgatcgatctgacttcagtggacatcatcgattcattcatcgccaaagtccttggcgatgtcattacaatgtcaaaactgatgggcgccaaagtcgttctgactggcatccagccggctgttgcggtgacattgattgaactcggcatttctttggacgagatcgagacggcgctcgatctcgaaaaggggctcgagacattgcagcgggaattgggggaat

SEQ ID NO: 4294 - DNA, 330 bp, Bacillus licheniformis
atgtttattttgctgacctatctcctgttgttggctcagaacaaggcggggtgcgcccggttttagtgattcaaaacaacatcggcaatcgcttcagcccaactgtgattgttgcagccataacagcccaaatacagaaagcaaaattacctacccacgtcgaaattgatgcgaaacgctacggttttgaaagagactccgttatattgctcgaacaaattcggacgattgacaagcaaagattaacggacaaaatcacccatctcgatgatgaaatgatggaaaaggtcaacgaagccttacaaatcagtttggcactcattgattttt

SEQ ID NO: 4295 - DNA, 325 bp, Bacillus licheniformis
gtgaatttggcagttgatacgaataaaaatgaccatgtgatagaagtaaaagttgcgggcgaaattgacgtgcacacggctccaacactgcgggatgagctgatgccgctcgcggaagaaggaaaagatctcaaagttagtctgaaagacgtttcatatatggacagcacagggctgggtgtattcgtcggcatttacaaagcggtaaacagaactgggggttctttagtgcttgaaaatctgtcagagcgtttgattcgtttgtttgatattacaggtttaaaggacatcattgacatttctggaaagtcagagggtggattat

SEQ ID NO: 4296 - DNA, 726 bp, Bacillus licheniformis
acagtttgaaaaactgaaaacgctcaaagaaatagcggaaactttaaacgaagggaacgatctaaaggaaacgctccatgccgttttaaagaagctgctccgcctaacgggactcaaaacggcatggctttttctgatcgatgaaaaggggagctttgaactggctgcttcggcccgcctgcctcaagccctttcttaccggcaaaaccgtttactatgcgaaggaagctgctactgtcttgaacaatacagggacgaaaagctggacagggcgaaaaatatcatccactgccggcggattacgacggccatgaaacagaagacaggagatccggaaggcatcacccatcatgcaaccgtcccgctcagtgaccaaaagaagcggttcggtttgctgaacgttgcggcaccgggcaaaattcatttcagccgcggggaactggcgctcctcgaagctgttgctctgcaaatcgggatggcgatcaaacggatgaggcttgctgaacaacagcaaaaacacctgctgctgaccgaaagaaacagattggctcaggacttgcatgattccgttaatcaaatgcttttttcgctcagcttgaccgctaaagcggcgggggaaatgacagaccagccggaaatcagggaaatgctcgagtttatgcaaaatctttctcatgaagcgcttcttgagatgcgggcgttaatttggcagctcaggcccccagg

SEQ ID NO: 4297 - DNA, 316 bp, Bacillus licheniformis
atgtcaaaaaagaccatctattttttatgcacaggcaactcctgccgcagccaaatggctgaaggctgggcgaagaaacatctcggagacgagtggaacgtctacagtgcagggattgaagcgcacggtttaaacccgaacgcagtcaaagccatgcgagaagcaggcatcgatatttctgagcagacgtccgatatcattgatcccgatatcttacacaacgcagacctcgtcattacgctgtgcggggacgcggctgataaatgcccgatgacaccgccgtacgttaagcgcgagcattggggttttgacgatc

SEQ ID NO: 4298 - DNA, 459 bp, Bacillus licheniformis
aaaaatagtaacggctgtgatagtgtttctcgttatatatgcactgttttcactcgcaggaattttatttcccgtagaccgggaatggtatgagtcattaaacaagccggattggacgccgtcaggccgtttgatcggaaccgtctggagcgtgctgttcgccttcatttcattagcagcggcgctcgtgtatgctgcatatgacatgagaaaagcagctgcgccattttggatcatgctgatcatcaactatgtgtttaaccaggcattcagctattttcaatttacgcaaaaaaacttacttgctgccgcagtcgactcctttttcgtagccattaccgctctttcgctcacctttatcacacggcgaattcacaaaacggcggccattctctttatcccttatgtgctgtggagttttttcgcggcttatctcgcgtttacgatttacgggatgaa

SEQ ID NO: 4299 - DNA, 440 bp, Bacillus licheniformis
ttgaacatattatttgtctgtactggaaatacgtgccgcagcccgatggccgaagcgctctttaaatctgcggctgccgaaaaaaatctggatgtctccgtcaaatctgccgggttgtttgctcctgaaaacggaaaagcttctttatatgctgtcgaagcgctttttgaaaaaaacatcgctctgaatcatacatcttcacagctttccgaggagaaggtggaatgggctgatcttgttctgacgatgacagagcagcacaagcagctggcagtacatgaattttcaaagagccaagataagatctatacgctgaaagagtatgttaatggagatggcggggacattattgacccgttcggcggttctctcagcgactatcaaagaacgagagatgagctggagcagctgctgagaaaattggcggaaatgcttgcgaa

SEQ ID NO: 4300 - DNA, 479 bp, Bacillus licheniformis
atgaaaagatatcaaggacgaatcattgcaaccgtgctggcaatgacttttatcatgttttggaattttttattctatggggtgttgggaaataaaatcaattggacggttgatctgctgtttacgctggtgacattaatcagcgtttggtggctcacactttatatcgatgagtcaaatcagcttgtctataaattgaaggaaagcgaaaagaaatataaagagctttcctcagaaaccaaccgcataatggataatcttcaggaaatcgtctttcaaacggaccggataggatacattacatttctgaatcaggcgtggacaaccctgaccggatacagtgtcgaagagagccttggaacgatgtacaacgattattttgaccatgaagaacggatctcgaatcacctgatcgcccagttgaagaacaaggagcccgaaggcaggatcgaggtgctctaccatcgcaaagacgggag

SEQ ID NO: 4301 - DNA, 936 bp, Bacillus licheniformis
atgacaatgttatggattggcattctgataattttggcgtctctcaatatcgttcaatataaaatgaaaagacaacgggatcgaaacttgaagtacatcacggaaaagctcagtgtgatgctaaatgagcatgaggctgatcaaattttattaggaacggctgataaagtactgcgggctctgctcgtgcaaattaacctgtttgttgaggagcatcagcacataacagcccgttttgcaaaaacggagcagtcaatgaaacgaatgctgaccaatatgtcccatgatctgaaaactccgctgaccgtcgtgctcgggtatatcgaggcgatccaaaatgattcagacatggcggaagaggagcgtgaaagactgctggagaagctttatcaaaaaacaggcgaaatcattcagctgatgaattctttctttgacttggccaagctggaatcggaagataagcaaatactgctcactaaaatacatatcaacgaaatatgcagaaaaaacattctccaacactatgatgccgttcaggcaaaaggttttaaagctgtcatcgacatcccggataccccggtttatgcacatggaaatgaagaagcgcttgaccggattttgcaaaaccttttatcaaatgcgattcaatatggtgcagacggaaagctgatcggattgtcccttacatatgatgagacgtggattgtcattacggtatgggaccgtgggaaaggaattagtgagtacgatcagcagcgggtgtttgaaagactgtatacccttgaggaatcgagaaataaagcgttccagggaagcgggctcggtttaacaattacaaaaaggctcattgagaaaatgggagggaacatctctctccaaagcaagccgcatgaacggacagtgttttccattacgttaaaacgaatgacctattag

SEQ ID NO: 4302 - DNA, 339 bp, Bacillus licheniformis
ataacggcgaacttgtcgttgcacatgccggcatcaaacggaagacatcggcaaaaagcctgtcgcgaaaagtaaaacagtttgtgctctacggagatattacaggggaaacgctgccagacggacggccagtgagacgggactgggccgctcattacagaggcgagccgtgggttgtatacggccatactcccgtcaaaaacccgaggatgattcatcatacaattaatatcgataccggttgtgtattcggcaacaggctgaccgctttcagattcccggaactgacaaccgaatctgttccctcctctttgccttatgatgagtctagattccgca

SEQ ID NO: 4303 - DNA, 477 bp, Bacillus licheniformis
tctagtcgcgtttgacggaaaagaggaaagcaaaaaagcgctgagaaaagcgatcgacctgtcgaaaaggctcggctcacaattgaccgtcgcccatgtccatgaaccgaggcaagtgagaacagaggctgcggccgaaagaccagctgccggagcgccatacctttacagcggcttcccggccgcaccccggatcccccgcgattcagacttggccggtgaacccatgatctacgaggacagcgcggaagaagcgattgcggcagcgaaaatcatattgagcgaaaaccagtacgacgcggaaatcgaggtgctggaaggagacacggccaacgcagttctgcagcatgcggaaaacatcggcgctgacctcgtcatcacaggtacgcgcgaccagaaccgcctgaaaaagctcctgttcggcagcgtcagcgacaagatatcgacaaaatcggagatccccgtgctgattgtgaa

SEQ ID NO: 4304 - DNA, 766 bp, Bacillus licheniformis
gtgaaaacattgataagatggctgtttgaccgcccgctcaaaaaaggaaccgtcttggaggggagatatcgaatcaaccgtgtgctcgggatgggcaactacggcatcacatatcttgccgaagaacttggaagatccggtttccgcgtcatcaagcagcagagaaaaacaaaagcatggacatcagccggccggcggtctttcaaccgcgaggctgaaattttgcgggaattggatctgcctgccgcgccccgtctatatgaggtgcttcgagcggccggcgagcggtttatcgtaatggagtatattgaaggaaaaacgtttgaagatttgctcttttatgatgggcgtgtctttgatgaacagcaaacgatcagcatattgaaggaggtgcttcacagcgtttcacttcttcacagccgggggattattcaccgggacttgaggatcccaaatttgattgtgaatcgaggaacgatccgcatcatagatttcggactggcatgccgcctgactgagagagaacgcgttgataaccggcacccggaaaaaaagctgatgcgtgcagtttcagtcaaaagtgacttttatgcgttagggcattttgcattgtttctcctgtactccggttttaccccgtccgacgaggaagaaaaatgctgggaagaagagctcagcatatcgtctgggcttaaatctgttctgcggaagatgctgcagattgatctcccgtatgagcgtgcagaagacattatcggcgatttga

SEQ ID NO: 4305 - DNA, 626 bp, Bacillus licheniformis
atggggcttggcatctggtctatgcactttatcgggatggtgtcatttcagacagcagaagaaatgaaatacgatttgaaattcgtcttgttgtcgattgttgccgctttcgcaggctcgctcatctcattttatgtggtgaatgaaaaaaaaccgacgaatggaagactggcggccgggtcccttgcaatgggatgcgcaattgcctccatgcattttatcgggatggaagcaatggaaaatatgacaatcgtctatcatcccgttctttatgccgcctcttttgcaatcgccatttttgcctccttcgctgccttaaaactgtcagttgtattcgccaaaaaaaccggttcttttcggatattgttcattaaaatcggaagcgcgcttttaatgggcggagcgatttccggcatgcactatacaggaatgtcagcagctacgcttttcatggctgacagcgttgacacaggctatgaaggaatcgataccgttgaactgggcattatgatcgtgcttgtcagcctgatgcttcaatgcttcttgattttcggcgccttcaatgacaaacgcctgctgcttcatatcgaaaaagtcaaagataacgaggagcggttgccagtcct

SEQ ID NO: 4306 - DNA, 411 bp, Bacillus licheniformis
agccaatacagcaaacgcttccgctcttttgtatcaatcattggaagacgtcaactgggcgggcttttattttgccaaagacggtgagcttgtgctcgggccgttccagggacttcctgcatgcgtaagaatcccgttcgggaaaggcgtctgcggcaccgcttatacaaacggccgggtcgagcgcgttgaagatgtgaacgcattccccggacacattgcgtgtgatgcagcgtcccaatccgaaatcgtagttccgcttgaagttgacgggagcatcatcggagtgctcgatatcgacagcccgattaaaaaccgcttcgatgaaactgatgagtattatttgaaaaagttcacggagaagcttggagagcgtttaagcgaaaagagccggtaattccggctcttttt

SEQ ID NO: 4307 - DNA, 411 bp, Bacillus licheniformis
gacatatactgctggctgctgacggttccaagcattctgaaagagctgccgatcatgcgattcatctggcttccatgtcaaacgaagcggtcgtcgacatgatttatgtattggattatgcgagagcaaaacatgaagtcctgcatagcgaaaaccgtacagaactcgaacgcgaacggcgcagcaggctgctgtcgatagaaaataaattaaaacaggcggccgttccctatcaaatgacgatgcagcacggggatccgggcccggccattgtatcgtacgccaaccatcatgatgttgatatcgtgattatcggaagcagggggctgaacactttgcaggaaatggtgctcggaagtgtcagccataaagtggcgaaaagagtgaagtgtccggttttaatcgtaaaat

SEQ ID NO: 4308 - DNA, 699 bp, Bacillus licheniformis
atgtcggtgtcggctgaagcggagaatggcgaggaggcttttgagctcgctctcaaacacggtatcgacttattgattgtcgacttgaatatgccgatcgtaaacggaattgccttgatgaaaaagctccgcggcgccttgccccagtgccgctttgtcatcgtgacgggctacgatcagtttgcatacgcgcaagaagcgatccggctgaatgttgatgattatttgttaaagccggtcgatcccgctcatctggaacaagtgctcaaaaagatcagcgtgtcgcttgcagctgagaaaaagaagctgagcgagcaaaagcttgctgagcagcatattcaacaaaacctcggccttctgaaggagcatgttttcagaagctggatcgaaaaccgggcagacgaagaagacgtttaccggcagctcgaatgcctccgtctgccggcgcgcaatcctgaaacgctcggcgtcatcgcggctggacatgtatggaacaaaccgtctgaagccgacaatctgaaagaaaaagtagaacgtttttttattaacgagcgagataaagccgtatttttcgacggagaccgcctgatcgccgcctgtctgtggcgttctgttacggaagccgaacagcgggcgcttgcagagattatcaacgccgaattgcaggcaagcccaccgtctgttttgcgaacttgctga

SEQ ID NO: 4309 - DNA, 456 bp, Bacillus licheniformis
tctggattttatctactatcggcggctttacgtcagtatacatcgtctcatatttaagaaaatctcattttctgttaaaaaagtatgaagaggaatcgtcgattgattatttaacgggattgaataatgtccggcaatttgatgcgatatggaatgctcatatttcaaacgcaaaagagaagaacgagaaactgtctttgcttttgatcgatatcgattatttcaaaacgattaatgatacgtacggacattcaaatggagatgcgattttaaaagaattaggaacgattttaaaaaagtctgcccgatcggaagatatcgtatcaagaaacggcggagaagagttttcggtcatattgccgaactgttcccattcgcaggctgcagagattgctgagagggtgcgcaaggaagtggagacacacacttttttcatttctcattcaaaaaagattc

SEQ ID NO: 4310 - DNA, 1389 bp, Bacillus licheniformis
atggggcgtaggatacagatgggaataatccgcaaaaaaaagacactgcgcagagaactgatcaaatatatgctcactttgagcttcagcctgatcgcgatcacggctttatatgttttggtcaatatgataggaatgaatgcagggctgttttatcctgccaactacaatgaaatcgaagctgaaaagcttaagcccaggcttcaatcggctgaacagataacggaagacatgataccggatacaatgctgtacgccatactggacaaaaagtcgaaacaaaagacagcgggaaacatgaaagagacgaatctttcgattgtacggaaaaagatagagagcaggccttatgtcagctttagtcaaaaaggctatatgattatcgaacgcaaagacgagtattgtgtattggagtatcctttgcgcgctgagtttcggtctccactgctgagacggtttctcccgaactatgagctgacaagcatatgcatcatcgttcttcttttaattacggtcgtttttacggtgacaacccgatttgcaaacagattaaaagaacattttcaaactttaaacaccattgccgagcaaattaaaaaacagaatttaaattttactccggagttctcgaatattaaggaatttgatcatgtaatcagttccctgatggacatgaggaatgccctccaagcctccctacgggcgcagtggcatttagagaaaacgaaaaaagaacagatcggcgcattggctcatgatattaaaattccagtgaccatcatcaaaggaaatgcggagttgctgagcttatctccgcaaaatcaagagcagtcggaatatatcagatacatccttgacgcggggcaaaaaatcgaacagtacattgaccaattaatccatctctcaaaaactgaggaagcattacataccgagtacagagaaggcgctgtgaaaacgctagtcgaaagtgttctccatgagactgaagcatatatagggaacaaatcgattgacattgtgttgaaggagcagaaccttgaaggaaaaaaagcagtgtttgacaaacagctgcttcaccgagcgttgatgaacatcatgacgaacgccgcagatcacacaccagaaggcgggagaatcgattttgaagctgtgtgtacggctgatcaattgattttcacaatcactgacagcggaaaagggttttctcaagacggcctgcagaaagctgccgagcttttctatatggaagataaagcccggacatcgaatggtcattacgggatgggacttacctttgcacttcgtgttgttaagcttcatcaaggcgatttggcgattaaaaacagcgaagcaggaggcggacaggtacaagtgaccatccccctctga

SEQ ID NO: 4311 - DNA, 279 bp, Bacillus licheniformis
gcaatatttgccgatctccgatggcagaagctgtatttaacgatatgctcaaaaaaagcggactggaggaccggatcgaagccgattcggctggcacaggaagctggcatgtcggcaaaccgcctcatgaaggcacaaggtcgctgctgtctgaaaaaaagataagctgcgaaggcctgtatgcaaggcatattactgacaaggacccggaagcgttcgattatatcatcgcaatggatgccgaaaatgcaggccatgtgagaagccttgccggctacg

SEQ ID NO: 4312 - DNA, 206 bp, Bacillus licheniformis
atgaaaaatgaaatgaacattcagtttacagcgctcagccaaaatgaatcgtttgcacgggtgacagtcgctgcttttatcgctcagcttgacccgacgatggatgaactgaccgaaattaaaacggtcgtatccgaagcggtcacaaacgcgatcattcacggttataaaactcagggcagggaaacgtatatatttccgtcact

SEQ ID NO: 4313 - DNA, 198 bp, Bacillus licheniformis
ttgtcgatacgatggtcgccgatcagttgttcaaagtcgtagacagcacaaagctgcttggcgttgaaacggttctttcgggtttgagaccggagattgcccaaacagttgtgaagctcggcatggatttttcacatattaaaacagaacagagtcttgctaaggcgctttgcaataaaggcttctgcatccatgaag

SEQ ID NO: 4314 - DNA, 483 bp, Bacillus licheniformis
tccggcaaaacgtcagaaatgctctttatgaagtcagaagaatcatttatgatttaaggccgatggctttagacgatttgggattgataccgacgctcagaaaatacttgaacacgatcgaagattatcatggaaaagcaaagattcatttccaatgcatcggagaatccgaagaaagaagaatagcaccgcggtttgaggttgcactattccggcttgcacaggaagcggtgacaaacgccttaaaacactccgaatcaactgaaattcatgttaaagtagaagtgacaaaagattttgtgacgctgattatcaaagacaatggaaacggctttgacttaaaagaagtaaaaggcaagaagaacaaatctttcggtctgctaggtatgaaagaaagagtcgatttgctcgaaggctcaatgacaatcgattcgaaaataggtcttgggacatttatattgattaaagttccactgtctttgt

SEQ ID NO: 4315 - DNA, 174 bp, Bacillus licheniformis
aggtgttccgtcagcacctacagcatccggaagggtataagggcaagggagttctcatctttattttttccttgttcagcatcatcagcaactatacaggcattgaaatccgggagcgcgagattttgaacaatgactggattttcgcaatcgacccgtcaagctcgattgcca

SEQ ID NO: 4316 - DNA, 210 bp, Bacillus licheniformis
gccttttcgcattaaagagcatcgcctcaaaacatccgtcagcatcggaatcgccgtttctccggacgatggaacagacggcgatgagctgatgagaaaagccgacatggctatgtacgccgcaaagcacaagagcgtaagcagatatcggtacttctcgtcttccctcgccagaaagaacagaccgtctttccagaaggaaatcgagct

SEQ ID NO: 4317 - DNA, 349 bp, Bacillus licheniformis
  misc_feature (1)...(349): n = A,T,C or G
gtgaaagcgttaattgtggatgacgaggaactggcattgcttcattttaaaaatatgcttgaacgaacaaattgctttcgattcattgaaatgtttcaagatccggctgatgttctggaatatccggatattcgggatatagacacggtgtttcttgacattgaaatgccggggataaacgggattgagctcgctgaagcgattcaatcgatgaatgaaaacattcaggttgtttttatcacggcttataacgattttgccataaaagcgtttgaattaaatgcngtggattatttgcttaaacccgtcgattacgtccggctcgtgaagacgattgaacggatcaggg

SEQ ID NO: 4318 - DNA, 220 bp, Bacillus licheniformis
atggcggatcgcaaacccgatatcctcttcctggacatcgatctgtcaggggagaacggttttgacattgcgcagcggctgaaaaaaatgtcggcgcctccggctgtcgtttttgcgaccgcttatgatgaatatgcgctgaaagcatttgaagtggatgcgattgattatttgacaaagccgtttgatgaggagcgaatcagacagacaatccacaaat

SEQ ID NO: 4319 - DNA, 429 bp, Bacillus licheniformis
attacattgaaatgaagtcacctgccaaaccagaatacgtaggaatcattcgtttaaccctgtcggggattgcaagcaagatggggtattcttatgatgacatcgaagacttgaaaattgcggtcagcgaagcgtgcacaaacgctgtgcagcatgcttataaagcagacaacaacacaggagaggtctccgtcagattcggcgtgttcgaagaccgcctcgaaatcgtcgtcgccgatcagggagacagttttgatattcaggataaacagaaggagctcggaccatattcccctgagcatacggtagatcaattgtcagaaggagggctcggtttatatttaatggagacgctcatggatgaagtgcatgtccagattgactcaggcgtaaccgtctcgatgacaaagttcttaaacagggagcgag

SEQ ID NO: 4320 - DNA, 432 bp, Bacillus licheniformis
acagggtgacaggctttgataataaacagaggatgaagctggagctgtcagaagaaatcaagcgggcggagcggtatggcaactcgtttgtttttttactgcttcatatgcattatttcaaagagttcaaatccctgtacggagaaaaagaaaccgatcgtctctttcaatttgtcagcagtcaaatcagatcatgtgtccgggaaaccgataaaaagttccggcctgccgaggagcggttcggcatcctgctgacacacacgcctgccgaacatatgcccgccgtccttgaaaaactgaagaaacagctggatacgtaccagctgaaaaacggcaagtatgtcaccttgaccttccacgtgtgccacttatcatatcagaacgatttaaagactgccgatcaatttttagaagaactagaaaacgagatga

SEQ ID NO: 4321 - DNA, 1169 bp, Bacillus licheniformis
tgatgtataaagtgctgttggcggacgatgaacggattattcttgacggcatctccagcatgatcgagtggaattcgttcgggacgtctttgatcggggccgcacagaacgggattgatgcttaccgcctgattatggaaaagcggccggacattgtgatcagcgatattaaaatgcctgggatgggagggctcgaactgatcgaaaaagtgtcccgcgaccacccgtcaatccggtttattttgctgacgggcttcggccagtttgaatatgcaaaaaaagcgatgtcatacggagtcaggcattatttgctcaaaccctgcaatgagagccatattacagattcgcttcaaagcgtgatcggcgagctgaaaaaagaggaatcggcgcaaaaagtgaaaaccgatctggagatgatgaagccgcatcttatgaagcagatgttaaaagagctgatcaccggaggcggcatcgaggatgaagcgtgcctgcgctttttttcagagcaaaaggccatcaggctgatcctgttttccgtccgggacggggaggataaagattatgcacaaggcgttgaatccattgcggatgaggtgctgaacggtgctgtcatcgcctcggcccgggttcagcaattgcttgtctgtgcagtagacggaacattggcttctgctgtgcttgaggaaaaaatgaaaagcgtccaagagctttcacgccgcctgctccgatttgaaccagaagcatcactcagcgaaagcggcaatatcagcgaagcctccgcgatgtacgaaaaggcatatagaaagatcgtccaagatgaaggggagacatcggttttaatcggaaggatgcttgatctcatcgaaaaggaggcctcaaatccgaagctttcgctaaagtgggcagcccgcaacatgctgtatatgaatccggattatctcggcaagctgtttaaacaggaaaccggtgagaagttttcaagctatgtcgcaaaggtgcgcatcgaaaaagcgatcgcgaagatgaagaagtctaaaaacacggccatcggcacgctggcagaggaactggggtttggccacaatccaaaatacttcagccttgtctttaaaaaatacacgggactcaccccgtcagaatttcgaaaaaaagaagacaacacgttttaa

SEQ ID NO: 4322 - DNA, 780 bp, Bacillus licheniformis
atgaaacttttgcgggaagacacacagtttgaaaaactgaaaacgctcaaagaaatagcggaaactttaaacgaagggaacgatctaaaggaaacgctccatgccgttttaaagaagctgctccgcctaacgggactcaaaacggcatggctttttctgatcgatgaaaaggggagctttgaactggctgcttcggcccgcctgcctcaagccctttcttaccggcaaaaccgtttactatgcgaaggaagctgctactgtcttgaacaatacagggacgaaaagctggacagggcgaaaaatatcatccactgccggcggattacgacggccatgaaacagaagacaggagatccggaaggcatcacccatcatgcaaccgtcccgctcagtgaccaaaagaagcggttcggtttgctgaacgttgcggcaccgggcaaaattcatttcagccgcggggaactggcgctcctcgaagctgttgctctgcaaatcgggatggcgatcaaacggatgaggcttgctgaacaacagcaaaaacacctgctgctgaccgaaagaaacagattggctcaggacttgcatgattccgttaatcaaatgcttttttcgctcagcttgaccgctaaagcggcgggggaaatgacagaccagccggaaatcagggaaatgctcgagtttatgcaaaatctttctcatgaagcgcttcttgagatgcgggcgttaatttggcagctcaggcccccaggggctggaagaagggttagcggcggctcttga

SEQ ID NO: 4323 - DNA, 255 bp, Bacillus licheniformis
atgtgcatgtttgaagcattcaggctgtccttcctgctacatattttatatcggaggtgccttgaaattgtttatagcaaaaataaaaaaatcctcactttttttgtgaggataatttcgcaagcaaatcgtttgagatggaagcggcccggctgttttcttcctggatcgccaaatagatttccttgcggtgaatttcgatatgcttcggcgcgtcgatgccgattttcacctgatctccgtcaacggatatga

SEQ ID NO: 4324 - DNA, 249 bp, Bacillus licheniformis
atgcagccgttttttcagctctttcgcgtatgtacggctgacagggatcgtggagccgtctttcatcaggaggttgtatgtcgaattgaaccagggtttgacctgtttaatatgatccatatttgcgagaaaacttctgtgcaccctgatcaatgccgtctgcgaaagcttttgttcgagtacaaccaatgtatcgtgaaccgtgtatgcctgatcaaaagtcttcactgtgacgtgtccgccttctaa

SEQ ID NO: 4325 - DNA, 239 bp, Bacillus licheniformis
atggcgattcaattatctaaaggacaaaggatcgatttaacgaaaacgaaccccggtttgacgaaagcgctgatcggtttaggctgggatacaaacaaatataccggcggcgccgattttgacttggacgcgtcggcttttcttgtcgatcagaacgatcgatgcatcaatgatcacgacttcgttttttacaacaacctcgagcatccaagcggcgccgtgattcatacgggcgacaa

SEQ ID NO: 4326 - DNA, 1596 bp, Bacillus licheniformis; identical to SEQ ID NO: 4275

SEQ ID NO: 4327 - DNA, 1285 bp, Bacillus licheniformis; identical to SEQ ID NO: 4245
  misc_feature (1)...(1285): n = A,T,C or G

SEQ ID NO: 4328 - DNA, 2490 bp, Bacillus licheniformis
atggaaaaagcggaaagaagagtgaacagcccaatagctggacctgctgttcaaaaattgtattcatggtttggcagcatgacgaagcttatgatgcagcatttatattccctctttttttataaagggctgatctatatggtcatcggttttttattgggacgagccttcattctgtcagaggtcattccctttgctcttccatttttcggagcgatgcttttaatcaaaaaagataaagctttccttgcatgcctggcgcttcttgccggagctctgagcatatcgcctcagcattcgctgttcgtgcttgcggctctgtttgcatttgcgatatgttcaaaaatgacgtcccttattataaaagaccgtgtcagaacgctgcctgtcgtcgtctttttggcgatggctgtgacaagatgcggattcgtatatgccgaatacggaacggtttcaggttatcactatattatggctttcgttgaagccggattatcgtttatcctcacattgatttttctgcaaagcctgccgattgtcacatcaaagcgggcgaaacagtcgctgaaaattgaagagatcatttgttttatgattttaatcgcttccgttctcacgggcttgacaggcgtttcatttcaaggcatgcaggctgaactgatattggcccgttatgtcgtgctcgctttcgcgttcatcggaggcgcaagcatcggctgtacagtcggggttgtgaccgggctgattctcagcctctcaaacatcggcaatttatatcagatgagcctgctggctttctcaggccttctcggcggtttgctaaaagaaggaaaaaagttcggcgcagcggtcggcttattgattggatctctattgatttctctgtacggagaaggttcggctgaattagtgccgacgctttatgaatctctgattgcaatcggcctgttccttttaacccctcagtcgattacgaaaaaagtggccaagtatatacctggaacgactgagcacgcccaggaacagcagcagtatgcaaggaaaatccgcgatgtcaccgcccaaaaagtcgatcagttttcgaacgtttttcacgctttatccgaaagcttcgctaccttttatcattcagctccggacgatgaaggaaaagaaaaagagatcgatctgtttttgagcacggtgacagaacattcctgtcagtcatgctataagaaaaacaagtgctgggttcagaactttgataaaacatatgatttgatgaaacgggttatgcaggaaacggaagaaaagcaatattttaaaaaccgcaagctgaaaaaggagtttcatcagcactgctccaaatcaaagcaagtagaagcgctgattgaagacgagctgactcattttagggcgaaccagacattaaaacaaaaggtgcatgacagcagacgtctcgttgcagagcagcttctcggcgtttctcaggttatggcggacttttctcgggaaataaaaagggaaagggagcagcattttattcaagaagagcaaattcgggatgcgctgcagcacttcggcatcgagattcagcaagtcgaaatatacagccttgagcagggaaacatcgatattgaaatgagtatcccgtattgcaacggccatggagagtgtgaaaaaatcatcgctccgatgctgtccgatattttggaagaacaaattatcgtcaaagcagaacagtgcgccggccatccgaatggatattgtcatgttgccttcggttcggcgaagtcatacagggtggtgacaggagccgcgcatgcagcaaaaggcggagggcttgtctccggcgacagctacaatatgatggagctcggcaccggcaaatatgccgccgccattagcgatggtatgggaaatggcgcaagggcccattttgaaagcaatgagacgatcaagctgctggaaaagattcttcagtcgggcatcgacgaaaaagtggcgattaaaacgattaacagcattctttcattaaggacaacagatgaaatttattcgacattggatttatcggtcatcgatcttcaggatgcgagctgcaagtttttgaaaatcggctccaccccgagctttattaaaagaggcgatcaaattataaaagtgcaggccagcaatctgccgatcggcatcattacagaattcgatgtcgatgttgtcagcgagcaattaaaagcgggagaccttttgatcatgatgagcgacggaatctttgaagggccgagacatgtggaaaatcatgatctgtggatgaagcgcaaattgaaatcgctgaaaaccgaggagccgcaggaaatcgccgacttaatcatggaagaagtgatccggacaaggtcgggtctgattgaggacgacatgacggtgattgtcatcaagctggaccataatacgccaaagtgggcctccattccggcgccggcttttttccaaaagaatcaagagatttcttag

SEQ ID NO: 4329 - DNA, 1245 bp, Bacillus licheniformis
gggcgatccgcctggaagtccagatcaggacgtttgaaatgcatgaaattgcggagtacggaatcgctgcccactgggcttacaaagaaggcaaaaatgccaatgaagattcaagctttgataaaaagctttcctggttccgcgaaattttggaatttcagaatgagtcgagcgatgccgaagaatttatggaatctcttaaaatcgatttgttttcggacatggtattcgtttttacgccgaaaggggacgtcatcgaattgccgtcaggatccgtgccgatcgacttttcgtaccgaatccattcagaaataggcaataaaacgatcggggccaaagtaaacggcaaaatggtcacccttgattacaagctgcgcacaggggatatcgtagaaattctgacgtccaagcattcgtacggtccgagtcaggactggatcaaccttgcgcagacatctcaagcgaagcataaaatccgtcagttctttaaaaagcagcgcagagaggaaaatgtcgaaaaaggcagagaactggttgaaaaagaaattaaaaacctggactttgaagtgaaggacgtcttaacagccgagaatctgcagaaggtcgccgacaaattcaactttgccaatgaagaagacatgtatgccgctgtcggctataacggcattacagccgctcaagttgcaaaccgccttacggaaaaagaacggaagatcagagatcaggaagaacaggtgaaaagcgttcaggacgtaacgcctgaagtgaaaccttaccaagggaagaaacgcgaagcgggtgttcgcgtcaaaggcgttgacaaccttttgatcaggctgtcaaaatgctgcaaccctgttccgggagatccgatcgtcggattcattacaaaaggcaggggcgtatccgtccatcgcgaggactgcccgaatgttttaacaaatgaagcgctcgaccggctcattcaagtagaatgggagcatgaaccgcagacccagcggagaaaagaatataacgtcgaaattgagattctcggctatgaccgccgcggtcttcttaatgaagttctacaggcagttaatgagacaaaaacaaatatttcatctgtttcaggtaaatcggaccgcaataaagtggcgacgatccatatggcgatcttcattcaaaatattaaccatttgcataaagtagttgaacggattaagcagatcaaagatatttactccgtgcgcagggtgatgaatt

SEQ ID NO: 4330 - DNA, 1008 bp, Bacillus licheniformis
atggatttcagggaagtgattgagcagcgctatcgacagctgcttagccgttatatatctgaattaacagagacatccctttatcaggggcagaaattcagcagaaaaacgattgaacatcaagtgccgccggaagagattatcagcatacaccgaaaagttctgtctgaattatatccggatcttccagaccatgtgttccattctctcgattttttaattgaagtgatgattggatacggtttggcctatcaagaacatcaaacattaagaggaattcagcaggaaattaaatcggaaattgaaattgccgcgaatgtccagcaaacgctgcttgagacgacggttccgaaagttgaagcgctcgaaatcggtgcggtcagcattccggccaagcaaatgagcggtgattattatcattttgtgcgcgacaaggaatcgattaatatcgccattgcggatgtaatcgggaaaggaataccggctgcgttatgcatgtcgatgatcaaatatgcgatggactctctgccggattcgggcacgtctccttcacaggtgctgaaaaacctgaacagggtcgtcgaacaaaatgtagacccaagcatgtttattacaatgttttatggcaactatcatcttcaaaaacacctatttacgttttcatctgccggtcatgaacctggcttttattattcttgcagggaaaataaattttacgatttaaacgcaaaaggcctcgttcttggcatttcatcaaattacgactatgagcagtacgagcaaaaactggatattggcgatatgatcgttcttttttcagatggtgtaactgaatgccggacagacagcgggtttttggagcggtctgacttgcagaacctgattactgtacatatggagaaaccggctcagcaaatggttgacaatatatacgaacatctgctcaagcttcaggattttcagcttcatgatgattttactctcattgttttaaaaagaaaggtttaa

SEQ ID NO: 4331 - DNA, 688 bp, Bacillus licheniformis
gtgactaaagtaaatattgtaattattgacgatcatcagttattccgtgaaggtgtcaaacggattttggatttcgaacctacctttgaggtagtggccgaaggagacgacggagatgaagcggctcgcattgtcgagcactaccatcctgatgttgttatcatggatattaatatgccgaatgtgaacggagtagaagcgacaaaacaactggtcgacttgtatccggaatcaaaggttattattttatccatccatgatgacgaaaactatgttacacatgcattaaaaacaggagcccggggctatctgctgaaagaaatggatgccgatacgctgatcgaagccgtgaaagtagtagctgaaggcggatcttatctgcatcctaaggttacacacaatcttgtgaatgaattccgccgtcttgcaacaagcggtgtatcatctcacgctcagcatgaggtgtatccggaaatccggagacctcttcacattctcacaagaagggaatgcgaggtactgcagatgctggcggatggaaaaagcaaccgcggaatcggcgaatcattatttatcagtgaaaaaacggttaaaaaccatgtcagcaacatccttcaaaaaatgaatgtaaacgacagaacgcaggctgttgttgtagccattaaaaacggctgggtagaaatgagat

SEQ ID NO: 4332 - DNA, 682 bp, Bacillus licheniformis
atgtttaaactgctgttgatagaagatgatgaatcgctgtttcaagaaataaaagagcggttaaccgggtggtcatacgaggtatacggcatcaacgatttcagcgaagtgatgcaggagtttgcggcgattaagccagactgcgtcatcatcgatattcagctgcctaaatatgacgggtttcattggtgccggcagatccgctcccgttccaacgttccgattctctttttatcttcgcgcgatcatcctgctgatatggtcatgtccatgcagttcggagcggatgattatattcagaagccgtttcattttgacgtgctgattgccaagatccaggcgattttccgtcgcgtctacgactataatacagagcctgagattcttaaaaaaacgtggtgcggtgcaaccgttgatcccgaacaaaaccgcgtcagcaataaggcgggggcgatcgaactgacaaggaatgaaatgttcattttaaaacaattgatcgaccaaaaaaacaaaattgtcagcagggaagaattgatgagaagcctatggaacgatgaacgctttgtcagcgataacacgctgacagtcaacgtaaaccgcttaagaaaaaaactcgatgccttgaacttggggcaatatatcgagacgaaggtcggccagggctatatggcgaaagaagaag

SEQ ID NO: 4333 - DNA, 916 bp, Bacillus licheniformis
atggcgaacgaacaagtattaaccgctgagcaagtcattgagaaggcgaaaagttacctttccgatgaacatgttgcttttataaaaaaggcttatcagtacgcggaagacgcacatcgcgaacaataccgcaaatcgggcgagccgtatattatccatccgatccaggtcgcgggaatcctcgtcgatttagaaatggaccccgccacaatagcgggaggatttctccatgatgtggtggaagatacgagcgtaacgcttgaagatttaaaggaagcattcaacgaagaagttgcgatgcttgtcgacggcgtcacgaagcttgggaaaattaaatataaatcacaggaagaacagcaggcagaaaatcatcggaaaatgtttgtggctatggctcaggacatccgcgtcattttgatcaagctggcggaccgccttcacaacatgagaaccctgaagcatctgccgcaggaaaagcagcgcagaatttcaaatgagacgcttgaaatatttgctccgctggctcatcgccttgggatttcaaaaataaagtgggagcttgaggataccgctttacggtatttaaatccgcagcaatattaccggatcgtcaatttgatgaagaaaaagcgggccgaaagggaattgtacgtcgaagaggtcgtaaacgaagtgaaaagccgcgtcgaagaggtcaatattaaagcggacttttccggccggccgaagcatatttacagcatctacagaaaaatggcgatgcaaaacaagcaattcaacgaaatttacgacttgctcgcagtccggatcctcgtcaacagcatcaaggactgctacgcggttttaggcatcattcatacgtgctggaagccgatgccgggcagatttaaagactatatcgcaatgcccgaagccg

SEQ ID NO: 4334 - DNA, 672 bp, Bacillus licheniformis
ttgtcatactccatttatctagttgaagatgaagagaatttaaatgaattgctgacaaaatacttagagagtgaaggctggcacgtcacttcttttctaaacggtgaaagcgccaggcaaaaaataggccagtcacctcatttatggattctcgatatcatgttaccagatatcgacgggtatacgctaataaaagaaataaaaaatcaagatccggaagtccccgtcatttttatttctgcgcgcgatgccgacattgacagagtgctggggcttgaactgggcagcagcgactatatatctaagccgtttctccccagggagctgatcatccgcgtgcaaaagctgctcaagctgatttataaagaagaaccgcctgagaagaaaaaaggaacgccggtttcctgctatgaagtctatgaagacttgagagaagtctatgaaaatggcagcatgatcaatttgacgtcaaaggaatttgatcttctgcttctatttataaacaaccagggccgcgccttttcaagggaggatattctcaccagcgtctggggagtcgattacttcggaaccgaccgcgtcgtcgacgatcttgtcagaaggctgcgcaagaaaatgcccgaactgaaagtggaaaccatctacgggtttggctacaggatgttgaaatca

SEQ ID NO: 4335 - DNA, 632 bp, Bacillus licheniformis
gtgattcgagtattgttaattgatgatcatgaaatggtgagaatggggctggccgctttcctggaatcccagcctgatattgaagtgattggggaggcatcagacggaaagcgcggcgttgaattggcgcttgaaaccaaacccgacgtgattttgatggatcttgtgatggaagggatggacggaattgaggccacgaaacaaatatgccggcagcttgccgatccgaaaatcatcgttctgacgagcttcgttgatgatgacaaggtctatccggtcatcgaagccggagcgctcagctatttgctgaaaacgtcgaaagcgagtgaaatcgccgatgcgatcagggctgcgagcgtcggagaaccaaagcttgaagccaaagtcgcaggaaaagtgttgtccaagctgagacattcagccggcgaacagccccttcatcaatcgctgacggcaagagaattggaaatcctcaaacttgtagcagagggcaagacaaacaaaggtattgccgaagaattatatatcaccattaaaacagttaaaacgcatgtgacgaacatcctttccaagcttgaagtcgacgaccggacacaagccgcaatctacgcccaccgaaacaaacttgtcga

SEQ ID NO: 4336 - DNA, 732 bp, Bacillus licheniformis
ggaaagaaggattttggaaaatgcgacaattttgattgtggacgacgaagacgccattgttcaaatggtcaagcgcgtcctcacgaaggaaggattttcagaagttctgaccgcaagcagcgcagaagaagcgctcgacatcgtgaaaaaggacaccgtgcacttaatacttctcgatgtcatgatgccgggacagacaggatttgatgtatctcctgaaatcaggcggcacaccaacgctccgatcttcttcttgacggcgaaaacatccgatctcgataaactgtcgggttttgcctacggggctgatgattatattacaaaaccttttaatcctctggaattaatcgccaggattaaagcccatttaaaaagaacgtatatacataaagaagttgcagctgcttcagtatcttcagcctacgaatatgaacgctttatatttcatcccgactttgcggagctgatcgtggacggcgaaacggtcagctgctcggcgcagctgctccagctcctgcaatatttttgcgatcatccgaacagggtgctttccaaggatcaaatttatgaaaaagtgtggggcgttccatcttatggagacagcaacaccgtcatggtacatatcagaaagctgagggagaaaatcgaaaaagacccgagcagccccgaatatattgtcacgattcgcggccttggatataagttcgttcccaatcctgcacgaaaagagag

SEQ ID NO: 4337 - DNA, 534 bp, Bacillus licheniformis
acggcattgaagtatgcaaggaactcagacagaagaagctgatgtatccgattttgatgctgaccgcaaaggatgatgaatttgataaagtgctcggtctcgagctgggtgccgatgactatatgacaaagccgttcagcccgagagaggtgacggcaagggtcaaagcgattttaagaagaacacagacgctgtccgttcagccggaggagacggaagaaccggatgcaggcgagctgatcataggcgaactgaaaatactgcctgaacattatgaggtttattttcaaaacgaacgcctcgagctgacgccgaaggaattcgaacttctcttatatttgggaaggcataaagggagggtgctgacgagagaccttctcctcaacgctgtctggaactacgacttcgcgggcgatacgcgcatcgtcgatgtccacatcagccaccttcgcgataagatcgaaaaaaatacaaaaaaaccggaatacattaaaacaatcagaggtcttggctacaaaatggaggagccgaaac

SEQ ID NO: 4338 - DNA, 683 bp, Bacillus licheniformis
atgcaaaaagtgatgattgtagaagacgacccgaaaattgcagatttgttaaaatcgcatattgtcaaatacggatacaacgttcatgtagtgaaagactttgaccgtgtcatggatgagttcagaagcacggcgcctgatcttgttctgcttgatattaacctgccgagctttgacggctactactggtgccggcaaatccgccaggaatcgatttgccccgtcttgtttatttctgcgcggacaggtgaaatggatcaggtgatggcattggaaaacggcggagatgactttatcaccaagccgtttcacgccgagatcgtcatggcaaaaatacgcagccagcttcgcagggcttacggcgaatacgcggcgaaggcggaggaacggctgctggaaaaagaagggctgcggctgtatccggaaagacttgaactgacatttgccggtcaaacggctgctttgacgaaaaaagaagcggatattattgaaagcttaatggaacgccatccgagaatttcaggccgcgaagatttgctggccaagctgtgggatgatcaggcatatgtggatgaaaacacgcttaatgtcaacattacgcgcgtcagaaaaaaatttcaggagctcggtattgaagatgcagtggaaacagtgcggggcgcgggctatcgcttgaatgtatc

SEQ ID NO: 4339 - DNA, 354 bp, Bacillus licheniformis
gagaagacagaacacagcggctcctgccgaagaagaatcgtcttcaaacgaaattcaaatcggatcgctcgtcatttttccggatgcctatgtcgtttcaaaacgcgacgagacaatcgagctgacacatcgggaattcgaactgctgcattaccttgcaaaacatatcgggcaagtcatgacgcgtgaacatcttctgcaaaccgtgtggggatacgactactttggggatgtccggacagttgacgttacggttagacgccttcgcgaaaaaatcgaggataatccgagtcacccaagctggatcgttacaaggcgcggtgtcggctactatttgagaaatccggaacagga

SEQ ID NO: 4340 - DNA, 681 bp, Bacillus licheniformis
cacttttacgatgaaaatattaatgattgaagataatttaagcgtatgtactatgacagagatgttttttgcaaaagaaggatttgaaacagagttcgtccatgacggactcgaaggatataaccgttttaaatcaggtgattgggatttgctgatcatcgatatcatgctgccgtcgatggatggggtcacgatctgcaaaaaggtcagagaagagagcacggttccgattattatgctgacggcaaaggatacggaatcagaccaggtgctcggttttgagctcggggctgatgattatgtgaccaagccgttcagccctttggcgcttgtggcgagaatcaaagcggtgagccggagatatcaaaacgccggccggcaggattccgctgacagcgacacgcttgaaacggaacattttaaaatcaataaaaaaacgagagaagtgtttttggacggcgttcaaattcaaaatttgacgcctaaggagttcgatttattgtattacttggtgcaaagcccgaaacaggttttttcaagggagcagctgcttgagcaggtttggggataccaattctacggagacgagcggactgtggatgttcatattaaacggctgagaaaaaagcttggcagcgactcgcggccgtttctttacaccgtatggggagtagggtacaa

SEQ ID NO: 4341 - DNA, 683 bp, Bacillus licheniformis
atgaaagcattacaagtatttatcgtagaggatgacatcagaaacgctgacatccaccaaaaactgatcagcaaaattgatggattttctgtcattggaatcgcggaaaattttcaagatgcaaaagatttgcttccggacgtgaagcccgaccttgtcctgctcgacatttttctgccggacggctccggcatggagcttctctggctgatcagacaaacgctcaggcatacagacgtcatgatgattacggcggctaaggaagtcgaatatgttgaacaggcgattcgcgcgggagccgtcgattatttgatcaagccgattatgttttccaggctgaaagaaacgctgttaaactatcggtcttaccggctcaaagtaaatgaaatgtcttcaatcgaccagacagacgttgacagcctgatggcaaaaaggcggagcatcacgaaagaacaaattgctaaagccgattatccgaaaggaatcgacggactgacgctgaaaaaagtagccggcgttttaaacaaaagcgaaaacagcgatggcatcaccgccgaaagcctcgggcgcaccatcggtgtcagccggacgaccgcaaggcgctatttagaatttttagctgccgaaaagcatgtaaaaacagaactttactatggaaccgtcgggcggcccgaacggcgcta

SEQ ID NO: 4342 - DNA, 601 bp, Bacillus licheniformis
atgattcgtttaattattgccgaagaccaaagaatgctgttaagcgcgctgggatccttgcttgatctcgaagaagacatggaagtgatcggccaggcgacaaacggcgaagaagcgctcaccgccattctgaagctagaaccggacgtctgcctcatggatatcgaaatgccggtcaaaagcggactggaagtggccgaagagctcgcaaagcaaggcgcaaaaacgaaaatcatcatcctaacgacgtttgcgcgtcccggctacttcgaacgcgccgtcaaaagcaatgtccacggctacctgctcaaggacggggaaatcgacgatctcgcagacgccatccgaaaatgcacggaaggcaaaagaacctttagtccggaacttaccttcaacgctgtccgcgaaacaaacccgctcaccgaacgcgaacaggacatcttgcgactggcatatatcggaaagacgacaaaagaaatttctgaggagcttttcttgtcgtcagggaccgtccggaattatatttctgagattatgcagaagctggatgcgaaaaaccggatggaagcggcaaggattgcggaggggaaaggatggattt

SEQ ID NO: 4343 - DNA, 702 bp, Bacillus licheniformis
atggaaaaaacaaaaatactgattattgaagatgatgaagcaattgctgatttgctttcatacgggctgacgtccgaaggctttgaaacgtgcacggtcaataacggttcttcaggaatgaggaaactagatcagttcaaacctgaccttctgctcctcgattggatgctgccggactgcagcggattggatatttgcaaaaaagtgaccgaaagctgtaatattccaatactgatgattaccgcaaaatcagatatcacggataaaatactggggttggaattcggggccgatgactatattacaaagccgtttgatctgcgcgaagttgtcgcgagaatacgcacgatccttcggcgtctggaacaagcccatcatgtgaacgaacgggaaacggaaaaagtggatgagatccggtttaaaaatattgtgatcgttccgggcgaaagactggtgaaaaaagacggggcagccgtcgaattaactcctaaagaatatgatctgctaatgactttggttgaccatcggggaaaagtttttacccgttcagagcttttggaattcatctggggatacgattttttcggtgacacccgtacagtcgatacccatattcaaagactccgcaaaaagcttgatgcaagcgacttgattaaaacagtgttcggcatcggatataaattcgagaagcaggaggagtag

SEQ ID NO: 4344 - DNA, 609 bp, Bacillus licheniformis
atggcttacatgattagtatatttattgcggaagatcagcagatgctcttgggcgctttaggatcgcttctgaacttagaagatgatatggaagtcgtcggcaaaggcactaccggacaagatgccgttgatttcacaaaaaaacatcggcctgatatatgcattatggacattgaaatgcccggaaagacggggcttgaagctgctgaggaattaaaggatacaggctgcaacattattatcttaaccacttttgcccgccccggctattttcagcgagccattaaagcaggtgttaaaggctatttgttaaaggacagcccaagcgaagagcttgcgagcgccatccgcagcgtcatgaaaggaaagcggatctatgcgcctgaactgatggaagacatgtacagtgaggccaatcccctcacagatagagaaaaagaagtgcttgaacttgtggctgacggaaaaaacacaaaagaaatcgcccaagaactcagcatcaaaagcggaaccgtacgaaattatatctcaatgattcttgaaaagcttgaggtgaaaaatcggattgaagccattactcgttcaaaggaaaaaggctggtttaaataa

SEQ ID NO: 4345 - DNA, 699 bp, Bacillus licheniformis
acagacgaaagagacaaaaatattagtagtagatgatgaggcaagaatcagacgacttttaaaaatgtaccttgaaagggaaaactacaagatcgaagaagccgagaatggcgatgaagccatcgacaaagccctcggcaacgattacgatttaatcctgctcgatttgatgatgccgggaaccgacggcattgaagtatgccgccaagtacgcgataaaaaagccactccgatcatcatgctgacggcgaaaggcgaagaagcgaaccgggtgcagggctttgaagtcggaaccgatgactacattgtgaaacctttcagtccgagggaagtggtgctgagagtcaaggcgctcctaagaagatcatcgcaaacctcttacctgaatacggatacaacggcaaaaaatgtgcttgttttttctcacttatccattgatcacgatgctcacagagtcatggcggacggaacggaagtcagcctgacgccgaaagaatacgaactgctttactttctggccaaaactcctgataaagtatacgatcgtgaaaagctgctgaaggaagtatggcaatacgagtttttcggcgacttgagaacggtcgatacccatgttaaacgtttacgtgaaaaattgaacaaagtctcgccgaaagctgcgaaaaaaatcgtaacagtatggggcgtcgggtataaatt

SEQ ID NO: 4346 - DNA, 656 bp, Bacillus licheniformis
atgaaaattaaagtgatcattgcggatgacaattcattcataagagagggcatgaaaatcatattgagcacttatgatgaatttgaagtgctggcgacggtggaggatggcttgcaggcggtcgaattttgccgcgcccaagctgtggatattgcactccttgatgtccgcatgcccaacatggatggagtggaagctgcgcggctcatttcagaaacgggcgccaagccttttatcttaacaacgtttgatgacgacgaatacatcgtcgctgcgatacggaacggcgcaaaaggctatttgctgaaaaatgccgaacccgagcgaatcagagacgcgattaaaagtgtgttcaacggccatattgtgatgcaggatatcatcctcgacaagattaagtccaatttggcggagcataaagaagcggaacctaagatagacgaaagcctgtttaccgaacgcgagctcgggattatggcgctgatcgccagagggctgtccaataaagaaatttcgaaggagctgtttatctctgaaggtacgattgccaattatatttcctcgattttggggaaaacagggcttgaacatcggacgcaaattgcgatttattatttaaccggtaaagttaacttttaacctgggggacatcaagg

SEQ ID NO: 4347 - DNA, 648 bp, Bacillus licheniformis
gatcagtgaaatggtcgatcattatttaacaaaagaaggatttgaggtcgtgcttggcttttgacggagaagagggcgttcgcttgtttcagcaaggcaattatgatgcgattctgctcgacatcatgcttcctaagctgaatggaatggattttctgaaaatgatccgtgaacagagcaaagttccggttttaatgatttccgcaaaagacggggatgtcgataaagcgctggggctgggctttggtgcggatgattatattgccaagccgttttcgatgatcgaactgaccgcaagaataaaagccgccattcggcgggcaacgcaatattccgtcagtgaaccggcaaatcaaaaaatattacgtgttcacgagcttacggttgatatagaaaatgtatccgtacaaaaaaatggtgaaccgcttcagctgacatcgacggaatggaaaatgctgactttgtttgtgacaaaccctaaaaaagtgtttacaaaagaacaaatctatcgttcggtttggaatgatgattattttggcgatcaaaatattattaacgttcatatgaggcgcttgagagaaaagatagaggatgatccttcctccccgcaatatattaaaacgctttggggcatcggctataaattag

SEQ ID NO: 4348 - DNA, 615 bp, Bacillus licheniformis
atgatgattcgcaagggcatccgtgtccttttggaaggcttttctggaattgaaattgcgggagaaagcaataatggcaacgaagccgttcttagcgccggacagttaaagccggatgtcgtgctgatggatttgtcgatgccgaacgggttggacggattcacagcgagcagtgagatccgaaagttgaatccttctgttaaaatcgtgattttgacaatgcatgatgaggaaatttttgtccaaaaagcaatagaggcgggggcgcatggctacgtcttgaaaaacagccattatcggttgctttatcaggcgattgtcgaagtgtacaggagcaatctcttttacaaaacatctgtatcgcaagacatcattgatcaatggctcaattcagagcccaaaaagccgacctctgtattaactgtccgcgaaaaggagattctcagattcattgtgctgggttatgccaataaggagattgccgataaactctcaatcagcgtcaaaaccgtcgaaaaccacaaaacgaatatgatgcagaagttagatctggactcgaaacacgaattgattcaatatgcgatcaaaaataaatatctcgatctgtcgttgtaa

SEQ ID NO: 4349 - DNA, 374 bp, Bacillus licheniformis
gtgaaaatcatcattgccgatgatcatcatattgtcagaaaagggctcttgtttttcttcaaaacaaaaagcgattttgatgttatcggagaggcttcgacaggtatcgaggcgctcgatgtcttgcgaaaacgtgaggcagacatcgtattaatggatttatcaatgcctgatatggacggcattgaggcgacaaagcgaataaaaaaggaatatccgtctgtcaaagtcatagcgctgacaagctatgcggacgagagctatgtgattcccgccatccaggcgggagcctgtgcctatcagctgaaagacgccgagcctgatgaacttgtcgagacgatccgcgcagtttaggcgggagatactcatggaca

SEQ ID NO: 4350 - DNA, 506 bp, Bacillus licheniformis
atgatacgcgtgttgttagtagacgactacagggttctgacatccggaatgaaggaaatattaaaaaaatataatatggatgtcatcgtttgccacgaaggaaatgaagctctcgacctcttaaaaaaccaagaggtacatatagacgtttttctttatgatttaaaaatgccggggatgaacgggttggaactgtctcttaaaacgctggaaatcgaacctcaatccaaaattatcattatgttttcgggagatgaaattcactcatattttaataagttgatcgaggccggagttaaagggtttatagataaatcgtatacagacagcatgatagcttcgagtattttattgtgtttaaaaggggctgtgttatttcccgacggcttgctgcaaaaactgagactcgactccgatctctcggtggacgagcatttaacagacacagaactggatattttgcagaaggtcgccagcggtaaaacagatatagaggactcccaagg

SEQ ID NO: 4351 - DNA, 240 bp, Bacillus licheniformis
atggaaattctcgaggtccgaaaggccgacttgctgctgttggatatttacatgccggatgagatgggcacaacattgattcctgtcattcgaaaacggtttccggaagtggatatcatgatcatcacagcagcaaccgaaacatgtcatttacaggaatcgctccgggcgggaattgtgcactatttgattaagcctgtgactgccgaaaaattcaaacagggtgctgcttcaatataa

SEQ ID NO: 4352 - DNA, 228 bp, Bacillus licheniformis
atggacgttagtctagactttactgttctctcagagacgcccaaatcaaaggcaatcgctttgcttttaagacctttagcaattgcttttagaactatgacttccttttctgtcagctgcgtatcactgctctgcttcttcatccgctccaattggatttcttgcagacgttttaagatatcaggctgcaatagcacgtttcctcttattgctgcgtccatcgtatga

SEQ ID NO: 4353 - DNA, 1599 bp, Bacillus licheniformis
atgaatatctatgacatgatgaaactccctgtatttaaaggcgcaacgcttgccgctggaaaggcgggcgtaacccggaacattgaacacatcaatatgatggatgcgccagatattgccgattatctgcatcatggcgaactcctcgtcacgaccgcataccatttaaaagaccggccttttttattgaaggaattgattgaaaggatgatcaggcggggctgcgccggactcggtatcaaaacccgctttttgcaggaaatacccgacgaggtgatcaagcttgccgacgagcggacatttccgatcatcgagctaaatgaagatgtccgcctcggtgatattgtcaatcatacactgagccatattctagacaaacggacggcagaactcgaacaggccatcgccgctcaaaaaaagttcacaagccatattatgagcggaaaaagcattcaatcgctcttgcataacgtctctgctgttttaaagcttcccgttcttctattcaatcagcacctcaagccgattgcctcctcaaaagcagatgccgccgggacgctgtcggattatgaaggaatatttcaaaaaggaaacagaacggggctcacctgtttttcaacgattcccgacaaacaaacctattcggtatttccgatctatactcatgaaaaaaaatgcggcttcctcgttgtctgcgggatgatttccccttcagacaaaggcttgctgttaaccctcgaacaagccgccaatgtcatcgcctttgagctgctgaaggaaaatgcgctcaaacaatatttgcgaagagcgcggaacgagtttttcagaaattttttggacggcgccttttcctctgctgaagaaattaaaaaccgagcaaaagaatttcagctcaagtgggatcaaaaatatgtgtgcatcgccggcaaattggaccgccgcgaaaaatcgctcagcttcacggaaaatcagcttgaatcagattccgtgttcgaacgcctggaagaagagctggttgacttcccgtttcctccgcaccttttcacaaaaggaaacatatgcttcctgctggccgaggcgacggacagctgggctgaaatgaatgcagccgtgggcggatttttaaaggcgtttcagcgccatgcatctgagcattttcagcggacgatttcttttggaatcagcaacctcagccatcagctgagagacgttccgcacatttgcaaagaagccgtcgatgcgctccactccggccatttgtcaggcagcaccgagttcatccagacgtaccatatgaaagacgtgtcagagcttttgcgcatgattccggctgatgatttgaagacattttacacgcatgcgctgcatcagcttgccagcctgccgaaggatgacccagggctcctgcaaacattgtccgtctatctggaaacgcactgtcagatttctgaaacggccaagcgcctgtacatccacagaaacaccgtcatctacaggcttgaaaaatgcgaggaactgctcgggaaaagcctgaaagatgcggacacgaccttgcgcttgagactcgcgctcagaattcaaatgctgcttgggttgtga

SEQ ID NO: 4354 - DNA, 1228 bp, Bacillus licheniformis
atggaagagctattagaacaagttgtttctctttcaaacattaatgagatcattgactttatcagcggggagctgaaaaagccggtcatactggaaagcgcagattttttcttattagcttacaactcctattatattaaccattttgatgcagcaaaccagcaaacgattttctccaaaaaatgtccgctgccgatctttgaaaagttcgtcgaagaaggcattattgatcaattgaaaacgattccgactccttttcgggtaaaacagattgaagaaatcggcttaaaccagcgggttgtcgtcagcgccaagcataaagacgaaataatgggctatatctgggtgcaggagattgaagacaacctgtctgatgaagagcttgatttcttatatcaagcttcctttcatgtcgggaagatcatttataagaaaaaacgcctcaaacaagaaaaagaagaacaggcggaagagctttacaaaaaggcaattaacgatcagtttcaaacggaaaaagagctgaaggccgccgccgataaagcgaacgtcgtcctgccggccgtgtttaccgtcatggtgcttcaagtcgttgacggggaggatgaactgctcgaagatctaaaggaaacgatccggtcttatttaaacctgaaagacaacatcagtcacgtactggaggatcattcgaatatcgcaatcattgtcggcagtgtgtcgcgcaagcgttccgcgctggccgctgcctcagaactgatcaaccgtctgttgacccatctgcgctcgcaaatgctgccccttattttgatcggggtcggcaatgagtacagcagcctgctctccctcggcaaaagctacagagaggcgctccaagtgacgaaagcagcggagatcacgggaagccaagaacacattccctatgaatatcaaaagctcgggcttttcaaatatcttgaccaaatcgccgcaaaaaacgatcatctgcaatatgtaaacccggaccttcagctgctgaaagaaaaagataaagaaagccacaccgaatttttaagaacgcttgaaatctatctcgtcaacaattgcaaggtcaagccatccgcagaacagctgtttatccaccaaaacacgctcaactaccgaattaaacaaatattggaaatgacatcgattgatctcaatgattttaatacaagatgtcagttgtttatcgatttaatgctgatgaagaaag

SEQ ID NO: 4355 - DNA, 1017 bp, Bacillus licheniformis
gccccgcgcgcagcgacagaaaccgagctcgagcttgttcacacgggcgattatatcaggggccgtccagcttgcaggggcgggaaagctcccggcagccgaaagcgaaaactacgggcttggaacggaggatacccctgtttttgccgggatgcatgaagccgcctcccttttggtaggcggaacgctgacggctgcagactatgtcatgacgggcaaagctagacacgccctcaatcttggaggcgggcttcaccacgggttcagaggaagggcttcaggcttttgcgtctataatgacagttcagttgtgatacgttacttgcagaaaaaatatcatgcgaaagttttatatattgatacagacgcccatcacggcgacggggtgcagtttacgttctatgatgatccttccgtctgcaccgtctcgatacatgaaacaggccgctacctattcccgggaacggggcaggttcaggaaagaggtcatggcgaaggctacggctatgcttttaatatcccgctcgatgccttcacagaagatgagtcttttcttgattcctaccggacggctgtttctgaaatagccgagtttttcaaaccggatgtcattttgtcgcaaaacggagctgacgcacattactacgatccgctgacacacttgtgcacgacgatgaagatttacgaagagattccaaagctcgctcacgaacttgcacacacctattgcagcggaagatggatcgctgtcggcggaggcggctacgacatttggcgcgtcgtaccgagggcatgggcaagaatctggcttgaaatgaaagggatggaaccagaggagaaaatgcctgaaaaatggctgaaaaaatgggggaaacaggcatctgtccggcttcctgccaactggtccgacccggaagatttgtatcctccaattccaagaaaaaccgaaataacggaaaaaaacgcacaaaccgttgccaaagccctttatccgattcgctctgcccagcgtaccac

SEQ ID NO: 4356 - DNA, 1614 bp, Bacillus licheniformis
atgacaacattaaaagaaatattatctgtactgcaattttcagatttaacattgctgaatgagcagggcgatttggaacgagtggtagaaatggttgatattacagaaacgcctgatattaaaaattttacaacgccgcactcacttatcgtcacaacaggaatgagctatcaggatgatcaatccggactaatcaatcttattagagagttaaatgatatacaagttgctggtctaggtatcaagctatcccgatttttaaaaaaattagatgatgaggttattgcatttgcaaataaattaaaattcccaattattgaaattccggaaagttggaatttgggatccattactcatcatatatcttcatttatcttggatgaagaaacagaaaaattacacttcgcattagatatccaacaagagttaaatgctatgctaatgcaagggtttagcctgaacatgatgattgaacgtttaagtagactcataaaggttcctgtaatgctgctaaattcttttcatcaagttgaatcatcgagtcatcactttcatcaaaactcagaacatgttcaaaaaaaccttaattatttcagaagatatttaaattcagagcaaaccgaaccaaatcataatggtgttttccaggaagaatatgctgtatttaaggttcctgcatttaaatattttccgtattatcttatgatttcaaatgttaatttgctcaactatccgattagtttattaacaatagaacaggcagtgaacacacttagtctcgctatttataaaaatagtaaaatcaaggaagcagagcagcaggacgtgaaccattttttcacaacacttatgtccgaacatcctgacaaccttgtttcactagcacaacacactgatcttttaaaaaaatatcacattcaaccttctacattctatcaagtgattatttgcgggattgacaaagaaaagaatgtagaaaatagcgcctacttaaatgagcgatatcagatgacttttgagtggctgacgcataagtttactggaattgacccttccattagcatatatatgtctcagggagaacgcagatttacgatacttctgcaaagaagacatcattattatttggaatactgcagatatatccaaaaagagtatcagctattttttaatagctccctttcatttggcattggtaatgaggtttccgagctttcacaattgccactgtcttttttcgaagcgaatgaggcttatgataataaatatgaacaaggcgaaatggaatttatagagccctacaaatccaaaagcgtagaagaattattacaactcattccaacgaataaattaaagccatttatcatttatacactcggtcctttagcctatcctcagacaacgaaggaaaaagaactaagattcacattaagtgtctatatggcaaaccaatgtgatcttacaaaaacctcagaagatatttttattcaccgtaatactgtgaaatatcgtattaaaaaatgcgaagaaatattaggtcaatctgtagagtctcctgatacatcactgagcattcgtttggcgttatttgcttcagagaaaatatcgttgtga

SEQ ID NO: 4357 - DNA, 1239 bp, Bacillus licheniformis
atgaacaatcgaaacaatccttttaaatatcaatatgaccgtttagaagatgtggcagatcatatcagcgaggtgctggactgtccgattacgatagaagacatcaaccaccgcctccttgcttacagcacccacagcgactacacggacccggcgagaacgtcaacaatcatcggaaggcgcgttccggaaaaagtcatcaacaagctttggaaggatggaacgattcccgccttgatgaaaaccgacgaaccgatcagggtcgaacaaatcgatgaagtcggcctgtcgagccgcgtggcgatttcaatctggaaaaacagcgaggttatcggttttatctgggcgctggaaagccaaaaaacgctgtcggaagacgagcttcaccttttgaagctggccgcggattccgtaaagaacaagctgctgccttatcaggtccgaaaaagaaaaaatgaacagcgcagccaggaatttttctggaagctattgaccgggcacatttcggaagatcaggaaatctccgacggctttcaccagcttggcatcggagttccttcaacttattcggtcatcatcatccggctgaaagacgaaatcgaagaaaaaaccgaaaagcagctccattacttgctggaaacgacgcagcagctgcaaatccttctggctacaatcgactataatgagctgattgtcctcgcttcgccaaaaacggggcaaaaagggcagccgttcaatgatttaaagcaatttgccgcgaatatacaaaagcaacttgaagagcgctataaactgaataactgcacgatcgcgatcggcggaatgtacagcttgatcacccttgtacaccagtcttatcaggaagcgctctcggcgctgaaggtcaaggagcgttttcccgatgagacaaggcacctcgtcagcttttcagagctcggcatctaccagtatctcgacgtgctcagcgaaaaacggaaacatgcaagctatccaaactattctttaatgcagcttgaagcatatgataaagagcaccactccaatcttgtcgagacgcttgaacaattcatcgaatgcgacagcaacgtcaacaccgccgcaaaaaagctgaacattcacgtcaacacgctgaattacaggctgaaacgcatcagcaaaatcgccgaaatcgatttaaaaaacatcaatgaaaaatttacgatttatcttgaaatcaagcttcgcaacatgcatttgtga

SEQ ID NO: 4358 - DNA, 444 bp, Bacillus licheniformis
  misc_feature (1)...(444): n = A,T,C or G
aaatgctgccccttattttgatcggggtcggcaatgagtacagcagcgtgctctccctcggcaaaagctacagagaggcgctccaagtgacgaaagcagcggagatcacgggaagccaagaacacattccctatgaatatcaaaagctcgggcttttcaaatatcttgaccaaatcgccgcaaaaaacgatcatctccggtttgccccganngaccttnanntgctgaaagaaaaagataaagaaagccacaccgaatttttaagaacgcttgaaatctatctcgtcaacaattgcaaggtcaagccatccgcagaacagctgtttatccaccaaaacacgctcaactaccgaattaaacaaatattggaaatgacatcgattgatctcaatgattttaatacaagatgtcagttgtttatcgatttaatgctgatgaagaaag

SEQ ID NO: 4359 - DNA, 942 bp, Bacillus licheniformis
  misc_feature (1)...(942): n = A,T,C or G
atgggtcgcaccttctttaaaatcattcataaaaggctggatcgacggaacaatcaccatttaaaaaacgatcttaggcaggagcatgatgaaatgaattacctatcaaaagaattggcggaggaaattgtcgaaagaaccatgtcgattattcggcacaacattaatatgatggatgaaaacggggttatcatcgcttcaggagaccgttcgagaatcggtgatgaacacgcaggagcgaaggacgcacttgcagctgaaaaggttatcagcatcacgcccgaagaatgctcggctttaacgggaacgaagcccggcgtaaaccttcccatcgtatttcatgatgaaataatcggcgtcattggaatcacggggccgccttctgaagtcagccgttacggagaacttgtcaaaatggcagcggagctaacagtcgaacaggcatttttaacaaaacagctgacatgggatcaaaggctccgcgaagaaacggtcatccaaatgattcaggggactgatctagcatcccttgacttctttgaacgtgcagagcgattaaacataccgcttgacggccagcgtacttgtcttgtgtttgagctcccatcggctgatatgaagccggcgtttattaaaaaacttgaaaagcatttaaccgcgaaagatttgtacgccaatatttctttaaaagaggtcgcagttattctggcaggcgcccccactaaaagcaggtctgatctcttttcagcttggaacggctggctcagccaatggaaaacagtcagaggcgcgcttggcgagcaggctgaccagcttcagcagctgccattttcctatcaaagtgcanaacaaacgctcaagattgctgaaanacattgtagtttatacgattatcgagagtttgcgattcctgttttattatcaaaaatagagcattccgat

SEQ ID NO: 4360 - DNA, 864 bp, Bacillus licheniformis
atgctggagaaattaaagacgctttacggtgaacggatggttggatctaaggctgtttcaaagcacgatgcattatggtttcaaaccgacgaaggcgaaactttcggcgttttgaaaagcgcggtcaccgaccgggaaaaagagctgctctattgcctattccggcctttttcagaaccgcatcgtccgcagcagctgacaaagcgggagaaagaatggcacgaatatttcttttgcgatgcccccctccaaaacccgggaaacattcagctgattcaaggccatttttttaaaatggagcatgcccctgaagaaagacaggcgattaaagaagcggtcagcggcttttttaaagacccgcttgttgtatggtacgaccggcatgaagccgttatcgtccacgaaaatccttcaccgtttctcgcaaaaaaagagctgtccgagcttgcggatgcactgacaagcgatttcatggcaactcctgtgtttttcagcggccagcttcatccagtcaacggatcgcttcaaggcaaaatccgctttgaaaaacaaatgtttcattacatgctggaagcgggtgacatcggaaacgtcgccacgttttgccagtgcctcccgtcttttttgacggcaaaaccggagcgggttcatgcttcttcattttcggacgccgtaagagaagcgctgtctgatcccgagacatccctgaccatcaaaacgtatatgagatgcaacctgaatgcctctcttacagccaaacgtttgtttatccaccgaaacagcctgcagtacagaattgataaattatcgaacggactgcaattgacatcagacagtttgaagaagcagccgctgtttatttga

SEQ ID NO: 4361 - DNA, 76 bp, Bacillus licheniformis
ggggccttagctcagctgggagagcgcctgctttgcacgcaggaggtcagcggttcgatcccgctaggctccacca

SEQ ID NO: 4362 - DNA, 77 bp, Bacillus licheniformis
gggcctgtagctcagctggttagagcgcacgcctgataagcgtgaggtcggtggttcgagtccactcaggcccacca

SEQ ID NO: 4363 - DNA, 74 bp, Bacillus licheniformis
ggggccttagctcagctgggagagcgcctgctttgcacgcaggaggtcagcggttcgatcccgctaggctccac

SEQ ID NO: 4364 - DNA, 77 bp, Bacillus licheniformis
gcgcccgtagctcaattggatagagcgtttgactacggatcaaaaggttaggggttcgactcctctcgggcgcgcca

SEQ ID NO: 4365 - DNA, 75 bp, Bacillus licheniformis
tccgcagtagctcagtggtagagctatcggctgttaaccgatcggtcgcaggttcgaatcctgcctgcggagcca

SEQ ID NO: 4366 - DNA, 77 bp, Bacillus licheniformis
ggtccggtagttcagttggttagaatgcctgcctgtcacgcaggaggtcgcgggttcgagtcccgtccggaccgcca

SEQ ID NO: 4367 - DNA, 75 bp, Bacillus licheniformis
ggcccgttggtcaagtggttaagacaccgccctttcacggcggtaacacgggttcgaatcccgtacgggtcattc

SEQ ID NO: 4368 - DNA, 75 bp, Bacillus licheniformis
gcggaagtagttcagtggtagaacaccaccttgccaaggtgggggtcgcgggttcgaatcccgtcttccgctcca

SEQ ID NO: 4369 - DNA, 74 bp, Bacillus licheniformis
gcgggtgtagtttagtggtaaaacctcagccttccaagctgatgtcgtgagttcgattctcatcacccgctcca

SEQ ID NO: 4370 - DNA, 73 bp, Bacillus licheniformis
  misc_feature (1)...(73): n = A,T,C or G
gcgggtgtcgttttgtggtaaaacctcagccttccaanctgatgtcgtgggttcgattcccatcacccgctcc

SEQ ID NO: 4371 - DNA, 77 bp, Bacillus licheniformis; identical to SEQ ID NO: 4362

SEQ ID NO: 4372 - DNA, 83 bp, Bacillus licheniformis
gcgggtgtggcggaattggcagacgcgctagacttaggatctagtgtctttacggcgtgggggttcgagtcccttcacccgca

SEQ ID NO: 4373 - DNA, 88 bp, Bacillus licheniformis
gccggggtggtggaattggcagacacacaggacttaaaatcctgcggtaggtgactaccgtgccggttcaagtccggccctcggcatt

SEQ ID NO: 4374 - DNA, 76 bp, Bacillus licheniformis
gagccattagctcagttggtagagcatctgacttttaatcagagggtcgaaggttcgagtccttcatggctcacca

SEQ ID NO: 4375 - DNA, 76 bp, Bacillus licheniformis
ggcctgtagctcagctggttagagcgcacgcctgataagcgtgaggtcggtggttcgagtccactcaggcccacca

SEQ ID NO: 4376 - DNA, 77 bp, Bacillus licheniformis
cgcggggtggagcagttcggtagctcgtcgggctcataacccgaaggtcgcaggttcaaatcctgcccccgcaacca

SEQ ID NO: 4377 - DNA, 77 bp, Bacillus licheniformis; identical to SEQ ID NO: 4362

SEQ ID NO: 4378 - DNA, 69 bp, Bacillus licheniformis
tagctcagttggtagagcatctgacttttaatcagagggtcgaaggttcgagtccttcatggctcacca

SEQ ID NO: 4379 - DNA, 77 bp, Bacillus licheniformis
cgggaagtagctcagcttggtagagcacatggtttgggaccatggggtcgcacgttcgaatcctgtcttcccgacca

SEQ ID NO: 4380 - DNA, 85 bp, Bacillus licheniformis
ggaggggtagcgaagtggctaaacgcggcggactgtaaatccgctccctcagggttcggcggttcgaatccgtccccctccacca

SEQ ID NO: 4381 - DNA, 61 bp, Bacillus licheniformis
cacaacgcctgaaggaaaagtcctgctaagggcttatgtagggaaagccggcgatgagtac

SEQ ID NO: 4382 - DNA, 76 bp, Bacillus licheniformis
gccggtgtagctcaattggtagagcaactgacttgtaatcagtaggttgggggttcaagtcctcttgccggcacca

SEQ ID NO: 4383 - DNA, 76 bp, Bacillus licheniformis
ggaggattagctcagctgggagagcatctgccttacaagcagagggtcggcggttcgatcccgtcatcctccacca

SEQ ID NO: 4384 - DNA, 75 bp, Bacillus licheniformis; identical to SEQ ID NO: 4365

SEQ ID NO: 4385 - DNA, 77 bp, Bacillus licheniformis; identical to SEQ ID NO: 4366

SEQ ID NO: 4386 - DNA, 75 bp, Bacillus licheniformis
tgggctatagccaagcggtaaggcaacggactttgactccgtcatgcgctggttcgaatccagctagcccagttt

SEQ ID NO: 4387 - DNA, 74 bp, Bacillus licheniformis
ggcccgttggtcaagtggttaagacaccgccctttcacggcggtaacacgggttcgaatcccgtacgggtcatt

SEQ ID NO: 4388 - DNA, 75 bp, Bacillus licheniformis; identical to SEQ ID NO: 4368

SEQ ID NO: 4389 - DNA, 73 bp, Bacillus licheniformis; identical to SEQ ID NO: 4370
  misc_feature (1)...(73): n = A,T,C or G

SEQ ID NO: 4390 - DNA, 86 bp, Bacillus licheniformis
gccggggtggtggaattggcagacacacaggacttaaaatcctgcggtaggtgactaccgtgccggttcaagtccggccctcggca

SEQ ID NO: 4391 - DNA, 84 bp, Bacillus licheniformis
gcgggtgtggcggaattggcagacgcgctagacttaggatctagtgtctttacggcgtgggggttcgagtcccttcacccgcat

SEQ ID NO: 4392 - DNA, 77 bp, Bacillus licheniformis; identical to SEQ ID NO: 4376

SEQ ID NO: 4393 - DNA, 69 bp, Bacillus licheniformis; identical to SEQ ID NO: 4378

SEQ ID NO: 4394 - DNA, 31 bp, Bacillus licheniformis
gaaatcgggcaggcggtcaacccggactcga

SEQ ID NO: 4395 - DNA, 74 bp, Bacillus licheniformis
gccggtgtagctcaattggtagagcaactgacttgtaatcagtaggttgggggttcaagtcctcttgccggcac

SEQ ID NO: 4396 - DNA, 73 bp, Bacillus licheniformis
  misc_feature (1)...(73): n = A,T,C or G
gggtgtcgttttgtggtaaaacctcagccttccaanctgatgtcgtgggttcgattcccatcacccgctccta

SEQ ID NO: 4397 - DNA, 85 bp, Bacillus licheniformis; identical to SEQ ID NO: 4380

SEQ ID NO: 4398 - DNA, 76 bp, Bacillus licheniformis; identical to SEQ ID NO: 4383

SEQ ID NO: 4399 - DNA, 77 bp, Bacillus licheniformis; identical to SEQ ID NO: 4364

SEQ ID NO: 4400 - DNA, 77 bp, Bacillus licheniformis; identical to SEQ ID NO: 4366

SEQ ID NO: 4401 - DNA, 74 bp, Bacillus licheniformis; identical to SEQ ID NO: 4369

SEQ ID NO: 4402 - DNA, 77 bp, Bacillus licheniformis; identical to SEQ ID NO: 4376

SEQ ID NO: 4403 - DNA, 76 bp, Bacillus licheniformis; identical to SEQ ID NO: 4361

SEQ ID NO: 4404 - DNA, 77 bp, Bacillus licheniformis; identical to SEQ ID NO: 4364

SEQ ID NO: 4405 - DNA, 73 bp, Bacillus licheniformis
tccgcagtagctcagtggtagagctatcggctgttaaccgatcggtcgcaggttcgaatcctgcctgcggagc

SEQ ID NO: 4406 - DNA, 75 bp, Bacillus licheniformis; identical to SEQ ID NO: 4368

SEQ ID NO: 4407 - DNA, 77 bp, Bacillus licheniformis; identical to SEQ ID NO: 4379

SEQ ID NO: 4408 - DNA, 76 bp, Bacillus licheniformis
gcttccatagctcagcaggtagagcacttccatggtaaggaagaggtcagcggttcgagcccgcttggaagcttaa

SEQ ID NO: 4409 - DNA, 76 bp, Bacillus licheniformis; identical to SEQ ID NO: 4361

SEQ ID NO: 4410 - DNA, 77 bp, Bacillus licheniformis; identical to SEQ ID NO: 4364

SEQ ID NO: 4411 - DNA, 75 bp, Bacillus licheniformis; identical to SEQ ID NO: 4368

SEQ ID NO: 4412 - DNA, 86 bp, Bacillus licheniformis
gcgggtgtggcggaattggcagacgcgctagacttaggatctagtgtctttacggcgtgggggttcgagtcccttcacccgcatta

SEQ ID NO: 4413 - DNA, 88 bp, Bacillus licheniformis; identical to SEQ ID NO: 4373

SEQ ID NO: 4414 - DNA, 76 bp, Bacillus licheniformis; identical to SEQ ID NO: 4374

SEQ ID NO: 4415 - DNA, 77 bp, Bacillus licheniformis; identical to SEQ ID NO: 4379

SEQ ID NO: 4416 - DNA, 76 bp, Bacillus licheniformis; identical to SEQ ID NO: 4382

SEQ ID NO: 4417 - DNA, 76 bp, Bacillus licheniformis; identical to SEQ ID NO: 4383

SEQ ID NO: 4418 - DNA, 76 bp, Bacillus licheniformis; identical to SEQ ID NO: 4361

SEQ ID NO: 4419 - DNA, 77 bp, Bacillus licheniformis; identical to SEQ ID NO: 4362

SEQ ID NO: 4420 - DNA, 76 bp, Bacillus licheniformis
gcgcccgtagctcaattggatagagcgtttgactacggatcaaaaggttaggggttcgactcctctcgggcgcgcc

SEQ ID NO: 4421 - DNA, 75 bp, Bacillus licheniformis; identical to SEQ ID NO: 4365

SEQ ID NO: 4422 - DNA, 72 bp, Bacillus licheniformis
tgggctatagccaagcggtaaggcaacggactttgactccgtcatgcgctggttcgaatccagctagcccag

SEQ ID NO: 4423 - DNA, 75 bp, Bacillus licheniformis; identical to SEQ ID NO: 4367

SEQ ID NO: 4424 - DNA, 85 bp, Bacillus licheniformis
gcgggtgtggcggaattggcagacgcgctagacttaggatctagtgtctttacggcgtgggggttcgagtcccttcacccgcatt

SEQ ID NO: 4425 - DNA, 86 bp, Bacillus licheniformis; identical to SEQ ID NO: 4412

SEQ ID NO: 4426 - DNA, 76 bp, Bacillus licheniformis; identical to SEQ ID NO: 4374

SEQ ID NO: 4427 - DNA, 78 bp, Bacillus licheniformis
gaagaaatgaatgaaaaagctgaagaggcggcccgttttatgaatggaatggccgaagcgctcagagacggagtcaaa

SEQ ID NO: 4428 - DNA, 65 bp, Bacillus licheniformis
ggggcattagctcagctgggagagcgctacactggcagtgtagaggtcagcggttcgagcccgct

SEQ ID NO: 4429 - DNA, 72 bp, Bacillus licheniformis
ccagtagctcaggtggatagagcaacagcctcctaagctgtgtgtcgggagttcgaatctctcctgggacgt

SEQ ID NO: 4430 - DNA, 75 bp, Bacillus licheniformis
gtcccagtagctcaggtggatagagcaacagcctcctaagctgtgtgtcgggagttcgaatctctcctgggacgt

SEQ ID NO: 4431 - DNA, 75 bp, Bacillus licheniformis; identical to SEQ ID NO: 4386

SEQ ID NO: 4432 - DNA, 73 bp, Bacillus licheniformis
tgggctatagccaagcggtaaggcaacggactttgactccgtcatgcgctggttcgaatccagctagcccagt

SEQ ID NO: 4433 - DNA, 75 bp, Bacillus licheniformis; identical to SEQ ID NO: 4367

SEQ ID NO: 4434 - DNA, 72 bp, Bacillus licheniformis
ggcccgttggtcaagtggttaagacaccgccctttcacggcggtaacacgggttcgaatcccgtacgggtca

SEQ ID NO: 4435 - DNA, 74 bp, Bacillus licheniformis; identical to SEQ ID NO: 4369

SEQ ID NO: 4436 - DNA, 76 bp, Bacillus licheniformis; identical to SEQ ID NO: 4375

SEQ ID NO: 4437 - DNA, 85 bp, Bacillus licheniformis; identical to SEQ ID NO: 4380

SEQ ID NO: 4438 - DNA, 74 bp, Bacillus licheniformis; identical to SEQ ID NO: 4395

SEQ ID NO: 4439 - DNA, 85 bp, Bacillus licheniformis; identical to SEQ ID NO: 4380

SEQ ID NO: 4440 - DNA, 76 bp, Bacillus licheniformis; identical to SEQ ID NO: 4383

SEQ ID NO: 4441 - DNA, 55 bp, Bacillus licheniformis
tagctcagctgggagagcgctacactggcagtgtagaggtcagcggttcgagccc

SEQ ID NO: 4442 - DNA, 77 bp, Bacillus licheniformis; identical to SEQ ID NO: 4366

SEQ ID NO: 4443 - DNA, 74 bp, Bacillus licheniformis; identical to SEQ ID NO: 4387

SEQ ID NO: 4444 - DNA, 76 bp, Bacillus licheniformis; identical to SEQ ID NO: 4374

SEQ ID NO: 4445 - DNA, 67 bp, Bacillus licheniformis
tagctcagttggtagagcatctgacttttaatcagagggtcgaaggttcgagtccttcatggctcac

SEQ ID NO: 4446 - DNA, 1553 bp, Bacillus licheniformis
ttcatggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttccaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttct

SEQ ID NO: 4447 - DNA, 2929 bp, Bacillus licheniformis
ggttaagttagaaagggcgcacggtggatgccttggcactaggagccgatgaaggacgggacgaacaccgatatgcttcggggagctgtaagcaagctttgatccggagatttccgaatggggaaacccactgctcgtaatggagcagtatccatatctgaattcataggatatgagaaggcagacccggggaactgaaacatctaagtacccggaggaagagaaagcaaatgcgattccctgagtagcggcgagcgaaacgggaacagcccaaaccaagaggcttgcctcttggggttgtaggacactctgtacggagttgcaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagtttgaaaagacggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaaagacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttgcgaacagtggtaggagagcgttctaagggctgtgaagcgagaccggaaggactcgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggcaagcgcggtattggatatccgcgtccaagcagttaggctgggaaataggcaaatccgtttcccgtaaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgctgcccttatcgggcagggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattcctataaggaagtaagatccctgaaagatgatcaggttgataggtctgaggtggaagtgtggcgacacatggagctgacagatactaatcgatcgaggacttaacc

SEQ ID NO: 4448 - DNA, 112 bp, Bacillus licheniformis
tttggtggcgatagcgaagaggtcacacccgttcccatgccgaacacggaagttaagctcttcagcgccgatggtagttgggggcttccccctgtgagagtaggacgccgcc

SEQ ID NO: 4449 - DNA, 791 bp, Bacillus clausii
aagaattcgattttgcatgcgcttgcagaagagcggctgctcttgttggcaaacagccaatcgatcggcgcaggcagccagccactgctggcaaatattcgggcaagcctgctttacttattggaagactacgatattcaccctacattaacggtgctaatttggaaacatgctgccgagcacgaagatagcctgctcacccattggaagcagctgctagaagaaacaaaagaagagtgggttgctggcgccatcgactacagcttactcgcccacattattaacagccatgttgcttatgggttgcatgcatttcgccatgaaccgacttgcatcggtcttgttgaaaaaataatgactcttgtagagacaagttttggcaccatttcaaaaagaaggagacctttttccatgaagaaactcgtcgtattaggagcaggatatggaggtatgcgcttgttacagcgtttgttgccaaacgatttgccaaaggactgggaaatcatccttgtcgatcagctcccttaccattgtttaaaaacagaatactatgccctagccgccggaacagcatcggaccaccatttgcgtgtctcttttcccgaagatgagcgcttgcgcatcaaatacgcaaccgttacggccatccatttgcacgattcaaccattgatcttgacaatggcgagtcgattccgtttgacaaactcgttatcggcctcggttgcacagacaattaccacggcgtgcctggagctgaccagtatacgtatagcattcaaacgatgggcgc

SEQ ID NO: 4450 - DNA, 708 bp, Bacillus clausii
aagtgaaaccacttaatggcttgcgtgtaattggcaaatttggtgactcagtcacaacggaccatatttctccagctggagcgattggcaaaaatacgccagcaggtcagtatttgatggaaaaaggcgttaaaccaaaagactttaactcatatggctctcgccgaggcaaccatgaagtcatgatgcgtggcacgttcgccaatatccgcattcgtaaccaaatcgctccaggcacagaaggcggctacacgacttattggccgactggggaagtgatgtctatttatgatgcagctatgaaatacaaggaagacaatacgggccttgtcattctagccggccaggattacggcatgggttcttctcgtgactgggcagccaaaggtacgaacttgctcggcatcaaaacggttattgccgaaagctatgagcgtattcaccgttccaacttggtgctcatgggcgtgttgcctcttcaatttaaagcaggcgaaagtgcagaatcccttggcctgacaggaaaagagacgatttctgtcgccatttccaacgatataaaaccacgggattatgtgacagtgacggctgttagcgaagatggcaagaaaacagaattcgaggcgcttgttcgtttcgatagcgatgtagaaatcgattactatcgccatggtggtattttgcaaatggtgttacgtgaaaaattgg

SEQ ID NO: 4451 - DNA, 183 bp, Bacillus clausii
tcagaacgccgagtaaagcgaaaagggatcgcgttgttgtcattggaacggggcatgtaggcagcagttatgccttcgcactgatgaaccaaggggtggcaaaggagcttgtcattattgatatagatcaagaaaaagcaagtggcgatgtgatggatttaaaccatgggcaggctttcgctc

SEQ ID NO: 4452 - DNA, 599 bp, Bacillus clausii
gtggcagcacatgaaacgataaatccaaacgaaccacttgaatatcaatcatctgaaggccgcaacaatatcctaggtttctggatttttcttggcgctgaattcgctttgtttgcaacgctgttcgcctcgtattttgtcctcgttgacagaaatgccggggcagtgccgtctgcggaactgtttgatttaaaccttgtgttaattatgacgttcctgcttttgacaagttcgtttacttgtgggatcgcgatccatgaaatgcgtgccggtagaatgaaacaaacgcttgtctggattggtttgacgcttttactaggccttggctttgttggctttgagatatacgagtttatccattatgtccatgaaggggcgaccttgtcggcaagcgcccattggtcaacattctttgtgctgcttggcacacacggcttgcatgtctcgatcggcatcggctggattgtgttgttggcgattcaaatgctaaaacgcgggtttacgccacggacaacgtctaagtttttcatcgccagcctgtattggcactttttagatgttgtatggattatgatctttaccggcgtatatttgctagg

SEQ ID NO: 4453 - DNA, 237 bp, Bacillus clausii
aaatgccgatccaaattaccagaaaatccatatgccaagcaatacatggcttggaccagtgatgagtttgatgatgttcattgcttcctttgccctcgtatttagttggttcccgcttgcgattataggcggtattggaattttcatttgcatgatcatccgttcctttgattacaacgacgggtattatgtaagtgtagaagaaattacagaaattgaaaataaagcgagggaggc

SEQ ID NO: 4454 - DNA, 675 bp, Bacillus clausii
tttctgtaccaactgtcataaccatttataatttggaagaagctcctgaagtagctgaaggcagcgtccaagttgatccgcttgtcattcacgcaacaagcgtaaactggaaatggatctttagctatccagaggaaaatattgaaacggtcaactatgtcaatatccctgttgatcgtccagtccagttcaaattgacttcagcagattcaatggcatcgttttgggtaccgcagcttggtggacaaaaatacagcatgtcgggtatggaaacagaattgtttttaatggctaatgaaccaggcacgtacaacggccgtaatgcaaactttacaggcgaagggttcacggagcaacggttccttgttaatgccgtaacagatgagagctatgattcatgggtggaagaagtgcaagcggaagcaccaccattgtcagaagaagaatacgcacatctaatggttccaggtcacgctgaagaaatgacattctcttcaacacatcttgagtttgtcaaccatgcttatgatccgacatacgcgcttgagaaaagtgcagaacttggatatgagccactaaatccgcattcgacagaaggcaaagcgtacgaaatgccaaaactgacgcaaccaattgacacatcaagaacatataaagtggaattggatgatgagt

SEQ ID NO: 4455 - DNA, 669 bp, Bacillus clausii
  misc_feature (1)...(669): n = A,T,C or G
tattcaagaccagatacatgcctggcatagagccaattaaccgtatagctttgaagactatagagcatttttgnaagagattggctacttggagcctgaagtcgatgactttcaaatcacgacccaacatgtggatgacgagatagccgttcaagctgggcctcaacttgtggttccagtgaacaacgcacgctttgccattaatgcggcgaatgctcgctggggcagtctgtatgatgctttgtatggaacggatgtgattagcgaagaggcgggcaccgacaaaggaaatgggtacaacccagttagaggagcgaaagtgattgcgtttgcgaagcaatttctggatgatacggtacctttgaatggaggttcccacaaggatgccgtgcagtacagcatcgtagacggtgctctagcagtaacgcttggcgacggaacgacaacaggtttgaaggaccgtacccagtttaccgggtatcaaggcgagacggcagcgccatccgctttgttattcgtacaccatggccttcacttagaaattcagatcgatgccacacatcctattggccaaaccgatccagcaaacgtaaaggatattgtgctagaggcagcgattacgacgattatggactgcgaggactctgtgacggccgttgatgctgaaga

SEQ ID NO: 4456 - DNA, 657 bp, Bacillus clausii
atggctaaaattattgcaattaatgcaggaagttcatctctcaaatttcaactgttggcaatgccagaagagacagtcattgcgaaagggctggttgagcggattggcttaaaaaacagtatttttacaatcgaagcaaacggccaacagcatgaattgactgaagatattcctgaccatgctgcagcggtaaagcttttgcttaaggacttaactggccgcggcatcattgcatccttagaagaaattgaaggcatcggccaccgtgttgttcatggcggcgagaaattcaatgattccgttgtaattacagataaagtccttcaaggcattgaggaagtatcagaattggctcccctccataaccctgccaacattacaggtattaaagcctttaaagaagtccttccaaatgtacctgctgtagcagtgttcgatacggctttccaccaaacgatgccagagagcgcatttttatatagtttgccctatgaatactatgagaaatatggcattcgtaaatatggattccacggcacttcccataaatatgtcacacatcgtgcagccgaattaatggagacgccaattgaagaattgcgtattctttcctgtcatttaggcaacggtgcaagtattgctgcggttaaaggcggc

SEQ ID NO: 4457 - DNA, 510 bp, Bacillus clausii
  misc_feature (1)...(510): n = A,T,C or G
aatgattaagaaggccgggctgctagaggaagtgacagtggcgcttgcagggcgtcgctatggcttatttttagaagtggagccagaaccagcattttcggttgtggaagcgtgcaaacaaacatttgtcgctggcggccatgatggcatgattgccataggagncggcagtgccctcgatacagcgaaagcgacggctgcttacgttcgttataacggtgcacttgctgatttgattggcactgatttagttcctataaaaggggtgccgctcattgccattccgaccacagccggaacaggctccgaggtaacgaatatagcgattctgtccgacgatgacgctaagctaaaaaaagggattgtcagtgaccatttgcttcctgatgtggcaatcgtttctccggaattatcaaggacaaccccacctgccgttacagctncgagcggcatagacgcctttgtccatgggattgaagcgtttttatctgtaaacgcatcaccccttac

SEQ ID NO: 4458 - DNA, 285 bp, Bacillus clausii
acatttttaccaacgtccgcgacgccgcctatgaaataattcataaaaaaggcgccacttattatgggattgccatgagtttagtccgcatcacaaaagcactgttaaaaaatgaaaatgcagtcatgaccgtcagcacatttcttaatggcgagttcggagcgaaagaagtatgcatagctgtacctgcaattgtaaaccgtaatggtgtccgtgaagtgcttgaactgaagttgaacgaccttgagcggcaacagttcactgagagcgtccagatgctaaaag

SEQ ID NO: 4459 - DNA, 504 bp, Bacillus clausii
ttcgccgaaaccagcaagtacaccaaacttgtttatccttggtcttggagaacggagcgccatcgaagcgggccggcgggggttaggttttgtccatgggcgttttatcgagcctggacgagggaggttggcacacgctgcatatcgacaagcgtttaagggcaaagggaagccagatgcgttaacggccgtatttatcatttgcggcgaaacggacgagcatgctgaagagttggcaaagacccaagatttatggttaatgcggacggaaaaaggtttagatagccgcgtgccaaccagcataacagccgcctctgctcagctaagcgaacaagaccgtgcccgtatccaggcgaatcggaagcggatgattattggcgggcctgaaactgtaaaacgggaattagaaaaaatcgcgaatgaaacaggctgcgaccaatttctagttttaacgaatatcgatgattttgatgaaaaatgccgttcttatgaacggttggtgaa

SEQ ID NO: 4460 - DNA, 432 bp, Bacillus clausii
  misc_feature (1)...(432): n = A,T,C or G
aaagatgaggcttgaagtgtttttaatgggtgctggccaccatattggtgcttggcgccaccccaaagcagcagctgatgcntacgaaagcatcgacttttatagacaagtggctctgttagctgaaaaagggaagcttgatatgttgtttattagtgatgccctgtcattgacagaaaanagccatccgtctgagttggtccgattcgaaccgcttacgctcgtgtctgctctagcaatgacgacagctaaaattggattggcggctaccgcaagcacgacttataatgacccgtttcatatcgcccgcaagtttgcatcnatcgnccatttaagtaatggccgctctgcttggaacattgttacctcttattatnaanagnaagcgtacaacttcggcgatttgcctcacccgccacatgcanagcgtta

SEQ ID NO: 4461 - DNA, 308 bp, Bacillus clausii
  misc_feature (1)...(308): n = A,T,C or G
taaaagaggatntagatgcctttgcatcaggcgggcaaacggaagnngcggcagctccaaaagaggaagaaaagactgcttcctcaaaaccagcagctacggcacaagccggcggaaacgancagtnggaaaancgcgtaccgcttaaaggcatccgcaaagcgattgcaaaagcaatggtgaactcaaaacatacggctccacacgtgacacatcttgacnaagtcnacgtgtcagcccttgttgcccatcgcaaacagtacaaacaaattgctgcaaaccaaggcacgaaactgacgtatcttcca

SEQ ID NO: 4462 - DNA, 756 bp, Bacillus clausii
  misc_feature (1)...(756): n = A,T,C or G
ggagaattgaaaaaataattggcgcagcattaaaaggaaaacgctccgactttattatagccacaaaggctggaaatcgttttgagaaggggaaacaaggctgggagtgggacccttcgaaacaatatattaaagaggcagcaaaagcaagcttgcaacgcctacaaacagattacatcgacttgtaccaactccacggcggaaccntcgatgatccaatcgatgaaacaatagaagcatttgaggaactgaaacaggaagggcttattcgcgaatacggcatttcctcgattcgccccaatgtgatccgcacatatgttgaacagtcttccattgtgtcgattatgatgcaatacagcattttagacaggcgtccagaagaatggtttccgtatttagaggaaaatggcattagcgtcgttgcccgtggcccagtagcgaaagggattttaagcgaacgccccttacatacggttgctgctgcttctgacggttacttggattactcagtcaaagaaattgaacaattgcgggacgtccttatgcaaacttacggaaaaacatactctttgacaaaagtggctttcgattattgtttggcccatccgccagtagcagcagttgtagctggtgccagctcgatagagcagctaagacaaaatgcccgctcttgcaaggaaaagccactgttacagacagaaattgacaacatcgaacgaattactaaacaaagccaatacacgcaacatcgttcat

SEQ ID NO: 4463 - DNA, 507 bp, Bacillus clausii
aagacgtgtttaatgctaagtcttcttttgacctgaatgggaaaacgtaccattactatgcgcttgatgcgctggaaaaagccgggatcggaaaagtcagcaagctgccttactccgttaaagtcctgcttgaatccgtattaaggcagtacgatgattatgtcattaaaaaagagcatgttgaaaacctagcaaagtggggcacaaaggacgtaaaggagatcgacgttccatttaagccttcacgtgttattctccaagattttacaggtgttccggcagtcgtcgatttagctgcgctccgcaaagcaatggctgacctcggaggaaatcccgaccaaatcaatccggaaattccagtcgaccttgtcattgaccactctgttcaagtggacaaattcggaacagacgattcattgctctataatatgaatttggaatttgaacgcaatgcagagcgctaccaatttttaaattgggccaaaaaagcattcgacaaattacaat

SEQ ID NO: 4464 - DNA, 921 bp, Bacillus clausii
  misc_feature (1)...(921): n = A,T,C or G
agatgaggcttgaagtgtttttaatgggtgctggccaccatattggtgcttggcgccaccccaaagcagcagctgatgcntacgaaagcatcgacttttatagacaagtggctctgttagctgaaaaagggaagcttgatatgttgtttattagtgatgccctgtcattgacagaaaanagccatccgtctgagttggtccgattcgaaccgcttacgctcgtgtctgctctagcaatgacgacagctaaaattggattggcggctaccgcaagcacgacttataatgacccgtttcatatcgcccgcaagtttgcatcnatcgnccatttaagtaatggccgctctgcttggaacattgttacctcttattatnaanagnaagcgtacaacttcggcgatttgcctcacccgccacatgcaaagcgttacgaacgancagcagaattcgtcgaggtcgcnaaaaaactgtggcgtagctgggaaagaggggcagtcatccgaaatcaacaaacagggatttactttgacgcaaacaaagtccatgccgtcaaccataaaggcaaatatttttcggttaaaggccccttaaatgcatcggcgctgccgcaaggggagcctgtcctgattcaagccggttcctccacttatggcactaagtttgcagctcgatacgcagatgttgtctttacagcacaacagcatttaagaggggcaaagcgattttaccgtaacttaaaagagcaagtcgccgccgccgggcggctgccggaagaggttctcgtgatgccaggcatttcgccgataacagccaactcaaaagaagaagcanaggcgatttacgaagagttgcagtcgctgttagatgaggaaacgagtttggcttttttatcagactatttagggaaagtatctttttcga

SEQ ID NO: 4465 - DNA, 558 bp, Bacillus clausii
atggtagaatcaggagcgattgaccgcattttggattttgttactaaaaaggtcgcaaaaggggtacgttctgcagaattatctatcatttttgttacaacgcttatttctacacctatttcgcataatacagttgcagcgttacttgtaggtccaggatttgttagaaaaattggcgataggtttaatctgtcaccgtcccgaaaggctatcctgatggattgttctgtcacaaccctttatttcacgattccatggcatagcacgatcatcacatggtacgggcagctatccttagcggctaataaatggggaattccgttgccaaatattttaatccgtacgcctggtctctttttatcatcattgttattgctgccattacaggctggaaacgaacttatgctactcaaaagaatgatgaaagcacggcgatatgagtatgggctaaaaaggatagcgttttttcagtcgtgccatttttatttaaaaaattgtcaattcaacctgcctcgtgggctgttcgccatcgtaagcattttcttagttggccattga

SEQ ID NO: 4466 - DNA, 332 bp, Bacillus clausii
gtgaagaaaaagtgatcgaagctgattacgtccttgtgacagttggtcgtaaaccgaacacagaggaaatcggccttgagggcatcggggtagaaatggatgaccgtggctacattaaagtagacaagcaaggccgtacgagcgtgaaaaacattttcgcgatcggcgatattgttccaggtccggctcttgcccataaagcttcttatgaagctaaagtagcagcagaagcgatcagcggcgaaccttcagaagttgattatctcgcgattcctgccgtttgcttctctgagccagaattggcgacagttggctacaatgaagcacaagca

SEQ ID NO: 4467 - DNA, 816 bp, Bacillus clausii
  misc_feature (1)...(816): n = A,T,C or G
agccgaaggaaagcctgtccatagccgagaaggcganctaagccgctatatttatacgccatctggcgtcgccgttgntatttcaccttggaactttgcgtttgcgattatggcaggcacaacggtggcccctcttgtcactggcnnnnnnnnnnnnnnnnnnaaaccagcaagcacaacaccggtggttgctgctaaatttgtcgaagtgttagaagaagcaggcgttccgaaaggtgttattaacttcgtcccaggaagcggcagtgaagtgggcaattaccttgtcgaacatcctaaaacagcgcttatcacatttacaggttcacgggatgtcggcgtccgcttgtatgaaaaagcggcaatcgtccaagctgggcaaaaccatttaaaacgcgtgatcgtggagatgggcgggaaagatacagtcgtcgttgacaatgaagccgatattgacacggcggttgaagcgatcgttatttccgcatttggcttctctggacaaaagtgttcagcgggctcacgcgctgtcatccatgaggacctttatgacgaggttgtcgcaaaagtagtggaaaaaacagaagcacttaccgttggcaacccggcagacgctaagaactattatatggggcctgtcattgaccaagcggcatttgacaagattacaggttatattgaaattggcaaatcagaagggaaactagttgctggcggcaaaagcgacgatgcagaaggctatttcattcgcccaacggtttttgccgatgttgatccaaaagcacggattatgcaggaagaaattttcggccccgt

SEQ ID NO: 4468 - DNA, 354 bp, Bacillus clausii
acattataagagcaggattagagagtatcgtgtaccaggtaaaagacgttgtacagcttatctatcaagatacgaatgtagctgtaaaagaattaaaagtcgatggcggtgcaacaacaaatgcatttttaatgcaatttctatctgatgtacttggaattagagtgatcgtctcaaatgtttccgagttatcggctctaggttctgcataccttggtgggctcggcatacgtttatgggattctatcgaagtgattgaccaactaaggaatgaacaacatatttttgagccgaaaatgagtccaaaaaaaagagaaaagttctattcagaatggaaaaatgcaattcacgcac

SEQ ID NO: 4469 - DNA, 407 bp, Bacillus clausii
atgaatattttcgttgtgttaaaaagaacatttgatacagaggaagccattaccattcaaaacggcaaagtccaagaagagggcgccgaatttattattaacccgtatgatgagtatgctgtcgaagaagcacttgtgcttaaagaagcacatggcggagaagttacagtcgtcacagttggagaagaggaagcagaaaagcaacttcgtacagcattggcaatgggagcagacaaagctgttttgattgatagagaagagcttgaagagagcgatcccgcaacaacagcagcgctattgtatgcctactttaaggacaaagaagtcggcattattttggccggcaatgtagcggttggcggcggttcaggccaggtcgggccacggcttgccgaattgcttggcat

SEQ ID NO: 4470 - DNA, 324 bp, Bacillus clausii
atcaccattcctccatcgcccaagaagaaattttcggccctgtcctggctttatttgaagtggacggcatcgaagaagcgcttcgtttggccaatgatgtgccatacgggttaagtgcttcaattttcacaaaagatattgccaatatgcttgcctttattgaggatatggacgctggtctcattcgggtcaatgccgaaagcgcaggagttgaactgcaagccccatttggcgggatgaaacaatccagctcccattcccgcgaacagggggaagcagcgaaagagttttttacagcgaccaaaacggtttttgtaaaagcat

SEQ ID NO: 4471 - DNA, 675 bp, Bacillus clausii
  misc_feature (1)...(675): n = A,T,C or G
aagaagaacttatgaagcgctcaacaacgttcgccctgaagggtcgtctacattggtggcggtggttaagcngtgttgagcttgctagtgaactgcgggaaagccggccgatttaacgattcgctatttgaccgcggcgattacatttgtcaatggtttcgaaaaattaagcacgtatgtacaaaactggtttgtcgaacacggagtcgatgtcagcaataattccaacattacaaaagtcgagcctggcgcgatttacaaccatgacgagcgcatcgaaacagatgcagttatttggacggctggcgttcagcctgttgatgttgtccgtgcccttgatgtggaaaaagaccgttctggccggattgtgttgactccccaacactttataccagatcatcctgatgtttttgttgtcggcgactgtgcaagcctgcctcatgctccaagcgcccagcttgccgaatcacaagcagagcaaattgtaacgattttaaagcatcaatggaaatgcgaggaattgcctgagacgttaccgcgcattaaattaaaaggtgtgctcggttcactcggcaaaaaacacggctttggcatgatgggtgaaagaccccttaccggcagagtgccgcggattttaaaaagcggcgtgctgtggatgtataaataccattctgg

SEQ ID NO: 4472 - DNA, 350 bp, Bacillus clausii
atgaagaaactcgtcgtattaggagcaggatatggaggtatgcgcttgttacagcgtttgttgccaaacgatttgccaaaggactgggaaatcatccttgtcgatcagctcccttaccattgtttaaaaacagaatactatgccctagccgccggaacagcatcggaccaccatttgcgtgtctcttttcccgaagatgagcgcttgcgcatcaaatacgcaaccgttacggccatccatttgcacgattcaaccattgatcttgacaatggcgagtcgattccgtttgacaaactcgttatcggcctcggttgcacagacaattaccacggcgtgcctggagctgacca

SEQ ID NO: 4473 - DNA, 210 bp, Bacillus clausii
cttacttcaactatataaatggagagtggatagcatctgaaagcaatataacagaggcaagcacgaatcccgccaaaatggatgaggtggtgggctattttcaaaaatcgacgcagggagatttaaataaagctgtgtcctcagcaaaacaagcacagcagcagtggaaaaaactgaccggaaatgtacgcggcgatttcttattgaaaa

SEQ ID NO: 4474 - DNA, 1215 bp, Bacillus clausii
  misc_feature (1)...(1215): n = A,T,C or G
aaaagaaatcaaacgaataataaaagcagataaccgaattttaacggaagtggcagatcgcagtagttatggctatgatgcgtcgttcggctaccacttacctgatcttgtgatccagccaaccgccactgaagaagtagctgcagtcatgaagttagccaatcagtacttcatacccgtctatccaagggggcaagggacaagtttaagcggtggcccactcccagttaaaggaggggttgtgctcgatttatcccagtggaacgacaagctggtgattgacaaagaagacatggtggccattgtctctcctggagtgatcacagcaaaaatcgatgctgccgcaagggagattggctttatgtacccgcccgatccaagtagttctcatgtatcaacgattggcggaaatcttgctgaaaatgcaggagggccaagaggattgaagtatggcgtcacgaaagattatgtcctcggcttagaagtagtaacaccagaaggagaaattattcgtacagggggaagaacggttaaaaacgtgaccggctatgacttaacaaagctcattgttggttcagaagggacgcttgggatcattaccgaagcaacgctccgcctcgttcctaaaccaccagccagccaaaccgccatggcgctttttgaagacattgtcgattcaggacgggcaatttctaaagtattaactgctggcattgttccagccaaaatggagctgatggaccaactgtccatccaggcagtcgaagcatacgaaccacgtggtttgccaaccgacgttggggcgttgttgttaatcgagctagatgggcaccctgtatcgatcgctgaggagatgacaaaagtcaaggaactgtgcaaaagcgtaggagcaagaacggtccgagtggcagagaatgaaaaagaagcggcggaattttggcaggcgcggaagctcgtttctccagcgattgttcgagtgaagccaacgaaaatttccgaggatgccaccgtgccccggagtaaaataccagagatgtttcagcggttgaaggaaattcgcgaaacatatcaaatcgatcttgtcgtgtttggccatgcgggcgatgggaatttacncccgaatattattgccgatggtcgtgatcacgaggaaatggaacgagtcgaaaaagcagtggctgacattttcacagcagcggtcgaacttgggggaac

SEQ ID NO: 4475 - DNA, 351 bp, Bacillus clausii
atgaggaaattggttgagtttattacaatggcacctacttcaggagatggcacgagcatttccaccggaaacgctggctggacaacggcaaaaggaacaacgcagcgtgagccttctttttcctatataaaggaaattgccgaagcggctgaagccggcggctttacgtcgctattgcttccaacaggcgctggctgcttagattcagtagcggtagctgccaatttgattaactggacccaatcattggaatttttatatttgccgttcgacctggcgtcatgtcgccaacgacgtttgctaagcaatttgccacgatcgacaattggtcggaaggaagggcgcaagtga

SEQ ID NO: 4476 - DNA, 345 bp, Bacillus clausii
tgatttctgtcgccgtcatgtttatttttgcgatactcttttttggcattatgcaagatgcaggcttgtttgaccctgttatcaataaagtgcttgccctctcaaaaggaaatgtcattggcgtagcagtagcaacagtgatcgttgcctgcgtcgctcatctcgatggctcgggagcaacaacgttcttgctgacaatcccggcgcttttgcctacttacaagcgtttacagatgagcccgtatttgctcttgcttttagtcggtctaggggcaagcattatgaatatggtgccgtgggcaggaccggtggcgcgcgttggtaccgtacttaatatgagcgccg

SEQ ID NO: 4477 - DNA, 299 bp, Bacillus clausii
  misc_feature (1)...(299): n = A,T,C or G
caagaggaagtgttcgctccngtagtgccgataatggaagtcgattcttttgaagaagcgatcgcngtcgccaatcagacagattttggtctctcttcggccatttatacaaccaatttgcaaaaagcccatgaatttgttcgccgaattgaaacaggggtgactcatattaacatcccttccaaccactacgaaaaccaattgccttttggcggcaagaaaaattcgagcattgggccgcgggaacaaggaagcactgcccttgatttttgggttgacacaaaagcagtctatcttaa

SEQ ID NO: 4478 - DNA, 504 bp, Bacillus clausii
agaaagaaggcgtatttgtttttcgcacaatccgtgattgtgaacggttaactgaatgggcgactcgttaccaaaaagcggctgtcattgggggcggtttgcttggtcttgaagccgcccaagggctggctcatttaggcgtcgacgtaagcgtcattcatctttctgaccgaattatggagcgccagctcgacgaaacggcagcccggctgttgaaacagagccttgagagcaaagggattcgctttttgttacaaaaacaaacagcggaaattagcggcgaggagcgggtaacaggtcttcgttttcaagatggaaccactctttctgctgattttgttgtcatggcagctggcgtccagccgaacattgccattgccaaggaaagcaacattccaacaaagcgaggaattgttgttgatgatcgtctacgcacggacgtttcaggtgtgtatgccgtcggcgaatgtgccgaacataacggaatcagctatgggttagtgg

SEQ ID NO: 4479 - DNA, 491 bp, Bacillus clausii
atttaacaaaaaagattttaattgccctaggcatcggggtgattgttgggttgtcattgcctgcgatccatcaaggcacctttgaatggctaaaccaatatgtgtttgatcctgtaggaagcgtctttttaaatatgattatgatggtcgttgtgccccttgtgtttttctcgcttgtagtgggggtttccgatttaggtgacccgaagcaacttggccgcatgggcgtcaaaacgattgttttcttcatggcaacttctgctatttccttatcaattgctctttttgctgcttcggttatccaaccaggtgatcctggcttacttggcgaaggcatagctgaagagtacgagccgtctgagtcagtgccgatcatggatacactggtcaacattattccgagcaatccagttgcgtccatgtcagagatgaacatgctacaaattatcgcctttgcgatttttgtcggcattgcaatggctgtactagga

SEQ ID NO: 4480 - DNA, 582 bp, Bacillus clausii
atttatttgctgtcattaaacggcaagtagagtctcataagccaagtatcgtcttacctgaaggaacagacgaacgggtattgcaagcagcggccaaacttgctgccgataacgttgtaaaaccgattgtcataggggataacgatgcaattttagcgcttgctgataaattaaagattacactagaaggaatgacgatttacaatccagagacatatcctggaatcgatgaaatggttgacgccttcgttgcccggcgcaaaggcaaagaaacggaggagtctgcgcgcaagctgttacaagatgtgaactattttgggacaatgcttgtctacatggaaaaagccgacggcctcgttagcggcgctgcccattctacgggagatacggttcgcccagccttacagattattaaaacacaacctgggattaagcgcacgtctggcgtttttgtcatggtcaaagaagacaaaaaatttgtctttggtgattgcgcgatcaacatatcgccaaatgaagaagagttggcggaaattgccactgctacagcggataccgcgaagctatttggtatagaaccaa

SEQ ID NO: 4481 - DNA, 708 bp, Bacillus clausii
atgacattttttcaagatgtattctcggtattcaaaaagagagaattggtttttcaacaaagctacaaagaatccgatgacatctattcttttctttttgaaaaagagcacgatgtaacatggaaagcaggacaatatggattattcagtattacgcataaaaaagtgaaaaatcctacaaaaccgttcagcatagcctctgcccccacagagaatgtcataaaaataacaacgcgcattagcaataaccccagtgattttaaaaaagcaatgctcgaattaaaaccaggtatgaaagtaaaaatgagcgggccagtaggagcttttactcttcaagaacaaaagccctcactcctgatcgcaggaggaattggcatcaccccatttcgatcgatcctcaaacaactagaggcagaaaagactggggacatcaaaccgattcgtctcctctatttggatagcaaaaagtcgtacttatttaaagacgaacttgatgccattgccaaccatacgtccattcacgtgacttaccttgattcacaagacagcttgcatcaagagattgaccagtttgctgcttcacatcaaaacaatggcgtttactttattgcaggaccaaaatccatggtcgattccattaccacttgcttgaaaaacaaacatatttcgaaacagcatattaagaaggatgcttttttcgggtattaa

SEQ ID NO: 4482 - DNA, 471 bp, Bacillus clausii
ttcttctttaaaagggcatttgcacggcggcgccaatgaagcagttatgtatatgctccttgatgcaaactcacctgaagagtttgaaacgcttctatcgaataagttaaagaaaaaagagaaaataatgggatttggccaccgagtgtatatgaaaaaaatcgatcctcgggctcttattatgaaagaggcgcttgctgaactttcacaagctgctggagatgacagactcctgaaaatgtgcgaggcgggagaggctcttatggcaaaagagaaggggctttatccaaatctagactattatgccgccccggtatactggatgttaggcatcccaatcagcttgtatacccctattttcttttcttcccggacagccgggctaagcgcccatgtaatcgagcaacatcgaaacaacaagttatttaggcctcgggttaagtatacagggccacgttatacatctgtaca

SEQ ID NO: 4483 - DNA, 486 bp, Bacillus clausii
ccgcccaagaagggttaaaaacagcgctcgttgaacaaggattgctaggaggcacatgcttgcataaaggctgcattccaagtaaagcattgctaagaagcgcggaagtgctgcgcaccgccaaagaagcaagcgtgtttggcgtcgcaactggaccagtcgcatttgattttgccggtgcgcaaaaacggaaacaagagattgttgatcggttggctcaaggtgtaaaggcgttaatgtcgaaagggaaaatcgatgtttacgaaggaagagggcgcatgctcgggccatcgattttttcgccaagcccaggcacaatatcggttgatttggctgatggcgacaatcaaatgcttattggcaaaaatgtcatcttggcaacagggtcggtaccaagaccacttccgcatacaccctttgatggcaaacaaattttaagttccgatgacgttttgcagctaaaagagctacccgcgtcgatggtgg

SEQ ID NO: 4484 - DNA, 384 bp, Bacillus clausii
caaagcattgaagcgttgttttcaagtaccaccagggctgaaagtggtgatgccttcgactccttacgatgtcaaaggtcttttgaaagcgtcgattcaactcgatgatccagtattgtttttagagcacaaacgggcttaccggttaattaaaggcgaagtgcctgaagaggagtacacgttgccaattggcaaagcagacgtaaaacgggaaggagacgatgtgacggtcattacctatggattggctgtccatttcgccttgcaagcagctgaaagactagaaaaagacggaatttcgacgcatattctcgatttgcgcaccgtttatcctcttgatcagaaagcgattaaagaagcagcaagcaaaacggggaaagtctt

SEQ ID NO: 4485 - DNA, 246 bp, Bacillus clausii
  misc_feature (1)...(246): n = A,T,C or G
ccccaatgtgatccgcacatatgttgancagtcttccattgtgtcgattatgatgcaatacagcattttagacaggcgtccagaagaatggtttccgtatttagaggaaaatggcattagcgtcgttgcccgtggcccagtagcgaaagggattttaagcgaacgccccttacatacggttgctgctgcttctgacggttacttggattactcagtcaaagaaattgacaaattgcgggacgtcct

SEQ ID NO: 4486 - DNA, 824 bp, Bacillus clausii
attacaaaccaacgggaaacaacagtcgtctgggataaacatacaggaaaaccgatatacaacgctttggtttggcaatcacggcaaacagaaaagatttgcgctgatttgcgggagaagggcttaaacgagacattccgtaaaaaaacaggcttactgcttgatccttatttctctggcacaaaagtaaaatggattcttgaccatgttgatggcgcaagagaaaaagctgaaaaaggcgacctattgtttggcacaattgattcatggctcatttggaaactaagcggcggccaagcacatgtgaccgattatacaaatgcggctcggacgctcatgtacaatatccacgagttgaaatgggacgacgagctgcttgaactgcttgatgttccaaagcaaatgttgcctgaagtccgctcctcttctgaagtatacgccacaactgttgactaccatttctttgggcaaaatgtgccaattgccggcgtcgccggtgaccagcatgcggctttgttcgggcaagcgtgttttgaaaaaggaatggtaaaaaacacttacggcactggctgttttattttgatgaatacaggggaacaagcggttgagtcgaaaaacggacttttgacaacgctggcatggggaattgatggaaaagttgagtacgcccttgaaggcagtgtatttgttgccggttcggcgatccaatggttacgggatggccttaaaattattgaaaacgcgccgcaaagtgaaacgttagcgacacgggtgacgtccgctgacggtgtctacttagtccctgcgtttgttggccttggtac

SEQ ID NO: 4487 - DNA, 534 bp, Bacillus clausii
gtgatgtttctgcttatattccaacaaacgttatttcgatttcagatggacaagtgttcttacagtccgacttgttccactcaggcgttcgcccagcagtaaacccagggatttctgtatcccgtgttggtaattcagcacaaattaaagcgatgaaaaaagtagtgggaacgctgcgtcttgacttggctgcataccgggaacttgaggcgtttgcccaattcggttccgacttggatgcggcaacgcaagcgcgcttgaaccgtggtgagcgcacagttgaattgctgaagcaagatttgcaccagccgcttccggttgaaaagcaagtagcaattatttacgcgctgacgaagggctatttggatgatgtacctgtggctgattgccgccggtttgagtctgaactattcacatatcttgaaagcaacaacaatgaattgcttgagcatattcgcacaacgggcaatttgcctgaagaaagcgatttgaaagcagcaattgaagcgtttaaaaaaggttttgtcgcttcta

SEQ ID NO: 4488 - DNA, 1209 bp, Bacillus clausii
gattacaaggccgtatgaagcagctgatgtcatgcggctaaggggcacgctcgagattgaatacacgattgccaggcgtggtgccgaaaagttgtgggaacttctccatacagaggatttcgtcccggcactaggcgctttaactgggaaccaagcgatgcagcaagtaaaagccggattgaaagcgatttatttaagcggctggcaagtggctgctgatgccaatttgtcagggagcatgtatcctgaccaaagcctttatccggcaaacagcgtaccggaagttgtcaaaaaaatcaaccgcacgctgcaacgcgcggatcaaatttaccacatggaagaaaaagaagacatcgattggtttgcgccaattgtggccgatgctgaggcaggcttcggtggacagctaaacgtgttcgagttaatgaaaagcatgattgaagccggcgccgcaggggttcactttgaagatcagttgtcttctgagaaaaagtgcgggcatttaggcggaaaagtgctgcttccaacgcaaacagcagtgcgtaatttgattgccgcccgcctggcagcagacgtgatgggagtaccgaccattcttattgctcgtacagatgccaatgccgctgacctaatcacaagcgacgtcgattcatatgatgcaccgtttttaacgggagaacgaacagcggaagggtttttcaaaacaaagtcaggtcttgatcaggcgattgcgagaggcttagcgtatgcgccgtatgctgatttaatctggtgtgaaacgtctgagccaaatattgaagaagcacgtcggttcgcacaagcgatccacgagaaatttccaggcaaactgctcgcctacaattgctccccttcggttaactggaaagccaaactggatgaccacaccattttaaacttccagaaacaactcggtgaaatgggctataaatttcaatttgtcacactggcgggcttccacgccttaaccacggcatgtttgaattatcccgccactataaggaccgcggaatggcggcgtactctgatcttcagcaggctgaatttgccagtgaagcccacgggctacacggcaacaaggcatcagcgcgaagtcggcacaagctactttgatgaagttgcccaagtcgtaacaggcgggacttcatcgaccactgccctgaagggatcgactgaagcggaacagtttca

SEQ ID NO: 4489 - DNA, 803 bp, Bacillus clausii
atgaaacatctgctaggcacagcggataatttgctctcttctccgaacgaggagcagaagccggaggagatggtctggcgggaagaagcagtcggcaagctggacctgcttgttgcgcttgattttcgcatgactgcgacgccgatttatgccgatatcgtcctgcctgcagcgacttggtatgagaagacggatctctcttcaaccgatatgcatccgttcgtccatccgtttaatcccgccgttgatcctctttgggaatcgcgctcggactgggatatttacagaacccttgccaagaccttttcagagatggccaaagagcatctccccggcgtacacaaagatttggtcgctacgccgctcgcccatgattctgcgagtgaaattgcccagccttatggcgtcgtcaaggattggcgcaagggcgagattgaagcggtgcctggcaaaacgatgccgaatttgacgattgtggaacgggactatacacaaatttataacaaatatatttcgcttggcccaggactggccaacggcaaggtaggggcgcacggcgtcagcttcccggtggccgaggaatacgaggaactgaagcggatcaacggcatctatgaggacgacacgattaagcagggactgccgaaattgtatacggcacgtcatgcggctgaaaccatattgacgctatcatcagccaccaacggccgtgtatcccagcgtgcctgggaggcgctcgaacaggataccggcgtccagcttgcagatatttcagcggatcggtcagcggagcggattacgtt

SEQ ID NO: 4490 - DNA, 1626 bp, Bacillus clausii
tgactatccttcctgcgggccggatatgcccgaatttgaaccgcgaggctgtccgaggggagcgtcattctcctggtatgagtacagtccgttgcgcgtgaaatatccttatatgcgcggacggctatggcggctctggaaagaggcactcaagcagcacgacgatccagtcgccgcttgggcgagcattgtggaggatcccgagaaggctaaatcatacaagcaggcacggggaaaaggcggccatgtccgcgtatcttggcaggatgcggcacagctaatctccgcccagttaatctatacgatacgcaaatacggtccagaccggatagccggattcacgccgattccggcaatgtcgatgatcagctatgcctcaggcgcccgctttatttctctgctgggaggcgagatgctcagcttttacgactggtatgccgatctgccgccggcttctccgcaaatttggggagagcaaaccgacgtgccagaatcgagcgactggtataacgccggctacctcatcatgtgggggtcaaacgtacctttgacgcgcacgccggatgcccatttcatgaccgaagtacgctataaaggaaccaaggtggtctccgttgctccagattatgccgagaacgttaagttcgctgacaactggctggctccgaatccaggaactgatgcagcgattgcccaggcaatgacacatgtaattttggacgaatattaccataaacgccaggagccaatgttcctgaattatgcgaagcagtatacggatatgccttttctaattttgctagaggagtttgaggatggctataaagcgggccgcttcctccgggcaagtgatctcggggaaacgtccccccacgcggaatggaagccggttcttatcgatgaaataacggaagagattttggtgccaaacggaacgatgggacagcgctgggaagaggggaaacagtggaacttgattttggagcgtgaggacggttcggtcatatcgccggcactttcggtcgaaccccatggaggggattttcaaacgattcattttccgttctttgataacgcaggcagcggcacatttaaacgggtgattcctgttcgaacgatccagttggccgacggaacgaaacgtctggcagcaaccgtgtatgacttgatgctaagccagtacggcatccgtcgtatcggaagcgagtgggaggctggcggctatgaggatgcaacctcgaagtacacgcctgcatggcaggagggcattactggcgtgaaagcctccgttgtcgtacaaattgcccgggaatttgcccaaaattctctggatacaggtggacgctccatgatcattatgggagctgggatcaatcactggttcaacagcgatacgatctaccgggcgattctgaatctggtcatcctcacggcttcgcaaggcgtaaatggtggaggatgggcgcactatgtcggtcaggagaaatgccgcccgatcgaaggctggtcgaccgtagcgtttgcgaaagactggcaggggccaccgcggcagcaaaacgcgacttccttcttctacttcgccaccgatcaatgggaaggtatgagggaggatgggacactgaatcg

SEQ ID NO: 4491 - DNA, 219 bp, Bacillus clausii
gcgcttcacttttaaaagacaagtttaaaaaagcgggcattacgggtatccatgtatcgaatacagccgttagcaacattccagcagacgcggatcttgtcatcacccataaagacttgacagaacgagcgaaacaaaaacagcctgatgctgaacatctatccgtggagaacttcttaagcagtccccgctatgacgagcttgtggagcgtctaaaat

SEQ ID NO: 4492 - DNA, 474 bp, Bacillus clausii
  misc_feature (1)...(474): n = A,T,C or G
aggactgggcatacntcagtcctggatgaagcagtcggtgtgaatgaacatctatatcatatcggagcggtatatattgncggcgcgttcgggtttttgacactcgctggcatggtcctgcttactttttcggcgatttacgatgaagaatgtgcgccagctcagctccgcctcggatatgatcgtgaatgtactgctgctgtttattgtagcggtaggcatgtacagcacccttgtcaccaatgctctacagccggacttcaattaccgtgagacggtgtcggtctggttccgccagctttttatcttccgaccggacgcgggtttaatgacagacgtgccgctgtcatttaaaattcatattaccgctggcttgctcatttttgcgttgtggccgtttactagacttgtccatgtatggagtgtgccgttgaattatatcggcagacgatatatcctttatagaaagcaccg

SEQ ID NO: 4493 - DNA, 738 bp, Bacillus clausii
gcccggtatgcgtgttgcttttgactggcttgacaatggccgagtatttccgcgatgaacaaggcgcagatgtattgttgttcattgacaacatcttccggtttacgcaaagctggttcagaagtgtcgggctttgcttgggcgtatgccttcagcagtaggttatcagccaacgcttgctacggaaatggggcagttgcaagagcgtattacatcgacgaagaaaggttcggtcacatcgattcaggcgatttatgtacctgccgatgactataccgacccagctccggcgacgacatttgcccacttggatgccacaacaaaccttgaacgtaaattgacagaacaagggatctatccagccgtggaccctcttgcctccacatcacgtgccctttcacctgagattgtcggtgaagagcattacaatgttgcacgaggcgtgcaacaaacattgcaaaaatatcgggaactgcaggatattattgcgatcttagggatggaagaactgtctgaagaagataaattgattgtagctcgtgctcgtcgtatccagttcttcctgtcgcagaatttccacgtcgctgagcagtttacaggacagccaggctcttatgtgccggttaaagaaacaatccaaggctttaaagacattcttgcaggcaagtacgatgacctcccgaagatgcgttccgtctcgttggccgtattgaagaagtcgttgaaaaagccaagcaa

SEQ ID NO: 4494 - DNA, 345 bp, Bacillus clausii
  misc_feature (1)...(345): n = A,T,C or G
agtatggctgaacaatgaagacgccgctgctcatcacattcaggacancgactggctcaggtatccaccngaaatggagtggtcacagccagagctgtcgttagccatcggatgccgaaagggacgatgtatatgtaccatgcccagccaaacatatctacgtcccaggttccgaaattacgaaaaaccgcgcggtagccacaatgccccgactcggatccacgtgaagccgacacaagttgtcggggggtatgcccaactgagctatggatttaattactacggaccgatcggaaaccaacgggatgtgtacgtggctgtccgcaaaatgaaagaggtggattg

SEQ ID NO: 4495 - DNA, 152 bp, Bacillus clausii
atgtcaacaggccgtatcattcaaattacagggcccgtcgtagacgtgaaattcccaagtggacagctaccggaaatcaataacgcattgacagtcaaccagcaaggcgcagccgatggcgccgttgatgtgaaagtgacgttagaagtaag

SEQ ID NO: 4496 - DNA, 516 bp, Bacillus clausii
atatttgcaagaaaaaagacaactgcctaatcgtgaaatcgtctataacagccaatgccctttttgcagtgtacaatgcaagatgcaattgattaagcgtaagcatggacaggaaacatcatacgacgttgttggcatagagaatcccacgtcaaaaggccgtttatgtgtaaaagggctgaatgctcaccaacacgcctttcatcccgatcggcttacacaaccgctggccaaagtaaatggaaaatggctgccgattagttgggatgaagcactgaaacaaatcgccgaaaacgttcaagcaattcagcaagaagatgggcatgatgcaatggcggtatatggaagcgcgtcaattacaaatgaagaagcatatttgctcggtaagtttgcccgtttagccttgaaaacaaggcatattgactataatggccggctctgtatgtcggctgctgcctccgctgctacaacagcatttggaatagatagaggcttaaccaattcccttgaagacgt

SEQ ID NO: 4497 - DNA, 918 bp, Bacillus clausii
atgctagaaagctttaagcatggacagctgctagcgactgtcgatatagccgaaagaaaaccgttgtgcccatgcacgtcgctaaccgaacaacaagtcgcccaatcaatcgccgagaaacggctcgttgtgttttctgacatgagcgaaaagctaggttggaaaaacaaaaatgggtgccgagtctgccgagaagtgtctgcttattatgccggattgttctttcctgggggagcaccaaaggaacggaatggaaaacaagaaaacgatggcagttatacgattacacttccacacattgctggcagattgagcactgaccaattaaaacaatttgccctaatggctgaggaactgcaagtgccgagaattgatttttcagcacgcaaccaagtgcagctgaaagggttgacggaaaagcaactgccttacgtctttgaacagcttgatatgcctcctgctgttttggcaggcaagcgtttgcaggttgctattgatgacagccactattactggccggaagggaggcacttggctgaaagactgctcgatttatttaactgtgtgccttttcctgcggaaccagaagtatgcgttacgttagctgctcgtcgacacgagctcgctgctattcgtctctcccggtcgccattaaattggaaagtagcgattggttctgaattattttgttcgaacgactccgttgaaggaccctttcaacttgtttgcgctttgctgcaatactttaggcaatcagcgcagtacagtgaaaatatccatgcttggcttgtccgtaaaggcgcggtccatgttcgcgaagtcgtgtttgacgctgcttgccaggcaaaattaaataaacagctagcggaaataacggcagttagccatgagcatgcggaacgaatgccagtcgtttaa

SEQ ID NO: 4498 - DNA, 846 bp, Bacillus clausii
atttgcaagaaaaaagacaactgcctaatcgtgaaatcgtctataacagccaatgccctttttgcagtgtacaatgcaagatgcaattgattaagcgtaagcatggacaggaaacatcatacgacgttgttggcatagagaatcccacgtcaaaaggccgtttatgtgtaaaagggctgaatgctcaccaacacgcctttcatcccgatcggcttacacaaccgctggccaaagtaaatggaaaatggctgccgattagttgggatgaagcactgaaacaaatcgccgaaaacgttcaagcaattcagcaagaagatgggcatgatgcaatggcggtatatggaagcgcgtcaattacaaatgaagaagcatatttgctcggtaagtttgcccgtttagccttgaaaacaaggcatattgactataatggccggctctgtatgtcggctgctgcctccgctgctacaacagcatttggaatagatagaggcttaaccaattcccttgaagacgttctgtttgcggaatgtctgatgttggtagggaccaatttagctgaatgccaaccaacgctgatgccttacattgaacaagcgaaaaagaacggcgcttttcttatcgtcgttgatccaagggaaacggcaactgcacagctggctgacttgcatataaagctaaaacctggtacagacgctgctttagcaaatgggttattgaaatgtatcttagaaggtggctacgaagatgccgctttcatccaaaaacaggttgaagggtttgcggaagtcaaagcccatattgccaagctcaaacttgaaaacatagccgagcaaacaggggtcagcg

SEQ ID NO: 4499 - DNA, 274 bp, Bacillus clausii
atgctgtctcaagcaataacagaagaattggagaagattgtcggcaatggcaatgtgcaaacgtctcaggcgagccgccttgtctattcctatgatgccaccccgaattttcaagcccttcctgacgccgtagtcgcgccgcgctcgaccgaggaagttgctgaggtggtcaaagtgtgcaaccgggaaaagatcccgattgtgccaagggggtcaggtaccgaatttatgcgccagggactgtgcccgacagaaggcggcattggtctgctgg

SEQ ID NO: 4500 - DNA, 285 bp, Bacillus clausii
tgacatttttaccaacgtccgcgacgccgcctatgaaataattcataaaaaaggcgccacttattatgggattgccatgagtttagtccgcatcacaaaagcactgttaaaaaatgaaaatgcagtcatgaccgtcagcacatttcttaatggcgagttcggagcgaaagaagtatgcatagctgtacctgcaattgtaaaccgtaatggtgtccgtgaagtgcttgaactgaagttgaacgaccttgagcggcaacagttcactgagagcgtccagatgctaaa

SEQ ID NO: 4501 - DNA, 612 bp, Bacillus clausii
ggtcaaatattgcggctttcacaataatcttccctttcccttgccagaaggtgcgggcactggtctcagcggcggtgcgatcccaatcaatggggaagtcattattagcatggttcgtatgaagcgtttaatcagcgttgatttggaaaatcgccgtgccgttgtcgagccgggctatgttaacttgaaattgacgaacatgattgctgataagggctattactacgcgcccgacccttccagtcagtactgttgtacgatcggcggcaatgtggcggagaacgcaggcggcgcacattgtctaaagtatggcgtcaccacgaaccatattctcggtctcgaggtcgtccttcctaatggcgaaatcattaacgtcaactgtgaaggtgtagcagatgtgccaggttatgacttgcttggcttattaacaggctctgaaggaacattaggcatcgtcacgaaaatcacggttcgtattctgaaaaatcccgaagccaagcagacggtgcttgcctatttcgacgaagtatcagacggcagctatgccgtatcggatatcgtatcggccggaattgtcccggctgcacttgaaatgatggacaaaaccgccat

SEQ ID NO: 4502 - DNA, 480 bp, Bacillus clausii
  misc_feature (1)...(480): n = A,T,C or G
cgatgagccttgttggctttnaccagcgtagcggactgcaacacattacccggaaaatagggtttatgaagttgtttccagagagcatgcaggcaatggaaagggcgatgccaaacgtccttcctcaaaaagagcggaaggcacacaaacgtgtatatgaagcagagcaagcgcctgttgctacagttgcttttttcaaaggctgtttaatggatacgatgttttatgaaaccaacaaaaacacgattatgttattgcaaaaggctggttgccgtattgtcgtcccagatagccaagnatgntgcggcgccctccatggccatagcggcgagaaggcaaaggcgcaagaaatggcgcgcaaaaacattgatgcctttgaggatancggcgccgatttcattatttcaaatgccggcggttgtggcgcttttctccaagactatagtcatttgcttagcaaagaccgtgattatgctgagc

SEQ ID NO: 4503 - DNA, 435 bp, Bacillus clausii
tggaggaaggggcgacccttgtgtgcgacggccgtagccgggtatctgccgatggttattttattgggccgacgatttttgaacatgtgacaacggatatgacgatttggaaagatgaaatcttcgcccctgtgctttcgattattcgtgtgaaaaatttagatgaggggattcaaatagccaatcgctctgaatttgcaaacggagcttgcctatttacaacgaatgcggcggccgtccgctattttcgtgaaaacattgatgctggaatgcttggcattaaccttggcgttcctgcgcctatggcattttttcctttttcaggatggaaatcatcgttttatgggacgcttcatgcaaacggaaaagatagcgtagacttttatacgcgcaaaaaagtcgtgaccgcccgttatccgaagccgtcatttgact

SEQ ID NO: 4504 - DNA, 441 bp, Bacillus clausii
cttgttctcctaacagcaagagcaattatttatggaatgatgcgccagatgagaataaatgggctgattgcgtacactgcggcatgtgcctggaatcatgccccacctatgagataacaggccaagaacagcactcgccacgggggcgtgttcacctgatcaagtcggtagccgaaggcaagcttgaagtgaacgaaccgtttatcgatccggtctaccaatgtttagactgccgggcatgcacgactgcttgtccggctgatgtggatgtaggcggcttgatcgaagaagcaagaggacaaattcgccaagcgatgccgttaacaggtgtcaaggggctagtgagcaaatttttccttgaagggttgtttccacatccgaaacggatgcaaactttagttgggttgttaaaagttatcagaagagtggcatgcaagaagc

SEQ ID NO: 4505 - DNA, 720 bp, Bacillus clausii
acttgaagtgtcggccatcggcctgggaacgatgatgatgcctgacaacaatgaatcggtgcgaacgattcagggagcactcgatatcggcgtgacgatgtttgatacggctgacctatatgggacggaattcctgcttggacggttcggtgaaaacgagaagcttgtcggccgtgcccttaaaggtcggcgcgatcaggccgttattgcaaccaagttcggaattacacacgggcaaggaccaaaaggagatcctgcttacattaagaaatccgttgatgccagcctctacagcctggggctagattacattgatctctattaccagcatcgacccgacccccatattcccatcgaagaaacgatcgggacgatggctgacctcataaagcaagggaaaatcaggtttattggattgtcggaggcaccagctgatctgattagacgggctcatgcggtgcatcccatttccgccgtcgaaaccgaatattccctatggagcagggaagtggaagatgaggttctcccggtccttaaggagctgggcatcggtctagtcccttacagcccctttggccgcggcttcctaaccggccagatcaagaaattcgaagatttgccggaagacgactatcgtcgcattttccgcggtttcagggcgagaacttcaccaagaacgttgaggtcgtctcgctcattgagagcatggccttccaaaaa

SEQ ID NO: 4506 - DNA, 807 bp, Bacillus clausii
tttttgcccatattaagcatttaatgtggacgaccgtaccagcgcttttcatcacttatttgttgttttttataatcggcgggcaacaaagcggagagccgtctgaccttgctggactcttagaagcgttaaaggcgtcgtttacgattagctggctcacgttgctatcgcctttgctcgttgttctgttggcgatgctgcggttgccagtgctgcctgttttagtcgctgggattgtctcaggcttgttgctgactgtcgtggttcagcaagagtcgtcactggcttatatgttaaccgtattgcagtcgggcttcgagggaacgactggcaatgaactacttgacggcattcttaatgctggcggaattcaatcgatgatgtggtccgtctcattagtgttgctggcgcttgctttaggcggtgtgattcaacacatcggttttattgaagcattgtttgcaaacatgaaaaagctattggcgaagagggggcatttaattgcttcaacagcgttagcctcgatcggcactaatgctgtaacgggggaacaatatttatcaattttactaccaggcagttttttcaaacgttattatgaacaggcagggcttgctccgaaaaatttgtcgcggacgcttgaagatgcgggtacacttgtcaatccccttattccatggggggtgagcggcgctttttttgcgcaaacacttggtgtatctgtgcttgaatatgccccttttgcttttttccttattttatctccactacttacggttgcctttggctatttaggaatcggcatag

SEQ ID NO: 4507 - DNA, 440 bp, Bacillus clausii
gttgaaggggcagtcacaaaagaaatggttgaaagcatgaatgacaacccgattatttttgccatggccaaccctgttccagaaattatgccagaagatgcgaaagcagcaggtgcttcggttattggtacaggtcgttctgacttcccgaaccaagtgaataatgttttggcttttccaggaattttccgcggagcgctagatgcccgtgctacccatattaacgaagagatgaaagtggcggctgtttatgcaattgccaatttagtttctgaagaagaattgtctgttgattatgtgatcccggcgccatttgactctcgcgttgccccagcagtagcggcggcagtagctaaaaaagcgatggaaacaggagttgcccgcgtaaaagtagacccggaagaagtagctgaaaaaacacggaaattagcgattattga

SEQ ID NO: 4508 - DNA, 279 bp, Bacillus clausii
agtatgcccatataataaaggaatcgacagccatcatcatcaagaaatggaaccagatccagagctgtgcaaaccattactagagccgttgttgtcgataagcaatcgtgaattcaaggagcggtttggccatatggcaggctcatggcgtggcaaaaagccgatccaacgcaatgccattatcgcccttgctcattataaggaaaaaagcgctttgccgaagctgcgtgaattgcttgcgtccgaccctcggcctgttatccgcggcacggcagcttg

SEQ ID NO: 4509 - DNA, 936 bp, Bacillus clausii
cagaaatgaataacattattgctgtaaaagaaaaagatttccttgtaacggttcagccaggggtaacccgttctcagctcaatcaggaattaaagaaatatggattattttttccagtcgatcctggcgcaaacgcgacacttggcggcatggctgccaccaatgccagcggcacaacttctgtgcggtacggcattatgcgggatcaagtccgtgacttggaagtcgttttagctgacgggacgatgatccgcactggcaatcttgcagccaagtcatcatcaggctaccatttaaacggattgtttgtaggatcagaaggcactcttggctgctttacagaattgacgttacgtgtccacggcattcctgaacatattgtagctgggcgcgcggcctttcggacattagacgacgcagtagccgctgttgtcgcgattttacaagctggaattccgattgcccgcgtcgagttagtagatgaaccttccattgctaaagtcaatgcctttagcgatactgattacagccaaaagccgacactatttcttgaatttcatggcaatgaagcagggctcaaacaagacgtggcatttacaaaagaaatggtggccgactacggttgcgaagcctttgctttcgaaaccgatacagcggcacgcaacaagctatgggaagcgcggcataacttggcatatgcttacgtgcatagcgcccctggacgaaagctgatggtgacagatgtatgcgtccccatttcacaattggcagacgcgattcgcacagctcgaaatgcggtcacttgctctccttttgaaggaggcatcattggtcacgttggcgatggcaattaccacggtttgctaatgaacgacccggataacgctgatgagatcgaagcggctagccgcttaaatgaagcgattgtcaatgatg

SEQ ID NO: 4510 - DNA, 569 bp, Bacillus clausii
  misc_feature (1)...(569): n = A,T,C or G
ggccattgaaaatgttgaattttgctgcaggtgccccaagctnaatgatggncgattcattaccgacgattgcgacagacgtagaagcaagcaattatcgttatcccattggcgtcgtcggcggaatcgcgccattcaattttccgatgatggtgccatgttggatgttcccaatggcgatcgcactcggaaatgcatttctattaaaaccttcagagcggacgccattattgactgaaaagctcgccgacttgcttactgaagctggcctgccagatggcgtgttcaatgttgtctatggcgcccaagatgtcgtcaatggcatgctagagcaccctgacgtaaaagcgatatcgtttgtcggctctaagcctgttggcgagtatgtttataaaaaagcaagcgaaaacttaaaacgcgttcaagcgttgacaggagcgaaaaaccatacaatcgtcttaaatgatgccgatttggacgacgccgtcaccaatattgccggagctgcttttggttctgctggggagcggtgcatggcctgtgctgttgttacagtcgaggaaggaatt

SEQ ID NO: 4511 - DNA, 285 bp, Bacillus clausii
agctggaaggggacgccttcgatttactagtaatcggtggaggggttgcaggagcgggcattgcccttgatgcagtagtcaggggtatgaagactgttttaattgaacgagccgattttgcttcaggttcttcaggtgcctggtcaacccttttccataatgagagtaggcaggcccaccagcttgacatgaaatggcacggagaatatgtcaaagagcgcttgattttacatgaaaatgccccgcatttaatgaaacagcttcctttgctgcttcctgctttta

SEQ ID NO: 4512 - DNA, 636 bp, Bacillus clausii
gcattctttcggttcaaaggtagttgaacgtatatcagacttagcaagaaaggaaaagcgcaaacatttatctaaaaaggaacttgaatcgccttgcgcctttgctctctgacaaatcgatcaaaggggctgttctctatcatgaattttggcgtgacgatgcacggctcgtttttgacttattaaaagaagcaactagaaggggagcaatggcgctcaattatatgaaagcagagacatttctctatgaaaatgggaaagctgtcggtgtggtggcaatcgatcagttgactggcgaagcttataaagtgttcgctaaaaagattattaacgcgacagggattgaggcagatactcttcgggagcaagaccggtctatgtcggcaaagacgattggctatatgactgatgcttatatggtcattccaaaagagctgcttgcgattgaccaagttgtttatttggaattggacgacaaaaagctgattagtctggcgccaaggggcaagaaagtcgtgttgtctttgacaaacagcgatgaaagggacaaaaacgaacgagaggtcatgttggcgaaaatcaatcagacgtttcagcaagcacagatcacacccgatgatattgaagcctcatggc

SEQ ID NO: 4513 - DNA, 354 bp, Bacillus clausii
aaaaacggaagcagaagcatggacaaacgcgaatgcgctcgttcaacatttagcgccagaagcccttgaacaaaaacagcaggacagggcaaaaggcgattctgtcggcgttaatcgccttcatgatttgatggaagcgagccgtaaagacaattttgtcattggccctaatttgtgggcaggattgacacaagtactgtccggcaattccattgcccttgtcggtacggcagaccaaattgctgaccgagttgttgaatttgtcagtctcggcttcgataaagtccttttgcgcggttttccccatttggaagtgattacggaaattggtgcagaagtgatcccgcgtgtaaa

SEQ ID NO: 4514 - DNA, 288 bp, Bacillus clausii
cgaatgtaggggccatttatgcacgcttttggtcttataaaaaacaagcgcgtctatttgggttgccgccggttatttttgcgcagctgctgttttcgattgaagaagaaatggcggttacgcccgcagactttttagtcaggcgcacggcgatgttctactttaataaaacagaagcgttacatgtccaagaagcggtttttcgctacatgcgtgatcgctttaattggagcgaggagcaggaagcgcaataccgattagaattggatgccttgatcaagcctgcaa

SEQ ID NO: 4515 - DNA, 345 bp, Bacillus clausii
tgacttaccacgatgcttgccacttggcgcatggccaaggaatccggcaggagccgcgcgagctactgctcgctattccaggggtcgagatcgtccatatgccaaatgctgatcggtgctgtggcagcgctggaatctacaacattaccaatcctgagatggctggcgctgtcttggaaaggaaaatggagaatgtgccggatgacgtagagatgatctcaatgggcaacccaggttgtatgctgcaaatggcagttggcgtacagaagcatgggcgaagcgaaaagatcgtgcatacggtgcaactgttggattgggcatacaagaaagacgatgaacagactg

SEQ ID NO: 4516 - DNA, 249 bp, Bacillus clausii
ccagcatatggcgaattggctccatcacggcatctgcacgaaggagcaagtgcttgaaacgttgaaacgtatggccaaggtagtggatcagcaaaacgcaggtgaccctgaatacgttcctatggcgccggattatgaaaactctgttgctttccaagcagcatgcgacttggtgttcgaaggctaccagcaaccaagtggttatacagaaccgattcttcatcggcgccggaaagaagcgaaagcgaa

SEQ ID NO: 4517 - DNA, 561 bp, Bacillus clausii
  misc_feature (1)...(561): n = A,T,C or G
tgaacaaacgtatcatccaggtttggacggagtgattgcggcagaaaccgatttatcttttctcgacacggaacaaggacaaatcatcatccacggttatgacttgattcaattatcaaaaacaaatggctatttggatattgtccacttattgttaaagggtgaattgccgtcggaacaagaacggctagcattagcagaacgtttaagcggttcgtatgacttgccagaagctgttttggacgttttaaaacggttacctgcatcgacacatccaatggatgcactgcggacaggcgtttctgtgttaggagggtttgatacacggctagatgaccgcagtgaagaggcaaaccgtgaacgagcctatgaactactggcgaagttgccagcagttgttgctaacagctaccgcatccttgagaagaaacaagttttaacgccaaaagattccctttcctatagcgccaatttcttatacatgattactggaaaatgtgcccaagcgaatttagaaagagcgtgtgttcgaaccaatcgcttgtggctcttattcttnga

SEQ ID NO: 4518 - DNA, 360 bp, Bacillus clausii
aaaagcattccaggggcaaaggcgcggtgtgttttcgcgctcgtcatggggacaagattatcacaccgtcctcaatgaccgtttgaaaaaactggaggcatttttgcgcgaacgggttggggaaacggaaatggtgcgaatggttgacacaggcgctttatcagaccgagctgtggcagaacgtgccggcataggctggtcagcgaaaaatacgtttacgattacgcctgaattcggaagctttgtcttccttggcaacttattaacatccctaccgctcccgttggatgaaccgcttgaagatttatgtggctcatgcacaaaatgcattgacgcgtgtccaactggcgctcttgtgag

SEQ ID NO: 4519 - DNA, 441 bp, Bacillus clausii
ggtgaaaaactggattgacggcgcttgggtggaagcatctacggctgaaacggaagtcgtgccaaacccggcaacgggggaaaccattgcttacgtgcctctttcaggcgaacgtgatgttgaacaggcggtggcgagcgcaaagcgggcctatgaaacatggaaaacagttcctgttcccgagcgtgctcggtacatgtttgcgtatttggagcggctaaaggaaaatagggagcaattggcgcagttgataacgctagaaaacggcaagacgatcaaggatgctagaggggaagtccagcgtggcattgagtgtgtggagctggctacgtcgacaccgacaatgatgatgggcgacgctcttcccgatattgccagcgggattgacggttcgatttggcgctatcctttaagcgttgttgctggcattacgccgtttaa

SEQ ID NO: 4520 - DNA, 276 bp, Bacillus clausii
  misc_feature (1)...(276): n = A,T,C or G
attgtccngtgtgcgagatttggaagaggcaattgctttaacgaaccgatctcgctttgcgaacggagccgttatttatacatcaagcggcaaggctgcacaacactttcgaaatgcaatcgatgccggaatggttggcattaatgtgaatgtgcctgctccaatggcgttcttttcatttgccggtaataaagcatcgttttttggcgatcttggcacaaatggacgtgacggcatccaattttatacaaggaaaaaagtcgttacagaacgctg

SEQ ID NO: 4521 - DNA, 273 bp, Bacillus clausii
cttttatcggaaaaactaacgggcagagacgaagaaattgacagttcggccaacggcaaaaacgatgaaacattttgtcggcccgttcattcgccaaagccataaagacaaagttgttaaatacattgaacaaggggtagagcaaggggcagagctgttggttgacggccgcaacgcaacgagcgaggaagccggctattaccttggcgcaactttgttcgaccacgtgacaccggatatgacgatctggcaagaagagttgtttgcaccagt

SEQ ID NO: 4522 - DNA, 141 bp, Bacillus clausii
atgtcggcatttctcctgctacgatcgttgctttgcaagccgttggcggagcagcaggaaacatgatctgtgtccataacgttgtggcagcagcggcagcggcagggattattggcaaagaagcgtacttattagaaaagt

SEQ ID NO: 4523 - DNA, 343 bp, Bacillus clausii
gtgaacgtttcgctattcgtcacctgtctagcggacattttttatccacgtgttgggaaagacactgtagaagtgcttgaacgccatgggtgtaacgtcaaatttccggaaaatcaaatttgctgtgggcaaccggcatttaacagcggttatcatgaagatacaaaaaaagcagccaaacataccattgaaacgtttgccgatgccgaatatgttgtgctgccgtcagggtcatgtgctgccatgcttctcgaatacaaagaactgtttgctgacgatcctgaatgggaaaaacgggcagaagaacttgcgaacaaaacgtatgaactgacccatttcttgt

SEQ ID NO: 4524 - DNA, 576 bp, Bacillus clausii
  misc_feature (1)...(576): n = A,T,C or G
attggaaacagacctggggggagaacatttaacaaatagaggaccatgatcccctttcccaaatatngtcgcgccagcatggcacaaaaataaagaacagatccgtgaaacgtttaaagcccgcaaaggttatacaaagtcagagaatccccaagagttgacgttgtttgttcgtgaacagctccgcaaagagtttttgtcagcagatgtgggcattacaggttgcaattttgccgtagcagaatcaggaagcatttcgttggtcacgaatgagggaaatgcccgcctcgcgacagcactgcctaaaacacatattgctgttatggggatggaacggattgtgccgacgtgggaagaactcgacattttagttagcatgctatgccgaagtgcagtcggtcaaaaattaacgagttatgtgaccggcctcacaggcccccgtgaagatggcgatgctgacggccctgaagagtttcacctcgttattgtcgataatgggcggtccaatattctcggcactgaattccaagctgcgcttcattgcatccgctgcgcagcttgcatcaatgtctgccc

SEQ ID NO: 4525 - DNA, 327 bp, Bacillus clausii
aacataccagccgtcctgccatatggcaaatgttcaaaagcgcatagaagaaccaataaagctgcttcaatcgattccagggatgacgtacgtgccgatgaaggagagcgaactttgctgtgggtcggcagggatctataatcttgttcattatgagcaatcgatgaagattcttgatcggaaaatggaaaacgtaaaagccgttcagcctgaaatcattgtaacgacaaaccctggctgtcatttgcaaatgaagctcggcgtagaacgggaaggacgctcggaacaaataaaggtggttcagttaattgaactactagcagaagc

SEQ ID NO: 4526 - DNA, 1062 bp, Bacillus clausii
aaagtaaaagtgggatttttagattaatatttaccaggtgcacgagagagggcgggaaaatgggcgaccttttactcggaacaatggatagctggttgttatggaagctgacaactggggcgttcacgctacagacgtaacaaatgggagtagaacactactatttaatattaattccttaaattgggatgatgaattgcttgatatttttgatataccaaaattaatgttacctgaagtgaaattttctgatgaagtatatgggttcatagaagatagagaattattcatccctaagattcctgtatcggggattataggtgattctcaagcagctctgtttgcacaacggtgttttgataaaggtatggcaaaagctacttttgggacaggaacatcggtaatggtgtatacagaagaacacgtagatgcgaaagacggtttggttacttccatagcttggggtcttaatggagaggttacgtatgcttccgaaggaatcatccatacgacaggtgacattatgaagtggatgaaagaggatttaactttattcgatgatttctctgaagctgagacattggcggctatgttggaggataatggtggcgtatatttagtacctgcatttgttggactaggtgcgccttattggagtccaaatacacgggctggtattacgggtatgagcagaaacacgaacaaatctcacattataagagcaggattagagagtatcgtgtaccaggtaaaagacgttgtacagcttatctatcaagatacgaatgtagctgtaaaagaattaaaagtcgatggcggtgcaacaacaaatgcatttttaatgcaatttctatctgatgtacttggaattagagtgatcgtctcaaatgtttccgagttatcggctctaggttctgcataccttggtgggctcggcatacgtttatgggattctatcgaagtgattgaccaactaaggaatgaacaacatatttttgagccgaaaatgagtccaaaaaaaagagaaaagttctattcagaatggaaaaatgcaattcacgc

SEQ ID NO: 4527 - DNA, 420 bp, Bacillus clausii
tcgaatggggcacagccctctaccatctattggcattcgctgtgttgcttttaattctttctaaatttgccctcaagccgcttcttggcgtcatgcaaaaacggcaagatatgattaatgagcaaattgattcagcggaacaaaaccgcaaggaagctgaaaaactgcttgcagaacagcgggaagaaatgcaaaaggcgcgagtcgaagcgcgtgaactgattgaaaatgcaaaaaaagcaggcgaacagcaagggcaggaaatggtccgcgccgccaaagaagaagcacagcgcattcaccagcaagcgttggcggaaatccaaaacgaaaaagaccaggctgtagccgctcttcgcgaacaggttgcgtctctctctgtcttaattgcacagaaagttattgaaaaagaacttgacg

SEQ ID NO: 4528 - DNA, 891 bp, Bacillus clausii
tatgagtaaagggaaaattgttgtagtaggcggcgggttagccgggctaatggcaacgattaaagcggcagaaaaaggggtaccggtcgatttgttttcgattgtaccggtgaaacgttcccactccgtatgcgcgcaaggcggcataaacggcgctgtcaacacaaaaggagaaggggattccccttacgaacattttgatgatactgtgtacggtggcgactttttggcaaaccagccacctgttaaagcaatgaccgaagcagctccggcgattattcatttaatggatcgcatgggcgttatgtttaaccgtacccctgaagggctcctcgatttccgtcgttttggcggtacacaacaccatcgcaccgcttttgctggggcaacgactggacagcagcttttgtatgcactggacgaacaagtacgccgttacgaagtgcaagggcttgtaacaaaatacgaaggctgggagtttttatctgctgtgatcgacgatgagggcgcatgccgtggcattacagcgcaagagctgaattcagcagaaatacgcagtttctcagctgacgccgtcattatggcaactggtggaccaggaatcattttcggcaaatcgacgaactcaatgatcaataccggcttcgccgctgcaaaattgtacgaacaaggcgttgcctatgcgaacggcgagtttatccaaatccacccgactgcgattccaggcgacgacaagcttcgccttatgagcgattctgcccgtggaaaaggcgggcgcgtatggacatacaaagacggaaaaccgtggtattttcttgaagagaaatacccggcatatggaaaccttgtcccgcgtgacattgctacaagggaaaatttcccatgtgtgtg

SEQ ID NO: 4529 - DNA, 639 bp, Bacillus clausii
atgtcatctacgttaaaaagcaacgactttatgcaaattatcaaggggcgccgttcgattcggacgtatgactcgacctataaaataccaaaagaggagctcctacgtatcattgaggatgctgcatccgctccatcttctgtgaacttgcagccttggcgtttggttgtagtcgatagtgatgaagccaaagaaaagcttcgtccgctcgttaaatttaacacaaagcaaaatgatacttcatcggcaatgttgttagtgtttgcggactttaagtcccatgaaaatgccgagtacatttttaataaagcggtggatgaagggaagatgccagcagaagttcgcgaccagcaattggccgcaattcagtccctttacccaacattaccgaaagaacagatcaacgatgtcattaaagtggatagtggcttgtttgcgatgcaactcatgctcgtcgcaagagcatacggatacgacacaaatccgattggtggctttgaggccgatcaattagcagaggcttttgcgttagatccagaacgttacacgcctgtgctaattctttcaattggaaaggcggcagaacaaggctatgactctgttcgtttaagtccagagcaaattactttttggagatag

SEQ ID NO: 4530 - DNA, 735 bp, Bacillus clausii
aaacggtttcagaggcaagcgagcgaaaataccagcatgaacatgatcgagcatcctctcgctggaaccccttttattggaaggtaggggtgttgcctttccctatttatgtagctattgctgccatcgtcctggctgcagcgtattttcaaaaactgcctgctgacatgattggcgggtttgcgattattatggtagccggaatgttacttggggaaattggttcccgcctgccgattataaaaagcattggcggcccagcaatactagcgctgttcgtaccctcggcattcatgttttttggttggttaaatgaaacaactgtaaatgccgtatcgaatttaatgacgacatctaactttttatatttctatattgcttgtttagtagctggcagcattcttggcatgaaccgagtggtactcatgcaaggaatcacgaaaatgttggttccccttgttgccggaaccgctgtctcaatggctgcaggagtcggcatgggccttttactcggctatgaggcaaagcatacattgttttttattgttgttcctattttggcaggcggcattggcgaaagcattttgccgttgtcagctggttacagcacgattctcggaatacctgcggctgaattaatatcacagttaatccctgcagcaatcatcggcaatatctttgccattatcggtgccgccctcttaaaacagctcggcgcaaaaaagccccatctta

SEQ ID NO: 4531 - DNA, 744 bp, Bacillus clausii
  misc_feature (1)...(744): n = A,T,C or G
taaaagaggatntagatgcctttgcatcaggcgggcaaacggaagnngcggcagctccaaaagaggaagaaaagactgcttcctcaaaaccagcagctacggcacaagccggcggaaacgancagtnggaaaancgcgtaccgcttaaaggcatccgcaaagcgattgcaaaagcaatggtgaactcaaaacatacggctccacacgtgacacatcttgacnaagtcnacgtgtcagcccttgttgcccatcgcaaacagtacaaacaaattgctgcaacccaaggcacgaaactgacgtatcttccatatgtcgtcaaagctttgacgtcagctcttcgcaaatatccggctttaaatgcgtcaattaatgacgaagcaggcgaaatcgtctacaaaatgtactttaacgtcggaattgcagcagacactgagcaaggcctcgtagttcctgtcgtcaaagatgctgaccgtaagtctatttttgcacttgctgatgaaattaacgagttggctggaaaagcccgtgaaggcaagctgtcaagcgcagaaatgtcaggtggatcggcaacgatctccaaccttggatcagcaagaggacaatggtttacgccaattattaaccacccagaagtcatgattttaggcatcggccgtattgaagaaaagcctgttgtaaaagacggcgaaattgttgtgggcacaatgttggcactgtcaatcagctatgaccaccgtttgattg

SEQ ID NO: 4532 - DNA, 367 bp, Bacillus clausii
  misc_feature (1)...(367): n = A,T,C or G
atggttgttggaaatttcgcacaagaagtacatacactcgtagttggctccggcccaggaggttacgttgcggcgatccgtgctgcgcaacttgggcaaaaagtaaccattgtcaaaaaaggcagccttggcggcgtttgcttaaatgtcggctgcatcccatcaaaggcgtaaattcaagctgggcaccgggctcatcttgccaagtcttctgaagacatcggcattcgcgctgaaaacgtcgctattgactttgagaaagtccncgaatggacaggctctgttgtgaaaaagctaacgggcggcgtctaangcttgctccaaggcaacaaaatcnaaatcatccgntggcgaagcctatttctcc

SEQ ID NO: 4533 - DNA, 422 bp, Bacillus clausii
  misc_feature (1)...(422): n = A,T,C or G
ggcgacgtcattcctgccagcgatgcaaaggcgcttatgtatacaacccgtgtaccccttggcgtcgtagcggtcattacgccatggaatttcccgattgcgattcctctttggaaaacggcccctgctatcatttacggcaatacagtcgtcctcaagcctgcttcagaaacggcagttacgtgcgcaaaagtggttgcatgctttgaagcggccgggttgccccctggcgtcttaaatttcattacaggctcaggggcaaaagttggccaaagccttgttgaacatcatagggtgaacgcaatcacatttactggttcgaacacaactggcaagaaaattggccaaacagcccttgccangggggcgaagtaccagcttgaaatggggggcaagaaccctgtcattgtggccgccgatgc

SEQ ID NO: 4534 - DNA, 372 bp, Bacillus clausii
  misc_feature (1)...(372): n = A,T,C or G
tgatcaaagcagaattagctacaaacggtgttgaaattgatatggaggaaatggacggctataacgcttcggaactattgaattacgacggagtattgatcggtagttatacatggggagacggcgacttgccctatgaagctgaagattttgccgaagagttagctgaactagacttaacaggcgtcattgccgctgttttcggttcaggggaccgcgtttaccctgntttttgtgaagcggtccatacatttgaatcgattttgaaaaatggcggcgcaaccgtcacggccaaagggcttgaaatcgaatttgacccgaatacagacgaagaacgagcagcatgtcgttcatttgcaaacacatttatca

SEQ ID NO: 4535 - DNA, 900 bp, Bacillus clausii
  misc_feature (1)...(900): n = A,T,C or G
cctgtgtggaatgcgggcgctgcaccaatatgtgccctgcgactggcactgggaagatgctgtcgccgatggacttattgttgcgcatgcgtgaccatttaaccgaaaaaggggcggcgatcacatcaaggacgccgtggatgcctgcgtatgcttttgccaatactcgtgcnaatacgctggcaactganagcgcccaagaagcagcagcaggttacgatgtgcgtctaattggcgatgtcattactgaagaagagatttgggcgtgcacgacatgccggaattgtnaagaccaatgtccagtcatgaatgaacatgttgataaaatcatcgacttgcgccgttatcttgtgctaacggaagggaaaatggaccctgaagcacagcgagccatgcaaaaccttgaacgccaaggaaatccgtggggcataagtcgaaaagaacgggaaaactggcgtgacggccgtgatgatattgaagtgccgaccgtaaaggaattaagcaaaaaaggagagacgtttgaatatctgttctttgctggttcaatgggtgcctatgacaaccgcagccagaaaattgcccagtcttttgcaaaacttttaaatgtggccggtgtttcttttgcaatcattggcaataaggagaaaaattcaggcgatacaccgaggcgccttggaaacgaatttttgttccaagaacttgcaagcgctaacattgagctatttaaaaaacatgatgtcaaaaaaatcgtaacgattgatcctcacgcatacaatacattcaagaatgaatacccagaattcggcttggacggtgtcgaaatttatcatcataccgaacttcttgccaaattgttgcaggaaaataaattgacgccgacgaaagaagtgaatgaaaccc

SEQ ID NO: 4536 - DNA, 969 bp, Bacillus clausii
  misc_feature (1)...(969): n = A,T,C or G
atgtgccctgcgactggcactgggaagatgctgtcgccgatggacttattgttgcgcatgcgtgaccatttaaccgaaaaaggggcggcgatcacatcaaggacgccgtggatgcctgcgtatgcttttgccaatactcgtgcnaatacgctggcaactganagcgcccaagaagcagcagcaggttacgatgtgcgtctaattggcgatgtcattactgaagaagagatttgggcgtgcacgacatgccggaattgtnaagaccaatgtccagtcatgaatgaacatgttgataaaatcatcgacttgcgccgttatcttgtgctaacggaagggaaaatggaccctgaagcacagcgagccatgcaaaaccttgaacgccaaggaaatccgtggggcataagtcgaaaagaacgggaaaactggcgtgacggccgtgatgatattgaagtgccgaccgtaaaggaattaagcaaaaaaggagagacgtttgaatatctgttctttgctggttcaatgggtgcctatgacaaccgcagccagaaaattgcccagtcttttgcaaaacttttaaatgtggccggtgtttcttttgcaatcattggcaataaggagaaaaattcaggcgatacaccgaggcgccttggaaacgaatttttgttccaagaacttgcaagcgctaacattgagctatttaaaaaacatgatgtcaaaaaaatcgtaacgattgatcctcacgcatacaatacattcaagaatgaatacccagaattcggcttggacggtgtcgaaatttatcatcataccgaacttcttgccaaattgttgcaggaaaataaattgacgccgacgaaagaagtgaatgaaacccgttgtctttcacgattcgtgttatttaggtcgttacaacgatatctacgatccgccacgggaaattttaaaacgaattcctggcgtacgtattgttga

SEQ ID NO: 4537 - DNA, 651 bp, Bacillus clausii
gagcaaaaatgaagaaaaaagaagccctatggatttaccagaaaatgaatgaaatccgtttgtttgaggaagaagtacaccggacgtttggggaaggaatcattccaggctttgttcatttatacgccggtgaagaagcggtggcgacaggtgtttcggtcctattggatgaagaggattatatcacaagtacgcaccgcggccacggccatgcaattgcgaaaggctgtgatattaaccgaatgatggctgagattatgggcaaaaaagatggacttggcggcggcaagggcggttctatgcacgttgcggatattgaaaaaggaatgcttggcgccaatggcattgttggcggcggttttggacttgcagcgggtgcagccctaacgattaaaacacttcggcaggatcatgttgctgtttgtttttttggagatggagcatctaacgaaggtttattccacgaaggacttaacttaccgtcgattttgaaattgccggtcatctttgtttgtgagaacaatcaatttggcgagggaacgcctttccgttatgccagtgcttctgaaacggtcgcagagcgggcagccgcttacaatatgcctggagtccgggtagatggcatgaaagtagtggatgtttatagcgcga

SEQ ID NO: 4538 - DNA, 213 bp, Bacillus clausii
  misc_feature (1)...(213): n = A,T,C or G
aaacgttaatttatgcccaccgtggtgcgtctgggtcttatccggaaaacacgatgaaggcttttgaacaagcggcaaangcangggcagacggcattgaatttgatgtccaattaacgaaagatgatgtacctgttgtaattcacgatcgcacggtcaaccgaacaaccaatgggcaagggcctgtttgccaatacatggccaatgagttga

SEQ ID NO: 4539 - DNA, 573 bp, Bacillus clausii
aagcattaaaagcgacagaaattagctcgcttcattaagccaacagatcgaccaatttgaaacaacggtcaatgtgcaagacgtagggactgttattcgcgtcggggacggtattgcattcgctcacgggctcgacaatgtcatggccggcgagctacttgagttctcgactggggtaatgggaatggcccaaaacctggaagaagacagtgttgggattattattttaggtccgtatacagacattcgtgaaggggacgaagtcaaacggactggccggattatggaagtaccagtaggaagcgagcttcttggccgcgtcgtcaacccgcttggccagcctttagacggcctaggaccagtgcatacaagcaaaacgcgtccaattgaaagcccagctccaggggtaatggcacggaaatcggtccatgaaccattgcaaacagggattaagtcgattgactccatgattccaattggccgtggacagcgggaattgattatcggcgaccgccaaacaggtaaaacggcaattgctattgatacgatcatcaaccaaaaagaccaagacat

SEQ ID NO: 4540 - DNA, 390 bp, Bacillus clausii
  misc_feature (1)...(390): n = A,T,C or G
tctnagaggatcccctgcatccgttcgtccatccgtttaatcccgccgttgatcctctttgggaatcgcgctcggactgggatatttacagaacccttgccaagaccttttcagagatggccaaagagcatctccccggcgtacacaaagatttggtcgctacgccgctcgcccatgattctgcgagtgaaattgcccagccttatggcgtcgtcaaggattggcgcaagggcgagattgaagcggtgcctggcaaaacgatgccgaatttgacgattgtggaacgggactatacacaaatttataacaaatatatttcgcttggcccaggactggccaacggcaaggtaggggcgcacggcgtcagcttcccggtggccgaggaatacg

SEQ ID NO: 4541 - DNA, 420 bp, Bacillus clausii
  misc_feature (1)...(420): n = A,T,C or G
tcggtgtggaaacagaagctgtacgactaggagaaccgaatggagagacattgtatgcacttgaagcattcggcgtaaacacgccacgcttaatcgaaaaagcggcaggcgaaacagatcgagtcattctagttgatcacaatgaacgccaacaaagcgtcagtgacattgacgacgtccaagttttagaagtgatcgaccatcaccgcattgctaactttgaaacagctgaccctgtttattatcgggccgaacctgtcggctgcacggcgacgattattaaaaagctctacaaagaacacggccttgacattcctaaaccaattgcaggcttgatgctatctgcgattatctctgattcccttttgttcaagtcgccaacatgcacaggaagaagacaagcaagcagcnaaagaatta

SEQ ID NO: 4542 - DNA, 1164 bp, Bacillus clausii
atggatgcttttactttttacaatccgaccaaattaatttttggccaaggaaaaaccgaacatttggcagaagagcttgttgtctatgatcgcaatgtcttgcttgtttacggaggcgggagcatcaaaaagaacggcttgtatgaaaaagtcacgaaacaattagaactagccggatgcacggtcaccgaattggcaggagtagagccaaacccacggctgacaactgtgcaaaaaggaattgatttgtgcaaagagaagcaaattggctttattttagcagttggcggcggcagtgtgattgatgcgacaaaagccattgcggtaggtgcccgccatgatggcgacatttgggatattattactaaaaaagaaacgcctatggacgcattgccgtttggcacgattttgacgcttgcagcaactggatccgagatgaattctggttctgtgattaccaattgggaaacccatcaaaaaatgggctggggcagcatttttagctttcctaacttttccattctcgacccaattaatacgctttcggttccaaaagaccaaaccgtttatggcattgtcgacatgatgagccatgttcttgaagcctatttccacccggcggagaatacgccgttgcaagaccggatttgcgaatcaattttgcatacagtcatcgaagcagccccgccgttgctagatgatctcgaaaatgttgatttgcgggaaacgattctatatagcggaacaatggctttaaatggaataacgcaaatgggcgcgcgaggcgattggggcacacataaccttgaacacgcagtttccgctgtttttgatattccacacgctggcgggcttgcgattttatttcctcattggctccgccacagcattgatgtcaatccagaacgaagtgcgatgctcgctataaacgtgtttggcgttgatccaacgggcaaagacaaacaggatgtcgctcttgaggggattgacaagttagctgctttttggaaacaattgggagcgccgagccgtttggctgattacggcattgatgaaagcaaactcgagcaaattgccgacattgcttgtgagaacgggatttatggcaattaccataaactcggaaagcctcaaacgcttgaaattttaaaggcggcactttaa

SEQ ID NO: 4543 - DNA, 678 bp, Bacillus clausii
  misc_feature (1)...(678): n = A,T,C or G
aggattgagccgtgatgatcttgtaacccacaaatgcaaaaatcatgaagtctgtcaacacnagaagttgttaagtatttcgcntaacagntatattntcgttttgaccaacccggtggacgcgatgaattatacggtttataaagaatgtggcttttcgaaaaaccgtgtcatcggccagtctggcgttcttgacacagcatgtttccgcacgtttgtggcccaagaattaaatgtttccgtagaggacgtcactggttttgttttaggcggccatggagatgatatggtgccgtttatccgctattcagcagcgggcggtgtgccgttaacaaaactgatcgctccagaacggattgaagaaattgttgaacgcacccgcaaaggtggcggcgaaatcgtcagcttgttaggaaatggcagcgcctactacgcgccagctgcttcgcttacacaaatggtggaagcgatcttaaaagacaaaaaacgcattatcccaacaattgcctacctcgaaggcgaatatggccaacatgacctgtacttgggcgtaccgaccattcttggcggtgacggcattgagaaagtcatagagctcgacttgacagaggaagaaaaggcacaactagacaaatcggtgcaatccgttcgcaatgtaatggcggcattgccagcgga

SEQ ID NO: 4544 - DNA, 137 bp, Bacillus clausii
  misc_feature (1)...(137): n = A,T,C or G
gagggcctgnatacgccccataaagtaaaaatggctgtttccgcttgcccgcgtaattgtgcggaatcaggcataaaagatgttggaattgtgggtgtagaaggagcatgggaaatctatgtaggtgggaatggagg

SEQ ID NO: 4545 - DNA, 762 bp, Bacillus clausii
  misc_feature (1)...(762): n = A,T,C or G
ggggattgaatttaaagaaggctctgacgaagtgaaaaagcttattgcctttttgcaagatgagcttggtgcaaccaatatccgtttccctgaaacttccggcattggcgtaaagcctgtatcgaaggaaggcacagagcgcctcgtccgttctgccatccaatatgcgcttgatgaaggccgcaagagcgttacgcttgtccataaaggcaacatcatgaaatttacggaaggcgcgtttaaaaactggggttacgaactggctgagcgtgagttcggcgataaagtatttacatgggctgaatacgataaaattgtggaagaaagtggccgcgaagctgccgataaagcgcaaagcgaagcagaagctgctggcaaaatcatcgtgaaagatgcaattgccgacattttcttgcagcaaattttgactcgcccgaaagagtttgatgtcgttgcgacgatgaacttaaacggcgattacatttccgatgctcttgctgcccaagtaggcggaatcggcattgctccaggagcaaacatcaactatgatacaggtcatgccatttttgaagcgacacatggcacagcgccaaaatatgcaggactcgacaaagttaacccttcctcagtcttgttgtcaggagaactgcttttgcgtcaccttggctggacagaagcagcagacttgattatggcatccatggacaaaaccgantgccagcaaagttgttacctatgatttttgccccgcttgatggatgg

SEQ ID NO: 4546 - DNA, 658 bp, Bacillus clausii
gtgaataaagaaaaggttgttttaattggcaatggcatggcgggcatccgcacactcgaagaaatcattaaacgagagcctaatcgttttcaattcacggttttcggtgcagaaccccatccaaattacaatcgaatattgttgtcgtctgttcttcaaggcgactcaagtgtaagcgacatcgtcttaaacgactacgactggtatgaaagaaaccaaattgaattgtttacaggtgacgcagtcgtacgagttgattgtcgcaaaaaagaagtgtggagcgccagtggcattaaacggacctatgaccgtttgatctttgccacaggctccgacccgtttatgctccctttgcctggagcagagaaagaaggtgtcattgcgtttcgcaacatcgccgattgcgaatcaatgatcaatgctgcgaaatcgtatcaaaaagcggtggtcattggtggagggctgctaggccttgaagcagctagaggcctgttgaacttaaaaatggacgttgatgtcatccatattgccgatcatttaatggaccggcaactggattcagatgcaggaaagatgttgaaggccgagcttgaacaacaagggatgcagtttcatttaaataagaaaacggtcaaaatcaatggccacaaacgggtca

SEQ ID NO: 4547 - DNA, 1563 bp, Bacillus clausii
  misc_feature (1)...(1563): n = A,T,C or G
gcttgttgctcccttgtacgaacaaggcaaagtgcttgctggaacacatctgtacaaatacgagcaatgaggtcagcggctataaagggtcaatcgtctccacgaaattaaaagtatcaggcataaatgtcttttccgcaggggcgtttcgcgatcaagacgagacgaaatcgattcgtatccatgacgaatttgctggagtctacaaaaagctagttgttaaaaacaaccaagttgtaggggccctcttatttggcgacaccaatgatgccaatcgaattctttctctcattcggtctggggaagacatttcggccataagtaaagcggcactgttcccatctgagacgaatgacagcagtccatcagtagtagctacaatggcanacgaagaaacgatttgcggctgtaacggtgtaagcaaaggtgagattgtctgtgcaattaaagagcaggggctttctacggtagcagaaataaggcaatgtacgaatgcgtcaaggtcttgtggtggctgcaagccggaagtagctgaattgttggcactcacaacaggaacggacataatggcaaaaccagaacctctttgcggctgtacggaattaacccatgaaacagtggtagcctccatccgggaaatgggcttgtcctatgttcgagaagtcatgagcgtgcttggttggaagtcagaggaaggctgttcaaagtgccgccctgctctcaactattatctaggtctcattagcccccttgattatacggatgatgctcattcccggtttgttaatgaacgggtccatgccaatatccagaaagacggcacgttctctgttgtgcctcggatgtatggcggggtgaccaatccagaacaactgcggaaaatcgctgatgttgctgaaaaatacaatgtccctttattaaaagtcaccggcggtcaacggatcgacttgctcggcgtcgaaaaagaaaaattgcctaacgtatggcgtgatttagggatgcgctccggctatgcgtatggcnaaacattgcggacagtcnaaacgtgcgttggtgaagatttttgccgttttggcacgcaggactcggttagccttggaatngnnattgagnnnnnatncgagggcctgnatacgccccataaagtaaaaatggctgtttccgcttgcccgcgtaattgtgcgaaatcaggcataaaagatgttggaattgtgggtgtagaaggagcatgggaaatctatgtaggtgggaatggaggcgttgatttaagaagcgctgagctgctttgcaaagtggcaacgaatgaagaagtaatggaaacgatcagtgcatttttgcaatattatcgggaacaagccacctatttagaacggacttcccattggattgagcgagtcgggcttgaatcaattaaaaaagtgattttcgacgacagcatcgaacgagcagcgctaatcgaacggatggaaatggcgctatctaggcacaaagatccgtggacggaaattgttgagagtgaagaaaagcaacagcaattgtttgaaaagaaaaaaattgctgtta

SEQ ID NO: 4548 - DNA, 318 bp, Bacillus clausii
aaagcgttttgcccaggaagaaaatatttggaccagtcattgctctcattaaagcaaaaactgttgaagaagcaattgatatagcaaatgacaccgaattcgggctaagcgcatccttatacacatccaatattcgctcagccctttctttcattgatgagatcgaagctggattagtccgtgttaacgcagaaagtgccggtgtcgaattacaggcgccatttggcgggatgaaagcttcaagtactggaacacgtgaacaaggggaagctgccaaagaattttatacggcgattaaaaccgttttgattagaagtt

SEQ ID NO: 4549 - DNA, 495 bp, Bacillus clausii
  misc_feature (1)...(495): n = A,T,C or G
tcatatgcttgccaacctttttccagggccggatcgaccttggcttgggccgttcgccagggggttcggctgaggcagcggaagccctttctggcaactttatcgaacgcattcatacgatggacgagcgtatgacggagctaatgcactttcttaaccgtgattttccggaagggcataaatacgcttccttacaagctgtgcctcttccttatgaaccgccggcggtgtatatgcttggaacgtctaaaaagagcgctgccttagcggctaaacataacctccagtatgtttatggccattttatggatgatcaaaacggtcaagatgtcattgcccactatcggaagcgtgcgaatcaggctacaaagccaattgcttgtgtgtttgtgctatgcgcggaatcgaacgaaaaagcgaggcagctttaccgctctgtgaggctatggcnaacagccaatcaacaagggangatgatggtcgctatcccgactg

SEQ ID NO: 4550 - DNA, 1166 bp, Bacillus clausii
tggtggccaagcagtacaggtgttttcgtcggaatgttttccttcccttcataaaacgtatgtgcaggcgttttccgctctcccgtcaatttttaaacgacgctccaggaattttccataagtaaaataggcgacaattaacaaggcaccgcaaataagcataagtgttacaaaattcataagaccacctcacgtttaatagatttgcaaaaatggttcaataaagggctttccttttttgtgcgcataaagctggcttccgtcctgaagcaaaatccccgcatagcgttctgcccagccatgcaagccccatttgatgaatgataagctacggcaacggcgtgccgcttggcacagctcaggcgaaggcgctgtggctgttagtagcagtccgatgtaaatcgacgacatatgctgagatgaatggttcgcgtttgtttgaatataagcatcgagttcttgtacaaacgtagaaaaggtgtctattgttgcttcttccggctcataaaagaaaaagtgctggttgttttcaacgctccagacagttgcttttttagaaaggatgtaacgttcatcgcgccgctgatagtgggcgctgaagcgcagggggagctggccaaggtggtcgtcttcatacacatcaaactggtgctttaaagcgttttgcagttggcgtaaaggcaattcgattggcatgatgcacctcattcaaaattggtagcgtttacatatgtgtgtttagtatacctttattaaatcgacaattcaattctttctgaaaaaatatcagttctgtattcaccggatcaagcctcctttgaagtttacatatagagggaaagggaacagaataaaaaagcctaaaaggagtcgataagatgaaactttttataaatggcgaatgggtcagtgaagggttggatgtgtttgacgttgttaatccggctactggcgatgttgtcggctcggtgccgaaaggaggagcgaaggaggcaaaaatcgcagccgatagcgcttacgaggcattgccggcatgggcagcgcgttcagcttatgaacgaagcgcaatattagaggggtggcacgatcttattgctgaacagaaagaggaactagcgcaattaatgacaatggaacaaggcaaacaaattaatgaagcgcgaggg

SEQ ID NO: 4551 - DNA, 627 bp, Bacillus clausii
agtggtatgcagaagaaggcaaacgcatatacggggaaaccattccggcttcatcccctgataaacgtttatttgtggtaaaacagcctgtcggtgtcgtcgctgcgattacaccgtggaacttcccggccgccatgattacgcggaaagtggcaccggcgttggcagcaggctgcacagtgctgatcaagccagcatcgcaaacgccactaactgcattgaagctagcagaacttgctgaaaaagcagggttgccaacaggcgtgctccacgttgttgttggttcaacaagtgacatctcaaaagcgtggcaggaagacgagcgtgtccgcaagttgacgtttaccggctctacggaaattggccgcactcttatgagtgaagcggggcaaaccgttaagaaaatttctttggagcttggcggacatgcaccggtccttgtgtttgaagacgcggacatcgatcacgctgtccaagaaacaatcgcctccaaattccgtaatggcgggcacacgtgcgtatgcgccaatcggatttacgtgcatgaatccattgctcaagcattcataacgaaaatgaaacaagcagtccagcagttgaaagtggggaatgggttgaacgagggag

SEQ ID NO: 4552 - DNA, 393 bp, Bacillus clausii
cagacatcggcccactgattgacgaagatgcagttgataaagtccttacccatattcgagatgcaaaagacaaaggggcaaaagtactaacaggaggaagcagcagagacgggctgtttattgaaccaactgtcatagcaggagtaaccgacgacatggcatgcatgtcacaagaaacgttcggcccccttgcaccgatatctactttcaacacagaagaagaagtcgtcaaacgggcaaacgatacgatttacgggcttgccgcctacttatttaccactaatctaagccgcgggattcgagttgcagaaaagctggactacggtgttgtcgggttaaacgaccgcggcccatcggttgcccaggcgccgtttggtggtttcaaccaaaccg

SEQ ID NO: 4553 - DNA, 261 bp, Bacillus clausii
  misc_feature (1)...(261): n = A,T,C or G
tcactccctgccaatttccggtaaccatccccatttggaaaatggcgcctgcgctcatctatggaaatacggnggtgattaagccagcaagtgaaacggctgtcacctgtgctaacatcatcgactgctttgccgcagcaggtatgccggcaggaacagttaatatggtaaccggttccggatcggttattggacaacggctggcaaancaccccnatgtaaacggcataactttttacaggatccaanacggtgggaaaa

SEQ ID NO: 4554 - DNA, 318 bp, Bacillus clausii
  misc_feature (1)...(318): n = A,T,C or G
ggatgggtattcttcttgcttatatgatttttgggaaaggtgcgtcacgtgcctcctcttatggagcaggaattatccatttctttggcggcatccacgaaatttacttcccgtacgtgctgatgaagccattgttgatcgtagcagctattcttggcggagcaggcggtattttcactttgtcgctgtttaatgctggattggtgagcgttccgtctcctggaagcattatttcgattttattgcttacagcgtcngatanttatgtgggcgtcattttaagcgttcttgtcgcaacggggaattcgtttgttgtcc

SEQ ID NO: 4555 - DNA, 1344 bp, Bacillus clausii
gacattgctggccgttcagaaagagcatgtgtttactggcgctacaaaagctgttgcttatcgaaaacgacagctccaaaagctgaaaacgatgctgcaaacgtatgaaaaagaactgctttcagcgttacgagcggatttgaataaacaagagcctgaagctaggatggttgaaatggcttttctacaccaagagatcgatttggcgttggagtcgatcgatgaatgggtcaagccaataaaagtgaaaacgcctgccagccacaccggttcaaaaagctgggtagcaacagaaccatatggtagcgtcttaatcatttccccttggaattatccgattcaactcacatttgcgcctctaattggtgcccttgctgctggcaatgccgcggttctcaagccttctgagttgacgccgcggacttcaagcataatggctgccgctgtccgggccacatttccgaaagagctcgtgactgtggtagaaggagacgcgaaaacggcagagacgctgctcaatcttccatttaattctattttctttacgggaagtgccgcagtcggaaaaatcgtgttagaaaaagcagctaaacatatgacgccatgtacgcttgaattaggcgggaaaagcccggtgattgtggatggcgaagcaaaactgaaattggcagccaaacggattgcttggggaaagtttttaaacgctgggcaaacatgcattgctcccgactatgcccttgtcgatgaagacgtgtacgaactgtttcttgagcagctaaaagcgcaaacatatacgcttttttcggagaagacaaaagagggaacctatacgcaaattgtgaacgacaaacactttgagcgcctgcgccgctatttagatagtgggcatattgttcttggcggtcaaatttcaccaaaagcgcgtttaatgtccccaacgatcttaaccgatgttccttgggatgcgccgatcatgcaggaggaaatctttggcccaatcttgcctgtgtttcgatacaaaacgcctgccgaagcaattcaaaaagtccgctcattgccgaatccacttgcactctatgtattttctgaaaacgagcgtgtacaacggctatttacggagcagctttcgtttggcggcggctgcatcaacgacacacttatgcacgcagcaaacccctaccttcctttcggcggcaaaggaacgagtggcattggtgcttatcatggctatgaaagctttcgcactttttcccatcaaaaaagctttttaaagcaatcgacaacgtttgacgtgccatttcgttacaagcaagggaaaatcgcaaatacatttatacgttatat

SEQ ID NO: 4556 - DNA, 216 bp, Bacillus clausii
atgacagaattagcgattgggattgcagcaggtcttgcagcaatcgggggagcaattggcgtagccattatcgttaaggcagtaattgaaggaactgcacgtcaaccagaacaacgcggtacgctacaaacgctcatgtttattggcgcgccacttgcagaggccgttccgattattgcgatcgttattgcgttcttactcttctttatgggataa

SEQ ID NO: 4557 - DNA, 627 bp, Bacillus clausii
catcgtggtgattattacagtcattggctgccgcaaattggctatgcgtccgactgggcttcaaaattttatcgagtgggtagtggacttttgtcgtggaatcattaaggcgaacatggattggaaagtgggcggccgttttattgtcctcgcgtatgcgctgcttttctatgtgtttgttgctaatatgatggggattccatttgaattagtaacaaaagaaggccataacgttttttggaaatcgccgacgtctgatccggttctaacactgacaatggctgtatttattgtcgttttgacccatatttatggaatcatggtgacaggcccatctacttatgggaaaagttggtttacaccaaaatggtttttgtttccatttaaagtgattgaggaagggtcaaatgcgttaactcttggtatgcggctttttgggaatatttatgcgaaagaaattcttatgcttcttctcgtttcgttaggaacgacagcggtttattggggcatcttcgcttttgtgccgctcattgtgtggcaagcatttagtatttttattggttcattgcaagcgtacatttttgcgatgttggcaatggtgtacatgtcccacaaagtggaacaaca

SEQ ID NO: 4558 - DNA, 120 bp, Bacillus clausii
  misc_feature (1)...(120): n = A,T,C or G
caatgtatttgatgcagccagcccgtttggtggttacaaacaatcggggattggccgagaaatgggaaactatgcattagacaattatacagaagnaaatagtgtntgggtcaatatgga

SEQ ID NO: 4559 - DNA, 665 bp, Bacillus clausii
acatatcaacttgtcgcgccaattgctttatttgccgacacggttgttttgcaacacgcacctcctgctgggattgctgctggatttggcgatatggtcggcaagtatacgtcattattcgattggaaaattggctctcttctaaaaagtgaggcctattccgacttggtagctgatttaacagaggaggctctttctgcttgtgtcgataaagtcgcagacattggcaagaggacgtctgcgggcgtgcaggtactgatggaaagcctgcttacatccggtttagcaatggccttgtttggttattcccatcctgcttcaggtgccgagcaccatctttcccattactgggaaatggaagcgcttagactagggaaaaagcagttgctgcacggcgcaaaagttggcttatcgacgcaaatcatcaaccgcttttataagaacactgtgcttccagacgtacatcggtttttgggcgacgacgaagcgaagcaagtgattgctcttgttgaagcattgccagaccctgacgatgtaaaagcgctgcttgagcaggcagggtggaacgaagctctcgtaccgattgctccagaacttgttgaggaaagcttacagcacgcctatttgctgagagaccgttatacgcttttgcgtctttatcgtga

SEQ ID NO: 4560 - DNA, 399 bp, Bacillus clausii
  misc_feature (1)...(399): n = A,T,C or G
accaagttctgaaagtgcgttaacaccngttaaantggttaantgttttgaaantncagcctttcttaaaggggtactgaactttataaccggaaaaggctcccattgtgggngaancgtttataaatagcaagaaactaaacgggatnacgtttcantggatcggattcccaccggtaaaggattggccaaaagcnagccagtgttaatggcataaaataccaactagaaatgggcggggaaaattccggttcattgtttctaggacgacgcagatgtccaaagcgatgtgcaaggcattttaancggtgcctttnaatcaacagggcaaaaatgtacagcaacgagtcgtgtcattgtacaagaagggatttacgaagaactgaaagccgccctttt

SEQ ID NO: 4561 - DNA, 789 bp, Bacillus clausii
aattgtacgcaacagttgtacagcagggtataaggcgatgtggcataaacgcgacggctatccagatgactctttttttgccgcgctagatccaggccttgcccggctgacaacgacaaaacttcgcggtgatatccttgcccctggccaacgtgccgggggattaacagtagaaatggcggaaacgcttggccttaagcctggaacggctgttgcggtagggaatgtcgatgcccatgtggctgtcccagccgcaggcgttgtcacaccagggaaaatggttatggtaatgggcacatcgatttgccatcttgtattggctaaagaagaaagagcagtcgaaggaatgtgcggcgtagtagaagacggcattgtgccaggatactttggttatgaggcagggcagtctgcggttggcgatatatttgcatggctgatgaaacacggcattcccgctgacttgaaacaagaagcggaacaagcaggaaaaccgcttcattcgttgctagaagaaaaggcggccgcttaccgtcctggcgaaaccggtttgctcgctcttgattggtggaacggaaaccgttcaacgctagtcgatgcaaatttgacagggcttattttaggatacaccttgcaaacaaaagcagaagaattgtaccgaacattgctggaggcgaccgcatttggcacgaaaaaaattattgacgctttcagagacagcggcgttgaggtgaacgttctttatgcttgcggagggctgccacaaaaaaacgagttgctcatgcaaattta

SEQ ID NO: 4562 - DNA, 402 bp, Bacillus clausii
catatcaacttgtcgcgccaattgctttatttgccgacacggttgttttgcaacacgcacctcctgctttgattgctgctggatttggcgatatggtcggcaagtatacgtcattattcgattggaaaattggctctcttctaaaaagtgaggcctattccgacttggtagctgatttaacagaggaggctctttctgcttgtgtcgataaagtcgcagacattggcaagaggacgtctgcgggcgtgcaggtactgatggaaagcctgcttacatccggtttagcaatggccttgtttggttattcccatcctgcttcaggtgccgagcaccatctttcccattactgggaaatggaagcgcttagactagggaaaaagcagttgctgcacggcgcaaaag

SEQ ID NO: 4563 - DNA, 486 bp, Bacillus clausii
acaaacagtagaagtatttcaaaattatatcaacggcgaatggagagacagtacgagcggacaagtaatggatagtgtgaatccagcaaacaaaaatgaaacggttggccaactccaatcttctacaactgaagaagtcgatgaggcgattcaatcggcgactgaagcgaaagtcggctggcgtaaaaccgggcaataccaacggggccaactattagctagtgtcgcaaatgaattagaaaaaaatgttgatgacattgctgaaacgttaacaaaagaaatgggaaaaacgttgcccgaagcaattggtgaaactcaacgtgggatagcgatcttacggtattatgcagcggaagggatgagaaaagagggggaagtgattccagcttccgataaagaggcgctaatgtttacaaaacggacgcctttgggcgtagttggcattattaccccttggaactttcctgtggcaatccctatttggaa

SEQ ID NO: 4564 - DNA, 666 bp, Bacillus clausii
  misc_feature (1)...(666): n = A,T,C or G
tcgtgacgattattaacatgcgtgcaccaggtatgacgatgatgcgcttgccgttgttcgtttggacatcattcgtcacgtcgacgttgattttgtttgcctttacgcctctagcggccgggcttgctttgcttatgcttgaacgcatattcgatgcccagtttttcaacccgacagcaggagggaatgtcgtcatatggcaacatattttctggatcttcgggcacccagaagtgtacattctcgttttgccagcgttcggaatcatttctgaagttattccggccttttcacgcaaacggcttttcggttacacagcgatggtattcgcgacgatgatcattgccttccttggtttcatggtgtgggctcaccatatgtttacagtcggtatcggtccagtggctaactcaatctttgcgattgctacaatgaccattgctgttccgactggtattaaaatctttaactggctctttacgatgtggggcggcaaaatcacattcaatacgtcgatgttgtttgcttcttcattcgtgccgacgttcgtgcttggcggtgttacaggggtcatgctcgcgatggcgccggtagactatttgtaccatgatacgtactttgtcgttgcacactttcattacatcattgtcngcgggattgtgttgc

SEQ ID NO: 4565 - DNA, 233 bp, Bacillus clausii
ttgaaatgcaagattttgcggcaggaacgtcaagccggtcgacaaaattgatccatggcggccttcgttatttaaagcaatttgaagtaaaactagttgcggaagttgggactgagcgggcgatcgtctatgaaaatgcaccccatgttacagagccagtgcgaatgatgttgccgttttacaaaggcggtacgtttaatgcgttaacaacgtcaatcgggcttgctgtctac

SEQ ID NO: 4566 - DNA, 342 bp, Bacillus clausii
gcttagaagaggcagaagcagctgaacttgtcacacgttacggctcaaatgtcacgcacgtgtttgcgtttctaaatgatggggaagcagagaaatacgggcttccaaaagcggtatgggcgtcgctccgttacgcgatggcctatgaaatggcgctcacgcctgtcgatttcttactacgccgctcttcctatatgctctttgatattgacaaagccaacgcttataaagacaagattgtggaggcaatggcttctgttttaaagtggagtgacaaacagcgggccatttacgaggctgagttggcagaacaatggcggatacacacgcttgaggatatcg

SEQ ID NO: 4567 - DNA, 620 bp, Bacillus clausii
catgatggcacgccagtccgcttgagtggccaagatagcgagcgtggcacgtttgcacaccgtcactttgtcttgcatgaccgcgaaaccaatgaaacgcatgtaccgctgcaagcgtttaaagatgccaacgcgtcttttgccgtttacaacagccctcttacagagcaggcatgcgttggctttgaatacggatacaatgttttttcaaaagagacgctagtgttatgggaagctcaatttggcgacttcgtcaacggcgcccaagtaatgtttgaccagtgggtgtcagctgggcgagccaaatgggggcaaaagtcaggtcttgttgtcttgttgcctcacggctatgaaggcgccggccctgagcattccagcgggcgtgttgagcgcttcttgagctcggcagcagagaataactggacagttgccaactgcacgtcagccgcacaatacttccatattttgcggcgccaggcgaagattttgcaaaagaatacagtgcgcccacttattatcatgacgccaaaaagcttgctccgtaaccaagtggttgcctcgccaacgtctgcttttacagaaggcgagtttctgccgatcttggaagagccaacgcttgg

SEQ ID NO: 4568 - DNA, 657 bp, Bacillus clausii
ggcgcagttgtttaccaagcttaaagacaacaagctggataacaaacagctgcaaaaggcggtggacgatctttccatcgagctggtcctgaccgctcacccaacggaaattacccgccgcaccctgatccacaagctggttgaggtgaacacctgtctgagccagttggatcataacgacctggccgactacgagcgtaataaaatcatgcgccgtctacgccagctggtcgcgcaatcctggcataccgacgagatccgcaaaaatcgtccatccccggtcgatgaagccaaatggggctttgccgtggtggaaaacagcctgtgggaaggcgtaccggccttcctgcgcgagttcaacgaacagttggaaaactccatcgattaccgcctgccggtagaagccgtacctatccgcttcacctcctggatgggtggcgaccgcgacggtaacccgaacgtgaccgctgaaatcacccgtcacgtgctgttgctgagccgctggaaggcctgcgatctgttcacccgtgatattcaggtgctggtctccgagctgtcgatgaccgaatgtactcctgagctgcgcgaacttgccggcggtgacgaagtacaagaaccttatcgcgaattgatgaagcaactgcgcagccagttgat

SEQ ID NO: 4569 - DNA, 121 bp, Bacillus clausii
atgaacgaacaatattcggcaatgcgaagtaatgtcagtatgctcggcaaactgctaggcgataccattaaagaagcgctgggcgagcatattctcgatcgcgttgaaactatccgtaagc

SEQ ID NO: 4570 - DNA, 351 bp, Bacillus clausii
atgatgtgctaaagcttatgaccagtcatcggtcgattcgcgcttttacaaataagcgcgtcacaaaggagcaaattgaaacgattgtcagctcggcgcagtgggcgtcgacctcccatcatgtacaagcgtactccgttatagctgtggaggatactgctcgtaaagaaacactcgccgatttaacaggtggccaacgttgggtaaatgagtgtagtgtgttttttgtcatttgcgcagatttttcacggcatgcaagtgccagcaaacagcatcacgtttcatttgatgtcggtggggcggagcaacttctcgttggtgctgttgatgccgctttatttgcccaaaata

SEQ ID NO: 4571 - DNA, 387 bp, Bacillus clausii
aatcgagacaaatgtcgtcattgaaaatgtggaacaaggacttgtccgaacggcaaatgcagctttcccatttgaacggttgttagtggcggctggaaggcgtcataatacggaattagcggatgcgctgcatttacaaaaagacgcaaacgatcgtttcatcgaagtaaatcaatattatgaaacgagtaaaaagggcatttacgcgattggtgatgtgattggcaaatatgaattggctcatgcagcgagtgcggaaggcattgcggctgtcgaacatatggcagggatcaagcaacagccaattgacgaacttggcatccctcgctgtgtttatacaaatcctgaaatcgcttcctttggtttgagtgaaaaagaagcgaaaga

SEQ ID NO: 4572 - DNA, 545 bp, Bacillus clausii
gtgattgatcttgagaagctacatgagcagaagtcacgattcgccttttttgcccgacagcttatgtacccagagaagttggattttcatcctgatgtgtggacggaagcgctgactgccggacacccggcccatccttcactccagaaatactggcatctcatgcaaaattacagcttcgagcagatcgaagagatgtatgtgaagacgtttgattttcaaaaagacacaaccttgtacatgaccttttacaaatatgaggacagccgggagcggggagcgctcctcgtacggctcaaacaagcatatgagctgtttggtcttgcgatcgaaggcaccgaactctcagattacttgccgctcatgtgtgaatttctctacgccgccccttggcagggccatgagcagcaagctgcaagcagcctggatttgatgctggcggtaatggaagatggaacctaccatttgctgaatgctttagaaaaagcagacagcccttattttcatctaatccagggactgcgggaaacgtttaaggcatgcgt

SEQ ID NO: 4573 - DNA, 612 bp, Bacillus clausii
ggtccatggcgatgcctcttggaaagcggcagaacgattttggccggaatttacagctgttgaggcaacttactggcaatacaacggaatttgttcgcaaaatcaaatgaatcaactggcagccgttgtgcaaagcggcaagtacgatgcgattgtcggcgtgggtggcggcaaactccttgacctagtcaaaggaggggcttaccaaacgaaacggccttatgtgctcgtgccgacgctagcctcaaattgtgccccttggacaccccttgcggccgtttatacagatgaggggacttatacacactacgatgtctatccagaaaatgcgtcgttgttgttactggaaccgcgcttgcttttgactgcgccaaaagagctgtttgtcgctggcataggcgatacgcttgcaaaatggtacgaagcggatgtccagcttggttcgatggatgaaaagtccccagcattagaggtggcttattatacggctaaactatgtcgagacattttgttagataaaagcgatgaggctttgcacgcttttgacataggcgaagtgagcactgctttttgtaaagttgcagaaacgattattaagctaggtggcatggt

SEQ ID NO: 4574 - DNA, 366 bp, Bacillus clausii
cacacataaccttgaacacgcagtttccgctgtttttgatattccacacgctggcgggcttgcgattttatttcctcattggctccgccacagcattgatgtcaatccagaacgaagtgcgatgctcgctataaacgtgtttggcgttgatccaacgggcaaagacaaacaggatgtcgctcttgaggggattgacaagttagctgctttttggaaacaattgggagcgccgagccgtttggctgattacggcattgatgaaagcaaactcgagcaaattgccgacattgcttgtgagaacgggatttatggcaattaccataaactcggaaagcctcaaacgcttgaaattttaaaggcggcact

SEQ ID NO: 4575 - DNA, 330 bp, Bacillus clausii
ggagggatttcatgctagcattacttggttttttgacgattgtggtgtttttatattcgattatttcgaagcggctttctgttattgtcgcacttgtgttgattccaattgtttttggcatcattggcggatttggacttgagctcggtgagcatatgctggagggcattcaacttgttgctccgactggcgttatgctaggttttgcaatcctgtttttcggcgttatgaacaatgcaggcatgtttgatccgattcttgcccgaattttaaaagcggtgaaaggcgatcctttaaaagtagtagtcggtacgctggtatttgctatga

SEQ ID NO: 4576 - DNA, 588 bp, Bacillus clausii
cttaacgtcgactttcgttaagggggaccggacgatcaagcgaacattgaatcctgaccgagcgtatacttctccagacggcggctctttaactttatcaggtcgttcgttactgttcgtccgcaatgttggccatttaattaccacgaatgcggtgctagatgaagacggccaagaggtgccagaaggtttccttgattgtatcgttaccggtctaatcggtaagcacaccctattgggcaatggagcttatcgaaactcacaaaagggatcgatttatattgtgaaaccaaaaatgcacggttcagaagaagtagcatttgccaatgaactgtttaaccgtgttgaagatatcattggacttactcgcaatacccttaaaattggtgtgatggatgaagaacgccgcacgtcacttaatcttaaaaattgcatccatgccgtaaaagaacgagtcgtcttcatcaatacaggattccttgaccgtactggtgacgaaatgcatacgtccatggaagctggcccaatgattcgcaagccggatatgaaatcgtccgcctggctcaatggctaccagcaatccaatgt

SEQ ID NO: 4577 - DNA, 495 bp, Bacillus clausii
  misc_feature (1)...(495): n = A,T,C or G
gcggaaagtgccgatgaaaatcttccntgctgttcattactcaatggacggcatgtgggtagactatgatcaaatgacgaacattcctggtttatttgctgccggcgaatgcgattattctcagcatggtgcaaaccgtttaggcgcaaactcgctgttatcggcgatttatggcggcatggttgctgggccgaaggcagtggagtacatcgaaggattgaatacagctacagaagatttgtcgtcttcgctatttgaggcgcaagtgaaaaaagagcaagaccaattcgacgcgattttgcgcatggatggtacggaaaacgcgtatgtccttcataaagagcttggcgaatggatgacggacaacgtcacggttgtgcgttacaatgacaagctgttaaaaacagatgaaaagatccaagaattaatggagcgttaccaaaacattaacatccaagatacggctaaatggtcgaaccaaggagctgcatttac

SEQ ID NO: 4578 - DNA, 369 bp, Bacillus clausii
  misc_feature (1)...(369): n = A,T,C or G
aacgacgagagaagaagcgcttcacatgcaccggataaaccaaggaaaactagnatcaaaagcgaaagtcccagtaaaggatgccagagacttaagcttagcctattccccaggtgtagccgaaccgtgcaaagnaatttttgaagatgttgnaacggtgtatgagtacacgatgaaagggaatatggttgctgtcgtcagcaatggcacagccgtacttggcctcggcaacattggccctgaagcttccctccctgttatggaaggaaaagcggttttatttaagtcgtttnccggagtagatgcttttccaatttgcctccgttcgaatgatgtcgatgaaattgtcaatacggtgaagttgcttga

SEQ ID NO: 4579 - DNA, 702 bp, Bacillus clausii
ctgaccgcggctcctctgaagaagagtttgctattccttaccggcaaaacttgaatgttatttcttgcttaatggaaattcgccgcaaccccgtcaatgccaaaggtgagaagacaacgcctgtcacttgggatatgaactgtctagaagaagtatgtggcgcttgttcaatggttattaatggcaaaccacaacagtcgtgcaccgcgctcgttgataagttggaacagcccattcgccttgagccaatgaggacatttccagttgttcgtgatcttgtcgtcgaccgcagcataatgtttgattctctgaaaaaagtaaaagcctggattccaattgacggcacgtatgatttaggtcctggaccgcgcatgccagaaaaaagacgccaatgggcttatgagctgtctaaatgtatgacttgcggcgtctgcttagaatcttgcccgaacgtcaattcaaaatctgaatttattggcccggcggcactttctcaagttcgcctctttaatgcccacccaactggcgaaatgaataaagaagaacggttggctactattatgacagacggcggtcttgccaattgtggaaactcacaaaactgcgtgcaagcttgcccgaaaggcattccgcttacaacatccattgctgcattaaaccgcgcgacggcattgcagtcctttaaaaacttctttggaagca

SEQ ID NO: 4580 - DNA, 743 bp, Bacillus clausii
gacattgctgcgccccgttgttttgagattgagcaacgcctacaggaagaactaaacatcccggttttccacgacgatcagcacggcacagcgatagttgtcctagctgcgctgatcaatgcactaaaagtcgtcgacaaagggttgaacagtgcccgcattgtcatcaacggtgcaggggcagcaggcctttcaatcgccacgcttttgctagaagcaggttgcagtgacatcacccttgtcagcttagaaggaattgtccaagaaaacgagccgtggctaaaccaacgccagaaagaattagcggctaaaacaaaccgacgccatcttaccggcaagctcgaccaagcaatcgaaggggccgatgtctttattggcgtctccgggcctcgcgcattaacaggcgaacaagtcaagcggatgaatagcgatgcagttgtatttgctcttgccaatccgacgcctgaaatctacccagaggaagcgttcgctgctggtgcggctgttgtaggcactggacgttcagactttccgaaccaaattaataacgttcttgccttccccggcattttccgcggcgctttggacgcccgcgctagcaccattaccatgacgatgaagctggcagccgcaaaagcaattgcgaacattgttggtgaagacttgcatgccggccacattctcccgtctccgttcgatgaacggattgcccctgctgtggccaaggccgttgcggatgaagc

SEQ ID NO: 4581 - DNA, 464 bp, Bacillus clausii
  misc_feature (1)...(464): n = A,T,C or G
gcagcgattgtcaatgggcgcttaaaaggantcgattctcgcaaagttgaagcgattacatatgcagccgacaaagttattgagggcggactcgaagatcatttccctttagttgtntggcaaacaggcagcggcacgcagtctaacatgaatatgaatgaagtgctggcctacttagcggaccaatacttggatgaaaatggacatcatgatgttcgtgtccacccaaangacgatgtcaaccactcacaaagttcaaacgatacatttccaacagcaatgcatgtcgctactgtcgtttttgcggaagaaaacctccttccagcgattcgcgccttcaaagacacacttgctgaaaaagaagaggcctttgcggatgttgtgaaaattggccgtacacacttgcaagatgcgaccccgctcacatttgggcaagaaatcagcggttggaaacatatgctcca

SEQ ID NO: 4582 - DNA, 1146 bp, Bacillus clausii
atgaatatcagtaaatttgtaacaccagagattatttttgggagtgacgcgattaggcaagcgggggacgcttgcgtgcggcttggggcgagaaaagtattgattgttagtgataatggtgtagctaatgccggctggctagaaaaagtaatggatctttgcaaagagtctcatttgccctttgccacgtttatcgacgtgacgatagacccgaaagatcgcgaagttgagcaagggtgccgagtgtttgttcaacatgagtgtgacgcgattattgggattggtggaggaagtgtgttagatgtagcgaaagcgattgccatactcgcaacgaacggaggggcgattagtgattatgaagggattgataaaattaaaaaaccccttcccccgatgattatgattatgacaacggcaggatctggctctgaggtgtcgcagttttccatcattgtggattcgactcgaaaaaagaaaatgacgatcatatcgaaaacattggtgcctgatatcgccattattgacccttttacactcgtcacgaaagacagcagcctcactgctacaacggggatggatgtattgacgcatgcggttgaagcctatgtcagtgtggcggctactccgcttacagatgtccaagcgaaaaatgccctcaccttgtgtgctcaatatttgcgcccctctgttgcctcgaaaacaaataaagaagcgaaggaagcgatggcaatggctagtttacaggcagggcttgctttctcaaatgcaatcctaggggcggcacatgcgatctcacatgcaataggggggaagtttcctttgccgcatggagagatcaatgcgattcttttgccctatgtgatggattttaattttatcgcagcacctaaacgattttcagacatagcgacatgcttagggatcgatacaagaggattgaccgatcgggaagcaggcaatgctgcgatccaatccgttaaagaactatcctctgatattgggattccaaccaagtttaaacaagtcgggttaacagaaatgattgatcatataagccaagtggcgttagaagatgcgtgtatgattacgaatccccgtgacatggatattgagcaagtgaaacaagtattaaatcatgttttatag

SEQ ID NO: 4583 - DNA, 486 bp, Bacillus clausii
gctatattcataaaaaaggccatatcggcgttgtttcccgttcagggacattgacttatgaggctgttcatcaactatcaacggctggcattgggcaatcaacagctgtcggcattggtggcgaccctgtaaatggcactgattttattgacgttctatctttgtttaatgaagatccagatacgtatgctgtaattatgattggtgaaattggcggcacggctgaagaagaagcggcagaatgggtcaaagcaaacatgacaaaaccagtcgtaggctttatcggcgggcaaacagcccctccaggaaagcggatgggccatgcaggcgcgatcatctcaggcggcaaagggacggcagcagagaaaatcaaaacgatggaagcgtgtggcattcgtgtagctgctaccccttctgatatgggagaaacacttattgaagcattaaaggcgaacggcttgtatgaaaaaagcctcacccacgaaa

SEQ ID NO: 4584 - DNA, 558 bp, Bacillus clausii
cgggatttgatgcgattgaactccatggcgcccatggctatttaatccatcaattcctttcaccatatacgaacacacgaacagaccgttacggtaaagaccgcacgctcttcgccaaagaagtcattcgcgcggtcaaaagcgtcatccccgacagcatgcctttattgatgcgtatttcagcaaccgaatatgtcgatggcggctacgatatagaagaagccatccgcttctcacagattttaaaagacgaaggagtcgacgtgttcgacgtcagctctggcggcgaagggccaatcggctctagagggctgccaggaagccacgcaggttaccaaacgccgctggcaaaacagatcaaacaggcactatctgtccctgtaatcgccgtcggccgccttgaaaaccctattttagccaatgccgtgatcggcaatgaagaagccgatctcgtcgccgttggccgcggcctgttagccaacccatactgggctcttggcgccgcgtccgaattaaagcttgctgttgatgctcctactcagtataaggctgggtttt

SEQ ID NO: 4585 - DNA, 339 bp, Bacillus clausii
aattcaagcaaatgatgacgtggatgattattacagtcgtgctagggttggcgtttttagggttggaaatttacgagttccaacactatgtccatgactatgaatttggctttacgactagcgcgttttcatcggcattctatacgctagttggtctacacggcgcccacgtgttgttcggactcgggtggatcacgcttttgattatccgcaacttccgtgccggcatcacattgacgaatgcaccgaagttttacgtggccagcttgtactggcacttcattgacgtcgtctgggtatttatttttacggttgtttatttaatgggagtaggagggt

SEQ ID NO: 4586 - DNA, 339 bp, Bacillus clausii
atgaccatttgagtaagccgtttgataagagcgcgatgacggaagcagaaaaacgggaaatgaaaacggaaatccgcaatcaaatcgtcgtgtttgtcctcatgttgtttttaaccgtgctggcattcgcggcggttggtgccgatattattccaaataatttcgctgtaccgtttatcctcattcttgctgtcgttcagctactgctccaactgttgttctttatgcatatgaaggataaagaccatacttgggcaacggtgtttatcattacgggaatctttgtcacagtaccgacaattgtttcgcttatgctgctaatcggtattgtgaaatact

SEQ ID NO: 4587 - DNA, 398 bp, Bacillus clausii
  misc_feature (1)...(398): n = A,T,C or G
agaaaatttttattagtccaagcaagtatgttcaaggcagaggggttctcgacaagacaggtgaatatctgaaagacttaggccaaaaggcgctgcttatggctgatgaatttgtctggggaatcgctggaaaccgagtggctgacagcttgaaagaagcagggctttccgtggtggaaatcacatttgaaggcgaatcgtccgaggcggaaattaagcggatcgcaaaaaaagctgaagacgaaggcgctgagatcattgtaggaatcggtggcgggaaaacattggataccgctaaaggggttcgggatcgcttgaaaggtgccggctgtgccattgttccgacaacggcttcaaccgatgcgccgncaagtgctttgtcggtcatctattcagag

SEQ ID NO: 4588 - DNA, 342 bp, Bacillus clausii
caaacaatatgcggatattccaggaggagatctttggccctgttgtttccgttgcgacatttaaagatgcagatgaagcactacgaattgccaacgattccctttacggtcttggtgcgggcgtatggacacgcaacatcaacaccgcttaccgctttggacgtcagatcgaagccggtcgtgtctgggtgaattgttatcatgcttatccagcacatgctgcttttggcggttataaaaaatcaggtgtaggccgcgaaacacatttgatgatgcttaaccattaccagcaaacgaaaaacatgcttgtcagctataatgacaactcgcaaggattctttt

SEQ ID NO: 4589 - DNA, 942 bp, Bacillus clausii
atgtacattgcgtgtgcattgttaatgcttttccgcggtggcgtcgacgcaatgatgatgcgtttgcaattgactgccccaggcatgacgtttttaaacagccagcattacaatgaaatttttacgacgcatggcacgatcatgatcattttcatggcgatgcctttcctgattgggttaatgaacgttgtcgtgccgctgcaaattggcgcgcgtgacgttgcgtttccattcttgaacaatttaagcttttggacattcttttttggaatggcactttttaatatttccttgatcattggcggttcgccagcggcaggatggacgtcttattttccacttgcctcgaatgacttcagtcctggcgtcggtcaaaacttttatgcgctcggtcttcagctttccggtatcggaacgcttgccacagggatcaactttatcgtcacgatctttaaaatgcgcactaaaggcatgacgctaatgaaaatgccgatgtttacatggacagttttaatcacgtcaatgattattgtccttgcgtttccagtgttgactgtagcgctagcaatgatgacatttgaccggctgttcggatcggcgttctttaccttgcaaggtcaaggccttgatatgctatgggccaacctattttggatttggggccaccctgaagtgtatatcgttattctccctgcatttgggatcttttcagaaattatttcaacgtttgcgcgcaaaaagttgtttggctacaatgcgatggtcgcttccgttgtgattatttcgtttttaagtttccttgtatgggttcaccacttctttacaatggggaatagcgcggctgttaactcgtttttctcaattacgacaatggcgatttcgattccgacaggtgtcaaaatctttaactgggctctttacgctacacaaaggaaaaattag

SEQ ID NO: 4590 - DNA, 1079 bp, Bacillus clausii
ttgagatgggatgaatttattgtaacgggagacccgcttatacttggtgcgcaaatttccattgctttatcaagtataattgcaattgtcgcccttacttattttaaaaaatggaaagtgctctggacggactggatcacatccgttgaccataaaaagattgggattatgtacattgcgtgtgcattgttaatgcttttccgcggtggcgtcgacgcaatgatgatgcgtttgcaattgactgccccaggcatgacgtttttaaacagccagcattacaatgaaatttttacgacgcatggcacgatcatgatcattttcatggcgatgcctttcctgattgggttaatgaacgttgtcgtgccgctgcaaattggcgcgcgtgacgttgcgtttccattcttgaacaatttaagcttttggacattcttttttggaatggcactttttaatatttccttgatcattggcggttcgccagcggcaggatggacgtcttattttccacttgcctcgaatgacttcagtcctggcgtcggtcaaaacttttatgcgctcggtcttcagctttccggtatcggaacgcttgccacagggatcaactttatcgtcacgatctttaaaatgcgcactaaaggcatgacgctaatgaaaatgccgatgtttacatggacagttttaatcacgtcaatgattattgtccttgcgtttccagtgttgactgtagcgctagcaatgatgacatttgaccggctgttcggatcggcgttctttaccttgcaaggtcaaggccttgatatgctatgggccaacctattttggatttggggccaccctgaagtgtatatcgttattctccctgcatttgggatcttttcagaaattatttcaacgtttgcgcgcaaaaagttgtttggctacaatgcgatggtcgcttccgttgtgattatttcgtttttaagtttccttgtatgggttcaccacttctttacaatggggaatagcgcggctgttaactcgtttttctcaattacgacaatggcgatttcgattccgacaggtgtcaaaatctttaactg

SEQ ID NO: 4591 - DNA, 977 bp, Bacillus clausii
  misc_feature (1)...(977): n = A,T,C or G
ttgcgnacaccatcgaaagtctttaaatggtttgctctaaccatggtcggtctccttctgagtggttgttggaatttnncggtccttgacccacaaggtcctgtagcggaacagcaaagcgatttgatcatgctatcaatctggtttatgattttcattgttttagtcgtgtttgttttgcttacagtcatgattgtcaagtaccgtgaccgaggaaacaatgacaattatgatccgtcgattgagggcagccncaagttggaatttgtttggacgattattccaattatcattgtcaccattctttctgtaccaactgtcataaccatttataatttggaagaagctcctgaagtagctgaaggcagcgtccaagttgatccgcttgtcattcacgcaacaagcgtaaactggaaatggatctttagctatccagaggaaaatattgaaacggtcaactatgtcaatatccctgttgatcgtccagtccagttcaaattgacttcagcagattcaatggcatcgttttgggtaccgcagcttggtggacaaaaatacagcatgtcgggtatggaaacagaattgtttttaatggctaatgaaccaggcacgtacaacggccgtaatgcaaactttacaggcgaagggttcacggagcaacggttccttgttaatgccgtaacagatgagagctatgattcatgggtggaagaagtgcaagcggaagcaccaccattgtcagaagaagaatacgcacatctaatggttccaggtcacgctgaagaaatgacattctcttcaacacatcttgagtttgtcaaccatgcttatgatccgacatacgcgcttgagaaaagtgcagaacttggatatgagccactaaatccgcattcgagagaaggcaaagcgtacgaaatgccaaaactgacgcaaccaattgacacatcaagaacatataaagtggaattggatgatga

SEQ ID NO: 4592 - DNA, 576 bp, Bacillus clausii
tgaaggcacgatgacaaatgtcgaaggcagagtgacgttgcgtgaagccagtatgcccccttatggggaagcccgccatgattggcaaattatttgtaacattgcggctgttcttggcaaaggaactgatttttcctattcctgcgcggaagacatttttaccgaattaagaatggccagcaaaggtggaatcgctgattactatggaattacgtatgagcggcttaggaaagaaaaggggattttttggccatgccctagcctggaacatccagggacgccaatgttatttacggattgtttttatcggccaaacaaaaaagcgcttatgaccattgtgccgaatgaggcgcctgtaccaaaagaaaaaccaagtcgagattaccctctttatttaacgacgggcagagttcttgctcactatttgactggcgtacagacacgaaatagcgcctcccttatggcacgaaactttgaatcttttgcagaaatgcatccagaaaccgctaaaaggcatggaattgctgatcaaacgcttatcaagctgactaccaaacaaggcagtatgatcgtccg

SEQ ID NO: 4593 - DNA, 918 bp, Bacillus clausii
acgaaaacaccgtttgtgaaaaagtcgttcaaggcaatgataaacgcccggccattcaaacaaggggcggagcgacagtaacggctaaaaaagtcgtctcggcaacacacttcccatttgtggacggcggcggcctgtacatgacacgtttgcgggcagatcgatcctacgtcattgctggtacatgcgcaaaaccttggcctggcggcatgtatttaagcgtagaccaaacaagccgttctcttcgcagcgccacaataaacggcgaagaaatgattttagttggcggagaagggcataaagcggggcaagggatgaatgcgctcaaacattacgatgcaatcaaacaattcgcgaccaaaacgttagaaggatttacacaaacagaacaatggtcggcacaagacttgattacacttgacaaagtcccttatatcggagaattgtccgccctccgaccggatgtgctcattgctacaggattcaggaaatggggcatgaccaattcggctgtggcagcacacgtcttgtgcgatttaattgtggacggcaacagcttatacagccaattatttaagccatcacggttccatgccgatccaagcatccgttcctttttaaaagaaaatgcagacgtggctaaacatttgatccgtggaaaactacatcaggatattgaacatgttgaggaacttgaagctggggagggagccgttattgacaaagacggcgaacgagtaggcgcctaccgcgataaagacgggacactccacctcgtcgatacaacgtgcacccacatgggctgtgaagtaaattggaaccacgcagacaatacatgggattgtccatgtcatggctcacgtttttcttatacaggcgatgtcattgaagggcctgccaaaaaaccacttggaaaaa

SEQ ID NO: 4594 - DNA, 138 bp, Bacillus clausii
  misc_feature (1)...(138): n = A,T,C or G
aactttaccgttcattccgccaagaagtgccataagangaatacacaattgaacttggcanagccgatattaagcgagaaggaaaagacatcacgattgtggcctatggagcgatggttcaagcttctttgaaagcag

SEQ ID NO: 4595 - DNA, 742 bp, Bacillus clausii
atgaatatccacgagtaccagggtaaagaaattcttcgttcgtacggcgtagccgttccaaacggaaaagtagcattttctgttgaagaagcagtagaagccgcaaaagagcttggctcatctgtatctgttgtcaaagcacagattcacgcaggggggcggggaaaagctggcggcgtaaaagttgcaaagaacctcgatgaagttcgtacatatgcggaagaaattcttgggaaaacgcttgtcacgcatcaaactggaccggcagggaaagaagtaaagcgcttactcattgaagaaggctgtgacattaaaagcgaatactatataggccttgttgtcgaccgtgcgacttcaagcgttgtcttgatggcttctgaagaaggtggcactgaaatcgaagaagtggccgaaaaaacaccagaaaagatctttaaagaagtgattgaccctgccgtaggtttgcaagggttccaagcgagacgcatagcttttaacataaatattccaaaagaacttgtcggccaagccgtcaaatttatgatgggcttgtaccaagtgtttgtggataaagatgcatcgattgctgaaatcaacccacttgtaacaactggcgacggcaaagtcatggcattggatgccaagttcaactttgattcaaatgcgctttaccgccataaggacattttggaattacgcgatttggaagaagaagatgtaaaagaaatcgaagcatctaaac

SEQ ID NO: 4596 - DNA, 1105 bp, Bacillus clausii
atgtatattcgctcaattgagccgacaccaagcccgaatacaatgaaaatcaacttaagtgaagcagcagccggtacaagcaccacgtaccaagaaaaaaacaaagcagaggcgccgacttttattcaacagctttttgacatagaagggatcaagcaagtttaccatgttggtgactttttagcagtggatcgatatccaaaagcggattggaaagcgattttgccgcaaattcgcaaacaatttggcgaagaaccagacgagcaagcgaatgccaacaacctacatgatggctatggcgaagttcaagtgcagatccaaatgtttaaaggcattcccatgcaagtaaaggtatcagacggcgaagaagaagtgcgagaaggacttcctgaccgctttgcccaagctgtagcgcaagcacagcttccaaacgacaatgtggtgctagagcggaaatgggaagagcaagcgccccgttatggcgagctagcaaccattgcgaaagaagtagctgctgaaataagcgctgcttaccctgaagcaaggctcgacagcttaatcaagcttgctaaaggagaaaaagcggcagcggaaagctttgccgcccgcttcaaagaagtgacactggaaatgttgcaagcagaagattggcgtgaccgttatgctgcgcttgaacagatggatccaaaagagaaagacttgccggtgttggaaaaagcgctcaccgatgaaaaagcgtcgattcgtcgtttggctacgatgtatttagggatgatcgagacagaatctgttttaccattgcttgaaaaagcgttgaaagacccttctgtcactgtacgccgtacagctggcgattgtatgtcagacatcggatctgaaaaagcgattccagcaatgattgagtctttaaaagatgaaagcaaaatcgtccgttggcgggcggcaatgtttttgtatgaagtaggcacggaagaagcggtccctgccttgaaagaagcagaagacgactctgaatttgaagttgcgctgcaagtaaaaatggcgttggcacggattcaaggtggcgaagaagcaaaaggttctgtttggaaacaaatgacagagg

SEQ ID NO: 4597 - DNA, 396 bp, Bacillus clausii
aaggctatgttagctgcggtgaagaagacatctcgtgtgtttctgaggataagtgctttatggatgaagggccatgtaccagagattactatacggttgaaataggcaaggccaacgtcattcgcgaagaaagacatgacgatcgtagcgattgggaaaatggtgcaagtagcagaagaacggctcaaatccttgcaaaagacgacatttccgtagaagtgattgacttacggactgtcgcgccttgggatgaggagacggtcatggattcggtcaagaagaccgggcgtttaattgtgatagatgaatccaatcctcataacaacacggcgacagacatcgcctcagtcgttgcagataaagcatttgattacttagaggaccgattaaaacggt

SEQ ID NO: 4598 - DNA, 312 bp, Bacillus clausii
ttggccacttaatggaatcgagcttgcatattccagcagcgattttaatgatcttgattgctgcgattgcgaaagtattaaagctgattcctgaacaacttgagcaaggcgcttttcatttatataagtttgtatcaacaagctttacttggccgcttatggtagggcttgggttgttgtttattccccttgaagatgtggcaggcattattagcttttcctacgtcctgatttgcgccacagtcgtctttgccatgatcgcaactggctattttgtcggacagtggcttaacatgcaccctgtcgactcgg

SEQ ID NO: 4599 - DNA, 156 bp, Bacillus clausii
ttgtaactggttgccacagcggcctaggcggtacaggcgatgtcgccattttatcggcgtccgaccgcatgagcctaatgccgtttgcgcaagtagcgacgcgtctaggtggagcagggacagttattttagcaacatttgtattgcgttggttag

SEQ ID NO: 4600 - DNA, 321 bp, Bacillus clausii
aaatgaaggagtatgataacgtgtcacaagcacgaaaacagaaagaggcagcgattgcgctgcataagcatgggaaaatggaaatgaaaagcacagtccctttaataaatgaatacgatatgagcctcgcttatacgcctggcgtagctgagccatgcaagcgcatcgctgaaaataaagatgaagtatacgaccacaccattaagggcaatcttgtcgccattgttacggatggctctgcagtgctcggccttggcaatattgggccagaagcggctatgccagttatggaaggaaaggccgttttatttaagcaatttg

SEQ ID NO: 4601 - DNA, 525 bp, Bacillus clausii
  misc_feature (1)...(525): n = A,T,C or G
caagccccataatgatactgtccaaattgccacgagactcgttgagttgtttatccaggcaggaacaccnaaaggcgttttgaatcttgtcaccggggacggcgacaaagttggacaagaattaggcgaaaatcgaacgttaaaggcaatttcgtttactggttcttccgatgtcggtttgcgattaggccgatccgttacaaaccgaggaggaaaaatgcaggcggaaatgggcggaaaaaacgcaacggttattttagaggatgctgacttggataaagctgtttctggaatcgtcattagcgggcttctgaacaacgggcaaagctgcacaggaacctctcgcgttatcgttcctaaaaacatcgctaaaacggttacttccaaactcgtcgaaaaagcaactgccattcgcgttggcgatggctttgatgaaagcatggaaaacggccccgttgccaatgaggcgcagcttcgcaagtacctccattatgtagacattgctgttaaagaaggcgcgaagct

SEQ ID NO: 4602 - DNA, 216 bp, Bacillus clausii
ttatattcacgtcattatcggtttttttggcgtcccatttgacttaattttaagcacagatgcctattattttgcattgttgccactcgttgaacagattgtaacggaagtcggagtatcttctacttcagccgcatatgcgctcgtgatcggaaacatcattgggacatttgttagcccccttgctccggctgtatggctggcattgcaacttgc

SEQ ID NO: 4603 - DNA, 672 bp, Bacillus clausii
cagccagtaagcgccgaaagcaccacagtctcctgcaccagtaagcgaaggggaagcaggcaaacctgttgaacggcaaaaaatgtcgcgtcgccggcaaacgattgcaaagcggcttgtcgatgttcaacatgaaacagcgatgttgacgacttttaacgaagttgatatgaccgcagtcatggatttgcgtagccgccgcaaagatgcattttctgaaaaacatggtgtgaagttaggcttcatgtctttctttacaaaagccgttgttggcgctttaaaagagtttccgcttctaaacgcagaaatccaaggcgatgagcttctcgtcaagaagttttatgacattggcattgctgtttcgacagatagcggcctcgttgtccctgtattgcgggatgccgatcgcctcagctttgctggcattgagaaaggcattggcgaacttggcaaaaaagcacgggacaataaattgcaattggcagatatgcaaggcggtacgtttacgattacgaacggcggtgtgtttggctccctctggtcaacgccaattttgaatgcgccgcaagtaggcattctcggtatgcataaaatccaaatgcgcccagtagcgattgacaacgaacgttttgaaaatcgtccaatgatgtatttggctctctcttatgacca

SEQ ID NO: 4604 - DNA, 234 bp, Bacillus clausii
tgtcatttgtcattttaagtccttgcattggcgaaaaggcaggagaatgtgctgaagtttgcccggttgattgcattgaagaaggccatgaccagtactttatcaatcccgatatttgcatcaactgcagcgcctgccaaggcgtctgtcctgtggatgcgatcgtggaagaatatgaaatgagcaaagaggacgagcctttcttgaaaaaggcggaggcgctgtttgggatcg

SEQ ID NO: 4605 - DNA, 416 bp, Bacillus clausii
caaagcgtgatatattgcgagaagcatcgaaccaagtaccaacccaagcagtcaaacaagcagcaaatggaaacgcgcaaatggcgcacttagacgacataggggcaggcctgtctccgatccgcaaaacgatagcccgtaatatgcgcgccagcttgcacaatactgcccagctcacattgcatcgtaaggccaatgcaaatgcactgcttgcctttcgtcgtttattgaagacagaatcagagtctcaccagttacagttgaaattgagcgtcacggttcttattgcccgggcgaccatactagctctccagcaagttggtgccatgaacagccgctatgagaatggacagcttaaagaatttgaaaatgtccatttaggaattgcaacgtcactggacgatggacttggcgtc

SEQ ID NO: 4606 - DNA, 693 bp, Bacillus clausii
atttggcgtaggagaacatcaacgccaagattatgccgcttcttcccctgctgtcgtattggctgcggcggcttcgcaaacgaaacgaattaggctgacaagtgcggtgactgtgctttcatcagctgaccctgtacgcgtcttccaagatttcgcaacgcttgacgggctttcaaacggacgggcggaagtgatggcaggcaggggctctttcaatgagtcgtttccgttatttggctatgacttaaatgattatgatgagctgtttgacgagaaacttgatttgcttatgcatctacaaaagtcagaaagagtaacgtggagcggcaagcatcgcccggctattcaaaatttaggtgtgtatccacggcctgtacaaaacccgctgcctatatggattgggagcggaggcaaccaggaatctgttattcgggcagggctcctcggtcttccgcttgtcctcgcgatcatcggtggaaatccactccactttgctcctctagtggaactttattataaagcagctgagcatggaggacatgacccattaaaactccaagtcgcctctcattcacatggatttattgccgaagatgtggaaactgcggcagacacattcttcccttctacccagcaggcgatgaatacgcttgcccgggagagaggttggggagtatacacccgctcaagctt

SEQ ID NO: 4607 - DNA, 561 bp, Bacillus clausii
aaaaatgtaccgcaacaagcagggtgatcatccaaagcaaagtatatgaagtatttaaagaaaagcttcttgcaaaagtgaaggaaataacagtaggagatggcatgcaggaaggtatctggatgggtccatgtgcaaataaaaatcagctggatacagttctttcatatatagaaaaaggaaagctagaaggggcggctttattatatggaggcaaccggcttcaagatggaaatacaggcagcggttattttgttgaacccacggtatttgaaaatgtgaatacaaatatggtgattgcacaagaagaaatcttcgggccggttttggtgttaatgaaagtagagagcattgaagaggcgctttctctcgccaatgatgttgaatatggattaagtgcttccatctttacaactaatatcagcaacatgctttcttttatcaatgaaatggatgcagggttagtgcggattaatgcggaaagcgcgggggtagaacttcaggctccttttggcggaatgaagcaatcaagctcccattcccgcgagcaaggaagagcgg

SEQ ID NO: 4608 - DNA, 762 bp, Bacillus clausii
cactattgccttcgatggcggtaggatttctatggcttttatttgtcgcttactggattggaaaaaaagagcgaaaacgccttggcgtccaatcaatcgaacattcaatgagcagtgctcaaacggaagagcaattgaaaatgaaacgcccgaagctgtttattcccaatttattgttgaccgccttgacgttaacgacattggtgatgcaatggttgccgctgcccgtcgtctttatcattgcctttgtgcttgcgttgctaatgaattatccgaatccaaaagagcaaatgcaccaaatccagttgcaagcgtcgggcatggtgccggtgttatcgattatttttgcagctggaattttcacaggtatccttacaggcacagggatgatcgaagcgatggcagtggcgttagtcaacctagtgcctgaacaaattggcggttcactgccgatcgttgtcgccattgccagcatgcccctcagcctcgtctttaatccagacgcctattattacggcgtcatgccaattcttgcccaatcggcagaaatgtacggcgtgcctggaatcgaaattgcccaagcatgcgtactcgggcaaatgacagttggctttcctctcagtccgctgacagcatcaacgtttttgttggttggccttgcgcaagtagaattaggtgaccatcaacgatttatgttcaaatgggcctttttaacgacactatggatggcgctatttgctttgcttactggcgtgttgtctg

SEQ ID NO: 4609 - DNA, 561 bp, Bacillus clausii
  misc_feature (1)...(561): n = A,T,C or G
tgatattatccggaccggcgggaaattggcgaaggacgttgccgggctacgacttaacgcgcttgcttgttggagcggaaggaacgcttggcgttattacagaagcgacattaaaacttgtgccgatgccggagacgaagcagacgatgcttgctttgttttctgatatggaagcagcagcacggtccgtttcttccattattgccaaccgcattattcccgttacgcttgagtttctggaccagccaacattaaaagcggtggaagattttgcgaaaatcgggctcccgactgatgctgaagccgtattgctcattgaacaagatggagcaaaagaagtggtcgaacgggacattcagcatatagctgagatttgtttgaatgaaggagcgctttcggctgaagtcgcatcgtcaaaagaagaagcgctcgaactgacggcagcccgccgtgcagcattgtctgcgctggcaaggctccggccgacaacgattttagaggacgcancggtgccccgctcagaagtggcgaatatggtccgggcaattaacgagattgcca

SEQ ID NO: 4610 - DNA, 1035 bp, Bacillus clausii
acaagcattcagccgctgggcgtctagacggattaagacaagaaagtcgtcgttgtttttgccgtttgtgttagggtttgtgatttttattgatgattattttaacgctctaactgtcggcaatatgagccgaccgttaacagaccgatatcgtgtttcacgggcgaagcttgcttacattgttgattcaacgtcagcgcccatttgtgtcatcatgcctttatctagctggggtgcttttattatcgggacgttggcgactgttttaacagctaaccagttagacgaattcggtgcattccaagcgtttttatacacagtaccgattaatttttatgcattaatttcgttattgtttatcgttctaattattttatttaacatcgacattggcctgatgaaacgccatgaagaccgggcaaaagccactggcgaattgacggaccctgcaaaaggagatgtgcctggcgatttagatgaagcgctcgtcatgactaatggccgcgtttaccagctatttttgccgatcattgcccttgttgttgcgaccacttcgcttttgttttatactggcgcgacggcagccgctgcggaagggttgccggcgacactactcaatatgcttgagtacacggatatcggcttttcgttgcttcttggcagttgcattggctttatcgttgctgttgcaacaacgttagcatctaagccaaatttgccagacttcggaagagccttaaaagccggcgtgacggcgatgatgccagcgatttacattctagtgcttgcctggacgacgattgacatgattaatcgcctaggcacaggcgcgtttttggcatcgctagtgagtgattccgtcaaccctggctttttgcctgtcatgctatttttgattgcttgtttttcggggcttgcgacaggtacatcgtggggaacgtttggcattttgctgccaattgccgggcaaatggcggcactgatcgagccgtcgatggcgattccaatgtttgcagctgttttagctggttcgat

SEQ ID NO: 4611 - DNA, 234 bp, Bacillus clausii
cgaaagctgagaaaaacaacccgagccatattggcgcttcaatgccaggaacggtcattaaggcccttgtagctgaaggcgacaaagtggaaaaaggcgaccatttgatgattacagaagcgatgaaaatggagacaactgtccaagcagccattagcggtacggttaaaaaagtgtatgcacgagacggagagtcgatttcaacaggcgacttgctcattgagctttctgagt

SEQ ID NO: 4612 - DNA, 495 bp, Bacillus clausii
ggttgagtttattacaatggcacctacttcaggagatggcacgagcatttccaccggaaacgctggctggacaacggcaaaaggaacaacgcagcgtgagccttctttttcctatataaaggaaattgccgaagcggctgaagccggcggctttacgtcgctattgcttccaacaggcgctggctgcttagattcagtagcggtagctgccaatttgattaactgcacccaatcattgaaatttttatttgccgttcgacctggcgtcatgtcgccaacgacgtttgctaagcaatttgccacgatcgacaattggtcggaaggaagggcgcaagtgaatattgtcacaggcggttcgccgaaagaactggctggctatggcgattttttgcctcatgatgaccgttatcgtcgtacagaagaatatatccatgttttgaagcgtctattttcagaaaaggaagttagtcacacaggagaattttatgagctaaa

SEQ ID NO: 4613 - DNA, 702 bp, Bacillus clausii
atggacgtacaagcaattgcccatagaggctattccgcaaagtatcccgaaaacacgcttgccgcttatgaagcaagtataaaccttggattttcccatattgaggttgatgttcacttaagccgtgatgaagtgcctgtcattatgcatgatcaaacggtcgatcgtacaaccaacggcactggccttatcaacacctatacattaaaagagctgcgccgtttaaaaacgagcggcaacgaacagattccgacacttgaggaagtgttggacttggcaaaagggcaggtgaacatcgcaatcgagttaaagcaaaacgagaacatgtatcctcggttagaggggaaggtcgccgcattaatagaggaaaaaagaatggccaatgacgtttatgtcaattcatttaatcatgaatcgatggggacgttgagggagattgcccccgacttggaaattggcttaatcaaaagtgacgcaacgccagccttgtttccttatatggaacaaatacaggcgtcttccattgcaatggagcttcgtttctatacagaggcctttgccgatgagtgtaaggagcgtggctatcagctcattgtttggccagttgacacaaaagaagcgtgtaaaagaatggcaaaaaggccagacgtgctatgtacggtaaatgaattggagctgttcaaagaaaactaccatgcctaa

SEQ ID NO: 4614 - DNA, 209 bp, Bacillus clausii
atggcttctttgagcgacattaaaaaccggataaactcaacaaaaaaaacgaggcaaattacaaaggcgatgcaaatggtttcagcggctaagctgaaccgcgcccaagaaaaagcgcaatcgtatgaagtgtatgccaaaaaaatgcgcgaagtcgttggcaacatcgctcaggcaggcagtgatacaagccatccgatgcttgaaga

SEQ ID NO: 4615 - DNA, 1515 bp, Bacillus clausii
atggcaagcattaaagcgacagaaattagctcgctcattaagcaacagatcgaccaatttgaaacaacggtcaatgtgcaagacgtagggactgttattcgcgtcggggacggtattgccttcgctcacgggctcgacaatgtcatggccggcgagctacttgagttctcgactggggtaatgggaatggcccaaaacctggaagaagacagtgttgggattattattttaggtccgtatacagacattcgtgaaggggacgaagtcaaacggactggccggattatggaagtaccagtaggaagcgagcttcttggccgcgtcgtcaacccgcttggccagcctttagacggcctaggaccagtgcatacaagcaaaacgcgtccaattgaaagcccagctccaggggtaatggcacggaaatcggtccatgaaccattgcaaacagggattaagtcgattgactccatgattccaattggccgtggacagcgggaattgattatcggcgaccgccaaacaggtaaaacggcaattgctattgatacgatcatcaaccaaaaagaccaagacatgatttgtgtgtatgtagcgattggccaaaaagaatcaaccgtttcaggtgtagttgaaacgcttcgtcaacggggcgcccttgagtatacaattgtcgtctctgcaagtgcgtctgaccctgcgccattgcttttcttggctccgtatacaggcgtatccatggcagaagaatttatgtataacggcaagcatgtccttgtcatttatgatgacttgtcaaaacaagcagctgcttaccgggaaatgtcattgctccttcgccgccctccaggtcgcgaagctttcccaggggatgttttctacttgcactcccgcttgttagaacgtgctgcgaaattgaatgatgacttaggaggcggctccattaccgcgcttccattcattgaaacacaagccggtgatgtttctgcttatattccaacaaacgttatttcgattacagatggacaagtgttcttacagtccgacttgttccactcaggcgttcgcccagcagtaaacccagggatttctgtatcccgtgttggtaattcagcacaaattaaagcgatgaaaaaagtagtgggaacgctgcgtcttgacttggctgcataccgggaacttgaggcgtttgcccaattcggttccgacttggatgcggcaacgcaagcgcgcttgaaccgtggtgagcgcacagttgaattgctgaagcaagatttgcaccagccgcttccggttgaaaagcaagtagcaattatttacgcgctgacgaagggctatttggatgatgtacctgtggctgattgccgccggtttgagtctgaactattcacatatcttgaaagcaacaacaatgaattgcttgagcatattcgcacaacgggcaatttgcctgaagaaagcgatttgaaagcagcaattgaagcgtttaaaaaaggttttgtcgcttctaacgaatag

SEQ ID NO: 4616 - DNA, 546 bp, Bacillus clausii
atgagcaacaaggcagtagcaaatcgttacgctgttgctctttttgagttagcggaagaaaaagggcaaacggatgtgtttgaacgggagcttgaactggtacaggaagtgtttgaaacgacgcctcaattagaaacggtgttagcccaacctgggctttctgctgataaaaagcaagcgctccttcgggatgcgtttcaggctcatctaagtccagcagtgatgaatacgatcaatttgctaatggaacggggccgttattcagaaatcgtgggcctcgctggtgaatacaaacaattaaacgatgacaaaaaaggaattgctgaagcaactgttttttcggttaaggcgctttcggacagtgaaaagaatcaaattgctgccgtgtttgccccaaaagctggaaaacgggaactgcgagttgtgaatgtcgtcgattctgctttaataggcggattaaaagttcgtgtaggcgaccgtgtctttgacggtagcatccaagggcagctgaaacgcctcgaaaagcaattggtagcaggacaataa

SEQ ID NO: 4617 - DNA, 477 bp, Bacillus clausii
catcgaatggggcacagccctctaccaactattggcattcgctgtgttgcttttaattctttctaaatttgccctcaagccgcttcttggcgtcatgcaaaaacggcaagatatgattaatgagcaaattgattcagcggaacaaaaccgcaaggaagctgaaaaactgcttgcagaacagcgggaagaaatgcaaaaggcgcgagtcgaagcgcgtgaactgattgaaaatgcaaaaaaagcaggcgaacagcaagggcaggaaatggtccgcgccgccaaagaagaagcacagcgcattcaccagcaagcgttggcggaaatccaaaacgaaaaagaccaggctgtagccgctcttcgcgaacaggttgcgtctctctctgtcttaattgcacagaaagttattgaaaaagaacttgacgcaagcgagcaagaccagcttgtccaagagtatcttaaacaagcgagcgaagagct

SEQ ID NO: 4618 - DNA, 711 bp, Bacillus clausii
aaacgttaatttatgcccaccgtggtgcgtctgggtcttatccggaaaacacgatgaaggcttttgaacaagcggcaaaagcaggggcagacggcattgaatttgatgtccaattaacgaaagatgatgtacctgttgtaattcacgatcgcacggtcaaccgaacaaccaatgggcaaggccctgtttgccaatacatggccaatgagttgaaacaattgaatgcagctgccaagcaaacgtaccaaaaacaagaaagtatccctttcctgtctgaactgctcgactgggcagcgagttatccgtcgctccatttaaacctagaaataaaagggtacggccagccgcatgaacgggtcattgatgcgattttgccgctcattcgcgataaccggtttaaagagcgtcttgttgtttcttcatttgaccatatgttgctagcaaagttgcaagcccatttacctttcattgaaacggcagcacttgtaaaagggcctttatttaaagcaaccagctatctgaagcagttaggggcaaaaggctaccatttagatagtatgcacgtatcaaaagaattaattgaagaaatgaatcaggcaaatattgctgttcgggccttcactgtcaatgacacgacaactttgaaaaagctattttcttggggctgtccagccgttttcacagattttccgacacgagcactccatttgc

SEQ ID NO: 4619 - DNA, 690 bp, Bacillus clausii
cttgttctcctaacagcaagagcaattatttatggaatgatgcgccagatgagaataaatgggctgattgcgtacactgcggcatgtgcctggaatcatgccccacctatgagataacaggccaagaacagcactcgccacgggggcgtgttcacctgatcaagtcggtagccgaaggcaagcttgaagtgaacgaaccgtttatcgatccggtctaccaatgtttagactgccgggcatgcacgactgcttgtccggctgatgtggatgtaggcggcttgatcgaagaagcaagaggacaaattcgccaagcgatgccgttaacaggtgtcaaggggctagtgagcaaatttttccttgaagggttgtttccacatccgaaacggatgcaaactttagttgggttgttaaaagtttatcagaagagtggcatgcagaagcttgttcgcacgacagggttaattcgcgttatgcccaagcaccttgttgaaatggaagcgattatgcccggcataagtgttcctgttcgtaagaaatacaaaaatgaaaacatcattgtggctaagggcgaagaaaaacataccgtcgccttcttaactggctgtatcatggacgtcatgttcagcgatatcaacgagtctacgattcatgtactgacgcgcaatggaaatagtgttaccattccgaagc

SEQ ID NO: 4620 - DNA, 549 bp, Bacillus clausii
tttatcggaaaaactaacggcagagacgaagaaattgacagtcggcaacggcaaaaacgatgaacattttgtcggcccgttcattcgccaaagccataaagacaaagttgttaaatacattgaacaaggggtagagcaaggggcagagctgttggttgacggccgcaacgcaacgagcgaggaagccggctattaccttggcgcaactttgttcgaccacgtgacaccggatatgacgatctggcaagaagagttgtttgcaccagtgctcagcattgtccgtgtgcgagatttggaagaggcaattgctttaacgaaccgatctcgctttgcgaacggagccgttatttatacatcaagcggcaaggctgcacaacactttcgaaatgcaatcgatgccggaatggttggcattaatgtgaatgtgcctgctccaatggcgttcttttcatttgccggtaataaagcatcgttttttggcgatcttggcacaaatggacgtgacggcatccaattttatacaaggaaaaaagtcgttacagaacgctg

SEQ ID NO: 4621 - DNA, 561 bp, Bacillus clausii
tagagcaactcattcgcgaacggagaacaattcgaaaatttaacgccagcccagtatcacaaaaactggtgatggagctattgctaaaggctgagcagctttgtccctacgagggcgaagcgcgatggcgatatgtgtatgcaggtacgcccgaagcacgggaaaagctggccagttatgtaagctaaaaaatcatggatagcaaaatggctagactaacgctgaacaaactcatgaagagctttcataaacggtttatggaggcgccggccaatatcattgccgttgtgaaaaccgaccccgatcctattaaaaagaaagaagcctacgggacattatgccgcattttgcaaaattttcagcttcttgcctgggagcagcggcttgggatggtatggataacgggacctgcgccctttattcaaagcgagcaattccacaagcgcattggcttgcagaaagacgaacagtttgttggacttctgcaaattgggtatttcgacaaagtcccgaaaggccgaacgcgaacccatgctgaacgactttggaccgcaattgaaa

SEQ ID NO: 4622 - DNA, 440 bp, Bacillus clausii
  misc_feature (1)...(440): n = A,T,C or G
gagggcctgnatacgccccataaagtaaaaatggctgtttccgcttgcccgcgtaattgtgcggaatcaggcataaaagatgttggaattgtgggtgtagaaggagcatgggaaatctatgtaggtgggaatggaggcgttgatttaagaagcgctgagctgctttgcaaagtggcaacgaatgaagaagtaatggaaacgatcagtgcatttttgcaatattatcgggaacaagccacctatttagaacggacttcccattggattgagcgagtcgggcttgaatcaattaaaaaagtgattttcgacgacagcatcgaacgagcagcgctaatcgaacggatggaaatggcgctatctaggcacaaagatccgtggacggaaattgttgagagtgaagaaaagcaacagcaattgtttgaaaagaaaaaaattgctgt

SEQ ID NO: 4623 - DNA, 372 bp, Bacillus clausii
  misc_feature (1)...(372): n = A,T,C or G
tgaatacgctaatggcttctacgttganccagcgatatttgaacatgtgacgtccacaaagcgtattgcccaggaagaaatatttggaccagtcattgctctcattaaagcaaaaactgttgaagaagcaattgatatagcaaatgacaccgaattcgggctaagcgcatccttatacacatccaatattcgctcagccctttctttcattgatgagatcgaagctggattagtccgtgttaacgcagaaagtgccggtgtcgaattacaggcgccatttggcgggatgaaagcttcaagtacgggaacacgtgaacaaggggaagctgccaaagaattttatacggcgattaaaaccgttttgattagaag

SEQ ID NO: 4624 - DNA, 453 bp, Bacillus clausii
  misc_feature (1)...(453): n = A,T,C or G
aactttaccgttcattccgccaagaagtgccataagangaatacacaattgaacttggcanagccgatattaagcgagaaggaaaagacatcacgattgtggcctatggagcgatggttcaagcttctttgaaagcagcngaagagcttgccgnnnaaggcattgaagcanangttatcgactngatgacnattancccatttgacgtggaaacagttgtggcttcagttgaaaaaacanaccgcgctattgtggtccaagaagcgcaaaaacaagcaggagtggcttnccacattgtcgctgaaattacagaacgggcgattctttctttggaagcgccggtgcttcgagttacggctccngacacggtttatccatttgctgctgctgaagatgcatggctgccaaaccaccagacgatcgtagaaaaagtnanagaagttatcaacttct

SEQ ID NO: 4625 - DNA, 761 bp, Bacillus clausii
atgagcaaaccgactgttttcttagcacgttctttgcctgaagctgcgcttaaccatgtctcacaattctgccatttgcggatatgggacgaaagcaaaccgctcactagagaagcattggcacacgaattggctgatgtcgacggcgcgatgctgacaggaattggcgcagatgccgagctcgtcaaacatgctagcaagctaaaagtcattagcaccgccaccgttggttacgatggctttgatgttgcaggcctatcagagcaaaacatttatgtcacaaacacgccgtatgttcttgacgaaacggttgcagacttgctgtttggcctcattctatcaggggctcgccgtatcgctccactgcacgaacaagtgaaggcaggcaactggacaaaacagacgacggcacaatctttatatggacaggatgtctacaaccaaacactcggtattgtcggcatggggcgcattggcgaaaaaatcgttcatcgggccaaggaaggttttgggatgaagattctttaccataaccgctcaagcaggccggaaatcgaaaagaagtatggcgccaaaaaactagaattacatgaactgcttgaacaagcggatgttgttgtcgtcatggtaccacttactgaggcaacaaggcatttaatcgggaaagaagagctaagcaaaatgaaagaaacggccattctcgttaatggggcccgtggtgccgttatcgacgaaactgccctgattgaagcattaaagca

SEQ ID NO: 4626 - DNA, 558 bp, Bacillus clausii
ttgcgttgcttatcacaggggttggaagcttggtgatcctctattcgatttattacctttcaaaagaacgggaatcattgcatcatttttatatttatttactcatgtttatgggagccatgctcggcgttgtgttctcagataatttgctagtgctttatgtattttgggaattaacgagcatttcttcgtttttgcttattgcttactggcaccatcgccgccaatctcgatatggcgcacaaaaatcgatgttgattacggtgatgggcggaattggcatgcttgccggatttttaatgcttagttcgtttgcaggcacattcagcgtaagagaaattattggcgggatgggcgactatgctagccatgccctctttgtgccagcgatgctgctcattctattaggtgcatttacgaagtcagcccaatttccgtttcatatttggttgcctgacgcaatggaggcgccaacgcctgttagtgcgtatctccactcagcaacaatggttaaggcgggcatttacttagttgcccggtttacgcctgtttttggcg

SEQ ID NO: 4627 - DNA, 392 bp, Bacillus clausii
  misc_feature (1)...(392): n = A,T,C or G
atactaagacagcgcaattnccgttgcanannnggatgcctgatgcaatggaagcgcctactccgggggccgcctatctgcantcagccncgatggtgaaagcgggcatttatgaagtngcccggntaacgcntgtggtcggcggcgacgctgngtgggtgnggacattggngatggccgggcttgnnacactgacatacggatcaatnacggatgngcgccaaaaagatttaaaagggatcttggccnactcaaccatcagccaactagggctgatcatgagctcgcnnggagtcggtacggctgccannnatatggaatcaggagaaggggccctcttttatacactngctataacgactgctgtctnccatttgcaaaaccacgcgact

SEQ ID NO: 4628 - DNA, 372 bp, Bacillus clausii
acttgtactgccgatggttctcccgctgcttgtaggcatccttctcatttttttgcggccttttgtcaaatggcagcgagtcattagttttgtgacgttgctccttacttttggcctgagtatttatttgttgcttcatgttcagcgggaaggcattataacgcttgattttggtggctggtctcctccatttggcatttcttttgtcggcgattcgttttcattgttactaacggccacgacctatttcattgccaccatttgttcgctttattcgttctcaactattggcaaagacaaagaaaacatgtttgtttatcctcttgtccacttgctgttggcgggcgtttctggctcgtttttaacaggcga

SEQ ID NO: 4629 - DNA, 993 bp, Bacillus clausii
  misc_feature (1)...(993): n = A,T,C or G
atactaagacagcgcaattnccgttgcanannnggatgcctgatgcaatggaagcgcctactccgggggccgcctatctgcantcagccncgatggtgaaagcgggcatttatgaagtngcccggntaacgcntgtggtcggcggcgacgctgngtgggtgnggacattggngatggccgggcttgnnacactgacatacggatcaatnacggatgngcgccaaaaagatttaaaagggatcttggccnactcaaccatcagccaactagggctgatcatgagctcgcnnggagtcggtacggctgccannnatatggaatcaggagaaggggccctcttttatacactngctataacgactgctgtctnccatttgcaaaaccacgcgactnntaaaggcantnagaanatggcagtnggnattatcnaccatgaaaccggcactagggatatccgcaaattaggcggattaatgacgatcatgccaatcacttttgcgatttcagcaatagggctggcttccatggctggattgccgccatttaatggctttctttcaaaagaaatgttttttacgagcttgctgcgggcaactgagggcgatttcttttcattagaaacgataggctttctgcttcctgttattgcttgggttgctagtgtgtttacgtttctgtactgtgcagtcacatttttcaagacgttcttcggaaaattcgagcaaagccattacgaaaagcccgtacatgaagctcctttcggaatgctgattagcccagtgatcctagtagccttagttgttacgcttggtatatttccaaatatcgtcgctcaatcgcttgttgctcccgctgtcactagcatacttccccgtttttctgtggacgagcttgacatcaagttctcgctatggcacgggattaatacagaattactaatgacattggctatcattttatgcggaagcgtgctcttgatcacgatgaaaaaat

SEQ ID NO: 4630 - DNA, 471 bp, Bacillus clausii
  misc_feature (1)...(471): n = A,T,C or G
cacattccttttgcgcataataganctgccatttttctcagttgagacatgggggctgctatttccgattattgcatggttggcgagcgtgcttacctttgtctattgtttgatcctcatattcaaaacgttttttggcnaacatcagcctgaaaaactggaaaagtcagcgcatgaagcgccgtttggcatgcttgtctcgcctgttattttagcgagcctggttgtcgcgttcttcttcttcccgaatgtattaggcgaatttttgcttaaaccagcatacggggccgttatgcctgcgtttatagaagcaggggtattcgactatcagatcaaggcgtggcacggtatcaatacagaattgctaatgacgctagggattgttggtttaagttttgttctataccggtcattgccacgttgggttggtgtgtattctctctttccggcaaagctatcgctggatcgcct

SEQ ID NO: 4631 - DNA, 1311 bp, Bacillus clausii
ctattttaacaccttttatagtcgctctcttcatccccttcctatataaaaggttatctgccattcatacgggttggtttgtgctggctgtaccagtcgcccttttcgcgatattggctagttatattcccgcaattgctaatggagaaacattctattcctcgatcccatggctgccgtcacttggcattaattttacagcgtatttagacgggttaggtttaatctttgcgttgcttatcacaggggttggaagcttggtgatcctctattcgatttattacctttcaaaagaacgggaatcattgcatcatttttatatttatttactcatgtttatgggagccatgctcggcgttgtgttctcagataatttgctagtgctttatgtattttgggaattaacgagcatttcttcgtttttgcttattgcttactggcaccatcgccgccaatctcgatatggcgcacaaaaatcgatgttgattacggtgatgggcggaattggcatgcttgccggatttttaatgcttagttcgtttgcaggcacattcagcgtaagagaaattattgccgggatgggcgactatgctagccatgccctctttgtgccagcgatgctgctcattctattaggtgcatttacgaagtcagcccaatttccgtttcatatttggttgcctgacgcaatggaggcgccaacgcctgttagtgcgtatctccactcagcaacaatggttaaggcgggcatttacttagttgcccggtttacgcctgtttttggcggagaggccgtttggttttgggtcgtcagtatcgtagggattgtgacgctattctggggctcatttactgcaattcgccaaacggatttaaaagccctgcttgcttactcgacaatcagccaattaggattgattatgacattgctcgggctcggctcggcagcgttgcattttgatgttatagacaatcaatctttttactattcactcgcgatttttgccgctttgttccacctcgtaaaccattcgacgtttaaaggggcactgtttatggttgtaggtattgtcgaccatgaaacggggacacgggacattcgcaagctgggcggattgatggcagtcatgccagtcacgtttactgtagcggtgattggcagcttttcgatggcaggtttgccgccgtttaatggctttctaagcaaagaaatgttctttacggctgcaccgagcagttcaccgtattttttctccgtaatcagctttacaaagccagatgtgtccccttctgcgagcgctttcccattcg

SEQ ID NO: 4632 - DNA, 626 bp, Bacillus clausii
atgacggcggaaatgagagcgttagttatacaagaacctaaatcaatcaatggattaaagatcattgacaaaaaaatacctgaacctcagaaaggtgaagtccgcataaaagtattggctgccggtcttaatccttccgattttcaatatgcccttaataacgaagtagctaatgaagaacgagtactaggaattgatgtatgcggaattgtagacgaagtaggaagtaacgtgaaaaaccttaaagtgggggaccgtgtttactatttacgaagtttaaacaatgtccatggtggttttgctgaatatgctattacatcggcggatttagtcagtatcgtgcctgaagaagtaccgagtcatgttgccggagtggttccgggtgctggctttacagcttatcaagccattattcagaaattacgtcctgtttcaggaagaacgatcttaattcacggtgacgcaggtggtgtaggcagctttgcgatacaacttgcaaaaatgtcgggcctaactatcatttcctcatgccttcagaaagatatggcgtacgttcgctcactaggggcggataaagtgatagacttcaccgcaaaagacgtccatgaagaaacaatgaaatttac

SEQ ID NO: 4633 - DNA, 575 bp, Bacillus clausii
atgacacgtggaaaatcattcgtcaccatcaaaggcacaaaggatgggctgacgtttcttttagatgaccgctgttcttttgatgaattaataaaagagcttacagacaaactatcggccaattactacaaaagtggcgaagaagaacggccggtttacgttaaaatggatttgggcaaccgatatttaaatgaagaagataaagcgcagctagaagcggttgtcacagaaggccgtaatatgcggattgagcattatgactctggcgtcatttcttgggaagaagcacaattgatgaaggagcatgcgcaaacaacgactttaacgagaatgattcgttctggacaagtcgtccatgtcaaaggaaatgtcttacttgtcggcgacattaatcccggtgggcttctgacggctacagggagcatttatgtaatgggcgctttaaaagggcgtgcccatgccgggtttgaaggcaaacgagatgcccgtatttgtgcggcaatgatggcgcctgctgggttacaaattgcagacgaatcgctgtattttgtcgataaagacgaggctgtagagga

SEQ ID NO: 4634 - DNA, 515 bp, Bacillus clausii
gtcacgagccaatcaattcgtgtcgctggcgatgaaatggacgatgccatcattcaatatgtgaaaaagacatacaacttattgattggcgagcggactgctgaaacgttgaagctagaaattggttcggccagttccgacgacgagcaaaatggcgaaatggacatacgcggccgtgatttgttgactgggttgccgaaaaccattacggtgacggccgaagaaatatccaatgcactggcggatacggtagcaaccattattgacggagtaaaaggcacgcttgagcaatcgccacctgaacttgcagccgatattatggaccgtggcatcgttttaaccggtggaggggcgctgttgcgcaacttggacaaagtcctgagtgaggaaacgaatatgccggtcattgtcgctgaagaaccgcttgactgcgtggcaattggcacaggaaaagcgttggaaaacattcatttgttccggggcaagtcaagtagccaaacaagatcggactggaa

SEQ ID NO: 4635 - DNA, 717 bp, Bacillus clausii
aagtcaatagtttgacgatgtataaccaaacagcaacagagccattgcctgttctatttatgttcattgacaactttgatttaatcaaggaagaatacgagcagttggaatcaacctttatccaatttgcccgtgatggccagtctctaggaatttacgtaagcctaacagcgacgcgggcaaatgctttgcgtcagccacttatgaatacaatgaaaacaaagatcgtccactttatgaacgaccgaaacgatgttatcacgctgctcggccgcagcaagtacgaaatcgaaccgatacctggccgcgccattttagcgaaagacagccattattttgcgcaaatgtatttgccagaagccggtgaagatgaccaggaaatgatggcagcaacaagaaacacgattgccgatttaggccagcgttatcaagacgccaagctgccggaaaaaattgcgatgctgcctacacagctatcgctggcttctttccaaacgcgtgttggcgatccaggcgacagcattccctttgcccttgacgaagatacggtcaagcccgtattccttcaaacgaagtcagagcctcatttgttagttgtcggccagccgcggaaaggaaagacgaacgttgccaaagtactattaaactactatttgcaacaggaagttgacgagattggactatttgacggcacaaaccgcaagctgtctgcatttg

SEQ ID NO: 4636 - DNA, 435 bp, Bacillus clausii
cgtacttgttgccgtctcaggcggccctgattcaatggcgctgcttgccattatcgccaatttgcgagaaaagtggaggctcaatttgtttgttgttcatgttaaccaccgacttcgaggcgaagagtcaaataaagatgccgaactagttcaggctttctctgctcgccttggcgtgccgtgcaatgtgaaagacgttgacgtcgcggcctttaaagccgagcgccatgttggaacgcaacaagcggcccgtgccctccgctaccaagtcttccaaggggaaatggagcgagtacatgctactgtgcttttgactgcccaccatggcgacgacgaagtggaaacggcttttatgaaactgactcgcggtacgacaccgttgacgaagctaggcattgcggctacaaggccattcgcaaatggtgtattggcgcg

SEQ ID NO: 4637 - DNA, 270 bp, Bacillus clausii
  misc_feature (1)...(270): n = A,T,C or G
tttcctatatagaccaaaaagaacagnttaaagactgggtgtcagccgttgaagaaaaaatggctgttcgggaacaagcttacatggacgcgttaaacaatggagaaacggttccagcttttgcgccagtgctgttattaatcgacagcctaattcgcttccaacaaacggttgatgcggccattcaagataaattggcgaagctaatgaaaaattcgagccatttaggctttcgtatgattgtgtgcggcaattccgtagaatttacga

SEQ ID NO: 4638 - DNA, 520 bp, Bacillus clausii
gtgtcaaaaatcatcgctatcgcaaatcaaaaaggcggtgtagggaaaacgacaacatcagtcaatttggctgcttgtttggctcacttaggaaaacgtgtgctgctcgtagacattgacccacaaggcaatgctacaagtggcgttggcattgaaaaaggcgacgtcgatgaatgtgtctatgatttgctcatagaggatttagatgcacgcaaagttgttcggtcaacagaagtggacaatcttgacgttataccagctacaattcagttatcaggggctgaaatcgaactcgtaccgaccatttcaagggaagtgcgcttgaaaaaagcattgacgcctttgaaatcccattatgattacatttttattgattgccctccttcacttggattgctaaccattaatgcgttaactgcttcagattcagttgtgatccctgttcaatgtgaatattatgcactggaagggcttagccaattgcttaatactgttcgcctcgtacaaaaacatttaaatc

SEQ ID NO: 4639 - DNA, 323 bp, Bacillus clausii
atgtttggccgtgatattggaattgacttagggacagcgaatgtgcttatttatgtgaaaggcagtgggattgtattagatgagccttctgtcgttgctcttgatacgacaacaaaccgcgtccttgctgttggagaagaagcgtttcgcatggttggacggacaccaggaaacattgtagccattcggccgatgaaggatggcgtcattgcaaactttgagatgacagagtcaatgttaaagcactttatggataaaattcaagtaaagggttttctttcaaagccgcggattttaatttgttgccctacgaatattacgtc

SEQ ID NO: 4640 - DNA, 553 bp, Bacillus clausii
atggaagcacgcgtggaacagtttatagaaaacaatcgattgtttggaatggaaacaaacgtacttgttgccgtctcaggcggccctgattcaatggcgctgcttgccattatcgccaatttgcgagaaaagtggaggctcaatttgtttgttgttcatgttaaccaccgacttcgaggcgaagagtcaaataaagatgccgaactagttcaggctttctctgctcgccttggcgtgccgtgcaatgtgaaagacgttgacgtcgcggcctttaaagccgagcgccatgttggaacgcaacaagcggcccgtgccctccgctaccaagtcttccaaggggaaatggagcgagtacatgctactgtgcttttgactgcccaccatggcgacgacgaagtggaaacggcttttatgaaactgactcgcggtacgacaccgttgacgaagctaggcattgcggctacaaggccattcgcaaatggtgtattggcgcggccgcttcttgaagaaacgaagcgttccatcgtcgcctactgcaacgaaaaggacattc

SEQ ID NO: 4641 - DNA, 1193 bp, Bacillus clausii
atggagcaagaaaaatcatggcgcgataggattgactatacgctcttgtttctcgtgtttgtgttaggctgtatgagtatcatggccatttatgcaggcacaaccacccagtttttcagtgccgaagactatgaaaaatatcgccatgtgtttgccctttcgcaagcaaaatggtttttaatcggattcgtgttaatggttgtcgtaatgctagtagactatgaatatttaaaacgcttgacgatccctatttttgcctttggcatgatcttgttgttatgggtgcaattttttggcgttgaaaataaaggcgctacgcgctggattggcattaatggcacgccgatttaccagccttcagaagtgatgaaaatcattcttgtccttacgcttgcccatttaatcgtcgtgctaaatcaacgttattccgaaaaagggctcaaagccgatttaaaaaaacttggctggcttgctgcttttgggatcccgcctttctatcttgtcttaaagcaaccggacttaggaagcgcactcgtccttgctgtcatcattgccactgccattcttatggccaatgtttcctataaagtactagccagtttggccgcacttgcaggggcaggaattgcttttctttattatttgcttttaaaccatattgaactgattacaaaatatgtgttagaagaacaccagcttgtgcgtattctcgggtggctatacccagagcagtatgcatcaggttatgcgatgcaaacattaaatgcgatacgaggcattggttctggccaattgacgggaagcggcttcttaaatagtgtccaagctgctaatgcttctacgcctgaactccataccgactttatttttgccgttattggggaagaatttggttttctcggttcgactgttgtcatttgcgtctattttttacttatttatcgcctgatcatgcttgctcactcatgcgatgatttatacggcacatcaatcattgctggcattgccggcatgttgacgtttcaaatctttcaaaatatcgccatgacgattgggctaatgcctgtcactggcattgcattgcctttccttagctatggaggcagtgcgctcatgacgaatatgcttgccatcggcattgttctcaatattggcatgaggcaaaaaacgtatatgttcaagtcaaacaatga

SEQ ID NO: 4642 - DNA, 385 bp, Bacillus clausii
  misc_feature (1)...(385): n = A,T,C or G
atggcaaaacgcaagaaacgaaaaaaaaaccagnggaagtcccagttgacttttgaacttgtaggattaggcctacttgtagtggctcttgtcacgctggcccgattagggagcgtaggggaagcatttgtccgtttatttcgtttcttcttaggagaatggttngtcgttttggcgcttggtttttttgtaagcgcattgtacatcatgattaaacggaaaaaaccggccttgtggggaaggcgtttagctggactgtacacaatcgtgatttcgatggcgattttggcccacatcagcttattccgngaacttcagctaactggcaacgtcagcgatgaatcggttttgcgggggacgtggaacctgtattgggaagaaatga

SEQ ID NO: 4643 - DNA, 225 bp, Bacillus clausii
  misc_feature (1)...(225): n = A,T,C or G
ggttgaccaggcaacaaacagcgagcctgaagatgacttatacaacgacgctgttgacttagtcgtggaaggcggtactgcatccgtgtcgatgatccagcgccgctttcgcgtcggctatacacgggcagcgcgcattattgatgaaatggaagcgagaggcgttggtggcccatatgagggcagtaagcctagggaagnactgatcagccgnaatgatgaaga

SEQ ID NO: 4644 - DNA, 483 bp, Bacillus clausii
tcagcttagtagcaatttacagcggagcggggcagtatttttccgatgaccccacttatttcgtcgttagacaattaatatggtacggtattggtgcggtcgttattgtcgccgtaatgttggttgactttgacttgtttcgaaacttctccattcctgtttatgcaatagggatggttttgcttttggccgtcgagttttttggagtcgaacggaacggcgcccaacgctggatttttggtattcagccatccgagtttatgaagattttccttatattggcacttgcccatttattatacaagctgacaaaggataagcaaaagcggactttcaaagaagacatggtcgtgcttggaaaaatattgctcgtcagcctaccgccgttttttcttattctaaagcaacctgacctcggaacagcgctcgtaattgggtccgtaattgcgacgatgttgttgatgtcaggcatacgttggcggg

SEQ ID NO: 4645 - DNA, 366 bp, Bacillus clausii
aagcgttaaaagcgacagcagtgttaaaacgaccagaaatgacttacgaccatttcctgaaaatcattccgcggccagacgtggagcttgatgaagaggtatatgaacaagttgaaattcaagtcaaatacgaaggttatatcgagaaacaatggcaacaaattgaacgcttgaaaaagatggaacgaaaacgaattcctgaggatcttaattatgatgcgatccaaggcattgccacagaagcgcgacaaaaactaaaacaagtacggcctctttcagtaggtcaggcttcccgtgtttcaggcgtaaatccagcggacatttcaattttgcttgtatatctcgaacaagggcggctggcaaaaa

SEQ ID NO: 4646 - DNA, 345 bp, Bacillus clausii
agattgaagcgacaactgaacgtctgtgcattcaaaaagcctcaagcccatggcttgaccctcttgaagaatggctcccccctgtgcaaccagatacagaggtgggcatgttcccgttggcgcttgctgatgagccagaggaacaaaggcaattcaatgtttattatgaatggctaaaagacggcaatattgctgtatttggctctggcggttacggaaaatcgacaacgcttatggcattgatgctccagtttgcaaagtcgtttagcccagaagcacttcacttttacatttttgattttgggaatggcgcgttgttgccgtttaggcaacttcctaatacag

SEQ ID NO: 4647 - DNA, 387 bp, Bacillus clausii
agtagccgatatcgtgacagctgtaccgcagacggcggatgtatttcgcaagcttcgcattgatttttgctgcggcggacaagtcccactggaacaggcagctttaaagcgggggttggagccaaacgaggtgttggagcaggtgcagcttgtggaaagcaagtttgcggaatgtgagcagagtcgaccggccgatctgacagaactggaactgatcgactatatttaaaagaagcaccatgcttttctaaaagaagagttgcccgccctggtgccgtatgtaaccaagctggcccgcgttcatggcggttcccatcccgagctgcttcgcgttcaggagctggtttcggatttgaagcaggagctgctcgatcatactaccgacga

SEQ ID NO: 4648 - DNA, 523 bp, Bacillus clausii
atggagcaagaaaaatcatggcgcgataggattgactatacgctcttgtttctcgtgtttgtgttaggctgtatgagtatcatggccatttatgcaggcacaaccacccagtttttcagtgccgaagactatgaaaaatatcgccatgtgtttgccctttcgcaagcaaaatggtttttaatcggattcgtgttaatggttgtcgtaatgctagtagactatgaatatttaaaacgcttgacgatccctatttttgcctttggcatgatcttgttgttatgggtgcaattttttggcgttgaaaataaaggcgctacgcgctggattggcattaatggcacgccgatttaccagccttcagaagtgatgaaaatcattcttgtccttacgcttgcccatttaatcgtcgtggctaaatcaacgttattccgaaaaagggctcaaagccgatttaaaaaaacttggctggcttgctgcttttgggatcccgcctttctatcttgtcttaaagcaaccggactta

SEQ ID NO: 4649 - DNA, 516 bp, Bacillus clausii
tcgccatcatttcgtacggcggcgtagtctcttcgaattctgttcgggtcggcggagataaatttgatgacgcgattatttcatatgtgcgcaagcaatacaatgtcctcattggcgaacggacagccgaacaaattaaaatcgacattggctttgcgcctattgaccatgaaacgcggacaatggaagtgcggggccgggaccttgtcaatggtttgccaaaaacgattgaattaaactcaaaagaagttcaaggtgctttaagcgagctgttatggcaattgcttgaagcattgcggaccacattggaagattgcccgccggaactgtcaggcgatattgtcgaccgaggcgttctgttgacaggcggtggcgccatgttaaatggcttgcaagattggattgcgaaccaaattgcggttcctgtccacgttgcaccaaacccacttgaatctgtcgctatcggcacagggcgttccctagcttttattgataaactacaaaaagcgactttgt

SEQ ID NO: 4650 - DNA, 516 bp, Bacillus clausii
agtcgccatcatttcgtacggcggcgtagtctcttcgaattctgttcgggtcggcggagataaatttgatgacgcgattatttcatatgtgcgcaagcaatacaatgtcctcattggcgaacggacagccgaacaaattaaaatcgacattggctttgcgcctattgaccatgaaacgcggacaatggaagtgcggggccgggaccttgtcaatggtttgccaaaaacgattgaattaaactcaaaagaagttcaaggtgctttaagcgagctgttatggcaattgcttgaagcatagcggaccacattggaagattgcccgccggaactgtcaggcgatattgtcgaccgaggcgttctgttgacaggcggtggcgccatgttaaatggcttgcaagattggattgcgaaccaaattgcggttcctgtccacgttgcaccaaacccacttgaatctgtcgctatcggcacagggcgttccctagcttttattgataaactacaaaaagcgacttt

SEQ ID NO: 4651 - DNA, 633 bp, Bacillus clausii
  misc_feature (1)...(633): n = A,T,C or G
cgaagaaaaagccagtccagaaaaaacggcaactgattgccgatgtaaatcgacgttcacccattactgaacaataccgtacgattcggacgaacattgaatattcggcagttgacacggaaattaaatcgctgcttgtcacatctgccggccctggggaggggaagtcaacaacggcatccaacttagccgttgtcatcgcccaaaatgggcaaacggttttgcttattgatgcagatatgagaaagccgacggctcattatacatttgggctcatgaacaaccgtgggttgacgaatgtgctgacacgccaacaaaagcaggacgatgtgattcaggaaacaaacgtcgagaatgtttccctgttgacttgcggcccaatcccgcctaacccagctgaattgttaaattccaaaatgatggagcttgttttgcaagaggcaagaaaaaaatatgatatggttattttggacacgcctcctgtcatggctgttgccgatgcgcaaatccttgccaataaagtcgatggcacattattgtcacgtcaagcggcaagactgacagggagcagttacnaaaaacgaaagaaaaacctcgtcaaggcaaaatgcccatttgcttggcttgttgtta

SEQ ID NO: 4652 - DNA, 495 bp, Bacillus clausii
  misc_feature (1)...(495): n = A,T,C or G
aatgccccatttgcttgtggcaggggcaacaggcagtggcaaaagtgtgtgcatcaacggcatcattacaagcatttttaatgaaaagcaaaaccccatgaagttgaagctgatgnatgattcatccccaaatggttgagctaaacgtgtacaacggcattccccatttattgacacccgtagtcacagaaccgaaaaaagcgtctcaagcattaaaaaaagttgttgctgaaatggaacgacgctatgacttgttttcacatactggcacacgcaatatccaangctataatgactatattcgccgccacnatgaaacggaagaaggcaagcagccattgttgccctatattgtcgtcattgtggacgaactcgccgacttaatgatggtggcgtctggcgatgtccaaaattcaatcgctcgcccttgcgccaatggcacgaacaacggggcattcctatgattattgctaccgccaccgccggctgtagatt

SEQ ID NO: 4653 - DNA, 276 bp, Bacillus clausii
  misc_feature (1)...(276): n = A,T,C or G
tattaaaggaattgtaagtgcagcgcggatcgggcgtagccttggngtccacctcatttttgccacacaaaagccaggcggaattatcgacaaccaaatttggagtaacgcccgcttccgagtcgcattaaaagtgcaagatgctctagattctaaagaaattctgaaaaatcccgatgccgccaatttgacggtaacagggcgcgcctatttgcaagtcggcaataacgagctgtatgaattgttccagtcccgcatggagcggggcgccgtatt

SEQ ID NO: 4654 - DNA, 624 bp, Bacillus clausii
ataaacgctttacctttgatcctcaggatgcaacgacaaatgaaaggtatgcccgcttgctggcatcattgaaccaccaacgaggcatgagcctttctatcccggagatggcgtcttttctcgaaatgtttggcgtccagcatacaaaagaacttgctattgaacaacggtggcaaacgacaaacagcgccgagtcgctcgctgtgcccgtcggatttaaagcaaaggatgaacttcttgagctgaacatccatgaaaaggcccatggcccccatggtttgcttgcagggacaacgggttcgggaaaaagtgaatttctgcaaacgtatattttatcgttagcagtccattaccatccccacgaagttgcttttcttctcattgactacaaaggtggggggatggcacagccgtttaaaaatattccccatttgctcggcaccattaccaacatcaacgacagcaagaactttagtatgcgggcgttggcgtcgatcaaaagcgaactgcgcaagcggcagcggctgtttgaccaaaacttagttaaccatatcgatgattatatggagttgtataaacagaagcaggtattggaaccgatgccacatctgtttatcatatcct

SEQ ID NO: 4655 - DNA, 285 bp, Bacillus clausii
  misc_feature (1)...(285): n = A,T,C or G
ttaaagaactcgtaagtgcagcgcggatcgggcgtagccttggngtccacctcatttttgccacacaaaagccaggcggaattatcgacaaccaaatttggagtaacgcccgcttccgagtcgcattaaaagtgcaagatgctctagattctaaagaaattctgaaaaatcccgatgccgccaatttgacggtaacagggcgcgcctatttgcaagtcggcaataacgagctgtatgaattgttccagtcccgcatggagcggggcgccgtatttacgcgaaacc

SEQ ID NO: 4656 - DNA, 351 bp, Bacillus clausii
atgttcccgttggcgcttgctgatgagccagaggaacaaaggcaattcaatgtttattatgaatggctaaaagacggcaatattgctgtatttggctctggcggttacggaaaatcgacaacgcttatggcattgatgctccagtttgcaaagtcgtttagcccagaagcacttcacttttacatttttgattttgggaatggcgcgttgttgccgtttaggcaacttcctaatacagccgattactttaaaatcgatgaaaaacgcaaaatcgaaaaggccattgccttgctaaaagcggagatggacgatcgccgcgaacggttcctggtcaagaagtcaatagtttga

SEQ ID NO: 4657 - DNA, 1014 bp, Bacillus clausii
  misc_feature (1)...(1014): n = A,T,C or G
atgtataaccaaacagcaacagagccattgcctgttctatttatgttcattgacaactttgatttaatcaaggaagaatacgagcagttggaatcaacctttatccaatttgcccgtgatggccagtctctaggaatttacgtaagcctaacagcgacgcgggcaaatgctttgcgtcagccacttatgaatacaatgaaaacaaagatcgtccactttatgaacgaccgaaacgatgttatcacgctgctcggccgcagcaagtacgaaatcgaaccgatacctggccgcgccattttagcgaaagacagccattattttgcgcaaatgtatttgccagaagccggtgaagatgaccaggaaatgatggcagcaacaagaaacacgattgccgatttaggccagcgttatcaagacgccaagctgccggaaaaaattgcgatgctgcctacacagctatcgctggcttctttccaaacgcgtgttggcgatccaggcgacagcattccctttgcccttgacgaagatacggtcaagcccgtattccttcaaacgaagtcagagcctcatttgttagttgtcggccagccgcggaaaggaaagacgaacgttgccaaagtactattaaactactatttgcaacaggaagttgacgagattggactatttgacggcacaaaccgcaagctgtctgcatttgtcggacagaagcttatttcctatatagaccaaaaagaacagnttaaagactgggtgtcagccgttgaagaaaaaatggctgttcgggaacaagcttacatggacgcgttaaacaatggagaaacggttccagcttttgcgccagtgctgttattaatcgacagcctaattcgcttccaacaaacggttgatgcggccattcaagataaattggcgaagctaatgaaaaattcgagccatttaggctttcgtatgattgtgtgcggcaattccgtagaatttacgaangcttcgatcctcttactgcagaattga

SEQ ID NO: 4658 - DNA, 414 bp, Bacillus clausii
cgcaggaaattacagagctttacgaaaactggacatcggagtctgacaagctaaaaaagttaaaagagcagctgcaagcgcgcaaggacagcttagaaaaggctgaagaaaagcttgcagcttaccgtgaagaacatgccgctatccggcaaacggcagcggacctccataagaaacggttagaagtgagcgaagcgcttgaaaaaaatgaagggcgccgcggcgtactggaagaacgaaaaaagcatgccctccataatgaagaacagctgatctaggcgataaaagagcgtgaagctaataaaatagcgttgcaacaaaagctggacgaactgttaaaacaatatgaggcggtcaaactgaaagacgaccaattaaaggcgaactttgatgaggcggaacgccatttaacgc

SEQ ID NO: 4659 - DNA, 191 bp, Bacillus clausii
atgagttaccaaggtggaacgtttgatgttattgtcatcggcgcagggcatgcgggagtagaagctggccttgctgctgccagaatgggcgctaacacgctcatgttgacttgaatctagatcagttgctttatgccgtgcaacccttctgtggaggccggctaaggcattgttgtccgtgaaattgatgc

SEQ ID NO: 4660 - DNA, 624 bp, Bacillus clausii
  misc_feature (1)...(624): n = A,T,C or G
ttattattgtcggcgttgcgtttgccctcattatgcgccaacctgaccttgggacaggcacgtcaatattgatgacagctattcttatggtgttcgtatcaggggcaaggtggaagcatttaataggccttgggttagtgggcgctacnggtatttgctgcacttgcggtttttgaaccgtatcggcttgagcgccttacgtcatttgtcaatnccgtttgcaagcccggacgatagcggttttcagcttattaacggctatttggctatttcaaatggaggcgttacaggccttggcctagggcaaagcctacaaaagatgcgngatgcttcctgaaggacataccgattttattttagcggtncatttctgaagagttggggcttcttggccttgtgtttatatttggttgctatgcgatcatcttgtttcgtgggatatcgattggcgccaaatgcaaaaatccgtttggcnagtttgctcgcctttgggattgtgttttcagcttgcgattcaaatcattttttaatgtcggagctgtttnnccggcatgcttccgnattnacaggcannttacattgncctccttgtatcatatggggggacatcgctgctcattactc

SEQ ID NO: 4661 - DNA, 480 bp, Bacillus clausii
tcacgagccaatcaattcgtgtcgctggcgatgaaatggacgatgccatcattcaatatgtgaaaaagacatacaacttattgattggcgagcggactgctgaaacgttgaagctagaaattggttcggccagttccgacgacgagcaaaatggcgaaatggacatacgcggccgtgatttgttgactgggttgccgaaaaccattacggtgacggccgaagaaatatccaatgcactggcggatacggtagcaaccattattgacggagtaaaaggcacgcttgagcaatcgccacctgaacttgcagccgatattatggaccgtggcatcgttttaaccggtggaggggcgctgttgcgcaacttggacaaagtcctgagtgaggaaacgaatatgccggtcattgtcgctgaagaaccgcttgactgcgtggcaattggcacaggaaaagcgttggaaaacattcatttgttccggg

SEQ ID NO: 4662 - DNA, 240 bp, Bacillus clausii
acagtcataccagccacaagcaaatcaaccgcagtcctatcagccacagtcataccagccacaagcaaatcaaccgcagtcctatcagccacagtcataccagccacaagcaaaccaatcgcagttatatcagtcacagtcataccagccacaagcaaaccaaccgcagttatatcagtcacagtcataccagccacaagcaaaccaaccgcagccgtaccagccacagacatatcagcc

SEQ ID NO: 4663 - DNA, 192 bp, Bacillus clausii
ttgcctttaacgccgttggatattcataataaagaatttacccgtgctttccgcggatatgacgaagatgaagtcaatgagtttttggaccaagtcattaaagactatgaagcggtgcttcgtgaaaagaaagacttatttgagcaagtgactgcgcttgatgaaaagctttcccattttaataatattgaa

SEQ ID NO: 4664 - DNA, 950 bp, Bacillus clausii
atgtttgattttgaaatggatatggagcaattagcgcaaataaaagtgattggcgttggtggcggcggttcaaacgcagtcaatcgcatgattgaaaatggcctgcaaggtgttgattttattgcagtcaatacagatgcacaagcactccatttatcaaaagcggaaaagaagttgcaacttggcggcaaacttactcgcggccttggcgctggcgccaacccagaaataggcaagaaagcggcagaggaaagcagagaacagctggaagaagttcttacaggttctgatatggtctttattactgccggaatgggaggaggaacaggcaccggagcagctcctgtcattgctgaagtggcaaaagagcttggcgcattgacggtcggtgttgtgacacgccctttctcttttgaaggccgtaagcggcaaaaccaagcgatctctgggattgcagcgttaaaagaaaaagtggacacattgatcgtgattccaaatgaccgcttattggaaatggttgataaaaatacgccgatgcttgaagcgttccgcgaggcggataatgtattgcgccaaggagttcaaggcatttccgatttaattgccacgcctgggttgatcaaccttgacttcgcagacgtcaaaacggtcatgagtgaaaagggctccgctttaatgggcattggcgtcgctacaggggaaaaccgtgcagccgaagcagccaaaaaagcgatttccagcccgctgttggaaacgtctgtcgatggggcacaaggagtgctcatgaatattacaggcggcacgaatttaagtttatatgaagtccatgaagcggcagaaatcgtttctgaggcttgtgacgcagaagtgaatatgatatttggttcgatcatcaatgaaaatttgaaagatgaaattgtcgttacagtcattgccacaggctttgaaga

SEQ ID NO: 4665 - DNA, 1071 bp, Bacillus clausii
cgttgtcgtcggtgttaacggcagccatgtcgagctattgccgtgccacggggttgttgctgtttcttcaagcgatcgggaaatcggcgtggaggatgtccgccgagtcatggatgctgcacaagtggtatccatcccgccagagcgggaaatcatcgacgtgattccaaaacaatttatcgttgatggccttgatgaaattacagatccaaaaggaatgattggcgtccgtttggaaatggaaggtacgatgattacaggtgccaaaaccgttctccataatttgttgcgttgcgtggaacgggcgggcttggaagtggcagaaatttgcttgaatgggctggcaacaggtgctgttgcggtttcaaaagatgaaaaaagccttggcgtttgtgtcatcgacattggcggcggctcaacaacgatttctgtctttgagcaaggcacgctggcggctacttctgttttgcctattggcggtgaccatattacgaacgatttggctgtcggcttgcgcttgacgacagaggaagcagagcgcattaaatgcaagtacggccatgcgtttatcgaggaagcatcctccgatgagcaatttgcgatccaaacggtaggttctaatgaaaaagaaatgcttacacagcttgatctagctcatattatcgagccacgggtcgaggaaattttagaactgtcggcaaaagagctcgtccgcttagggtttaggcattttccgagcggtttcgtactgactggcgggacagtgatgctccctggcgtgcttgagctgacaaaggacatgctccaaggcaatgtccgtgtggccatcccgaactacattggcgtccgggaaccgaaatataccgtcagcatcggtttaattcaggttggccataaaaatggacgcggtcaagggaaggaagttgctgcggcattctcgcaattatcagaggctgaaacagcagactctagtgaaaacaaccaaccacttcggacgactgagcatgaaccgaaacgccaggaagcaaaaaaagaatcaaaaatgaaaagttggtttaaaacattctttga

SEQ ID NO: 4666 - DNA, 846 bp, Bacillus clausii
ttgtcgtcggtgttaacggcagccatgtcgagctattgccgtgccacggggttgttgctgtttcttcaagcgatcgggaaatcggcgtggaggatgtccgccgagtcatggatgctgcacaagtggtatccatcccgccagagcgggaaatcatcgacgtgattccaaaacaatttatcgttgatggccttgatgaaattacagatccaaaaggaatgattggcgtccgtttggaaatggaaggtacgatgattacaggtgccaaaaccgttctccataatttgttgcgttgcgtggaacgggcgggcttggaagtggcagaaatttgcttgaatgggctggcaacaggtgctgttgcggtttcaaaagatgaaaaaagccttggcgtttgtgtcatcgacattggcggcggctcaacaacgatttctgtctttgagcaaggcacgctggcggctacttctgttttgcctattggcggtgaccatattacgaacgatttggctgtcggcttgcgcttgacgacagaggaagcagagcgcattaaatgcaagtacggccatgcgtttatcgaggaagcatcctccgatgagcaatttgcgatccaaacggtaggttctaatgaaaaagaaatgcttacacagcttgatctagctcatattatcgagccacgggtcgaggaaattttagaactgtcggcaaaagagctcgtccgcttagggtttaggcattttccgagcggtttcgtactgactggcgggacagtgatgctccctggcgtgcttgagctgacaaaggacatgctccaaggcaatgtccgtgtggccatcccgaactacattggcgtcc

SEQ ID NO: 4667 - DNA, 462 bp, Bacillus clausii
atgttcctcaagcgacttgaagtaaaaggatttaagtcttttgcagaaccgatactagtagattttgtgccaggcgtcacagcagttgttgggccgaatggcagtggaaaaagcaatattgccgatgcggtccgttgggtgctcggcgaacagagcgcccgttcgctccgaggcgcaaaaatggaagacattatttttgcaggaagtgattctcgtaaagctgtaaatatggccgaggtttcactcattctcgataatgaagatggccatttggcgattgactacagcgaagtaagcgtaacgaggcgtttgtaccgctcaggggaaagcgaatacttaattaaccgcaactcgtgccgtttaaaagacattgtcgatttgttcctggactctggccttggccgggaagcgtactccattatcggtcaaggaaaaatcgaggaaattttaagcagcaaggct

SEQ ID NO: 4668 - DNA, 393 bp, Bacillus clausii
  misc_feature (1)...(393): n = A,T,C or G
cttaaaaagtgtaccaagtccatgggataagcnatctcctcgttttgctaatgaaacagtcattcctataagtgaatttgaagntgctttagggatcacactccaaaatgacggatcaattggtacgattgaagcaaggacagcaggcggacgagtggagactgtaacgtttgaaaataaaacattgtcaggccgagaagtccgggaagcgcttgaactggattcatctgatttttcatggcatgtaagcaatggccaagtcgtcatacaaacgaaaggctggggacatggcgttggtatgagccagtatggagcaaacgggatggcccaagaaggaaaaacgtacaaagacattgtccaatatttctacaaagatgtcgaaattgacagcat

SEQ ID NO: 4669 - DNA, 522 bp, Bacillus clausii
tgtagcagtgctatcgatgggtgatgttgtcaccgcctcttccatcaaggtggcaggggatcgtttggattctgacattttatcgtacataaaaaaagagtacaaactgttaattggagaacgaacatctgaagaaataaaaaagcaagtggctactgtttttcctggtgcacgttcggaggaaatggatatcagaggtcgcgatatgataagtggcttgccgcgtaacatcacgatttcgacgaaagaaattgaaaaggcattagtagagtccgttgaatacattgtccaggcggctaagcaagtattagaaaaaacacctccagagttgtctgccgatattattgataagggcgtaatgttaacaggaggcggagcgctgttgcatgggatggatacgctgcttgcagaagaattaaagatccctgtactaattgcagaagagccaatgcattgcgtggccaggggaacaggaatcattttagaaaacttggacaagatgtccagtaaaaaagttcagtt

SEQ ID NO: 4670 - DNA, 503 bp, Bacillus clausii
cagattttcttggagccggaagggcgcgatacaagtgaagtctatgtacaagggttgtcgacaagtctgccagaagatgtccaattgtcgatgcttaaaacgattcctggcttagaagaagtccgaatgatgcggcctggctatgcgattgaatatgacgcgatcgtgccaacacaactatggccaacattagaaacgaaaaaaattagcggtttgtttacggcagggcaaatcaatggaacatctggctatgaagaagcagccgggcaaggaattatggctggcattaatgcggcccaaaaagcatttggcaaagaaggcgtgatcttagatcgttcagaggcttacattggcgtgttgattgacgaccttgtaacgaaagggacgaatgaaccataccgcttgctgacatcacgggctgaatttcgcttaattcttcgccatgacaatgctgatttgcgtttgacggaaaaaggctacgagttgggattaatttctgaaga

SEQ ID NO: 4671 - DNA, 401 bp, Bacillus clausii
ccacgtccagcctaaaagtcgctttagcaaaaacgggaacagccgagcaaatgcaagtccaacaggaaatagtcaatgtcctcaaaaacgagggcgctgaatcagtcggactccgttttgatacacttactgaggaagagctagaagcggttggcggcctaaaagaagaaccctttaaaggtcctgctttgcttgcgccgacaagcaaaacaacgtttattactgtggcgagcggaaaaggcggcgttggcaaatcgaccgtctctgtcaacacggcagtctcgcttgcccgcctcggcaaaaaagtcggcattatagatgccgatatttatggatttagtgtccctgacatgatggggatagaggaacggccgaaagtgatcaacaagcgtatccatcct

SEQ ID NO: 4672 - DNA, 441 bp, Bacillus clausii
ccgtggagtacccactcggcagcggctttcaaattatccaatcgttgctggctattggtcctgggggcttgctcggtatgggccttggcgaaagcaggcaaaagtatttttacttgcctgagccacaaacagactttatctttgcgatactggccgaggaaatggggtttttaggcggagtgacagtgctgttgttatttgcgatcctttattggcgtggcatccgtattgcactaggggctccagacttgttcggaagctttttagccatcggcatcattacgatgattgccattcaagtaatgattaatattggtgtcgtgacagggctcatgccagtcactggcatcacacttccacttttaagctatggagggtcttcgttaacgcttatgcttgtttccatcggtgtgttgttaaacattagccggcatgctagat

SEQ ID NO: 4673 - DNA, 543 bp, Bacillus clausii
aaaatggtcgagcttgctacctatcaagaagtacctcatttggttgctccctgttattactgatccaaagcaagcgacagccgctttaaaatgggttgtccaggaaatggaacggcgctacgaattgtttagccagcgtggcgttcgcgatattagtaaatacaatcagcggttctctgaaaatggcaagccggcattgccatatcttttagtcgttattgacgaactcgccgacttaatgatggtgtcaccacaagatgttgaagatgcgatttgtcggattgctcaaaaagcacgggcttgcgggattcatttgctccttgcaacgcagcgcccttctgttgatgtcattacaggattgattaaagcaaatataccgacgcggattgcctttgctgtcgcttcacaaacggactcacgcacgattcttgatatgggcggcgcggagcggttgcttggaaaaggcgatatgctattccatgaaaatggatcaccgaagccgatacgtgtccaagggacttttgtatcagatgaggaaattga

SEQ ID NO: 4674 - DNA, 741 bp, Bacillus clausii
ccgaacttgtatgcagcaattcgttaaggggcaactcacttgccaatgctgtcggcgtgctgaaagaggaaatgcgccatcttgattcggtcattattaaagcagctgatgaagcagccgttcctgctggcggcgcccttgctgtagaccgccatgattttgctggcaaagtcaccgaatatgtcaaaggccatccaaacgtaacagtcgtccaggaggaagtgactgaaatacctgaaggcccgacgattattgctaccggtccactcacttctgaagcattggcggaacaattaaaggcatttagcggcgaagaatatttatatttctatgacgctgccgcacctatcattgacgccgaaacgatagaccgcgacaaagtctacttgaaaagccgctatgataaaggggaggctgcctatctcaactgtccgatgacagaagaagaatttgatcgtttctaccaagcattgattgaagcggaaaccgttccgctgcgggaatttgaaaaagacatttttttcgaaggctgcatgccaattgaagtgatggcttcccgtggcaagaaaacgatgctgtttggaccattaaagcctgttggactagaagatccgaaaactgggaagcgcccttttgctgtcgtgcagttacggcaagacaattcttccggaacgttgtacaatatggttggtttccaaacgcatttaaaatggggcccgcaaaaagaagtgatccgcatga

SEQ ID NO: 4675 - DNA, 760 bp, Bacillus clausii
atgtgtcaaaaatcatcgctatcgcaaatcaaaaaggcggtgtagggaaaacgacaacatcagtcaatttggctgcttgtttggctcacttaggaaaacgtgtgctgctcgtagacattgacccacaaggcaatgctacaagtggcgttggcattgaaaaaggcgacgtcgatgaatgtgtctatgatttgctcatagaggatttagatgcacgcaaagttgttcggtcaacagaagtggacaatcttgacgttataccagctacaattcagttatcaggggctgaaatcgaactcgtaccgaccatttcaagggaagtgcgcttgaaaaaagcattgacgcctttgaaatcccattatgattacatttttattgattgccctccttcacttggattgctaaccattaatgcgttaactgcttcagattcagttgtgatccctgttcaatgtgaatattatgcactggaagggcttagccaattgcttaatactgttcgcctcgtacaaaaacatttaaatacggacttagcgatcgaaggcgtattgttgacgatgttagatgcgcggaccaatttaggcattcaagtaattgaagaagtgaaaaaatattttcgtgataaagtatttgataccattattccgagaactgtccgtttaggggaagcgccgagctatggaaaaccaattatcgtgtatgatgccaagtcgcgtggtgccgaagtatacatagacttagcgaaggaagtggttgcgaatgg

SEQ ID NO: 4676 - DNA, 366 bp, Bacillus clausii
ggaagcgttaaaagcgacagcagtgttaaaacgaccagaaatgacttacgaccatttcctgaaaatcattccgcggccagacgtggagcttgatgaagaggtatatgaacaagttgaaattcaagtcaaatacgaaggttatatcgagaaacaatggcaacaaattgaacgcttgaaaaagatggaacgaaaacgaattcctgaggatcttaattatgatgcgatccaaggcattgccacagaagcgcgacaaaaactaaaacaagtacggcctctttcagtaggtcaggcttcccgtgtttcaggcgtaaatccagcggacatttcaattttgcttgtatatctcgaacaagggcggctggcaaa

SEQ ID NO: 4677 - DNA, 972 bp, Bacillus clausii
  misc_feature (1)...(972): n = A,T,C or G
tgccaagtcncgacttgttgctgacgcctgataagccagaacaaaagcaggaaaagcaacaattgacatccaatgcccgcaaattggaaaaaacacttgctagcttcggagtgaacgtccgtgtctccaaagttcatttaggtccagccgtcacaaagtatgaagtcaatccaagcattggcgtaaaagtaagcaaaattgtcaacttggcagatgaccttgctttggcgcttgctgcaaaagacattcgcatcgaagcaccaatcccggggaaatcagctgtcggcattgaagtgcctaatcaggaaattgcgattgtttctttaaaggaagtgcttgaaggggctgcttcacgacaacatgaagtgctttccgttggacttggccgtgacatttcaggggaacctgtgctggcgccgctaaataaaatgccccatttgcttgtggcaggggcaacaggcagtggcaaaagtgtgtgcatcaacggcatcattacaagcattttaatgaaagcaaaaccccatgaagtgaagctgatgatgattcatccccaaatggttgagctaaacgtgtacaacggcattccccatttattgacacccgtagtcacagaaccgaaaaaagcgtctcaagcattaaaaaaagttgttgctgaaatggaacgacgctatgacttgttttcacatactggcacacgcaatatccaangctataatgactatattcgccgccacnatgaaacggaagaaggcaagcagccattgttgccctatattgtcgtcattgtggacgaactcgccgacttaatgatggtggcgtctggcgatgtccaaaattcaatcgctcgcccttgcgccaatggcacgagcaacgggcattcctattattattgctacagccaccgccgtctgtagatttgattactggcgtcatttaggccaacatcccgttcgcgganagcnttcggcgttt

SEQ ID NO: 4678 - DNA, 222 bp, Bacillus clausii
accaggcaacaaacagcgagcctgaagatgacttatacaacgacgctgttgacttagtcgtggaagtcggtactgcatccgtgtcgatgatccagcgccgctttcgcgtcggctatacacgggcagcgcgcattattgatgaaatggaagcgagaggcgttgttggcccatatgagggcagtaagcctagggaagtactgatcagccgtaatgatgaagagg

SEQ ID NO: 4679 - DNA, 684 bp, Bacillus clausii
ttattattgtcggcgttgcgtttgccctcattatgcgccaacctgaccttgggacaggcacgtcaatattgatgacagctattcttatggtgttcgtatcaggggcaaggtggaagcatttaataggccttgggttagtgggcgctacggtatttgctgcacttgcggtttttgaaccgtatcggcttgagcgccttacgtcatttgtcaatccgtttgcaagcccggacgatagcggttttcagcttattaacggctatttggctatttcaaatggaggcgttacaggccttggcctagggcaaagcctacaaaagatgcggatgcttcctgaaggacataccgattttattttagcggtcatttctgaagagttggggcttcttggccttgtgtttatatttggttgctatgcgatcatcttgtttcgtgggatatcgattggcgccaaatgcaaaaatccgtttggcagtttgctcgcctttgggattgtgtttcagcttgcgattcaaatcatttttaatgtcggagctgtttccggcatgcttccgattacaggcattacattgcctcttgtatcatatggggggacatcgctgctcattactcttgtggcaatcgcgattttggcgaacattcatcaaaccaacatgagacaagcacgcaaacaagcttcaggcgaat

SEQ ID NO: 4680 - DNA, 330 bp, Bacillus clausii
  misc_feature (1)...(330): n = A,T,C or G
tttaggcaagccggcgaattngactgaagcaaaaacgatgctcatggcattgncgaatagcacccataccgtttatacaggtgttgccatcctacatggaaacaaagaacatgttttttccgacgcagccaaagtaacgttcgatgaaatgacaccagagtggttagagcgctatttgcaatcaggtgattcgcttgataaagctggagcatatggaattcaaagcttcggcgccatttttgtctcgcgaatagaaggggatttttatacagtagcggggctacctctttcaaaaacagcaaaagcattggaaaaatttcatatctatcc

SEQ ID NO: 4681 - DNA, 489 bp, Bacillus clausii
taaacacgcctgtttatttttcaacagcatatcgccatccgggcattggcgaatcgacagggtatgattatgcccgtacaggtaatccgacaagggaagtactagaaaaagccattgctgaattggaagacggcgagcgcggatttgcgactagctctggaatggctgctgttcaaattgtgctttcgttgtttgagcaaggtgatggggttatttgttcgaaagatttatatggcggtacgtaccgtctgtttgaaggaggctggacaaggtggggcgtgtcctttacatatgtcgatccacggaatttgcaagaagttgaacaagcgattcactctaacgtgaaagccatttttatcgaaacgccgactaaccccttattgcaggaagcctcgattccagcgcttgctgctctcgccaaaaaacatgatttgctgctcattgtcgataacacattttatacgcccgcttttgcagaagccactaacg

SEQ ID NO: 4682 - DNA, 609 bp, Bacillus clausii
ttgctcctcatatgcgccgctttgcaacgctaaaaaaagaggtccttggcctttctgagcttcgttttgaagatttaaaagcgccacttgacccagagtttgaaccagaaacaacctatgacgacgcctttgccactatcattgacgcacttcgcgtatttggtgacgactatgtagacatgttgcaaacggcaaaaacagaccgttgggttgaccgcgctgacaatatcggcaaagcaacaggcgctttctgttcaagcccttatggggcacacccctacatcttgctgacttggaaaaatacgatgcgcggcggttttattcttgcacatgaactagggcatgctggccatttttatcttgccaatgcccatcaacctctcagcgccactcgcccatcgatgtattgcattgaagcgccgtccacaatcaacgaattgtttttagggaaccacttgcttaaacagacagacgatcctcggatgaaacgctgggtgctgttgcaatttattgggacgtattatcataactttgtcacgcacctgcttgaaggagttttccaacaccgtgtctatcgctatgctgaggaaggcgtgccactgactgctt

SEQ ID NO: 4683 - DNA, 331 bp, Bacillus clausii
atgagtgaacaacaattaaatttaggatctgtttggcaaaaagtagatttccctaacttccccgctttacaagaagatatcgaagtcgatgtcgccattgccggtggcggtttgaccgggatcacgaccgcttatttgctaacagaagcaggcaaaaaggtcgccgtactagatgcaactaaaattggtggtggcacaactggtcatacaactgcaaagatcacagcccaacatgatgtgatttaccatgaattattgagccatatcggcaaagagcaaacgaagctttattacaaagcgcaagatgaaacgattagctggatgcccaatc

SEQ ID NO: 4684 - DNA, 552 bp, Bacillus clausii
gagaagcattggcgaaaccaaaggagcttccttctacaaaggggacctcgctgcaaaaacggctgcttttttcgagaaacatggcggcttcttatcgaaaaccgatttggaaaatttccagccagagtgggtggagccaatacatgtgaactaccgtggctatgatgtgtgggaaatcccgccaaacggccaaggactcgtagctcttatggcactgaatatgcttaaccaagttgatattggtgataaagaagcggtagacacgtaccatatgcaaattgaagcaatcaaactggcgtttagcgatggccaaaaatatattacagatacaaacaatatgagtgaaaaaatcgaagacttattgagcgatacatacgctaaagaacggcttcgcctcatctcaaatgaagcaatgctgccaactgccggaaagcctaaggcaagcggcacggtttacttaagtacagccgatgctgacggaaacatggtctcatttatccaatccaattacatgggctttgggtcagggctagttgtgcctggtcagggatt

SEQ ID NO: 4685 - DNA, 690 bp, Bacillus clausii
tattgatttgcttggcgtccatagccatatcggttcgcaaatttttgaaacagaaggttttgtgcttgcgattgaaaaagtctttaaccagcttcaaggttggcatgaagaattcgattttgtcccgcgtgtgctcaatttcggcggtggcttcggcatccgttacgtagagggagacaagccactagagcctgaaacgtacattcgagaaattgtaaaagaaacaaaaaaacatgctgaccgtctaggtttggccatcccggaaatatggattgagcctgggcgttcccttgtcggggatgcagctacaacgctgtatacaattgggtcaacgaaagatattcccaatgtccggcgctatctatctgtagatgggggaatgagcgataacttgcgcccagctttatacgatgcgaaatatgaaggattgcttgccaaccgcgcccacgacaaagcagaagaaacattttctgtagccggaaaatgttgtgaaagcggcgatatgcttgtttgggatatgcctctgccagaggtgcagcatggcgacgttctagcgatgttttgtaccggtgcatatggctattcaatggcaaataattacaaccgcattccgcgcccggctgttgtatttgtagaagacggggcagatcaactagtgattcaacgggaaagttatgaggatttaactaa

SEQ ID NO: 4686 - DNA, 411 bp, Bacillus clausii
  misc_feature (1)...(411): n = A,T,C or G
tggcatcaaaggaaaagtganccgcttgcttgctgagaaagaccnacgcnccncgagtctaaaagcccaagttgatgcgtttttccaagaagcgnagatgaagaaaacgttacaggcgaatgcgatgtaccgtttctatcctgctaatgccnacggcgatgagctagtgatctttgatccttatgatgttgnccgtgaacttgaacgttttgcttttccccggcaaacgcaagctccgttcttatgcttggcagattatgtccgccctattggtgaaggggttgattatgtcgggtttttagcggttaccgccggagctggtgtgcgcgaggcagcagaagcggcaaaagcaaaaggcgattacttgtatagtcatttaattcaagcggctgcattagaaacagccgaagg

SEQ ID NO: 4687 - DNA, 567 bp, Bacillus clausii
gccagaagcaaccatcgccctcgcactctcattacagagaagtggggcggatgtactggagcttggcattccttattctgacccgttggcagatgggccggtcattcaaaacgcctccaaacgcgcactaacaggagggatgacgctggctaaggctatggcgctcgtcccggaaatgaggaaagaggggcttacaattccggttattgtctttacttacgccaaccctttgctacaatttgggtttgaacgtttttgcgagacggcatgcgactacggaattgacggcctcctcgttcccgatttgccgtttgaagagagcgaaacattggctaatgagtgcgaaaaacaagggcttgcccttatttcacttgtagcgccaacatctcagcaacggatcaaagcgattgccagccgcgcccagggcttcctttactgtgtatcctcactaggcgtaaccggcgcgagaaaaacacttcatccacaagtggaagcttttttaaagctggtaaaagaagcatcgcctgtcccatatgtagttggatttggcatttccagctacgaaca

SEQ ID NO: 4688 - DNA, 378 bp, Bacillus clausii
taaagccagaaacgcaaatccatacgcatatgtgttattctgatttccaagatattatcgaagcgattgacgggcttgacgcagatgtcatttcaatcgaaatgtcccggagccatggcgaactaatttcatcattcgaagattacacgtataacaaaggcattggcctcggtgtgtatgacattcacagcccccgcgtcccagctaaagaagaaattgcccgtaacattgagcgtgcgttgaatgtcttacatccaaagcaattttgggtcaacccggactgcggtttaaaaacacggcaagaaccagaaacagtggctgcattaaaagtgatggtggaggcagcgaaggaagcgcggcaaacacttgcgacgaaga

SEQ ID NO: 4689 - DNA, 546 bp, Bacillus clausii
atctcattgcgcgatgatgatggtcccagaaccttggcaaaataataaacagatggacgaaaagaaacgggcgttttacgaataccatagcacacttatggaaccatgggacggaccaaccgccattgtgtttacggacggagaaaaaatcggggccacccttgaccgtaatggcttgcgcccatcgcgctattatgtaacgaaagatgattatattgtgatgagctctgaagtcggcgtacttgatttcccgccagaatcgattgttaaaaaagaccggcttcatcctggacagctgttgcttgttgatctcacagaagggcgcattattccagatggggaagccaaacaagcaattgtcgaagaaaaaccttatggaaagtgggtcaaagaccatttaattcatcttgatgatgtgctggaaacagctgacgtgtttgatacggaatttgagcgcatccatgaacgccaacttgtctatgggtatacgtatgaagaactaacaaaaatgctaatgccgcttattaaagatgaaaatgacccagt

SEQ ID NO: 4690 - DNA, 293 bp, Bacillus clausii
atgcaggaaacaataccagatagccgcggccgttttggcgagttcggcggcaaatatgttcccgaaacattaatgtcggcaattgaagagttggaagctgggctggcaaaagcgatggttgatcccgcttttataggagagctaaaagccgacttggctgaatatgcaggcagggaaacaccgctgacgtttgcaaaaaacattagtgcaaaattaggcggagccaatatctatttaaaacgggaagatttggttcatacgggggctcataaattgaataatgcaattggcca

SEQ ID NO: 4691 - DNA, 237 bp, Bacillus clausii
tgattgtaaaagtgccaaaggctggggcggaacaggcgaatcattcgactggaaacagatcccttcttatacggaagaaggagttcggcaaggtacgcaagtgcttattgcaggcggaattacgcctgaaaacgtcgtcgagcttgcccgctaccaaatagacggactggatgtatcgagcggaattgaagagaacggaaaaaaaagcgtcgcaaaaatagcgcgccttgaacaaga

SEQ ID NO: 4692 - DNA, 153 bp, Bacillus clausii
  misc_feature (1)...(153): n = A,T,C or G
tgatacgtcgctgcgcgatggagaacaaatgcctggtatcgctttgactgtgaaagagaagttagaaattgcccggcaattggaacgtctaggtgtggacattattgaggctggttttccagcctcctcacctnccgattttcaagcagtcaa

SEQ ID NO: 4693 - DNA, 477 bp, Bacillus clausii
tcatcctccagccgtcatctagcctattgcatgtgccagtaacagtgcaatcagaagagaacattgcagatgaactaaaagaagcgattgcatttgcggatgaaaaaataagcgaaatcgtttcattggcgaaagtggtcaacggtcaagagccggctacgttattagaagcgagcaaacacgcgttagcgcgattaaatgcttcacaggcccgaaacaatcaatcggtccaacaagaagtagcgcaaatcagcaacgaggacccatcccgtggcctagatgctcctgcacgggccaagttgcaagcggccaaactgaaactgccgctattgccgacgacgacgattggcagttttcacaaacaaaagagatccgtaaaaaacggttagactggcgcaaaggaaaattggacagtgctggctatgaaacattcattaacgccgagatagacccgctggatcgctatccaagaacagc

SEQ ID NO: 4694 - DNA, 417 bp, Bacillus clausii
atgaaactatattctacttttggcatagtcggtttcccttgggatggaggggcctccctcggacggcccgggtcgcggtttgctcccgaaaaaatacgagaagcgtttgcctggttcgccaatcgcatcgaaaacaaccaagtgtacaatgtagaaaagcgaaaaacgttcacattgccgaaaaatgcgttaaccgattatggcaatatcgaaattgccgcctatagcacagaccaaacgtttgcacatgcagaagcaaaactgaaagcagtgcttgctgaaaatgcctttccctttgtgctaggaggcgaccactcgatttcctacccgctcattaaagcgctgcacgaccagaaccttggaaagcggataggcattatccagtttgatgcccatcttgacctcgttgacgaatcc

SEQ ID NO: 4695 - DNA, 191 bp, Bacillus clausii
  misc_feature (1)...(191): n = A,T,C or G
atggttctagatcaaccgcttcgttcattctttatgcagcttgctaaaagcaaaccattaaataaagcagctaaaaaatggggattaaaatttggcgnncggcaatttgtcgctggacnaacantagaanaagcgatggccncagtcattgatttaaataacaaaggccttgtttgtacattagaccattt

SEQ ID NO: 4696 - DNA, 176 bp, Bacillus clausii
atgtgtggcattactgggtgggttgactggcaaagaaacctacgcacggaaacgaaacagatgaaaaacatggcaaacacgctgaatcggcgcggccctgatgcgcttgaaacatggacgtctgaccacgctgcattcgggcatgcgcggcttgtcgttgttgatccagagggcgg

SEQ ID NO: 4697 - DNA, 297 bp, Bacillus clausii
ttgtcattaaaataggcagcagcagtttaacagatggcagcggcgccttaagcacggaacggttaagaggccatgtcgaagccatatgcgaactgcgccatcaaggcataaatgtgattgtcgtgacgtctggcgcagtcgccgctggttttacgctcattggctatcaccagcggccgaaatccatttcgcaaaaacaagcggcggcggccgttggccaaagcttgctcatgcaagcatatatggatgcattccgcttgcatggctacacagctgcgcagctgctgttgacacgag

SEQ ID NO: 4698 - DNA, 1038 bp, Bacillus clausii
  misc_feature (1)...(1038): n = A,T,C or G
tttggacaatagcgcaaccactcggccccatcccgacgtgtttgctttatatacgaagatggctgcagattattttggcaatgcttcgtcgctgcatacacttggcatggaagcggagcaagtccttgatcatgcccgtaaacgttttgccgcttatcttaactgcatgccgaatcagcttatttttacctcaggggggacagaagcaaatgcggtggccattcaaggaacagcgaaaaagcatgcgaacggccacctaattacaaccactgtcgaacacgcatctatttatgagaatgctcgcgctctcgaagcgcaagggtttgaagtaacatatgtgcaagcggatgaggatggacgtgttactagcaaagcgattgaatctgccattcgtccaaataccgttttggttacgcttgggcatgtccaaggcgaactagggactgtacaaccaatcgctgaaataggcgctttgcttcaacgctacccacaaatcaaatttcatgtcgatgccgtgcaaagtttggcaaaagtgccgttttcactaaaagaagcaaacattgatatgctgtctttgtctgcacataaaatccacggcttgaaagggacagggctattatttgtcaacaatcctgctactctggaaagccttctctacggaggcggacaagaacaacgattgcgtcctggcacagaaaatacagcaggtatcgctgcatttgccaaggcgctcgggttaatggaaagccaggaacaaaaacagcaacaacggctgcttgcattaaatgacatgttgcgcgccaagctggaaccaatagaggggttaatcgttaacacgcctacatcaggctatgcacctcatatattgaatgtatcgattccaggcattaaagccgaagtgcttgtgcaggcgctcggtcaacgccaaatttacgtttcgacacagtccgcctgctcgacgaaaacgggcaagccgagccgtgtccttttangggcaatgaagccgagaacagtggctgagagcgccattcgcattag

SEQ ID NO: 4699 - DNA, 181 bp, Bacillus clausii
atgcggtattttgatcaagcggcaacgtcttttccaatggcaaaagcagttgctgacgctgttagcgaagcgattcttgcctatggcgcgaatccaggaagaggaggccataagttagcgaggcaagctgcagacacactttttcaggcaagaaaacggttggcggccttttttggtgcgc

SEQ ID NO: 4700 - DNA, 495 bp, Bacillus clausii
  misc_feature (1)...(495): n = A,T,C or G
aaaaccaccatttagggcagaccacgttggcagtttactgcggcccgaacgtatccaccaagcgagaaatgaatgtaaggaaggcaccattactgcggcgcaattgcatgaaatggagacgcaagaaatcaaacgaatcgtcgataagcaaattgaaattggcttggagttggtgacggacggagaatttagacgccgtttttggcatactgatttcctcgaacatttgaacggcgtagaaggatatgtccctgatgttggctatattttccaaggcaatgaagaaacggaaagatacaacgtccgaaacgtaggaaaaatttcatttaaccatgatcatccccatgtaaaagactttattgaatttaatgagattgtcggagggcgtgcagtcgctaagcaaaccattccgagcccaaatcaattgtttaatattggcattcgtgatgaaacgatctaccctgatattgaggaatacgcanaanatattattca

SEQ ID NO: 4701 - DNA, 357 bp, Bacillus clausii
atgaggagtaaagaggaaagtttaggagagaagatacttaatagagcacagggtaaacaaaaaggtcttatgacacaaggattcttggcaaatatattgaatcctaaagtggcgattttctttctgacgtttctccctcaatttattaaccctcaaacagaaactttaatgacattttttgtattaggcgcagtctatctgttaataaaatttgcttggtttacattatacatatatgtcataaacctagttcgtgtttggatgaggaaagaagttgttaagaaagcaatggatggtttaaccggagcaatttttattatatttggactccgcttagctttggaagaaccgaaataa

SEQ ID NO: 4702 - DNA, 180 bp, Bacillus clausii
atccgcaagaaggatcgttctgttattatgcagaacaagcattcgggaaccgtgttggctttgccactggctggaactattggatgtccaacattttaattatcggcagccaattaacggctttatcgattttatctcgtttctggtttgacaatgtgcccctttgggtgttcgcctcga

SEQ ID NO: 4703 - DNA, 537 bp, Bacillus clausii
  misc_feature (1)...(537): n = A,T,C or G
tgaaaatggacaaattncgcttgcncaatngaaaaatgcgttaaccgaagaaacgatccttgtctccatcatgtttgcgaacaatgaagttggcacagtccaaccgattaaagaaattggcgagctgctaaaagggcatcaagcagcccttcattccgatgctgatcaagcagctgggctatatgaactcaatacagacgagctcggcgnaaanttgatgaccattgcaagccataagctaaacgggccaaaagggattggctgcttgtttgtacganaaggcatcgaattagaaccgctgttgcatgggggcgagcaagaacggaaacgcagggcaggcacagaanatgtcnctggcgctgttggttttgctcaagctttcaaccaagcatacgctgaacgtgagcagcgtcgccaaagctacaaattatacaggacgatgtattttgaaacgatggaacngnncggcgtancagngctggaaaatggcgagagcggagaacnggttgatcacattttaaacgttagtttnccagg

SEQ ID NO: 4704 - DNA, 642 bp, Bacillus clausii
aagtggtcgttgtacttgggccatccgggtctggaaaatcaccaatgcttcgctgcattaacaggcttgaaaccatcactgatgggaaactgttggtcaatgattttgctttacatgataaaaaagtaaatatcaataaattgcgccgtgacattagcatggtttttcaacactttaatttatacccccatatgaatgtattggacaatattacattagccccacgccaagtactgaaagtttctaaagaagaagcggaagaaacggcaatgcagtacttaacgaaagtaggcatacccgaaaaagcaaaatcttatccatcccagctttcaggcgggcaacaacaacgagtggcgattgccagagggttggcgatgaagccgaaaattatgctttttgacgaacctacatcggcacttgacccagaaatgataggcgaagtgctagacgtaatgaagacgctagcgaaagaagggatgacgatggtatgcgttacccacgaaatgggattcgctaaagaagtagctgaccgagtgatatttatggatgaaggccaaattgtagaagaggcgaggcctatcgatttctttgaaaacccgagagaaaaaaggtcacagcatttcttaagccgtttgcttcatt

SEQ ID NO: 4705 - DNA, 573 bp, Bacillus clausii
atccagcagatattgataaacccgatgaagtgatcttgcaagagtttgccgacaacgaaccgttatgccagtggatccgcatggcacgtcgccatatttccttccaaggccttccggcaaggatttgctggctcggctatggggaacgtgcccgttttggcaaacggattaatgaaatggttgcttctggagaattgtccgcccccattgtgatcgggcgtgcccaccttgatgccggctcggtcgcctcgccaaatcgggaaacagaagcaatgaaagacggcagtgacgccgttgccgattggccaattttaaatgcacttgtgaatacagcagcaggggcaagctgggtgtctgtgcaccatggcggcggcgtcggtatgggatactccctccacgctggcatggttgttgtcgcagatgggacagcggaagcggatcggcgtttggagcgtgtgctgacaacggatcctggcctaggcgtcgttcgccatgccgatgctggctatcaaaaagctgtcgaaacggcaaaagcaacaggtattgtcattccggcccttgcaagggagggaa

SEQ ID NO: 4706 - DNA, 765 bp, Bacillus clausii
acgtcatttcttttaatggctgtttccacgaacgaacgctcgggtcgcttagcgtgagcacgtctaaagcgaagtaccgcaagcaccagcccgcacaagggatggcttatcaaattccatattacacgcctggcgatacggaagaacaagccattgccaagcttgatgagtcatttgcctccttatttgcccaccaagtatcaccagacgaagtagcagccgtcattattgaacctgttcttggggaaggggggtatattgtcccgcctgcctcttggttaaaacgaattcgctctatttgcgacgcgtacggaatgctgctcatttttgacgaagtgcaaacaggatttggccggacaggcgaatggtttgcagcacaaacttttggtgtcgtacctgacattatggcgattgcaaagggcattgcttctgggttgccactcagtgccactgtggccaatcataagctcatgcaaaagtggcctctaggaagccatgccacgacttttggcggcaatccgattgcgtgtgcggcggcacgggccacaattgcagtaataaaagaggaacgattgcttgaaaatgccaaacaagtaggcgcttatgcaaaacaacgtttgaacgcgatgcaacaaaaatggccacaaattggtgctgtccgcggcataggcatgatgtttggcattgaaattatcgacccagaaacgggcgaaaaagacggcgacactgctgcaaagattttggaccttgcattagaagaaggcg

SEQ ID NO: 4707 - DNA, 276 bp, Bacillus clausii
atgaacatttattcatcagttgacatggaagggatcacagggcttgtagaccgccagtttgtaacgccaggcgaacggttttatgaacggggccaacagttgatgacagacgaggtaaaccacgtagcagaagctgcgtttgcctttggctgcaaacgatttgtcgtcaacgactcacatgggaaaatgaataatttgcttgtggagcgacttcttgcagaaattgaattggtttctggcgagggcaaaccgtattcaatggtacaagggctcgac

SEQ ID NO: 4708 - DNA, 246 bp, Bacillus clausii
tgaatgctgtccttggcggccgcgcgactgtcgggaaaaattgtcatgtaggcgctggtgccgtgttggccggtgtcatcgagccaccatctgcttctcctgtcatcattgaagacggcgttgtcatcggcgcaaatgccgtcattttagaaggcgtccgtgtaggcgccggcgctgtggtagcagctggtgcgattgtaacagaagacgttcctgccaacacagtcgttgctgggacgccagcac

SEQ ID NO: 4709 - DNA, 642 bp, Bacillus clausii
cctcgatgttggccaagggaaagatttagagtttgttaaacaaaaagcccttcaagttggcgccattcaatcttatacaattgacgcgaaaaaagagtatgctgaatcatttgtcttgcccgcgttgcaagcacatgccctttatgagcaaaagtatcctcttgtttcggcgttatcacgcccgctcatttccaaaaagcttgtagagattgccgaacagacgggagcaacagcggtagctcatggttgcacaggaaagggcaacgatcaagtgcgctttgaagtttccattcaagcgttaaacccgaacttaaaagtattagcccctgtaagggaatgggcatggtcacgtgacgaagaaatcgagtatgcaaaagcgcacaatattccgattccgattgatctcgacaacccgtattcggttgatcaaaacttgtggggacgaagcaatgagtgtggcattcttgaagatccttgggcgactccgccggaaggggcatatgcgctgacagcgccgcttgagaaaacgcctgatacaccagacattattgaactgtcttttgaacaaggggtacccgttgcgattgacgggaaggcataccctcttgatcagctgattttgacgttaaatgagatcgctgg

SEQ ID NO: 4710 - DNA, 482 bp, Bacillus clausii
ccgtctttgccactagggctaattgcagaaataaaacaggcttccccttcgaaaggggttttatgtgagacgatttcaccaacagcgattgcacgggtttatgaagagggtggcgcaagcgcaattagcgttttgacagaccgtacgtactttcaaggtgacattgcttatgtagctgaagtgaaaaagaccgtgtctttgccggtattgcggaaggattttattttgtcgccccttcaagtggaggaaacggcgtgtattggcgcagatgccatgttgttaatagctggtacaatggaagcgaagcagctccacgaactatatgaactagcgtatagcaaaggggtggagtgtttagttgaagtccatagcgaagaagagctagagtcgcttcttgctgtttttacaccagaagtgataggtatcaataaccgcaatttaaaaacgttccaaacatcggttgcccaaaccgagcagattgc

SEQ ID NO: 4711 - DNA, 882 bp, Bacillus clausii
ttggacatctaatatgaacctttttcaagagcgttcagatttactaatacgcgcattttgggaacacattcaattgtcgcttgcttccttgctaattgcagtggcgattggcgtgccactagggattttgcttactcgttacaaacgaatatcagagtgggtgatcggcactgcagccgtcttgcaaacgatcccatcgctcgccttgcttggctttttagtcctttttgtcgggattggcacgactccggccatcattgcgcttactgcctacgcgttactgccgattttgcgcaatacatatacaggaattaaaggcattgacccatccctgatcgaggcggcgaaaggaatgggcatgaattcataccgccgtttgctgaaagtagagctacccatcgccatgccaactgtcatggcaggcatccgtacatcaatggttctgatcgtcggcactgccaccctggcagcgcttgttggcggcggcggacttgggcaaatcattatgaccggtattcagcggacaagcaatgaatacattttattcggcgctcttccagctgcgttgcttgcgctagcactcgattttgtgttgcgtttcagcgagaagcgagcagcgcatgcacaaggaacaacgtataaaccccttgcgagcgtgctccttgttgccattgccatcgtcgcgatttcgccgatcgcttcctttattcaaagcgatgaaccagatttagttatcggcggaaaacttggccctgaaccaccaatcctcgccaatatgtataaacacttaattgaacaagacaccgaccttacggttgaagtggtggcccctcttggtgagacaagcgtgaacttcaacgccttacgtgtaggagatattga

SEQ ID NO: 4712 - DNA, 465 bp, Bacillus clausii
  misc_feature (1)...(465): n = A,T,C or G
aactcgggcttactatganattgatcggcgttgcgaaaagagatgnggggcggttggaagtatgtgttgaaccaacacttttgccatctgaccatccactagctagcgtgcaaaatgaatacaatgctgtctttgtccacggggaagccgttggtgaaacgatgttttacgggcctggggctggctcgttgccgactgcaaccgcagtcgtaagcgacctcgtttcggtcatgaaaaatatgcgccatcgtgtaaatggctatgcggccatgaagccattatacgaagcggtgtttaaagaagagcaggaaaagcaatcacagttttttattcgcctgcatgtagaagaccgaacaggcacgttttcaagcattacgtcgttatttgctagatacgacgtcagctttgaaaagctcttgcaacttccactggaagaggaacaaatggcggaaattgtcatcatta

SEQ ID NO: 4713 - DNA, 291 bp, Bacillus clausii
gacgaatggttcaagcctttccaaaagcgggctcagcgtatacgtatgcgcaacaaagcatccatccaaatgttggttttgctgctggttggtctttgcttcttgattacttgtttctgcctatggtcaattttgcaattggcatggcttatttaaacgccgcttttccagaagttcccgcttttatttgggtcgttattttagcagcggcgattacaaccgtcaatattctcggcatacagttaactgcaaatataacagggttattcgtcgcgttccaagttctagttg

SEQ ID NO: 4714 - DNA, 366 bp, Bacillus clausii
  misc_feature (1)...(366): n = A,T,C or G
gcggctttttattggannaattgccggaagcaatcaaagagttancggcattcacaggaattcgcttaatcggtgtgacgagctttcccgttttagcgtatacccctggagacaagagctaccattacgcaagcaatgcgcaaacgattgtcaaagccgtccgtcttctccaacaagctggagtggaagtgaagcatgtcaatacgccaagcgccacgagtgtgaatacaatcccaatgcttaaacaacttggcgcgacacacgcagagccaggccatgctcttactggtacaacgccgttgcatgcctaccgcgaggatttagctgagctgccggctatggtgtatgtctctgaaatttcacatc

SEQ ID NO: 4715 - DNA, 738 bp, Bacillus clausii
acagctccatatggctaaagcacttggcgtaattgatgaggctgcctcaagcctagaagaaggggcacaagcagctgattttatcattttagcagtgccagtaagcaaaacgattgaattgattgagcagcttagcacgatctcgttgaaacaaggtgtcatcgttacggatgtcggttcaacaaagcaagatattgccgcggctgctgatacccatttcagtgacaacgtctgctttattggcggccatccgatggcaggctcacataaatcaggcgtcgaggcagcaaaagcccatttgtttgaaaatgcgttttacttactagcccctggcaagaatagtgagccacgccatattatcgccttgcaaaatttgttgaaaggcacgaaagcgcgttttttgcaaatggaaccacaacagcatgacaaactggcaggcacagtgagccatttcccccatattattgcagctagcctagtccatcagctcaaaaagcttgaaaaaaccgatccagaggtagcccaattagcggcaggtggttttagggacattacgcggattgcctcggcgagcccggtcatgtggcgtgatgtgcttttgcataataaagaagaaatgctgcgcctatttgccgaatggcaaatcgagatggattctgtaaaggaaatggttgaacgctgcgacggcaaagccattcatgcttacttccaagaagcaaaagcatttcgtgaagagtt

SEQ ID NO: 4716 - DNA, 560 bp, Bacillus clausii
  misc_feature (1)...(560): n = A,T,C or G
atgttagcaaanaaacaaatacaagggttgccaccatatgccccaggcaagccgattgaagatgtgaaaagggaatacggtttagagaccgtcataaaaatggcatcgaatgaaaatccgtatggggcgtctcctgctgtggcaaaggcgattgccgatggagcatcaaaaacgtttttgtatccggatggctatggcacagccttgcgcaaagcacttgctgccaaacataaagtagatgaaggacagcttatattaggaaatggcaccgatgaagttattcaactactatgcagaagttttttaacgcctgagaccaacacggttatggcgacgccctctttttctcagtacaagttaaatgcaacgattgaaggggcaacgatcaaagaaataaccgttaaagaagacggctcccacgatttagatgcaatgcttgcagcgattgacgaccaaacgcggattgtctgggtctgcaatcctaacaatccaaatggggtcgcactcggtgaagctgagttgaaaaagtttttagacgccgttccaactacatgcttggt

SEQ ID NO: 4717 - DNA, 570 bp, Bacillus clausii
  misc_feature (1)...(570): n = A,T,C or G
gattgtaatgacgccaagagaaggncatggtgcataaccgaccgaagccgtcagagcggcattaaatgcttgcgatgtggcctttggcgcaacgacgatgtcgatgtatcattcaaaagcacggttggaaacgagcagaaacggccggctccgttgggtaggacttcaagattatgcacttcatatgtttgatgaaggcggtttaacagctgattttgacgaagtgagggaggtcattgaccgggtttctcaatactaccaagggacaacatttacattaactgctcctggcggtacgaatatggtttgcagtatagaaggacgaaagcctgttttcgactatggaacatctagagaaccgggatctgcttcttttccgcctaatgcagaagtggcgcttggacctgtcgaagggactgccaatggcgtattggtatttgacggaagcattcctcatccgttgctaaatttacttgatgagccagttacatgcaaagttgaaggcggttacattacggaaattacaggcgggggcgaggcagacattttacgcaagcttttggccgactt

SEQ ID NO: 4718 - DNA, 890 bp, Bacillus clausii
  misc_feature (1)...(890): n = A,T,C or G
atgacagaaaaacaatctcttggttttgaaacaattgctctacatggcggacaaacgcctgactctgcaacaaacgcgagagcggttcccatttaccagacaagctcttacgtatttaatgatactgatcacgctgcaaatttgttttctttacaagagccaggcaacatttattcgcgcattatgaacccgacacacgatgtgtttgaacagcgaatggctgaattggaaggtggcgtaggcgcattagcaacttcttctgggcaggctgccattacgtatgcgattttaaatatcgcggaagcaggagacgacattattgcttccagcagcttgtatggcggcacttacgccctgtttgcgcacacgttgcctaaactaggtgtgacatgccattttgtcgatgttgatgaacctcccatttcagaaaagatcacagacaagacaaaagcgatttttatcgaaacgattggcaatccgcaaatcaacatagcggacattgaagcgattgcggacattgcccatgcaaatgggattccccttattgtcgataatacattcgctaccccgtatttgtgcagaccgattgaacatggtgcagacattgttgtccattccgctactaagtttatcggcggccacgggacatcgatcgggggcgtcattgtcgactctggacgatttgattttgccaatggcaagtttcctggtttatcagagccagacgctagttaccatggacttgtgtatncagaggcacttggccccctcgcctacatttcaaaagcgcgagtcacgttgctaagagatataggcgcctctgcttctccatttaatacgtttctatttattcaagggttagaaacattgccgttacgaatggagcgcca

SEQ ID NO: 4719 - DNA, 333 bp, Bacillus clausii
gcaaccctttagcagctgcaacggcaatagcggtcttagccgaattaagcgcagacggcttcttgccagaagtggaagagaaggcggagcgttttgttgcttacttaaaaggggagctaagtggcattgcaatcgttaaagacatacgccacaaaggttttttgattggcattgaaacagcgataccggcactggatttaattgcagcgtgtgagcaacaaggtttgctgctgcttcctgcaggcagtcatgtgacacggctgttgccgccgcttaccgtgtctgaaagcgaatggcgccaagctgtggcgatcatcaaacaagcggcaacga

SEQ ID NO: 4720 - DNA, 273 bp, Bacillus clausii
ataacggttcgtatacggcgattgccagccacgaccaccatattattgaaaaagttaaaacgtatgcggcggagaaaggtattcctaaaagtcagtttgaatttcaaatgctttatggttttcgcgaaacgctacaaaaggaactgctcgaacaaggctacaaagtccggttatacgtgccctttggaaccgattggttcggttacttcatgcgccgccttgccgaacggccgcaaaatattgcctttgctttgcgggggttcttttcaaaat

SEQ ID NO: 4721 - DNA, 304 bp, Bacillus clausii
atggtaaacggaattaaccacatgacgttttcagtaagcaatatggataaagcggtttctttttataaacatgtctttatggaagcacctcttgtcttaggagaaaaaacagcctattttaccattggcggcatttggcttgcgcttaatttgcaaccagacattgataggaaatgaaatcaggcagtcgtatactcatattgctttctcgattgaggagtcgcagctagacgctttttatactcgtttactggaaagccggagcccgatattctccctgggaaggaaacggcagtgggagact

SEQ ID NO: 4722 - DNA, 177 bp, Bacillus clausii
cgactggatcaagcattatgccacaaaagaaaaacccggatatggctgaattgatccgtggcaaaaccggacgcgtgtatggcagcctgttcagcttgctgacaacgttgaaaggtttgccgctagcttacaacaaagatatgcaagaggacaaagaaggcatgtttgacgctgtaa

SEQ ID NO: 4723 - DNA, 375 bp, Bacillus clausii
aacagtccaaagggagcttgcggattttcgcaggaatgattgaaccaatgactgtaaacacggatgcgatgacaaaagccgtcacaagtgacttttcgaatgcgactgagttggctgactatttggccacaaaaggaatgccttttagagaagcccatgaagtagtaggcaaacttgtgctcacagcaattgaaaagggtgtgtatttgctcgatttacctatcgaggtttacaaagaggcgagcagcctgtttgccgatgacatctatgaagttcttcagcccaaaacggttgttggccggcggaatagcgcagggggcactggcttcgaacaagtcaagcacgcccttggaaaagcaaacgatctattgtctc

SEQ ID NO: 4724 - DNA, 400 bp, Bacillus clausii
  misc_feature (1)...(400): n = A,T,C or G
atggctttttcgattactgttcccgccagcacagccaatttagggcccggatttgattccattggccttgctttaaaccgttatttgcacttggaagttgaacaagcaagcaagtggtcgtttatttgttcttcccctggcctggagaatataggtaccgataatttagtgacaaaagccgctgcgtttgcgagcaaacaatggggcaaggttttgcccccgtgtcgagttgtcatgaagaacgacatccctctttcaaaaggattcggcagcagtgctgcagcgatcgttgctggcattgaattggctgcgtctgtttgtgaccaattcgtttcaaaagctgaaaaggctcgtctagcttccttgtgggaaggccatccagatnatgttgctgcttcga

SEQ ID NO: 4725 - DNA, 351 bp, Bacillus clausii
tcttccgcggccttcaagcagcttctgcctgcgcgttgcaatccgatcaatccagtgtacacgagctggttggtctgtacaaagaacggagcgaagccctttgggaggcagcccaggaaattggctggcaagttgaacaaccatcaggttcgttttttgcctggttccctgtaccaaaaggctatacgtccgaggaatttagtgaactgcttcttgacaaagcccatctcgtcgtcgctccaggaaacgggtttggccagtatggagaaggatatgtgcgtatcgggctcctcgctgacaaaacgacattgcgtgaggcgatcgcacgagtgggcaacttaaatctgtttt

SEQ ID NO: 4726 - DNA, 487 bp, Bacillus clausii
ctgatgcgagtagtagacaatatcgctgacttaattggacagacgcccatggtccgtttaaacaaactggctgatggtaaaggcgcatctgtctatttaaaattagaaatgaataacccgagcggcagcgtgaaagaccgtgctgccttttccatgattattcaagcagaaaaggatggccatttgcaacctggttccaccattattgagccaacgagtggaaatactgggattggcttggctatgaacgctgcggctcgcggctatcgcgctattctcgtcatgcctgacacaatgagccaagaacggatcaatttactaaaggcatatggtgctgaagtcgtgctaacggaaggcgataaaaaaatgcctggagcaatcgaaaaagccaaggagcttgccgatagcattcctgggtctttcatgccaatgcaatttgaaaatgaagcaaaccctgatgcccaccgccataccactgcgttagaaa

SEQ ID NO: 4727 - DNA, 527 bp, Bacillus clausii
tacacagcttatacgccgtatcacccggaaatttcccaaggtgagttgcaagcgatttttgaatttcaaccaatgatttgcgaactaactggcatggatattgccaactcttccatgtacgatgggcctactgcgcttgctgaagcagcgatgttatcgtgtgggcatacaaaaaagaagacgattcttgtttcaaaagctgtccatccagaggcacgtgcggttttgaaaacaaatgcgtacgggcaacgtttgaatgtcatagaaattgatgctaatgcgaatgtgactgatatcgagtcattaaaggcggcttacaatgaagatgttgcttgcgtcattgtccaacaccctaacttttatggcaaccttgaacctcttgctgaaatcgaggaaattgtccatcaaggtaaagcgcaatttgttgtttcgagcaacccgcttgcccttggcgtcttaaagcctcctggcgactttggggcggacattgtcgttggcgatgcacaaccgtttgggattccggttca

SEQ ID NO: 4728 - DNA, 393 bp, Bacillus clausii
acctaaacgatctattgaagaccccaggtagaatccgtttagtaaagggcgcctatcaagagcctgaaggcatctatattccaagatcggaagaattaaataaacggtatatagaatttgtatctatgtgtgtagagcggaatcaaccattatctattgcaacacatgatgaaaatctattgacggaattaaaagcgaaagggcttctttacaggccaaatgttgaagtagagatgttggatggtgtacgacctgacttattaagatctttaaaagaggatggcattcaggctaaagtgtatgtaacatatggtagcgagtggtatttgtatgtcgttcatcgtattgctgaataccctccaaatatttatacgttcctttcagatgtgattg

SEQ ID NO: 4729 - DNA, 651 bp, Bacillus clausii
gtacattgttgaatgatattgatgtcgtctttgaacaagatcctgctgcacgtagtcggctagaagtcatttttacgtactcgggtgtgcatgctgtttgggggcatcggattgctcacggtctatggaaacggaaatggtacttcttagcgcgcctgctttcgcaaattgtccgctttatgacagggattgaaatccatccaggggcaaaaatcgggcaaaggctatttattgaccacggcatgggcgtcgtcattggcgagacttgcgaaattggcgacaatgtcacgattttccaaggcgtaacgttagggggcaccggcaaagaaaaaggcaagcgccatccaactgtaaaagacggcgtgctcattgccagtggggctaaagtgcttggctcatttacaatcggcgagggcgcccggataggcgcaggctctgtcgtgttaaacgaagtgccaccccattcgacggttgtaggtatccctgggaaaattgttgtgcaaaatggaataaaagtgagctcggcccgttcccttgaccaccatgccttgcctgaccctgttgctgacaagattgctgaattagaacgggaaatcgcacgtttaaaagcagattacagcaagcttgccgacaaacaaagcacattggact

SEQ ID NO: 4730 - DNA, 213 bp, Bacillus clausii
agacatgaaacggcccgactttagctcagaaacggttccgctgagtgaagcggttggcagagttgcagctgagccacttgtcccgtaccctcctggagttcctttattatatcgaggagaaaaggtgactcctgcccatgccgagcagattgagcgactgcttgaagcaagcgtccgttttcaagggctggacccagaacatggattacgtgt

SEQ ID NO: 4731 - DNA, 903 bp, Bacillus clausii
cgataagtgggaatcgtacccaggcgattggaatatcgtggcgaagaaggaaggcacagatagaacgaagtaccatagcctccttttaaatggccatgtcgatgtcgctacagtcgaagaggaagaaaaaagccaatggaaatacgctcctttttctcccgtggtagaagaaaggacgctgtatggccgtggtgccgccgatatgaaaggcgggcttggcgcttgtctgtttgcgttgcgtcttttgcatgatcatggcattgaactaaagggcgatgtcttactcgaagcagttacaggcgaagaagtcggcgaggctggcacgaaacaatgttgtgaacggggctatacggctgattatgcaattgtagccgacacaagcaattgccatgttcatggtcaaggcggtgtcattactggctggattaccgtaaaaagtgactcgactcaccatgatggaacgcggcgggatatgatccatgccggtggcagtttaaggggcgctagtgcgattgaaaaaatggctaaactgattgctgctttgcaagagcttgagcgccactgggctgtgacaaagtcgtatccaggttttccgcctggtacccatacgattaatccagctgtcattgaaggcgggcgtcatccagcgtttattgccgatgaatgcaggttgtggataactgtgcatttttatcccaatgaatccgcagaagaagtggccaacgaaattgaagcccatcttcttgctacagctaaagcagatgtctggttgaaagacaatcttccaacctttacttggggcggcgcctctatgattgaagacaaaggggaagtattccctgctttttccatcgatgaagctcatcctgcattatctgttttaaagactgttcatcagactgt

SEQ ID NO: 4732 - DNA, 456 bp, Bacillus clausii
aaaagatgtcgcattgatttttgaattaagcaaacaaggacgcattggccatagtttgcctgacttggatattgaagagcagccgcttgaatctctgctccctgaagcatatgtacgtgaggaagagcctgagctcccggaagtgtcggagttgcaaattatgcgccattacacagccttatcaaaacgaaaccatggcgttgactccggtttttacccacttggttcgtgcacaatgaagtacaatccgaaaattaatgaagacattgcccgctcgcctggtttggtgcatgtccatccttaccagccggaggagcaagtacaaggatcgctgaagatgctctattcgttgcaaacagcacttgcggaaattacaggcatggatgaagtgacattgcaaccagctgcaggagcccatggtgaatggacagggttaatgatgattcgcgcttatca

SEQ ID NO: 4733 - DNA, 185 bp, Bacillus clausii
tttaatgaatttgtcatcaactgcggacagcctgtcaaagacgtaaatcgcaaattgttggaaaaagggatgattggcggttttgatctcggcagtgttgagccagaacggaacggacaaatgctcgtttgcgtgacagaactgcgcacaaaagaagagttggatttcttcgcgaatgaaatggg

SEQ ID NO: 4734 - DNA, 174 bp, Bacillus clausii
gcatttaacgattcacagtttcccggaacatggctatgcgagcatagacgtttatacatgtggtccagttatagacccaaacgttgcagctgagtttattgcaagagaattggatgcaacaacaagcgaagtgcttgaattgccacgaggaatgggaccgattaagcctgaaaa

SEQ ID NO: 4735 - DNA, 648 bp, Bacillus clausii
gattaaagcagctggtcgctggggcttatgaagtccaaaggagtagaaagccaataaagcagaaattattgcagccaaaggcaattttcatgggcggacattaaatgcgatctccttgtcgaatgatccaggagcgaccaaacattacggtccttttgtaccagggataaaaaaggtagcgtatgggaatgtggaagccattcgtgaagcaattacgcctaatacagcggctgtgattgtagagccaattcaaggagaagcaggcatcattatcccgcctgaaggttacttacaagccgttcgtgatctctgtacggaaaacgatattctctttattgccgatgaagtgcaaacaggttttgcacgaactggaaagatgtttgcgtgtgaatgggaaaatgtcgttcctgatatttatgtaatgggaaaagcattggggggcggcgtttttccaatatcggctattgctgctgacaaagacattatggatgtatttacgccaggttcacatggatctacttttggcggaaatccgttagcttgtgccgtttctctagctgcaattgaagtaattgaggaagaaaatttagcgaaaaaatcgttagaattaggggagtatttcacaacagctttacgggcaattgataa

SEQ ID NO: 4736 - DNA, 795 bp, Bacillus clausii
tttatctacgttcgcgattaaagtttcttgtggtttttttaacaacccgtcgatcgggctgcctagcttaggaggactgatgcttgcgatggacgctaagacaggtgtgccaaaagcattgctagccgataacggctatttaacagatgtacgcacggcgttagcaggcgcaatcgctgccgatcgtttagcaaaaaaaacgacttcaacagtcgccgtatttggtactggcatgcaggcccgcttgcaagtaaaagcgcttaagcttgtccgtgattttgcggaagtcgttgttttcggacggtctgaagaaaaagcgcttctttataaaaaagagatcgaggaagaattaaacgttcctgttcacgtagctaatagtggaaaagaggctgttgaacaagcagatctaattgtgacgacaacaccagccgaacactatatactgaaagccgattggctgttaccaggtgtccacgtaaatgcgattggctcagatgcagagcataagcaagaaatcgagccagcagcattttttaaagcagacaaagttgtatgcgacctttattcacaaagctcgacgatcggcgaactccatcatgtacaaggttttttagctgaacatgcgattgagttaggggcgattttaactggagaaaaggaaggcaggacgtctgaacgggaacggaccatttgtgatttgacgggcacaggggtgcaagatacagctatcgccaattatgcattggcaaaaatgaaacggagcgaataaaagaagtcgagcctgtcgctgtctga

SEQ ID NO: 4737 - DNA, 597 bp, Bacillus clausii
gcacccagaaatagagcatgggaagattcgtgttgcctttacgcctgatgaggaaattggacgtggaccggcccattttgatgttgacgcttttggggctgcctttgcttatacgcttgatggcggacctttaggtcaattccaatatgagagtttcaatgcggcggcagcaaaagtcagcttttatggcgttagcacccatccaggaacagccaaaaataaaatggtgaatgcgatcaaacgggcgatcgaattccattcacagcttccagcgaacgaagcgccagaattcacggaaggctatgaaggcttttaccacttgctttcaatggaaggcaatgctgattttgctgaactccactatattattcgtgattttgaccgtcagcaatttgcaaatagaaaagcaaaattggaggccattgcctgggaaatgcaagaaaagcatggaaagggaaaagtatccatcgagcttcgtgaccaatattacaatatgcgtgaaaaaatagagccacagaaggaaatagtcgaggttgcgttggaggcgatggagaagcttggcattgagccgaaagtagggccgattcgtggcggtac

SEQ ID NO: 4738 - DNA, 1224 bp, Bacillus clausii
  misc_feature (1)...(1224): n = A,T,C or G
atgaacgcaaaggagataaagaagctgttcccgatcctcgaccaacaagttaacgggaatcctcttgtctatctcgacagcgccgccacttcgcaaaagccaatccaagtcattgaaaagctcgatgattattaccgccgttacaattctaatgtccatcgtggcgtgcatacgcttggtacgcttgcgactgatgaatatgaaggcgcacgcgaaaaagtccgggctttcttgaatgcgcaagaaacggcggagattgtctttactcgtggcacaaccacggccattaatttagtggcgcaaagttatggaaatgaccatgtcggcgaaggcgatgaaattgtcattacgccaatggaacatcattcgaatatcattccatggcagcagcttgccaagcggaaaggggccgtgttgaagtatatccctttgcaagaagatgggacgatttcattagctgatgtcgaaacaacgataacggaacgaacaaaaatcgtttccgttgtctacgtttcaaatgtgctcggcacggttaacccaattgctgaaatggcgaaagtcgcccataaacatggcgcggtcatggtcgtcgatggcgcccaagctgctccccatgtccacgtggatgtccaacaattagactgtgacttttttgctttctcggcacacaaaatgtgtggcccttcgggcatcggcgccttatacggcaaaaaagcgttgcttgaagcgatggagccaattgaatttggcggggaaatgattgattttgtcggtctgcaagattcgacttggaaagagctcccatggaagtttgaagggggaacgccaatcattgctggcgcaatcgggttcggtgctgcgattgattttgtcaccgatttanggtttaatgaaattgaacagcacgaaaaagaactcgttgactattcgtttgagcgtctcggcgatttcaaagatttgacgatctttgggccaaaagaccgtgcaggggtgatcacattccagcttggcgacgtgcacccccacgatgtagcgactgtccttgatgctgaaggaattgctgttcgcgcaggccatcattgtgcacaaccgttaatgaaatggcttgacgttgtcgccactgctcgtgccagctattatgtgtacaatacgaaagaagatattgatgctctggcaaacggattagtcaaagcaaaggagtattttagcgatgtcttctcgtga

SEQ ID NO: 4739 - DNA, 1217 bp, Bacillus clausii
  misc_feature (1)...(1217): n = A,T,C or G
atgaacgcaaaggagataaagaagctgttcccgatcctcgaccaacaagttaacgggaatcctcttgtctatctcgacagcgccgccacttcgcaaaagccaatccaagtcattgaaaagctcgatgattattaccgccgttacaattctaatgtccatcgtggcgtgcatacgcttggtacgcttgcgactgatgaatatgaaggcgcacgcgaaaaagtccgggctttcttgaatgcgcaagaaacggcggagattgtctttactcgtggcacaaccacggccattaatttagtggcgcaaagttatggaaatgaccatgtcggcgaaggcgatgaaattgtcattacgccaatggaacatcattcgaatatcattccatggcagcagcttgccaagcggaaaggggccgtgttgaagtatatccctttgcaagaagatgggacgatttcattagctgatgtcgaaacaacgataacggaacgaacaaaaatcgtttccgttgtctacgtttcaaatgtgctcggcacggttaacccaattgctgaaatggcgaaagtcgcccataaacatggcgcggtcatggtcgtcgatggcgcccaagctgctccccatgtccacgtggatgtccaacaattagactgtgacttttttgctttctcggcacacaaaatgtgtggcccttcgggcatcggcgccttatacggcaaaaaagcgttgcttgaagcgatggagccaattgaatttggcggggaaatgattgattttgtcggtctgcaagattcgacttggaaagagctcccatggaagtttgaagggggaacgccaatcattgctggcgcaatcgggttcggtgctgcgattgattttgtcaccgatttanggtttaatgaaattgaacagcacgaaaaagaactcgttgactattcgtttgagcgtctcggcgatttcaaagatttgacgatctttgggccaaaagaccgtgcaggggtgatcacattccagcttggcgacgtgcacccccacgatgtagcgactgtccttgatgctgaaggaattgctgttcgcgcaggccatcattgtgcacaaccgttaatgaaatggcttgacgttgtcgccactgctcgtgccagctattatgtgtacaatacgaaagaagatattgatgctctggcaaacggattagtcaaagcaaaggagtattttagcgatgtctt

SEQ ID NO: 4740 - DNA, 1260 bp, Bacillus clausii
  misc_feature (1)...(1260): n = A,T,C or G
tanctgcttggcctgatgacttaaaagcggcagtgggcgagcaccactatttagtagccggcgggtatgaatacgatggcacgttgatttcagaactagatgaaaatgaaatccgttccgcactggaggctatgaaaggaaacgttaaatccattgctgttacaggcatattttcgccagcccgagccgagcaagaattgaaagtagcgcgccttgcccatgatgtcatgcctggcgtgccgatttcgctgtctcatcaaattggcagcattggtttgttggaacgggaaaatgcgacgattttaaatgcagcgctgcaaacgacaatacgtaccgtcgtttccgggttccgtgaagcacttagcaaacttggcattcctgcgcaaatctttatcggccaaaatgacggcacattaatggaagccgattatgcaatccgttacccgattttgacgattggctgcgggccaacgaactcgattcgcggagcctcgtttttgtccggtttaaaagacgcgcttgtgttggacatcggtggaacgacttctgatatccggtgttctatcaaatggatttccgcgccagtcagccattgccgttgatgtcggcggcatccgcaccaacttccgcatgccagatattctctcagttggcttaaggaagccggaaccattcatccgggtatagccgaccaggaagcaatcacggttggccntgattcagtcggctttcgtttattacaggaagcgcgctcttttgaaggcgacacattgacagcaacagatgtggtgttggccgtgacagacacaacgattgttggggctgatactagcgatttagacagcgacgcctgtcaacaggcgtacaaccgaatgatcgaaaagcttgaggttgcgattgaccaaatgaaaacgtcgaaagagcctgttcctgtcattttaacaggcggcggcagcattctagttaacagtcgattggcgggggcttcagaagtgataaagccagaccatcatgatgttgcaaatgcaattggggctgcgctggggactatttccggggaagcggagaatatctatgcgttggaagggcggacgtatgaagatgcagtcgaagcagcaaaacaacaagcaattgggaatgcggtcgaggcaggggctgttccggccacagtcgaaattgtctctgttgaggacgttccactcgcatacatgccgggaaactccgtttttattaaagtaaaggcagtcggagagctggatg

SEQ ID NO: 4741 - DNA, 471 bp, Bacillus clausii
  misc_feature (1)...(471): n = A,T,C or G
tgtggacattcacacctcttcaaaacaatacaaggctgaagtggggccagggattttgcgggaggcaggcaaaacgattgaagcgcttgccccggcttcttcctatttgatcgtttcagatgaaaatgtcgcaaaccgttatctcgatgtgttggtttcttcttttacaaaagctcctcatacgtttgtcgtgaaagcgggggaacaatcaaagtcttttcaagtgtatgagcagcttgttgttttttgtttggaaaaacagcttgaccgccagtcggttatcatcgccttcggaggcggcgttatcggcgacttggccgggtttgtagcgggcacctatatgcgtggcgttcgctttatccaagttccgactactttactcgcccatgattcaagcgttggcggaaaagtagcagtcaacttgcctgccgctnaaaatatgattgggcgttttttcatcagcctgaagct

SEQ ID NO: 4742 - DNA, 372 bp, Bacillus clausii
  misc_feature (1)...(372): n = A,T,C or G
ggaacacggtttcaagcagccaagtcatgatgagataacttggagcgaagaggaaggctacaggcggaagacgaatcgccttggcggttttgaagncgggatgaccaacggcatgcccattgtcgtaaaaggtgtgatgaagccgatcccaacgttgtataanccgctgcaaagcgtagatattgattcgaaagaaccatttgccgcaggtgttgaacgttccgatagctgtgccgtccccgctgcatcggttgtctgtgaaaatgtggtagcgtggnaagttgccaatgccttgctcgatacatttggttctgaccagcttcctntgatccaggctgctgtagaacgtcatcatgccgcttcaaaggagtt

SEQ ID NO: 4743 - DNA, 504 bp, Bacillus clausii
ggaaaaaatgaggcggaagttaacacgtccccgtccaggtcacgctgatttaaatggtgcaatcaagtacgggcaccgcgatatgcgcaatgtcctagagcgttcatctgcacgggaaacgactgtccgcgttgcctgcggggcattggcaaaagtcatcctgaaagcttgtggcattgaagttgccggacatgtccgcgaaattggcggcattcgggctgagaaaacaaactatgcgacgattcaagaattgcaaaagcgctcagaagagtcgcctgtacgctgtttagacgaggatgcaagcaaaaagatgatggcagccattgacaaggcaaaacaagatggcgattcgattggtggcattgttgaagttgttgttgctggcgtgcctattgggcctcggcagccacgtccattatgaccgcaaattgggatggcaaaatcgctggcgcggtcatgagcattaacgcgtttaaaggcgtagagattgggcattggctttga

SEQ ID NO: 4744 - DNA, 186 bp, Bacillus clausii
agttccatttaggtgtgaatgtcctctcgattggcaacaaacgggtgattgcactgcctatgaatgagaacaccaatgcccagttgcaagcacgtgggtttacgattattgaagtcgatttttccgaaattattaagtctggcgggtcgttccgctgcgtgacaatgccgttagtccgctcaaatt

SEQ ID NO: 4745 - DNA, 678 bp, Bacillus clausii
atgaaccgattcgtgcgaaaagaggcactgccttaacggccaaagggtgggtgcaggaagcagcgctccgtatgcttatgaataatttagatgaagaagtagcagagcatccagaccaattagttgtctacggcgggattggcaaggctgcgcgcaattggccgtcttatcatagcattgtctcatcgttaacagcgcttgataacgacgaaacgttgctcattcaatctgggaaaccggttgctgtctttaaaacacatgaagatgctccgcgggtgttgcttgccaattccaaccttgtccctgcttgggcgaattgggaaacatttcatgagcttgataagaaaggcttaaccatgtacgggcaaatgacagctggaagttggatttatattggtagtcaaggcattgttcaagggacttacgagacgtttgccgaatgtgcacgacaacattttggcggttcattaaaagggacgattaccgtaacggctggattaggcggcatgggcggcgcccaaccgttagcggtcacgatggcaaatggcgtggctatttgcgttgacgtggaccgttcccggatcgacaagcgtatagagaccaactatttggatattgtcgcccatacgctatcagaggcaattgaagaagctgaactcgcgaaaaaggaaggcatcc

SEQ ID NO: 4746 - DNA, 245 bp, Bacillus clausii
atgaataaagggcaacgccatattaaaatacgggaaatcattaccaattatgaaattgaaacacaggatgacttagtggatcggctaaaaagcgatggctacaacgtcacgcaagctacggtttctcgtgatatcaaagaacttcatttagtaaaagtaccgttgcaagacgggcgctacaaatatagcctgcctgcagatcaaaaattcaacccacagcaaaagctgaagcggattttaaccga

SEQ ID NO: 4747 - DNA, 465 bp, Bacillus clausii
aaaaagtggaatgtttgctaagggaacggattggtgctttaggggaaagcgaacaagcttcaactggaaagacgattgccatcccagtatgctatggcggcgactatgggccagatttagcggcggttgccgcccataatcatttaagcgtcgaggatgtcatcaacaggcattgtgctggcgactatctcgtttatatgatcgggtttgcccctggttttccgtttctcggtgggatggacccggccatttccgcgccaagacgaaaacagccgcgagccgtgattcctgctggaacggtcggcattgccggtggccagaccggtgtctacccactagaaacgcctggcgggtggcagcttattggcagaacgccgcttgtattattcgaccctgagcgcaaacaaccaagcttgcttgccccaggagatcgcgtccggtttgaggcgatttcagcgaaaacat

SEQ ID NO: 4748 - DNA, 300 bp, Bacillus clausii
taagctgttgcgaacaccgctttatgaactttacgctcaggcaggagcgaaaacggttgactttggcggctgggaattgcccgtttccttttcaggaattaaaaaagagcatcacgccgttcggaacgctgctgggctttttgatgtatcccatatgggagaattgctggtggaagggcctgatgcattaaacagtttgcaagcactagtaacgaacgacttgtcgaaattgcaagataaccaagcccaatacaatgcaatgtgcacggaatcaggggggacggttgatgattaattgtt

SEQ ID NO: 4749 - DNA, 954 bp, Bacillus clausii
tggacacgattcctgtcaaagcggtatggcaagcacgcaaacggctttttccttatctgccaaaaacgcccctcgtttatagcactcccttatcgggtcattgccgaacgcctgtttggttgaaattagaaacattacagccgagcggctcatttaagctccgcggggcgatgaacgtgctcttgtctatgtcagaagagtcaagacaaaaaggcgttgccgctttttccacgggaaaccatggccttgcggtcgcctacgccgccaaacaggctcaaacacaggcgacaatttttgtatccgaatcggtaccgcctgccaaactagccgcgcttcaagcgagcggggcaacaataaccgtgacagggcgcagccaagatgaagcaggcgcagcctgtatccgccactgtcagcaaacagggcagacgctcgtcccaccatttgacgacgacaggattatcgctggccaaggcacactcgctttagagctgctagacgatttgcctgaacttgaaacggtgatcgctggattatcaggaggagggttgcttagcggaattgggctagtaatgaaacataccgatccgacgattcaagtcgccggggcaagcatcgtcaatggagccgctatggaagccagtttggcagcgggccatccagtagaagtagccgaacagccgactgtggccgacagccttcttggcggaatcggtctgggcaaccgctggacgtttaaggcggtccaacgttatgtcgacacccgtgtacaagttccagaagaagacatggccaaggcgatggcttatttatatgagcatcaccatttaatcgtggaaggagcagctgccataggagcagccgcactgttaaataatagcattcgccctaaagggcctaccgctgttgtcattaccggcgccagcattcatccaaaagagcattaccgcatcatcc

SEQ ID NO: 4750 - DNA, 441 bp, Bacillus clausii
ggttggccttggggcaatggcagcggacgcactgtacatgtgtgctgtgtttttaggggtttcccgttttttagagtatgaggtcgtgaccgttttcttatggctgtttggttgttttgtccttgtatacacaggttttgagagcattatgaaggtgaaaaaagaagcacaaacaggcctcggcgtaaggacaaacgagtcgccgagacaatcattccaaattggatttttgatctcgatttccaatccgctgacgattttattttggctcggcatttatggctcggtactagcaaaaacgatttctgaatatgaaatggccactgtttggctgtacagtgtggcgatctttataggcatagcggcatgggattttacgatggctgttctgtcaagcaccgcccgcgcttttatgaatgaaaaggcgctcattgccatttc

SEQ ID NO: 4751 - DNA, 444 bp, Bacillus clausii
gtaagaaaaaagaaaaaaatacaagtttaaactggtggcaactttcacttttaggcgttggctgcacaattggtactggctattttttaggttcgagcattggcattggcctcactggcccttcgatcgtgattgcctttctgcttgcagctcttggcacgtacgtcgtctttattgcccttgccaaattgacggcggacgatccgcaagaaggatcgttctgttattatgcagaacaagcattcgggaaccgtgttggctttgccactggctggaactattggatgtccaacattttaattatcggcagccaattaacggctttatcgattttatctcgtttctggtttgacaatgtgcccctttgggtgttcgcctcgatctattcgcttctcggcattggcgttgttttgctcggtacaaaaggatttgattcggtgaaaa

SEQ ID NO: 4752 - DNA, 666 bp, Bacillus clausii
caggtggcgccgtaatggggaagaacatcaatacaacccacatacgattcacatgctccagcatgcgtgccgcacgaacaattatgagctttacaaacaatatacgcatgcgatcaatgagcaaacagaaaagcagacaagtttgcgtggtcttttccgcttcaaaaaaggcaacgcaattccgctagacgaagtcgaaccggcagaatcgattgtaaagcggttccggacaggtgcgatgtcatacgggtcgatttcgaaagaagcccatgaaacgcttgcgattgccatgaaccgcttaggcggcaaaagcaatactggcgaaggtggagaagatccacgccgctttactcctgatgaaaatggcgatttgcgccgcagtgctattaaacaagtagcgtccggtcgatttggagttactagccattaccttgtaaatgcagatgaaatccaaattaaagtcgcacaaggagcaaagccaggggaaggggggcaacttccaggcgagaaagtttatccgtgggtggcagaagtgcgtggctcgacggcaggtgttggcttgatttcgccaccacctcaccatgacatttattcaatcgaggatttagctgaccttatccatgatttgaaaaaccccaacccgactgcgaaagtagcgttaagctt

SEQ ID NO: 4753 - DNA, 684 bp, Bacillus clausii
tggcgatgcaattaaaacaaaaacaagatgcccctaaatcaggtacggcgctgttgttgcttttagcgatcatttataccgtttcattaggactcgccgtcagcatggtctcgtttgaccaatttacagacaaagaaagcccatttgtgactgcgttgtctgactatcatcttgctttctttccccacgtgtttaatgcagccattattgttgctggcttttcgacaatgacagcggcgctatttggggtgacgacgctgctaacaaccttagcccatgacgggaacgcaccttaatggttcgaaaagaaaatcaaatacaaggaccttcctttgccttcccttggcctcgctgttgttggcttaatctgtgcagtcattgctgcgctattattgcccgggaaactgttcgagtatattacaacagccgcaggaattcttattttgtttaattggatttgcatcgttttgtccaatatgcgcttgctgaaacaaacggttttttccataagtggaaacattattggcatcttgttgatgttgttggccatcagtggcatcttggcggaaaaaacgggacggccaggcttttacttaagcataggtttcgctgcaatcattgtgcttattgcatggcttgtaaaaaaaccgcacaaagaacagagtagctcttgagctaaaagag

SEQ ID NO: 4754 - DNA, 543 bp, Bacillus clausii
tatattacccgttttatgatgtaatcgaaaaaaacaaacggcaacttgtgaaaaatccgcttctatttgatggaaaccactataaaatggatttagctgggctggagcaggtgatcacagacaaaacaaaaacgcttctgttgtgcctcccacataatccaggcgggcgcgtgtggagcaaagaagagttgcaagcgctggccgaaatatgtgagcgccacaacctttatgtgatttctgatgaaatccatgccgacttgctatttgaggggtatacacacacaccgtttgcaactgttacaaaaacaattgcaaaccgtacgtttacagcgctagcgccaacgaaaacatttaatctcgccggcgttcaaggagcctacgtgattattgaagatccgaagcttcggctggaattccgtagagagctggcagcgacatttatgaatggaagcaatatgttctctgacattgctaccaaagctgcatacgagcacggaaagccttggctaaaggaattaatggcatacatccaagcaaattatc

SEQ ID NO: 4755 - DNA, 393 bp, Bacillus clausii
cgagattgaagcaagccgtcgggctgttgaaaagatcgtccaagacggacgaaccgtatatggcatcaatacggggtttggaaagttcagtgacgttcaaattgctgctgccgatactgaagagctttcaacgaaacttaatcttatccccatgcatgtggggtaggcggttatttttcccgatgaaatttccccaggcaatgatggtgctgcgggctaatgcactcgcaaaagggttctccggcgtcccgattagaagttgtggaaatgctgctcgagttgatcaataaagatgtatatcccgtgtattccttcacaagggtcgctcggggcgagcggcgacttggcgccattatcccatttagcccttgtgttaatcggagagggagaagt

SEQ ID NO: 4756 - DNA, 585 bp, Bacillus clausii
caggcatccctttgactaatgttgtaacgatgccgtatgacaaatttggagatgaagaagtcgatacacttcgctatctcgaacagtttttacgtgacaacggctctggagtagacattccggcggccgtcattctcgaaactgttcaaggagagggcggcattaatgccgcacgtatggaatggttacagcaattagagcgcatttgcaagaattaccacattttaatgattatcgatgatgtccaagcggggattggacgcacaggaacgttttttagctttgaggaagcaggcattacgcctgacattgtctgcctgtctaaatcaattggcggatatggattgccattagcactcactcttttcaaacctgaacttgatatttgggctccaggcgagcataatggcacattccgtggaaacaaccatgcctttattacagcaacggcagcattgtcctactgggaagacccatcgtttgaacaagcgattaaagacaagtcaaagaaaatccatgcctttttaacgaagctcgtcgattcatatccagaaatgaatggttgtgtaaaaggaaggggctttt

SEQ ID NO: 4757 - DNA, 225 bp, Bacillus clausii
aaaaggcgataaacgctgtagaccttgtcggcgtttcgattggcggaggcaaaattgaaatagtcgagttgaccggattcgaactccgtttatcggggaaccacccggctatattggttgcccatcttgaccgttatggcgtgattgccgcagtgagcaacctccttgcaaaacatccaattgaatatcgggcatatggaagtgtcgcgtaaagaaaaaggggaa

SEQ ID NO: 4758 - DNA, 369 bp, Bacillus clausii
ttgtttaaaaatgtcgaagaattagttacgaaagcggaacaggccaatatgcccatctcggaagtgatgatcacccaagaaatcgaagtgactggtagagagaggcgccaaattattgaacagatgcgcgggcaattgctggtcatggagcaagcagtagaacgggggatccacgaagacgtcgtatccgtttctgggctgactggcggtgacggcaagaagctggctgcttatgtgaaaaacgggacaatgattggcggtgagacgacacttttggctgtggcgggggcgatggcaaccaatgaagtgaacgcggcaatggggacaatttgcgcgacgccaactgcaggttcggctggcgttgttcct

SEQ ID NO: 4759 - DNA, 333 bp, Bacillus clausii
  misc_feature (1)...(333): n = A,T,C or G
aattgacacatttaccgattatagcgggagctgggcgattgttcgcacctntattgttgggttgtttctgtttgggctgctgctgttgcttaaacgcggcgaacaaaaaggcacacacgccgttttatcgtttcgtacatttggccgctcttttgctttgctaggcgtgtttatcatgctagcagcgtcgattggctatgcgatgccaaaacctgaaccgcagtggccggaccctcttccttatctccaatcggtatttggctttgttccgagcggcataggcactcctgtgcaacggattggctacagtgaggacgatcgccgcctcggtgg

SEQ ID NO: 4760 - DNA, 570 bp, Bacillus clausii
aaacacaatcacaaatcattcaagcgtgggacgttctttcgacgttgaccccaactgaatacatggaatttcgggaacagctcggccaggcatcagggttccagtcgtatcaatatcgtctcatagagtttgcactaggccataaaacgagagcgattttaaaaatctacgaaaaagacaaggagttgcatgaaaagctggttgaagcctatcaggcaccgagcttgtatgacgtttcgattcaagcattggcaaatgccggcctagcaattgaccaacacttaatagaacgggatttttcaaaaccttatgtggcaaatgattctgtccgagaagcgtggttgaccgtctatcgacatgtggatcgttattggaatctctatcaactaggagaaaagctagtcgatatcgaagattggttacagcaatggcgttttcgccatatgaaaacagtcgagcgaatcattggctttaaagttggcacaggtggctcgtctggagtcaactacttaaagagtgtccttgagcaacgtttttttcctgagctatgggatttgcgaacggaaattt

SEQ ID NO: 4761 - DNA, 612 bp, Bacillus clausii
gcgcacgggaaagcgatgtcgttgcagccatataccacgcacaaattgccgggacagaggagtttggtggcgattatccggcaattgtcccactcttgccgtcaggcgtaaaaacaagcgctcctcatattacgtggtctgaccaacgctatcctagcgaagatacagtcattattgagttagctggctgctatcaacgttaccatgctccactcgcaagaacagtgacgattggaaagccgcagcagcgtgtcgtcgatatagccaaaattgccgttgaagggctcaatgaagtgcttgcatggatgaagcctggagtcacgtgcgaagaagtggaagccgtctggaggaagacaattgggcgctacggactcgaaaaagaagcacgtattggctattcagctggattgaattatccacctgattggggcgaacatacggcaagcattcgaaagggagataaaacggtgctgcaagccaatatgacgttccatattatccctggcatgtggtacgacgacttggagtcgaaattagtgaatcggtaccggtgaccggaaaatggcttgtgagcttctttgcgaatttttccgcggcagctgtttgagcaat

SEQ ID NO: 4762 - DNA, 339 bp, Bacillus clausii
  misc_feature (1)...(339): n = A,T,C or G
cagcgtnaaaagatcggattgncactggcgatggtgaatgcagctgaagaatcgggagaactaaangccaggagcgaaccattgttgaaccgacaagtggcaacacgggaattggccttgcgatggttgcagcggcaaaaggctataaaacaaagctggttatgcctgaaaccatgagtatggagcggcgtaacttgctgcgcgcttacggagccgagcttgtgttgaccccaggtccagaaggcatgggcggggcaatccgaaaagcgacagagctagccaaacaagacgggcattttatgccgcagcaatttgaaaacagcgcaaatccgaaaatcc

SEQ ID NO: 4763 - DNA, 411 bp, Bacillus clausii
tcattgacttctttttaaaaacggagtcaggccttgccttgcgtgcaactggcgacaacccgaaaatgatccgcagcttatcagctaacacagaccgcctaaaaattattggcctcggcatgtccaatgccttcgttgcactagccggtgcaaccgcggcccagtatacaaaatttgctgacgtcaacatgggcattggaatgattattatcggccttgcttctgtcattattggcgaagccctgtttggcaaagggtcgctcgttaaaattacatttgccgtcattattggcgctgttgtctaccgcatcattattgcactggcgcttcgagttgagtttttagaggcaggcgatttgcggttaatcacagcagtgatcgtcatttgcgcccttgttgtaccaatgctga

SEQ ID NO: 4764 - DNA, 249 bp, Bacillus clausii
ttttttatgggaaggtttgaaatacacggttttaattacgctcgtcggtgtttttttaggaagtatcgttggctcgactttcggattgatgcgcctgtctcgtattggattcgtgagagcaattgcagcaatttttgtggaagccattcggggaacgcctttgctggcacaaatcttttttatccatttcgggattccaggtctgttggatttacggtttgatccgctttacactggtatttttgtcat

SEQ ID NO: 4765 - DNA, 252 bp, Bacillus clausii
agcctaccaagcgttgcttgctggccatgtcgatgccgttttatatgacatgcctaatgtgcagtatttcatgcaacagcaaggagaagggcaaatgaaaatggtaggcgagcgtttaacaggtgaggaatatgggattgcctttccaaaaggctcagacctcgttgaaccagtaaatgaagcgctggcgacgctcatggaaaacggcacgtacggcgatatttatgaaaagtacttcggagaacgaccaga

SEQ ID NO: 4766 - DNA, 1137 bp, Bacillus clausii
atgccttgttttgagagcgtttacacaaaagaatatgcgcaacaactggatgcagctgatccacttgcgcgctttcgcaatgagttttacattgacaaaaaaagcatttatctcgatggcaattcactcggtttgctgtccatacgtgcagagcaatcattgcttgacgtattggattcttggaaacagtatggaattgatggctggacaaaagggaagcacccttggttttatttgtctgaatcattgggggaaaagatggctttccttgtaggggcgaaggcggaggaagtgatcgttactgggtcgacgacaacaaatctccaccaattagttagctctttttttcggcccgaaggaaagaaaacgaaaatactggcagacgagctgaatttcccgagtgacatttacgcattaaaaagtcagctccacctccgaggccttgatccagaggaacaccttattcaagtgaaaagtgaaaatggtcacattctaaatgaaggggacattattgcaaaaatgaaagaagatgtcgctttgatcgttttgccgagtgttttatatcgaagcgggcaaatccttgatatggaacggttaacaacggccgctcatcaaagaaacattctaatcgggtttgatttatgccattcgattggttccattccccaccaattaggaaagtgggatgtggactttgctttttggtgcacgtataaacatgtaaatggcggaccgggcagtgtagcggcgctttttgtgaacgaaaaacactttggcagaagcccaggattagctggatggtttagttcaaacaaacaaaaacaatttgacatggagcatacgctaacgcatgctgaacatgccggtgcctttcaaattggtacacctcatatttttagcatcgcgcctttgatcggatctcttgccatttttgcagaagcaggaatcgaccaaattcgcaaaaagtcgttaaaactgactgactatatgatgacactaatcgagcacgagctttccgagtaccagtttacgatccaaaacccaagggatgaaagacaaggcggccatctttacattgaacacgaagaagctgctcgtatttgcaaagcgcttaaggaagaaaacggtgatccctga

SEQ ID NO: 4767 - DNA, 534 bp, Bacillus clausii
cttttgcccatttgtggaaaacggttttagaggaccaaggttatcaagtggaactttcccttgtggagaaagcaatgctttttaatggagtcgaaaacggcgatatcgatattggctttaatacttggctccctttcactgaccaagcatacgtctcactcgattcagaagaaatagacgtgcaggctgatggcgtcctgtacgaagggacaaccttggggctggctgtcccttcgtatatggatgatgcggaaacaattgaagacttagctggctatttcgacgagctaaagggaacaattacagggattgatccaggctcggcgttaatgcaattgacgcaagacgaagtcatggaccattacggcttggaagagtttactttacaatcctcttctgaacaagcaatgattgccgaacttgatgcccgttacaaaaacgaggaaccgattgtcgtcactctttggagccctcattggacatttggatcttacgatttaaagttcctagaagacccagatcgtatttatggct

SEQ ID NO: 4768 - DNA, 499 bp, Bacillus clausii
atgaaactagtatgctttggcgatagcattactgctggccacgaagggttaaacgaaccaatgttatccgcatttcttaaaaagaaattgccaccaacggttgaaatcataaacgctggcgtttctggagacacaaccgttcaagctttagcacgaattgaaaccgatgtcattagccatcaacctgatcttgtaaccgtgttgtttggagctaatgacgtagccacccataagcgagtgaaacaagacgaatttactcataatatcgacaaaatcgctagcctcatttcgccaaagaagaccattttgattacccctgctcctggcgatgaatcacttgaacaaaacagaacaaacgaagcactcaaggcatacagcgattgcatcaaggaagtagcacaaaggcgcaactgtcatttcattgacttttttactaccttcttttcaaagccagattatcaatggcgcttaaaaggcacgagggatgacggcttgcatt

SEQ ID NO: 4769 - DNA, 537 bp, Bacillus clausii
  misc_feature (1)...(537): n = A,T,C or G
cantagcccatagcaaaaagcccagtccatgcatgaaccagcctacaaagatatggggttagacgcctgttaattgtgcctatgacatttctcctcaggaattgggaaatgctatacgtccaatgaaagcgcaaggcatcgacgggtttaatgtaaccattccccataaagtcgcaatcatcgactatttagacgaaattgatgaagatgccgaagcgatgggggcggtcaatacagtcgtttgtcaggacggccgttgggtcggcaaaaacacagatgcggatggttacatcgaatcccttctgccggttgtaagcgaccaatcgcttacaggaaggcgtgtgcttgtcattggtgcaggaggcgcggcgagggctgtaatccacgccctcggcaaacaacgtgccactatttctgtttcaaaccggacggcggaaaaagcccaggagctggcgcagctgtttagccatttgactattgaggcaatcccgcttaacgaggcggaatcaacgctcggaacatacgacgtattaatta

SEQ ID NO: 4770 - DNA, 966 bp, Bacillus clausii
  misc_feature (1)...(966): n = A,T,C or G
attaattgatttagctactgaacatacggcaacattaatgactggttacacacatttacagccagnngaaccgattacgtttgcccattacctttccgcactgctgcacggattcgagcgggatttcacacgcctgtataactgttatgcccaaatcaacaaaagcccgcttggttcttgcgcccttgcctcaactacgttttcgattaaccgaaaattcacgatggatttattaggattcaccgatttgcttgaaaattcgcttgacggcatcgcctctcgagattatgcattagaagcactttcagcattaagcatatttagtaactcattaagccgcttcgcacaagacctttacactnggtgttcgtatgaatntggttatctngaagtcngtcattcantancagttattagcagcattatgccgcaaaagaagaacccggatatggctgaattgatccgtggcaaaaccggacgcgtgtatggcagcctgttcagcttgctgacaacgttgaaaggtttgccgctagcttacaacaaagatatgcaagaggacaaagaaggcatgtttgacgctgtaaaaacagtcaaagggagcttgcggattttcgcaggaatgattgaaacaatgactgtaaacacggatgcgatgacaaaagccgtcacaagtgacttttcgaatgcgactgagttggctgactatttggccacaaaaggaatgccttttagagaagcccatgaagtagtaggcaaacttgtgctcacagcaattgaaaagggtgtgtatttgctcgatttacctatcgaggtttacaaagaggcgagcagcctgtttgccgatgacatctatgaagttcttcagcccaaaacggttgttggccggcggaatagcgcagggggcactggcttcgaacaagtcaagcacgcccttggaaaagcaaacgatctattgtctcagtctat

SEQ ID NO: 4771 - DNA, 834 bp, Bacillus clausii
aacggctgcaaacattgcaaaagcaaatgggagaaaagcaagcttggtttgcgtttataacaagcaaagaaaatgtcttttatttaactggttaccgtacggacccccatgaacgcctcattgccttttttgtttttaaagatagccattttcttgttgttcctaaaatggaagaaagcatggtcagaaaagctggctacgatggcgacattctttcatacagtgataatgaaaatgtttgggagaacatttatgcccgcattcccaagcacgaacaccgtaacttgccacttatatgtgtagaagaacggcttgtttcttttgaacggattcgcgctttacaagcccttgataaacaggttttgtttactgactgtgaaggacttttaatggagcagcgcctacagaaaacaaatgaagaactgcaaacattgcgtgctgccgctgcttttgctgatagaggggtagagctaggcgtagccgcgttaaaaactggcgtaaccgaaatggaagtcgtcgcggcgattgaatatggcttgaaacaacaaggcatccgggaaatgtcattccagacaaccgtcctctttggtgaccatgcgagcgcaccacatggaaagcctggcaaccgccaattgcaagaaggcgaatttgtcctttttgaccttggcgtcgttgtagatggctactgttctgacattactaggaccgttgcctacggaaacgtttccgaacaggaggccgctatttaccgtacagtccttaaagcgcaagaagccgcgctcgctgctgcgaagccatgtgcggtgattggcgctgttgaccaagctgcacgcc

SEQ ID NO: 4772 - DNA, 918 bp, Bacillus clausii
aaaacgccgcagctggtcttgaatttgggggtggaggaaaggccgttattattggcgatccacgctcaaataaaaatgaggaaatgttccgggcgtttggccgctatatccaagggcttaatggccgttacattacggctgaggatgtgggcacgaccgttgaagatatggatatgatccatcaggaaacagactatgtgaccgggatttcgccagcatttggcgcttcgggcaatccttctccagtgactgcttatggcgtttatgtagggatgaaagcagcggcgaaagaagggtttggttctgaggacttagctgggaaaacgatagcagtccaaggagtaggcaatgttgcttacaatctttgcaaatacctccataaagatggagctgagctgattgtaaccgatattcataaaccgtctgtagagagggctgttgccgattttggcgctactgccgttgatccaactgagatttacagcatcaaatgcgatattttcgcgccatgcgcccttggaggcgtcattaacgatgattcccttgccaagctgaaggcatcggtcattgctggtgctgctaacaaccagcttaaagaagaaaagcatggtgttcgcttgcaagaaatggggatcgtatatgctcctgattacgttattaatgcaggcggcgtcattaatgtagcagatgagttaaacgggtataaccgtgaccgggcatttaaaaaagttgagggcatttatgataacgtcgcccgtgtgtttgaaattgccaaggaagaaaatatccctacgtttcaagcggctgaccgtatggccgagcagcggatcgagcgggtccgttatgcaagagggacgtttttgcaaaatgagcatcacatcctttcgaggaaaaagtaagcaggaagaagtgggctaa

SEQ ID NO: 4773 - DNA, 574 bp, Bacillus clausii
ttgtcaaaaattagggttgagggcttgacaaaagtatttgggaaaaaaccgaaacgggctctggacatgttggcacaaggaaaatccaaagcggacatattaaaagaaactggccacacggttggtgttaaccaagcaagttttgaagtcgaagacggtgaaatttttgttattatggggctttccggcagcggtaagtcaacaattgtgcggctgctgaaccgtttgattgaaccgacatcaggaagtgtttggattgacggtgaggacctcgctaagatggatgggaaaagccttcgggaagttaggcgcaaaaagatgagcatggtctttcagaagtttggcttgtttccaacaaggacgttgattgaaaacgtggagtatggccttgaagtgcaaggcattgagaagcaggtgcgccgtgaaaaagcgatatcgtcgcttgaacttgttggtttaaaaggatacgaaaatagttatccttcgcaactttctggcggtaatgcagcaacgtgttatggcttgcacgtgcccttgcccaatggatcccgggatgtcccttgtttaatggacc

SEQ ID NO: 4774 - DNA, 301 bp, Bacillus clausii
gtgtaccgccatatccatgaactcataggttcaacacccatgcttgaactgacggcctttccgctcccgcgccgtgtgcgtttatttgcgaaattggagtatacaaaccctggaggaagcattaaagaccgtttaggcgtcaaactcctcaaggaagcaatcgccaccgggaaaattacaccgaaggggacattaattgagccaacggctggaaatacaggggattgcccttgcgctcgcagctattggcacggatgtaaaggtcatttgtgtcgtgccaaaggcatttagcgtcgaaaag

SEQ ID NO: 4775 - DNA, 771 bp, Bacillus clausii
  misc_feature (1)...(771): n = A,T,C or G
gatcatcacaaaagaacgtgttccgtcgccccatccgaatattcatttatacgagacatcttacaaaagtggcgcgttaacggtgtacggtttattagcagaaccgaagtctcgaaacaaacaaccagggttgttgtatttgcgcggagcattaaatcagtgggcatgttcagaaaacagcgtgtcatccagtggctcacgagggatttgtagtgtttgntccttataaccgggtaatcgcggtggcgaaggcagagaggacttttgtggagatgatcgtgttgacgcatacagcggttttgatctgctaagcagccatcttcttgttgaaaaagaggcgggcgtccatgtagtggggttttcaagagggggcatcatggcgctttggacagggcttatgcggccagaagcgactagcattgtctgttggagtggcgtaaccgatatggtattaacctataaggagcgcgttgacttgcggagaatgatgaaacgcgtgattggtggaacgccgtggaaacgaccagaactatatgaaaaacgaacaccacttggccatttaagcgattttcgtcccccgcttcttttcatacatggcgaaaaagatgagcatgtatcgattgtacacgctcaaaaagggctgcgcgcagccaagggtagccagaatgccgaatcatggtttttcgctgatttttcccatcacttcccagccgaagagcaagaaaaagtattgagaaaggcagcgtcatggatgaaggcaaaacatcactc

SEQ ID NO: 4776 - DNA, 1041 bp, Bacillus clausii
  misc_feature (1)...(1041): n = A,T,C or G
aagaaaatggggaagtgttttatctgtcggccgtnctnactccataacncgttttatcgaatgaagaccgttccgtgcgcaaacgtgcttatgaagcgtcgctacaagcatgggctcagcaagcgccattgtttacgcaaacattaaatcgccttgctgggttccgtttgaagctgtacgaagaacggggctgggacaatgtcttgaaagaaccattggacataaatttgatttccgaagaaacattaacaacgatgtgggatacgattacgaaaaacaagccaaaactatacccatacatggacaagaaggcagaattgttaggctcgccaaaactgaccttgtttgatgtcaacgctcctttgccgacaagcgaaacgtctaataacgatattccgtatgaagaagcttgtgagctgatcatcaaacattttaaccgcttcagcccgaaaatggctgaatttgctgaaatggcgcttagcaacggttgggtcgaagctgaaaaccgcgcaggaaaacgcccaggcggcttttgtacaacttttccactccgtcaagaatcgcggatttttatgacctatgacggctcaatggacaatgtggcaacgctcgctcacgaactgggtcatgcgtaccatagctggtgcttaaaagacatgccagtttcgtcgcaaaaacagtatccaatgagcatcgccgaaaccgcctctacatttgccgaaatgattgtcgctgatgcacttttgtctgaggcagagagcccagagttaaaacgatatctgctgggaaaacaaactttctcgttcattagcctttttcatgaatatccattcccgttttctgtttgaaacgcgtttttatgaagaacggaaacaggggattgttccgactgaacgtttaaaccaattgatggtttgaaggcccaaaaagaagccntatggcccttnaagtggaagccttccacccttatttttgggcctcaaaattggcattttcacaaaacgaaacaaccattttataatttcccttatacatttgggg

SEQ ID NO: 4777 - DNA, 504 bp, Bacillus clausii
cttcgttaaaattgttgcctttaattaagcaaatgaatgaagggatttcattctctggaaactcccttggcagtaaagcatctttttcgacagcggcagcgtttaatccccatgttaagcatcttgataaagcggtgcgacgtttagaaaagaaaatcgaagctggtgctgattattttctgacgcagccaattttcgatgaacaacaatttgaacaattgtataacgcaacaaagcatttgcctgtgccgattttcgttggcattatgccgctaacaagcagccgaaacgcggagtttcttcataatgaagtgccaggaatgacattgagcgacgagacaagagcacggatggcggcatgtggaaacgacaaagaaaaagccgagcaagaaggtttgcaaatcgcgatggagctagccgacgcagctaggacctattttaacggcttgtatttagtaacaccgtttttgcgttatgaattaactgcagcgcttgccacccatt

SEQ ID NO: 4778 - DNA, 921 bp, Bacillus clausii
aggctgccaatgagtatttaaatcaaactgcacctcatattgtatcggaaatttatggaaaatatttacaggtaggggcagacattatttccactaataacgttcggcttcaaacgagcatcgttcttgctgattacggccttgcccatttagcctatgaccttagcaaggaagccgctcgattagcccgaatggaagctgatcgcgcatcaaaaccaggaaaaccccgtttcgttgctggagcgatgggcccgacgacaaagtcattgtctgtaactggggggacgacattccaagaactaatcgaagcgtacgaagaacaagcccgtgctttaattgacggaggctgtgacgttttgttgttggaaacgagccaagatatgcgcaatgttaaagccgcgtatctagggataagcgaggcattcagacgtactgaacgaacattgccgctaatggtatcgggaacgattgaaccgatgggcacgacattagctggacagacggtggaggccttctatttgtcgcttgaacatatgaagccagcagttgttggcttaaattgcgcgactgggccggagttcatgcgcgaccatattcgctccctcgcagaacttgctgaaacgaatgtgagctgttacccaaatgcagggttgcccgatgaagatggtgtgtaccacgagacgccagattcgcttgttaaaaaacttgaaggatttgctgccaaaggttggctaaatgtagttggcggctgctgcggcacgacgcctgcccacattaaaaaaatggttgaagtgatcaagaagtacccgccccgcaaggcgaaaatacgtcaaacccacgctgtatcagggattgaaccgctgttgtatgacgactcgatgcgcccgcttttcgttggagaacgtacaaatgtgattggct

SEQ ID NO: 4779 - DNA, 732 bp, Bacillus clausii
ccaatacgtatgcagcaaatgccgtcaaacttaaaaagtatggattggacgaaagtgtcgcagacatcaataacgccgccgtcagcattgctaaaaaagcgattggcaacgacgaacagcttgcgttagttggcacaatcggcgggattcgcgggttcctccatgaagagacggaaaacaaggcgattacagctgctttacttgaacaaataactgctctcttagaagcaggcgttgacgggttattgtttgaaacattttatgattttgaagaggcaaaagaagcagtagcgctggcaaggcgtcttacagacaaagcaattattatgaacgtgtcgatgggcgatatcggcgtcttaaatggcggtattcccctcggtgaagcgctcgagcgactccatcaattaggagcagacgttttaggaatcaattgccgtatgggcccttatcatatgctccgctctttggaacagcttgaattatcgtcagctttcccacttgcttgctatccgaatgccagtttgccaggttaccgagacggacgctttgtttatgcttccaataccgattacttttatgaaatgacaggggcgtttattgaacaaggcgtccatttgattggcggctgctgtggcactacgcctggacatattgccgcgatcgcttaagccgtcgaaacgaacacgccgaaaacacgctcgctcattgtcagacggccaagccaacttcagg

SEQ ID NO: 4780 - DNA, 456 bp, Bacillus clausii
atgacacaaaaaacagtacgcttattaatgccccaatggcaaggaggaaacaaccctaactactcttttggagccgaactgcttgcttggcttgctccgaacaatgatcaacctcttattcatgtgcccgttcaagcttatgatggtactccccttgagaacgagaacgggatgaatggtagaacgcagttgcttgcacagttagaagctgctcagcatatcattcatgctcataaaccggatcgcattgtcatgtttggcggcgactgcttagtcgagcaggccccatttgcctatttaaacgaacgatacggcggggaattaggtttaatttggattgatgctcatagtgatttagttagatatgtcgggtatgataatgcccattctttacctctcgggaatcttctgggagaaggggatgaggagttcgcaaaacatgtgaaaatcccttta

SEQ ID NO: 4781 - DNA, 399 bp, Bacillus clausii
aagaacaaaccccgttatttacgggtttaaccgaatatgccaaaaaagagccaatcccttttcatataccaggccataaacgaggagcaggcatggacgcagattttcgcaattttatgggcgaagaagcgctgtccattgacttgattaacattgcacctctcgatgacttacatcatcctcatggaatcatcgaccagtctcagcaattggcagcgaaagcatttggagctgattatacatttttctctgtacaaggcacaagcggggccatcatgactatgatcatgagcgtatgcgggcctggcgataaaattattgtccctcgcaacgttcataaatccgttatgtcagcaattattttttgtggggcattgcctgtgtttatccatccagaaa

SEQ ID NO: 4782 - DNA, 525 bp, Bacillus clausii
tggatacggccatccaaaaacatgagccaatcgttgtaaccgcatggaatccacattggaagtttgctgcctatgacttaaaatacttggatgatccagaaggttcattcggcggtacagaagagattcatacgattgcacgccaaggtttggaaagcgagaagcctgaaggctatcaagtcgttgataatttcttctggagcgaggatgacatgaacgaagtcatgctggctgtgcatgaaggcgctgatccagcggatgctgctcaagagtgggttgataacaaccaagaaaaagtcgatgaatggattgacggcgttgagacagtcgatggagaatcattctcccttgtactcgtaaactgggattcagaagtagcttcttccaatgtgcttgcccttgcccttgagcaagttggctatgatgtcgaactgagtgtcgttgaaaacgggccaatgtggaaatcccttgaatctggcgaccaaaatgcaagtgttgctgcatggttgcccattacacaccggc

SEQ ID NO: 4783 - DNA, 504 bp, Bacillus clausii; identical to SEQ ID NO: 4777

SEQ ID NO: 4784 - DNA, 525 bp, Bacillus clausii
atgaatgaagggatttcattctctggaaactcccttggcagtaaagcatctttttcgacagcggcagcgtttaatccccatgttaagcatcttgataaagcggtgcgacgtttagaaaagaaaatcgaagctggtgctgattattttctgacgcagccaattttcgatgaacaacaatttgaacaattgtataacgcaacaaagcatttgcctgtgccgattttcgttggcattatgccgctaacaagcagccgaaacgcggagtttcttcataatgaagtgccaggaatgacattgagcgacgagacaagagcacggatggcggcatgtggaaacgacaaagaaaaagccgagcaagaaggtttgcaaatcgcgatggagctagccgacgcagctaggacctattttaacggcttgtatttagtaacaccgtttttgcgttatgaattaactgcagcgcttgccacccattgccgagcgatagcgaatccgacaaaccacacgatggaaggcgagcgaatatga

SEQ ID NO: 4785 - DNA, 363 bp, Bacillus clausii
  misc_feature (1)...(363): n = A,T,C or G
ttgaagatatcggggctggaacaaaagtgcttgcagttaagggcgcaacttcaggccaaaacttgctagaacaagcgcctgatgccgaagtgattgagctcgaaaattaccaagaggcattcttggctcttcagtccggtcaaggagatgcgctaactacggataactccattctttatggtatggctgaggaaaatagcgattatgaagtcgttggcggtacatttaccgacgagccatatgggattgctgtccgcaaaggcgacaacnaatttacggaaaaaatcaatgaaattcttgcagacttaaaagcttctggccggtatgatgaaatttatgaaaaatggatcggcgagtctccag

SEQ ID NO: 4786 - DNA, 1335 bp, Bacillus clausii
ccaagaacaaaccccgttatttacgggtttaaccgaatatgccaaaaaagagccaatcccttttcatataccaggccataaacgaggagcaggcatggacgcagattttcgcaattttatgggcgaagaagcgctgtccattgacttgattaacattgcacctctcgatgacttacatcatcctcatggaatcatcgaccagtctcagcaattggcagcgaaagcatttggagctgattatacatttttctctgtacaaggcacaagcggggccatcatgactatgatcatgagcgtatgcgggcctggcgataaaattattgtccctcgcaacgttcataaatccgttatgtcagcaattattttttgtggggcattgcctgtgtttatccatccagaactcgactttgaacatgggattgctcacggagtggcgacggagtctgttgccaaagcaatacgcgctcatcctgacgcaaaagccgtccttgtgatcaaccctacttactacgggtttacttgcgatttaaaggcgattgtggaattagcccatcaagcaggcattcctgtacttgttgatgaagcacatggcgtacacatccattttaatgatcgtctgccgctaagcgcaatgcaagcaggagcagatatggcagcgacgagcgtgcataaattaggaggctcgcttacacaaagctccatattaaatgttcgtgccgggcttgtatccgttgaacatacaacggccgttatgagcatgttgacaaccacttcgacatcttatttactccttgcctccctggatgtggcgagaaaacatttggctactaaaggagcccaactcctcgatgagacaatcgaattgtcgatttggatgcgccatgcaattaatgaaattgacggcctctactgccttggcagcgaaaaactctgtgggtctgccgtattttcccatgatcccacgaagctgttaatctctttaaaaggcttaaacatttctggttttgccgcagaagtttggctacgggaccattacaatattgaagttgaactttccgacttgtacaatattctttgcatcattaccattggcgatacagaagaaaagcttgctttgttgcttagagcgttaacgcaactggcgctggaattttcttcaacggctaatcgttgtgcatctttacctgtccatgtcgccaatattccaacgctcgctctttcgccccgtgaagctttttatgcgcaaacagaaacagtgccattcgatgaatcattgggccggattattgccgagtttattatggtctatcctccaggcatccctattcttatccc

SEQ ID NO: 4787 - DNA, 318 bp, Bacillus clausii
  misc_feature (1)...(318): n = A,T,C or G
ttcaggcaatcccaaccggccagatggaggcggcgcgctcctcaggtttaacttatacacaagcattgcgattcgtcattttgccgcaagcgatcaaaacngtcattcccccacttgggaaccaaacattgaacttggtgaaaaactcctcgattcttgcagtagtgggaggggctgacttaatgtaccaaggcgatatcatnaacagcatgacgtttagtccgtatgccgtatatggcattgttgcgttattttatttacttttaacgattccgcttagctggggaatcggctattatgagaaacgccttgctaaag

SEQ ID NO: 4788 - DNA, 445 bp, Bacillus clausii
  misc_feature (1)...(445): n = A,T,C or G
atggactttctatcggcatatacgccatccaacctcctttatttatgggaaggatttcaagttacattatttttggcattaatcgccatcatttgcagttatgtagtcggcattgtactcggcattcttcgctatgcaaagattccggttttttcgcgagtattaggcgcggccattgatattatccgctgtttgcctttgctgttgattttattntttacccattttgntttgcttccggaactagggtttcaagtaagcccgtttgtagcagctattgtcgctttgaccgtgtntgaaggtgcgatgatttctgaaattatccgcagtggtttaaattcgattcctaaagggcaaattgaggccgcgcgttcatctggcttgacgtacacacagacgttgcgggcgattttgattcctcaggcagcacgaaaaatgatgcccc

SEQ ID NO: 4789 - DNA, 492 bp, Bacillus clausii
atggggcaattagagctaggcgtattatatggagatggaatcggctatgaaatcgtaagcgcttccgtgaaaattgcaagcgctgccgccgcgaaatcaggtttggctattggctggcatgtgttgccaatggggctggacgcaatcaaacagacaggtttaagcatgccagaggagacgatacgagcactcgacaaactcgatgggtggctgatgggcccccatgattcacagtcgtatccaaaacagctacaaaacgtacgcaatccaagcggtgaattgcggcaccgtttcgatttgtatgccaacattaggccagctaagtcagagccatatataaaaggagtggtggaacgcgcagatttggtcatatacagagaaaatacagaagggttttatgttgaccgcaatatgtataaaggaatcggcgaatggatggtaacagcagacattgctgtaacagcccggtgtgtttacgcgcaaagcgattga

SEQ ID NO: 4790 - DNA, 722 bp, Bacillus clausii
  misc_feature (1)...(722): n = A,T,C or G
agacgacggtgaaaaaagtgcgcctcgctatttacaaagcactgcggatgatgggcttcacgattgaagcttctcaccatgaagtggcagtcggtcagcatgaaattaattttaaatattcggatgcattagggtctgccgatgcaccaactacgtataaatgggttgtaaaaacaattgcgaaacaatttggcctccacgctacattcatgccaaaaccacttggcggagcacacggaaacggcatgcacgtccatatgtcgttgttcgatatcgaatagcaagaaaaccgtttctacaatgaagacgatcaaaatgcgctttcctagacggcctatcactttttcgccgggcttgcttgactacgtcaaagactttgtgggcaataacaaatccaccttttaactcatacaaacgccttgttccaggctacgaagcaccatgttacattgcttggtctgcttccaaccgttcggcgcttgtccgcatcccggctacgangggccctggcactcgtgtggaaatccgttgtccagatccgtcccgcaaacccttatcttgcttttgcggttatcgcctctgctggattggacggcgttgagaacgaaatcgaatgcccancgtctgtnnatgcngatattttcagcatgtcttccgccggaaattaacggancgggcgattggagaacttacctacaagccttgaagatgccantaatcgt

SEQ ID NO: 4791 - DNA, 229 bp, Bacillus clausii
gtggaagtgtaccgccatatccatgaactcataggttcaacacccatgcttgaactgacggcctttccgctcccgcgccgtgtgcgtttatttgcgaaattggagtatacaaaccctggaggaagcattaaagaccgtttaggcgtcaaactcctcaaggaagcaatcgccaccgggaaaattacaccgaaggggacattaattgagccaacggctggaaatacagggg

SEQ ID NO: 4792 - DNA, 564 bp, Bacillus clausii
  misc_feature (1)...(564): n = A,T,C or G
ggatgaagggggcaatcgcaaaaagcnaaaancgtttagtaaccaangaagcttgatgatgcttattgtcccgcagccagtttcagcaataaagcggaatccactcacttattatgagacgcttggaccagaaatggtttcaccagcttgacggaaaaattgatgtttttgtggcaggcgctggaacaggggggacgttttcaggaacagccgcttatttaaaagaagtgattccaggcattcgaactgttgtggtagaaccagagggttcgattttaaatggcggggagccagggccgcaccggactgaggggattgggatggaattcatcccagactttgtagacacgtctttatttgaagccatttatacgatttcagacaaccaagcgtttaagcggacacgcgaacttgctgaacatcaaggtgtgcttgtcggcagttcttcaggtgctgctcttgaagctgccttgcgagaggctgaaatggccgacgaaggtgcccacatcgtcactgtctttcctgacggggcggaacggtatttgagcaaaggcatttatgagg

SEQ ID NO: 4793 - DNA, 240 bp, Bacillus clausii
atggtggcattggaatggatgctgaaacaggcgcagtcacgccaccgatccatccagccagcacatttaaacaaaaaggaattggcaactttcaatatgagtatgggcgaacgggcaacccgacgcgccatgcgcttgagttctttgcttgctgatatagaaagcgggacccatgggtttgcctttgcttcaggattggctgcgatcacccccagtgatgaagcttttttcatcaggtga

SEQ ID NO: 4794 - DNA, 749 bp, Bacillus clausii
ggctatttacaaagattttgcaaagggaagggattgaagccacttttgtcgatacggaggatcaaacggccgtcgcaagggcaaaaacaagcaaaacgaaagcgatttttattgaaacgccaacaaatccattgctgaaagtaacggatatacggaaactggccagctatgctcaagcagaagaattgcttcttattgttgataatacgtttgccactccttattggcaaaatcctcttgtattaggagcggatatcgtcgtccacagcgctacgaaatatttaggcggccatagtgacgttgttgcaggagcggtagttgttaaagacgaaaaactagctgaaacgctcgcttttattcaaaatgcgacaggcgctgttcttggcccaactgacagttggctattgatgcggggcatcaaaacgctcggtgtaagaatggaagaaatcgaaacgaatgcccgtatgctcgtgaaatttctgcttggccatccttatgtcagccggatttactatccaggtttagttgaacatcctggccatgcgacgcatgctttgcaagcgagagggtttggcggcattctttcctttgaggctgcgagtgaagaaattgctgacaatgtgttaaacaaaacgatctattttactttagcagagagtctcggagcggtcgaaagcctgatttcattgccagctaaaatgacccatgcttcaatcccagaagacaggcggcgtgcccttggcattacg

SEQ ID NO: 4795 - DNA, 557 bp, Bacillus clausii
  misc_feature (1)...(557): n = A,T,C or G
aacatgaaggaaaaatttcaggtattttaaaagaaaaatttacatcactaggcttagacgtagtcgaggatgatgcaaaagaaagaacaggccatggggcagggaatttaatttgtacgttgcctgaaacaagcagcggatttgatccactttatttcattgcccatatggatacagttggcccaggaaaaggggttcaaccaattgtagaaaatggctatattcaaacggacgggacaaccattttaggagcagacgataaagcgggaattgcagcaatgttagaagcaactcgtgtcctgcaagcatctaaaaaaccacatggccaaattcagtttgtcattactgtaggcgaagaggctggcttagttggtgcgaaagcgttggccaaagatgcgatttctgcttcttatggctatgctcttgatagcgacggagaagtagggggcatgattacgtcagcgccttcgcaagcaaaaatctttgcaaaagtatatggcaaaacggctcatgntggcgttgaacctgaaaaaggaatatcagctattgcagtcgct

SEQ ID NO: 4796 - DNA, 993 bp, Bacillus clausii
  misc_feature (1)...(993): n = A,T,C or G
agtacagggttgaacgagacttactaggagaaaaacaagtaccgaaacatgcttattatggcatccaatcgctgcgggcaaaggataattttccgattaccggctatccgccccaccctgaacttattcgcgctttcggctatgtgaaaaaagcggctgcccttgcaaaccgcgatgtcggcgtactgcgcccccacattgctgaagcgattatcaaggcaagcgatgaagtgattgaagggcgtttgaatgatcattttattgtcgattcaatccaaggaggcgccggcacgtcgtttaatatgaacgcaaacgaagtcattgctaacagggcgattgaaattcttggtggcgaaaaaggcgattatttaaaagtcagtccaaacacacacgtcnacatggcccagtctaccaatgattcatttcccgacggcgattcatattgnccgcnttnaatatgacaaagggcttgatggaagaattgcancnnttgatcaacgaaatggaagcgaaagccgaagaatttgacagtgtcttaaaaaatgggtcggacccacttgcaagatgcagtccctattcgactagggcaggaatttggctcgtaccgcagagtgctagcccgtgatctaaaacgggtaagccgttcggcagaccacctccacgacatcaatatgggtgcaaccgctgtaggaactggtttgaacgccaaaccggaatacattgagaaagtcgcaaaacatttggctgacttgactgatttaccgttgaaaacggcggaggaccttgttgatgccacacaaaatacagatgcctatacggagctttctagttcgttgaaaattttagccattaatttatcaaaaatcgcaaatgacttacgtttaatgagttcgggcccgcggacgggattgaatgaaatcaatttgccaccgcgacagccaggttcatcgatcatgcctggaaaagtaaatccggtcatgtgtgaagtcatta

SEQ ID NO: 4797 - DNA, 723 bp, Bacillus clausii
aaatgtgattggcttcacggaaaatttaaacgccttgattgaagaaggggaatatgaacaagcttcggaaatcgcaagggcccaggtcaagcgtggagcacacgtcatagatatttgcttagcagatccagatcgaaacgaacaagaggacatggctgcttttctgaactatgtagtcaacaaagttaaagtgccgctaatgattgattctactgatgaagctgtcatagaacgagcgcttacctattcccaaggaaaggggattattaactccattaacttagaagatggcgaagagcggtttgccgcagtgctgccacttgtgagaaaatatggcgccgccattgtagtaggaacaattgatgaaacaggtatggctgtcacagccgaaagaaaattggccgtggcaaagcgatcgtataagctgctaaccgaaaagtacaacattccgcctcatgacatcatttttgacccgcttgtatttcctgtaggaacaggagacgaacaatacatcggttcggcagcagcaacagtcgaagggattgcccttataaaaaaagagctgccccaatgcttaacgattttaggagtctcgaatgtctcttttgggcttcctccagttggccgtgaagtattaaacgcagtctttttgtatcattgcacacaagcaggccttgattatgcgattgtcaataccgaaaagctggaacgttatgcgagcat

SEQ ID NO: 4798 - DNA, 576 bp, Bacillus clausii
  misc_feature (1)...(576): n = A,T,C or G
ggcggcagcagacatgattattaaagtcaaagagccgctntntgaagagtatcggtatttccgcaaagggctaattttgtttacgtacttgcatttggcggcagagcctgagttgacaaaggcgttagtcgattcaggcgtgacggcgattgcttatgagacggtagagataaaccgggcattgccattgttaacgccgatgagtgaagtggctggaaggatggcaacacaagtgggcgcccagtttttggagaagacacgaggagggaagggaattctcctctccggcgtacctggcgttaaacgggccaaagtaacgatcatcggcggcggcgttgttggcacaaacgcggcaaaaatggctgttggccttggcgctgatgtcactctgctcgatgttagtgcagaaaggctgcgccaacttgacgatcaatttggaaatgacattcagacgatcatgtctaaccctttgaatattgctagcgctgtggccgaggccgatcttgttattggcgctgtgctaattcctggagcaagagcgcctaaactcgtaacagcagaaatgatacaaaaaat

SEQ ID NO: 4799 - DNA, 372 bp, Bacillus clausii
agacgacggtgaaaaaagtgcgcctcgctatttacaaagcactgcggatgatgggcttcacgattgaagcttctcaccatgaagtggcagtcggtcagcatgaaattaattttaaatattcggatgcattagggtctgccgatgcaccaactacgtataaatgggttgtaaaaacaattgcgaaacaatttggcctccacgctacattcatgccaaaaccacttggcggagcacacggaaacggcatgcacgtccatatgtcgttgttcgatatcgaatagcaagaaaaccgtttctacaatgaagacgatcaaaatgcgctttcctagacggcctatcactttttcgcgggcttgcttgactcgtcaaaga

SEQ ID NO: 4800 - DNA, 330 bp, Bacillus clausii
  misc_feature (1)...(330): n = A,T,C or G
ttgtggcaataacaaatccacttgttaactcatacaaacgccttgttccaggctacgaagcaccatgttacattgcttggtctgcttccaaccgttcggcgcttgtccgcatcccggctacgangggccctggcactcgtgtggaaatccgttgtccagatccgtccgcaaacccttatcttgcttttgcggttatcgcctctgctggattggacggcgttgagaacgaaatcgaatgcccancgtctgtagatgcngatattttcagcatgtcttccgccggaaattaacggagcgggcgattgagaacttacctacaagccttgaaga

SEQ ID NO: 4801 - DNA, 294 bp, Bacillus clausii
atacaaactagctactaaacaaatgactggcggcggtggcatgatttgttttgaacttaaagatggtatggatggcgggcttggcttgatttcaaacgtgaaactaaacaagatggctgtcagtttaggcgggtatgcgagcaccattacccatccagcgtcgatgacgcataatttattgccgagagaagaacgtgaaaaaggcggcattacagatggcatgataaggttttctgtcggaattgaagaatatgaagatataagagacgacttatcccaagcgcttgataaaat

SEQ ID NO: 4802 - DNA, 510 bp, Bacillus clausii
aagaaaacggtggcgtccttgattcacttggtgttgtagaatatgtaaacggtttagcacctggggtgtttgtcattgtcaaaagtgaattggaacctgtagatgaggaactgcgctacttgttaaaagtcaacgctaaccatggcccgcattacacgttataccgtccgtaccatctggcaagcctagaaacaccaattacgattgctaaggcagtgcttcatcatgatacgtcgattcatccccttggcgcaccggtttctgaaaccgtagcagttgccaaacgtgcgattcagccaggtgagagactggatggaattggcggttatagtgtaagaggcatgttggaaacacatcaggatatgaagcggaatggccatattccgattggcctgatcagtggcaatgtcgtcgccaaacgagccattgaagaaggacagtttttaacgatggatgatgtcgaactcgacacaatgactactgtttggaagctgcgtgcattgcaagacc

SEQ ID NO: 4803 - DNA, 480 bp, Bacillus clausii
  misc_feature (1)...(480): n = A,T,C or G
ttggcaaaaacaaaggcaaagcatgactgnaaaaaggcattgacgtgcttttgctcactgacccagccaatatgaattatttatccggttataatggctggtgcttttatgtncatcaaatgctagtcgtcctcatcgatgaggaccagccgatttggattgggcggggcatggacgcgaacgttgccaancagacaacttggttaatgcatnaacggattatncngtaccctgaccattatgtccaatcggatgaccgccacccgatggactttatcgccaaagttctggcagatattggccaaggcaaccgccgcattggcgtcgaattagatacgtattactacacggcaaaagcacatgaacgccttaagcaacgcttggctgacgcccggtttgtcaacacgactaacctngtcaactatgtntgtatcancatgtcacacatggaaatccactntatgaaatgcgctgcaaaat

SEQ ID NO: 4804 - DNA, 498 bp, Bacillus clausii
  misc_feature (1)...(498): n = A,T,C or G
cccggttatttccngagtgtggcttttggcttatgacgatatggacggaatggtatgaagtggcttgttggcangaaaaaaaagggcccttattttnttgnccggtaataccaaaacccggactgtgcaagcgtttgaagataaagtgaaagtgctggaaaaagcgaatgcagcaactagtttttcaaccggtatggcggctatttccaacacgctttatacgtttttaaggccaggagaccgcgtagtgacaattaaagatacgtatggcggcaccaataaaatttttactgaatttctgccaaagttaaatatcgaggttgttttttgtgaaacaggggatgtcgagcaaattaaaaaagaaacggctaaaggctgcacgatcgtttatttagagacgccaaccaatccgaccgtaaaaattgactgacatccgcgcttgcgcagaagctggaaaacaagctaggcgcacttgttgtcgtagaccaatacgtttgc

SEQ ID NO: 4805 - DNA, 477 bp, Bacillus clausii
  misc_feature (1)...(477): n = A,T,C or G
gtattatccccagcnttttagcgccgcacatttgtactggttgggctccagtnacattcgggaataaatgtacacaggaagaccaggcaaatttattgcgttttgtattcgctgtttcagaacctttgcaaattgaagaggagattacacgtgttgcgtccgacattgtcagttgcgggcctgcgttcttttccttccttgcgcaacgatttatcgatggcgcggtaagcgaaacatcaatctcgcaagaagaggcgaccgagttgacgacttcaatgatcattggcttaggaaaattattggagagtggccattacacgcttcccgcattgcaaaaacgggtttgcgtccctggcggaatcactggagaaggccttgctgttttagatgatgaattaggggatggtttttgttctcttttcaaacgtacacacgaaaaatacgcaactgaaaaagaaaagttattagcggaagttt

SEQ ID NO: 4806 - DNA, 594 bp, Bacillus clausii
gaaaaaatctaactttaatcgaaaaaatgccagactctgaaggacttagcaatgaaaataattatcaaaaaggccagcagattccttttggtgcaagcattgcccaaatggttcgaatcggccgccggaaacctgtcgaggtcggcaatgccaataaagtagaagcagatcatatccaacaggcaatcacagagaaaacagccgcacctctctacataaaatcccatcatgctgttcaaaaaggcatgcagtcgcttgaaacaatgatgaaaattgcgaaggaacaccagttaccattcattgttgatgctgcggcagaagaagattttcaagcatatatccgaatgggcgcagatatcgttatttacagcgggggaaaagcattggaaggtcccacttctggtttgatttgcgggaaaaagaaatggatggaagcgtgccgcatgcaatataaaggagttggccggccaatgaaagtagggaaagaaggagttgccggacttatcgctgctttaaaacaatatccgcttaaggaagacaatggcgatgaacaaattgaacgtatgacaaagctggccgatgctttggccggat

SEQ ID NO: 4807 - DNA, 867 bp, Bacillus clausii
  misc_feature (1)...(867): n = A,T,C or G
ggcgtgatgagggcaaagcgtttgccgatgacgaaganttcgcgacaaatgcagcaaggttaaaanaagggaatgtgtttgttcagttttttgcgatttgggtgccatcaactgttccgcaagaatcaaaatttcaagtggtgcaaaagcaaatcaatgcattctatgagcgtgtccttgctgtgcctaacatgaaggcgattcgctcattggatgaagttgcttccttaaaagagggggaaattggcgctgtccttgctttagaggggatggatgccttaggaacagatatgggcaaattggaatggttgtatgagaaaggggtttcctccattggcttaacatggaatgaccccaatttatgcgccgatggtattggtgaaatgcgaggcgccggactaaccgaatttggcaaaaaagtgatcgcattgaataacaaacaccatgtgctaaatgatgtgtcccatttgagtattgctgctttttgggatgtccttgaatgttcaaaaagaacgattgccagccattcaaatgcgtatgctgtttgccgtcatccccgcaatttgcacgatgaccaaatcgatgcactaattgcaagtgacagtttcattggcgtcgtgttctatcctacttttataaaaagcgagctgggcgcttctattcgcgatctcatttgtcatatcgaccacatagcaagccggggcggggtcgcccatatcggttttggttcagacttcgatggtatttctattcatgttgacaagttagagcacgctggcatgtatgaacatttagtgaatgaactattaaaacattataaggaagcggaagtcgaagggttttgcaacagaaatttcattgaaaaag

SEQ ID NO: 4808 - DNA, 693 bp, Bacillus clausii
tcaatcgcgaacggcttaaacaaacgctccaggcgttcgcagcattcggggcaacaggcaacaatggcgtgacacgccttgccttgtctgaagaagacaagcaagcacgggcttttttccgccagcaatgtgaagcgctcgggcttgtagtaacgacggacgatctcggaaacatgtacagtgtaattccaggaaaacagcgcaatgccccgcccgtctatcttggttcccatcttgataccgttaaaaaaggcgggcgtttcgatggtgtcctcggtgttgcaggcgccttagaagtgctacgcacagtagtcgaacataagcttgaattaaatgtgcccctcggactgatcaatttcaccaacgaggaaggcgcccgttttgagccttcgatgatggcatcagggattttggctggaaaatttaacaaagacgcaatgatgcaatcaacagaccaagatggcgtttcttttggagaggctctggcggcgagtggttttgctggctcggcccaccatcggctgacggacgcaagcgcttttttagaactgcatatcgaacaagggccggttttagaagcaaaaaagcaaaccattggcgccgttgaatgcgttgttggcatggtttgttacgaaatcgagatttgtggcaaatccaccacgccggaacaacgccacaacggatgcgtcttga

SEQ ID NO: 4809 - DNA, 926 bp, Bacillus clausii
  misc_feature (1)...(926): n = A,T,C or G
tacaggatattattcgagcaaatcaacaaattaaagatgtcgtgacgcatacacctttgcaaaaagatcaggttttgtctgaacgatatgattgcacagtttacttaaaacgggaagacttgcaagttgtcagatcttttaaaattcgcggcgcctattaccaaatttcttcgctatcaaaagaagaacttgccgctggcgttgtatgcgcaagcgctggaaaccatgcacaaggggttgcctattcatgccgcgctttaaaagtcaaaggtgttattttcatgccgactaccacgccaaagcaaaaagtcgcacaagtgaaattttttggcagggactatgtagacgtcaggttaattggcgatacgtttgatgattcttatgcggacgccattcaatattgcgaagaacaggaaatgacgttcatccatccatttaaccaagacaaagtgattgccgggcaaggaacagtcggacttgaaattatgaatgacatcgaggaaacgccagattttgtgttttcatcaatcggcggcggtgggcttattagtgggatggccacgtatataaaaagcgttagcccaactacgaaaatgattggttgtgaacctgctggtgctgcatccatgacggaatcaattaagcaaggcaacgttgttgagttagacgaaatcgacaaatttgtcgatggagcggctgtgaaaaaagtcggcgacaaaacactggaaatttgcaaagaactgctagatgacattattgttgtgccagaaggcaaaatttgcacgacgattttaaacctttacaatgagaatgcgctagttgccgaaccggcaggggctatgcctattgccgctctcgatttgtangctgaacnaattaagggaaaagtcgttgtttgnattgttagtggcggcaccaacgntatc

SEQ ID NO: 4810 - DNA, 594 bp, Bacillus clausii
gaaaaaatctaactttaatcgaaaaaatgccagactctgaaggacttagcaatgaaaataattatcaaaaaggccagcagattccttttggtgcaagcattgcccaaatggttcgaatcggcggcgggaaacctgtcgaggtcggcaatgccaataaagtagaagcagatcatatccaacaggcaatcacagagaaaacagccgcacctctctacataaaatcccatcatgctgttcaaaaaggcatgcagtcgcttgaaacaatgatgaaaattgcgaaggaacaccagttaccattcattgttgatgctgcggcagaagaagattttcaagcatatatccgaatgggcgcagatatcgttatttacagcgggggaaaagcattggaaggtcccacttctggtttgatttgcgggaaaaagaaatggatggaagcgtgccgcatgcaatataaaggagttggccggccaatgaaagtagggaaagaaggagttgccggacttatcgctgctttaaaacaatatccgcttaaggaagacaatggcgatgaacaaattgaacgtatgacaaagctggccgatgctttggccggat

SEQ ID NO: 4811 - DNA, 525 bp, Bacillus clausii
aattgtggcctccgaaagggacaggtgctgtgtatttgtcgaaacgtctccattggcggggtttttacgaacaagcccgtcatgaatcaggatttcgtccaggcacagtggacacgccagcagttgctgcctttgcctctgcagtcgaaacacgctctttcaattcggaaaacaagggatggctgagctagcggaactacggggatacaatcattcgccagctgactgcaacagggcattttcaattaatcggttctaaaaaagaacgcctgccttttcatattggcatgctcgtcaagggatggagcgggcagcaatttatgcttgaatgcgaccgggctgggtttgcgattgccactggttcagcttgccaagctggccaaaccagtccgcctctctcccttttggcgcttggtttgacaaacgaacaagctgaccgctatgttagggttacgttaggaaaaccaacgacggaagatgaagtcggtatgtttattgaacactgtaccaagattgtatgtaggt

SEQ ID NO: 4812 - DNA, 765 bp, Bacillus clausii
  misc_feature (1)...(765): n = A,T,C or G
aacgggaaactggcatgtgaagcgagccaaagcatgancaaacggccccattgctcccttggtagaancattacaggcattaggggcaggcattcagtatggcgaccgtaggggccattatcccctttccatctccggtgaagggttgaacgggggaaaagtgaacatgagcggccagctgtccagccaatttataagcggctgtttattggcggctccattggcgaaagaacctgtctcgatcactgttgaaggcggcattgtccaacaggcgtatgtgcgaatcacaatcgacttgatggcagcttttggggtcgaagtgaaagcagcgcctgatttaagcttgcttgaagtgaacccttctccttatgtcgcaaacgacatcgcgattgaagccgatgcctcaacggcttgttactttcttgcccttgccgccatcacagcagggaaaatccgtatacgccatttttcgacgaaaacaagccagccagatattctgtttgtctccatccttaaacgaatgggatgcaactttgaaatcggaccatcgtttgttgaagtagaagggccccctcgtttaaaaggcgggttttccgttaatatgaatgaattatccgatcaagccttaacgcttgccgcgatcgctccttttgctgacggtccaattgcccattggaaggagttggccaacattccgaacaccatgaaatgtgatcgcatttcgcgccaatttgtacaggagttaagccgcttaggtatccgtgt

SEQ ID NO: 4813 - DNA, 582 bp, Bacillus clausii
  misc_feature (1)...(582): n = A,T,C or G
aaaccaagagggataaattagatgttcttgcngcaactcaatccatcatacataaggcgcnaaaaaaactaggctatccagatgaaatgtatgaactactnaaagagccggtacggatgttgaccgtccgtattcctgtgagaatggatgagggatcaacgaaaatctttaccggctaccgtgcccaacataatgacgctgttggtccgacaaaaggaggcgtacggtttcatccagatgtctgtgaaaaagaagccaaggcgcngtcganttggatgagtttaaaagcaggcattgtcaacttgccatacggtggaggaaaaggaggcattgtttgcgacccaangcagatgtcgtttagagaagtggaacgtctaagccgtggctatgtccgcgcgattagccaaattgttggcccgacgaaagacattcctgcgccagatgtttttaccaactcgcaaattatggcgtggatgcttgangaatatagccggattcgcgaatttgactcccccaattttattacnggaaanccgcttgtgcncggaaggtcacacggtcgaaaagcagcgactggccaaa

SEQ ID NO: 4814 - DNA, 783 bp, Bacillus clausii
  misc_feature (1)...(783): n = A,T,C or G
aaaagtcggttttttaggcccgaaaggcacgtttacggaaatggcagcatacagcctgtttccgaaagaaganttagttccactgaaaaccatcccncaagtgctggatctcgcatttgcaaaagggattgactatgcagttgtgccaattgaaaatgcgattgaaggaactgtgaatattacgctcgattatttaatccaccataagcccatgccgatcgtagcaagcatatctctggaaatcgcgcaacatttgctgttttcgccaaacaaagactgggaaacgttcgttcctaagaaagtcgtttcccatccacaagcaattgcccagtgccatcaatttctgcaaaaaaactatcctgaaattgaaatcgagtatgccgattcaactggttcggctgccgcttggctcgctgaaaaccccgatgcagatgcttgtgtcattgccaacgcgcaagcggcttcgacttatggattagctgtagctcaaggagacatccatgatttcgaacataaccggacgcgctttatcgtgctaacggctaaaaaggaacaagctcctcacatagtaggcccagagcatacaggagacaaaacaacattgatggtaacgctgccgtctgattttgccggagccctccatcaagtgttgtccgcttttgcttggcgaaagttgaatttgtccaaaatcgaatcacgcccaacaaaaaccggcctcggaaattactttttcctgattgacatcgaccagttaatggatgacgtcctagtgccaggagcgat

SEQ ID NO: 4815 - DNA, 582 bp, Bacillus clausii
ggcttgatgttaagtgcgatccccccgccaatatatgggcttttcgcaacgggcgacaacctcttcctgctatttcgtttggctcccatatggatacggtgccaaacggcggcatgtatgatggcgcgctcggtgttctcattgccttagaagtaatggaacgactgaacgaagaaagaatcgaaacacgccatccattcgcactcgtttcctttacggcagaggagccgaacccgtttggcttatcgacatttggcagccgggcagtagcaggaaagttaacaaagcaagacttagagggtgtgacagatgacaatgggctgttgttgacggaagcgcttaggcaagcagggggagatcccgatcgctttgaggacacgcacgcgttagcgccgcctttatctgcttaccttgaagtccatattgaacaagggaaacgcttagtcacaagcagtattcctgttggtattgtttctggcattacgggcatttacagagagcgtgtaactgtaacaggtgatgccaatcatgcggggacgactgtcatggtcgaacgtaaggatgcactggcagctgcggcag

SEQ ID NO: 4816 - DNA, 312 bp, Bacillus clausii
atggttcagtttgattcacaagcacgtagcccttggacgcctttagcaggggtggagcgcctccgtttaacgccgagccaaaacataataaacgcttcgttagaagtgcctggaagcaagagtgcaacaaatcgcgcattgctgttggcaaccaggctgcgtcaggcactctctacattaaggaatgcgttaaaaagcgacgacacgtattggtgcatccatacgcttacaaaaacaggggtaaaaattgcggtagatggaagcgatatgactgtctatgggaaaggaggggtgtttcattctggctccctt

SEQ ID NO: 4817 - DNA, 927 bp, Bacillus clausii
ttgctaaacaaggcgctgcttattacccagacttgatcaagcagttggcagcacttggccaaaaacaaacaggctataagcaaacgggcgcattgtggctccatcaagattcgcacgaacttgcagcggcctatgagcgtgcccgccaaaaacaagcagctgccccggaaatgggtgaactaacggttctgtctccttccgaaacgcagaagctttttccgccactaagcaacgattttggtgccgttcatgtgagtggcgcagcgcgagtcgacggctctaacttaaataaggccctgcaacaagctgcccaaaatcttggcgctacccttattcctgcaaaagcaacgcttgttcgtgaatcgccgcgtaagctcagcgtttatgctgacggaaaacaagtacatggggatgaaatcgtcattgcttgcggtgcttgggcaaaagaattgctcgcccccgtcggcattgctgtggacgtgcgggaacaaaaagcacaaatcatccatttacatctcgaaacaaacacagatgaatggccagtagtcatgccacctggaaattcctatttgcttgcttttgagaacggccgtatcgttgcaggtacaacccatgaggattatccacgctttaatacagctgtcactgccgggggagtgcacacgatactggccaacgctcttagtgttgccccagggttacaaaaagcggaatggctagaaacgcgagtcggcttccgtcctgtcgtcccacatttccaaccggtcttcggcttgcttcctggtgtagaggacgtgtggtttgccaacggtctcggctcaagtggcttaacgactgggccttatatcggcatgcttcttgcacagcaaatgcttgggaataggctgccccttgatcccgaagactacaaagtcgctaccatccttc

SEQ ID NO: 4818 - DNA, 486 bp, Bacillus clausii
ccctagtggcgttggcggaggtcctggaggggttgctttcggcttgaagctcgttttcggcgacgcgatccgctgtttttttgcggagcctacccattcgccatgtatgttaattggtatgttaactggaaagcaccatcacgtctctgtccaagactttggaatcgacaaccaaacagcagccgacggtcttgcggtagggaggccgtctggctttgttggccgcatgatggctccattgcttgagggcatctatacaatcgccgactcgatgctctatacactcctcgccgatctcgctgatgcagaaggcctctatttggaaccatcagcagttgcgggattatacggccctgtacagcttgaaaagagagggttatataccggtgcagcgactcatcttgtctgggcgacaggaggaagcatggtgcctaaggaggtcatggaaaccgattaccaattaggtgttaatttacggagggagca

SEQ ID NO: 4819 - DNA, 295 bp, Bacillus clausii
ttgttggatcaacagggaatttagggttgagcattggcatcattagcgcaaagctaggttttcgcgtgacggtgcacatgtcagccgatgcaaagcaatggaaaaaggacatgttgcgagaaaaaggcgtacgtgtggtcgaacattccgccgattacagcaaggcagtcgaagaagggaggaaagaatcagacgccgatccgaacagctactttatcgatgacgaacattcaatcgatctatttgtagggtacgctgttgccgcattcccgcttaaaagaacaattgcaggaaa

SEQ ID NO: 4820 - DNA, 489 bp, Bacillus clausii
  misc_feature (1)...(489): n = A,T,C or G
caagtgcttgaacaaatgtttaatgggcgaatccttgtctgtccaagaggcggagcaagtgatggaacaaatcatgtcagggcgtgcgaccgccagccaagtggcgagcctcatcacgatgatgcgcgttcgtggcgagactgcggaggaaattctcggctttgccaaagggatgcgcgcttatgcgcgcagattcccttctgtcattgagggggcgattgatacgtgcggcacaggaggagatggactaggaacgtttaacatctcgactgcgtcagcgctcgttttggggtcgctcggtgtccctgtcgccaaacatggcaatcgctctgtctcttccaaaagcggcagtgctgatgtgttggaagagctcggcatcaacattcaagcttccgttgaagaagcttgccaaatgcttgaaacancaaacttgtgctttttatttgcgccgctgtaccaccagtcaatgcgccacgtcgctggcccacg

SEQ ID NO: 4821 - DNA, 1172 bp, Bacillus clausii
gtgaagatcattgagctaaaagaaggagaggcagtttccttaaagcgcagcggcctccatggaagcgaagccgaaatcgccactgtgaacacgatcattgacacggtaaaaaaggaaggcgatcaagcgttagtccattacacgcaacaatttgacggagtggaactaacagacttgtttgtcacaaaggcagaattggacaatgcttaccgccacattgatcaacctgttttggcagcgattcgccaagcaattgccaatgtccgtgcctttcacgaacaacaaaaagggaagtcgtggtttcaaacagcccctgatggcacgattttagggcagcgtgtcacaccccttgatgcagtaggcgtttatgtacctgaaggaaaagcggcttacccgtcttcgattattatgaatgtagtacctgctcaagtagcaggtgtaaaggaaatttcaatggtttccccagctggcaaaaacggttcccttccgccagctgttctcgcgacagcggttgaacttggcgtccatacgatttataagcttgggggagcgcaagcagtggctgctttggcgtatggcacggaaacggtgcgtccagttgataaaattacagggccaggcaacaaatatgtggcccttgccaaaagagcggtttttggcgatgtcgccattgacatgattgctgggccaagtgaaatttgcgtattagccgatgaaaaagcgaaccctgcctatgtagcagcagaccttctttcccaagcggagcacgatgaggatgcgtcagccgtgttagtcactccttctagggaactggccgaagcggtccaacaagaaacagcacggcaactggctactcttccgagaaaagagatagcagggcgagcattagaccagtttggcactttgtatgtgactgcctcgctggcacaagcaattgaagtcgtcaaccaattggcgcctgagcatttggaaattgccacggaagagccccttgcattgcttggtcgcgtcaaacatgcgggagcgatttttcttggttcgtacagtgccgaaccagtcggtgattattttgctggcccaaaccatgtactgccgacaaacggaacagcccgctttgccagcccgctatcagtagatgatttcgtcaaaaaatcaagcattatttcctacag

SEQ ID NO: 4822 - DNA, 618 bp, Bacillus clausii
actgacaatggcgatgccgaaggggcggatttttgaggaggctgttcagctgctccgttcggctggctatgacttgccaagttcctttgagcaatcgcgcaaactcattatcgatgtgccgaatgaatcgctccgttttatcttagcgaagccgatggatgttcctacttatgtggaacacggtgttgctgacgtcggtgttgccggcaaggatgtcatgttggaggaaaagcgtgacgtccatgaggtgctcgacttgaacattagcgcttgtcatttggcggtggcggcgctgccgacgtaccaacgaggcgaattaaatccaaaagtagcgtcaaaatacccgaacgtggcgtcgcagttttttaaagaacaaggggaacaagtcgaaattattaaattaaatggctcaatcgagttagcgccgatcatgggacttgccggcagaattgtcgacatcgtttcaacgggacaaacgctgaaagaaaatggcttagtcgaattggaacaaattagacaaatcacatcgcgctttattgtcaatcctgctagctaccggatgcgcgcaggtgaaattcatgatatggttgagcgtttggcggccgttatagaggggga

SEQ ID NO: 4823 - DNA, 703 bp, Bacillus clausii
gtgagctatttattcccaacctattctaaaaaaagcctctgtattaaggaaggacgaggggcatggctgcaaacagaagacggaaaagattatcttgattttatggccggcattgccgtttgcaatttggggcaccgccaccctaaagtcgtagcggcgctccatcagcaagtcgaccgcctttggcacgcatcgaacctctttcactatgatgtccaggaagaggcggcaaggcaattggtacaggcaagtgcatgtgattatgtgtttttcacgaacagcggcacagaagcgaatgaagcggcgattaagctagcccgcaaagcgactggaaaaaaccatattgtatcgatgaaacaatctttccatggccggacacttggaagcatggccgcaacagggcaagacgggattaaaagcggtttcgggccaatgctgcagtccttttcgtatgctcagtttaacgatatggcttccttgcatgaagcggtcaccgatgaaacagcagcgattatggtagaaatcgttcaaggcgagggaggcgtccatgtcatgacagcgtcttttgccgaagcgatggtggccctttgcaaggaacagaatttgctgctcattgtcgatgagattcaaacgggcatgggacgtaccggcaaactgtttgcctatgaacattacggccttgagccagatatcgtgactgttg

SEQ ID NO: 4824 - DNA, 504 bp, Bacillus clausii
cgttttgttggaatttaaaaatgtcacaaagcgttatggtgccggcaggccagctgtagacaatttaaatttaaaaataaataaaggcgaattcgtttgttttattggcccaagtggttgcgggaagacaacaacaatgaaaatggtgaatcgtctccacgaagcgacagaagggcaaattattgttaacggcaaagacatacggaaacaagatccagtcgaattgcgtcgatcaataggctatgtcatccagcaaatcgggttaatgccccatatgactgttaaagagaacattgttcttgttggaacgcttttaaagtggccgaaatcgaaaaaagacgagcgggcaaaagcactgattaaactagtcaatttgccagaggcatatttagacaaatacccacacgaactaagtggcgggcagcagcagcgcattggtgtgttgcgggcacttgcagctgatccaccactgattttaatggacgaaccttttggcgcactcga

SEQ ID NO: 4825 - DNA, 237 bp, Bacillus clausii
ctggctacgaatgccctaccgaccatcacatggtggcggtgattgaaaaactgctgggttcacgcaccgaagtggtcaactactgcaccgaagcgccgttcgtccaggaagtgtgcccaacgctggtgctcggccctggttcgatcaaccaggcacaccagccggacgaatatctggataccgcgtttattgagccaacgcgtaagctgctgggtcagttggtcgaccatttctgcc

SEQ ID NO: 4826 - DNA, 778 bp, Bacillus clausii
atgaaaacgatattgaattttgctgcgaaacgagttcgagatgcctggggattaggtactcgacctattaaaaatttggtctatttaatggaaactaagggttttgtactctcttctctaaaattagatcaaaaatcaattgatgcttttggaatgcagagtgaaattaacgggaaaattttttacaccattgtcttagggaatgacaaaaattctttttatagaaggcaatttagtcttgcacatgaattggctcacattattcttcacgatccttttttgaacttggaagacttaaataaagaagaatttaagcaactagagaatgaagcaaatgaatttgcagctgcatttttgctccctaaagaagaatttattagagatgtttccattcatccaactgatttagagtactataaagttctaaaaaagaaatggaatgtttcaattggaatgatggttatgagagcctataaactgggtattatctctcaggggagttatcaatacatgcagagaagtattagtaaatatgggtggagaaaacaagaaccttttgatacgattaaagaaatggctgagccagtctctatacgacaagctgtagaacttttgatcgagaatgattatgttactggagaagagctcatttccaaattatctactgagtatggtctaaccttatttagaacagatattgaggagctattagctgtagactccggttaccttaaatcaaaggtggaagctatacctaataatatagtaagtcttaaag

SEQ ID NO: 4827 - DNA, 714 bp, Bacillus clausii
ttatcatgaggcgaagggcgataagaagcgtacgaaagtggtcgttcctgattcgggcccatgggacgaacccagctcggccactgttgctggctttgaatcagtaacagtacgtacaaacgaagcagggcttgtcgatttagaccatttacgtgaagtggtcaacgaggaaacggctgcccttatgctgaccaatccgaatacgcttggcttatttgaagcagacatacaggaaatggctgatatcattcatcgtgcaggaggaaaactgtactatgatggagccaactccaatgcgatactggggatcgctagaccaggagatatgggttttgatgtagtccacttgaatttgcataagacatttacaggtccacatgggggcggtggtccaggctcaggaccagttggcgtcaaaaaagaactggttccctttttgcctaagccagtgttaatcaacgacggcggctttttccgttttgatgctgatcggccacaatcgattggccgtgtaaaaccgtattacgggaattatggcattaacttgcgcgcctacacgtatattcgcacaatgggcccagatggattgcgacaagtctctgaaaacgctgtgctaaatgccaattatatgatgcgccggctagagccctattatgatttgccgtatacgcaacattgtaaacatgaatttgtcctatctggcaaacgccagaa

SEQ ID NO: 4828 - DNA, 437 bp, Bacillus clausii
gtgattgcctttgagcaagtctctaaagtatatgccgacggcacaacagctgtaaacaagctctcctttaaagttgaaaaaggggaattctttgtgttaattggcccgagtggctgtgggaaaaccacaacccttaaaatgattaatcgtctaattgaaccttcttctggcgcgattttcattggcggccaacatactgctcatgcaaacattcatgaactgcgctggaacattggttatgttttacaacagatcgcgttatttccgaatatgtctgtggcagaaaacattgggattgtgccagaaatgaaacaatggaaaaagtcgacgattgaaaagcgcgtcgatgaattgcttgatttagttggacttgaacctaagatttaccgagagcgcatgccaagtgatttatccggcggtcaacaacaacgtgttgg

SEQ ID NO: 4829 - DNA, 439 bp, Bacillus clausii
gtgattgcctttgagcaagtctctaaagtatatgccgacggcacaacagctgtaaacaagctctcctttaaagttgaaaaaggggaattctttgtgttaattggcccgagtggctgtgggaaaaccacaacccttaaaatgattaatcgtctaattgaaccttcttctggcgcgattttcattggcggccaacatactgctcatgcaaacattcatgaactgcgctggaacattggttatgttttacaacagatcgcgttatttccgaatatgtctgtggcagaaaacattgggattgtgccagaaatgaaacaatggaaaaagtcgacgattgaaaagcgcgtcgatgaattgcttgatttagttggacttgaacctaagatttaccgagagcgcatgccaagtgatttatccggcggtcaacaacaacgtgttggcc

SEQ ID NO: 4830 - DNA, 368 bp, Bacillus clausii
  misc_feature (1)...(368): n = A,T,C or G
ggcggacattaattgatttagctactgaacatacggcaacattaatgactggttacacacatttacagccagnngaaccgattacgtttgcccattacctttccgcactgctgcacggattcgagcgggatttcacacgcctgtataactgttatgcccaaatcaacaaaagcccgcttggttcttgcgcccttgcctcaactacgttttcgattaaccgaaaattcacgatggatttattaggattcaccgatttgcttgaaaattcgcttgacggcatcgcctctcgagattatgcattagaagcactttcagcattaagcatatttagtaactcattaagccgcttcgcacaagacctttacact

SEQ ID NO: 4831 - DNA, 546 bp, Bacillus clausii
  misc_feature (1)...(546): n = A,T,C or G
aagaagccaaagaaattgaactcgtttacgttgtatgggattctgaaatcgnttcaaaccatgtagtgangattgctttggaacaagccggttatgatgtaacgttaacaagtgttgagcaaggaatcatgtggtcgtcagtggcagacggaagcgccgatgcccatgttgccggatggctgccagaagatatgaaagtccactatgaacagcataaagatgacattatcgatttaggagctaatttggaaggggcacaaactggcttagctgtcccaacgtatatggagattgacagcatcnaagaattgtcggctgacgtcgtcagtaccatcacaggcattgacgctggcgcaggcgtaatgatgacaacggaagaggcgcttcgtgaatatggaattgatgacgttacgttgtcagcaagttcagatgcgattatgacggcagagcttggcaaccgctatgcagcgcaagaaccaattgtcattaccgcttggcaacctcactggaagtttaattcgtatgatttaaaatttcttgaggaca

SEQ ID NO: 4832 - DNA, 564 bp, Bacillus clausii
  misc_feature (1)...(564): n = A,T,C or G
atgttngttttttcaaggatcggcgcaacttgtaacggctggtatgatggcaggcagcgcaagtgcaatcagcatactagctgcagtgttgctattaaatttacgcaatttgttatacggcgctgccttagccaacacggtatcattagcaggaaaatggcgctttgcccttgcttttggtgtgtcagacgaaccatttgtgcttgcaagcgccagggaacaaaaacatgggccggaccctttttattttgcgatcgtgtttgtttgcttttacttgtcttgggtatttgcttctttggctggcgcgcttctcggcgcccaagtcgatcccctcacttgggggctcgatttcgtttttcctgtaacgtttacagcattgcttgtcccttcgttaaagggccgtccagcgatggctacagcccttgcggcggttggcatttgcctgctgttccactattctggcttccgcgaagaactaattatgattgcggcgggcatgcttgctcccctcgcagggctaatggctggagggaggaacagcgatggacaataactggccgttaa

SEQ ID NO: 4833 - DNA, 627 bp, Bacillus clausii
gttgatgggtgcatccaccttaatagaggaagtgttggccgacgttgatttgttgattgtacgggagttaacaggcgggctttattttggcgagccacgtgaacggcgacaaatcaatggagaagacggagcagtggatacgctcctttatacaaggggtgaaatcgagcggattttgcaccaagcgtttcaatttgcaagaacgcgcaagaaacgtgtcgtctctgttgacaaggcgaatgtcttagagtcgagcaggttatggcgggaaattgctgatgaagtagcccgtgagtatccagacgtcacgctttcgcacatgcttgtcgataatgcggcgatgcagcttattcgcgatccaaggcagtttgacgtcattgtaacggaaaatttgtttggcgatattttgagtgatgaagcttcgatgattactggatccttgggcttattgccatcggcgagcatgaatacgtcaaaagtcggcttatttgaacctgttcacggttctgctcctgacatagcagggacgggggcggccaatccgctagcgacgattttgtcagcagcgatgatgctgcaatatagttttgggttagcggacgaggcaaaagcaatcgaagtcgcagt

SEQ ID NO: 4834 - DNA, 402 bp, Bacillus clausii
aggcgtttagcgacttcttaaaagaaacaaaccgtttgctcgaccattggcaggaaacagaagctgcttctgtggacatacaagagcttgttgcggcaattgaacacatttttcctcgtcttgcccatgcgagtgcctttgtttcttgtttgctagcacaaaatgtaaaggacgaaacggcacgtttgcgccaagagcaagtacaagagcttgaagtcaaatggcaaaaattaaacttgctccttgaagaaaaactgaaaccgattgacgatcaagcctttgcctctctccttgaagaagaagcaatgaaaccatcagcttttatgttggaaaaagcgagaaaacgggcagctgacaaaatgagcgcagacaaggaagaattggcggccaagttggctaaag

SEQ ID NO: 4835 - DNA, 984 bp, Bacillus clausii
ttttatcgaatgaagaccgttccgtgcgcaaacgtgcttatgaagcgtcgctacaagcatgggctcagcaagcgccattgtttacgcaaacattaaatcgccttgctgggttccgtttgaagctgtacgaagaacggggctgggacaatgtcttgaaagaaccattggacataaatttgatttccgaagaaacattaacaacgatgtgggatacgattacgaaaaacaagccaaaactatacccatacatggacaagaaggcagaattgttaggtttgccaaaactgaccttgtttgatgtcaacgctcctttgccgacaagcgaaacgtctaataacgatattccgtatgaagaagcttgtgagctgatcatcaaacattttaaccgcttcagcccgaaaatggctgaatttgctgaaatggcgcttagcaacggttgggtcgaagctgaaaaccgcgcaggaaaacgcccaggcggcttttgtacaacttttccactccgtcaagaatcgcggatttttatgacctatgacggctcaatggacaatgtggcaacgctcgctcacgaactgggtcatgcgtaccatagctggtgcttaaaagacatgccagtttcgtcgcaaaaacagtatccaatgagcatcgccgaaaccgcctctacatttgccgaaatgattgtcgctgatgcacttttgtctgaggcagagagcccagagttaaaacgatatctgctggaaaacaaactttctcgttcattagcctttttcatgaatatccattcccgttttctgtttgaaacgcgtttttatgaagaacggaaacaggggattgttccgactgaacgtttaaacgaattgatggttgaggcgcaaaaagaagcctatggccataaagtggaagcatacgacccttatttttgggcatcaaaattgcattttcacaaaacgaaacaaccattttataatttcccttatacatttgggg

SEQ ID NO: 4836 - DNA, 494 bp, Bacillus clausii
atggaaccgattcaagttcataaaggcaaagcagttgttttagaccgcgtcaatattgatacagaccaaattatcccgaaacaatttttaaagcgagtagagcgcacgggcttcggccaatatttgttttacgattggcgttttcaagcagatggtgcagataacccagcatttgagcttaatcagccagaagcaaaaggggcaagcattttaattaccggccataattttggctgcggctcttcccgggaacatgcaccgtgggctttgtatgattacggtttccgcgtcattatagcaccaagttttgccgatatcttctataataattgcgtaaaaaacggcttgttgccgatccgcctttcgcctgaagaaactgaattgtggatggaacgggcgaaagaaagccaacaagagattacggtcgatttaggtgaacagctcattaagcaaaatgggctagaaaccaagtttgaaatggactcgtattggaa

SEQ ID NO: 4837 - DNA, 615 bp, Bacillus clausii
tgtcgagaaatgggcccgattggcaaccgatccaggagcaacctatgatcgctcagtgacgattgatgcagcggaaattgaaccgatggtgacatggggaaccaatcctggccaaggggcagggatttcaaaagctgtaccacggcttgaggatgcgaaatcggaagtagaacggcgcgcaattagccaagcgcttgattacatggacatcaaaccaggcatgcctttgagcgagattgaaatccaacatgtgtttattgggtcatgtaccaattcgcgcttgagcgatttaagggcagcggcagccgttattaacgggcggaaagtagcgcctggagtccgtgcccttattgtccctggctcccagcgtgtcaaaaagcgtgctgaggaagaagggttggatcaagtctttaaagaagcgggatttgaatggcgtgattcaggttgtagcatgtgtttgagcatgaacccagacgttgttcctgaaggggaacgttgtgcctcgacttccaaccgaaactttgaaggcaggcaaggaaagggagcgcgcacccatttggttagcccggcaatggcagcagcagcagcgatcgctggtcggtttgtagacgtccg

SEQ ID NO: 4838 - DNA, 585 bp, Bacillus clausii
  misc_feature (1)...(585): n = A,T,C or G
tttcagcaaatggacgtgctgttcttgtagccggcagccataaggaaaacaatgattttacttttgcagttgatgtttggtttattgacttggatncgggagcaaaaacgcaaattacaaaggaaccaatggtcgtacaaagcggatctgtatcacccgatggttcttatgtcgctctcctaggccatgagagagaatacaaaaacgcgacattgacgaagctgtatgtttatgattgccaaaaacaagaaatccgtttgctttccggccaagtggatgcgtcaattggcgatgttgcaattggggattttttacagaatattggttcaaatgggttgaaatggggagaagatggtcagtccatttatgcgcttgtttcaaaagaaggcgatgtgaatgtttggtcgtttagcctcgatggcacagtcaatcaggtcacgcatgaaaaacgtcacataaatggattcgattttcaaaatggccaaggaattgtaacgataagcgacgttaaacagcttagcgaggcctaccgacttgaacttgccactgggacgcttcatgaacttacgtcattcaatgaccaac

SEQ ID NO: 4839 - DNA, 612 bp, Bacillus clausii
atgtattcatacgtcgcaattggagattcactagtcgtaggggttggctcaactaacggatttgttgtaccttatcggaacatggcgagccgccgactaggacagccgatccaaataacaaaactggctaggatcgggctgacctgtgaacaaatctcccggataacctttacgcattataaacaaatcgagcgtgccaatatcataacgattacagctggagggaataactttttagctgctttacagctaactagtagaacaggatccgttgatcatttgcctaaaatagcagctggcgtttacgcctgtttacatcaacttatccgtcagatcacttacgtaaagcataatcagcacaaaccttacatcgtccgtgtgtttaacctttataacccgctagcaaatatgccagttattcagcagcacctctttcgttttaatcagagcttatatacattggagcgctatccaaatgtacgcatcgtcgatattagctttctttcagatggagggtttcgatacctatcaagtgacggggtccacccaaataaccgaggctatgagaggatggctgaggctgtttatcagacggggttccagcctctgtag

SEQ ID NO: 4840 - DNA, 561 bp, Bacillus clausii
  misc_feature (1)...(561): n = A,T,C or G
atctagacggggcaaaagccaaaaggcctgtgaacgatgaagcgattttgacgatcgcccaaaaattagacgtccccgttcaagtggggggaggaattcgcaccgaacaagatattgaccactatataaacggaggcgtcgcccgtgtcgtccttggcagtgtggcggtttaccagcctgattttacgaaacaaatgcttgccaagtatggagaacaaattgcgatcgggattgatgctcgtgatggatatgtagctacagaaggatggcttgaaacgtcacacgtcaaagcggaagaccttgctgctgaaatggcccgctttggcgccaaaacgttcatttttaccgatattgcccgtgacggcatgcttactggaccgaatatcgaagcgtgcgttgctctttccaaggcagcgaatgccaatgtgattgcctctggaggggtaagcagcattgccgatttggcacaattgcgagctgcttcccttgctggggctattgtcggcaaagcgctgtacacgaagcggttcactttagaggaagcgttgcngaaggagagtt

SEQ ID NO: 4841 - DNA, 416 bp, Bacillus clausii
atgattaaagtaaatgatttgcataaatcgtttggagaacatgaagtgctaaaggggattacgacggacattcgcgaaaaggaagttgtttgcattattggcccgtctggctccgggaaaagtacgtttctccgctgtttaaaccggcttgaagacattacggctggggaagtcgtcattgatggcgtcaatattgccgatccgaaaacgaatattaatgctgtgcgccaggaggttggcatggtgtttcaacattttaatttgtttcctcacaagacggtattggaaaatatcacgcttgcgccattgaaagtgcggggcattgaaaaaggggaagcggttgcggcagccaagaagcttcttgagaaagtcggtttaggggataaagcagatgcttacccggccagcttgtcagg

SEQ ID NO: 4842 - DNA, 267 bp, Bacillus clausii
ttggcagatgcgttcatttgatctaaaccttgccattgaatcctttccgtttattttaaaaggcttgcaatatacgctttttgtggctgtaattagcatggccattgcactcgtgttcgggtttatactagcgcttggacgtatgtcaaaacaagcatatgttcgcataccgtgtatgctgtttatttctttcaaccgtggtgtgccgattttgctcttattgtttttactatatgccgctttgccggaatttgggtttcagctaag

SEQ ID NO: 4843 - DNA, 672 bp, Bacillus clausii
attcccgacgtcctaccatgatgacgataatgaactgacagggtttgaagtcgaacttgttaaaaaagtagctgatctcctcggtgtcgatgtgacatttgaagaaataggcgtcgaaacgatgacacaagcgctaaacagcggacgggtgcaccttgctgccaacagtttagccattaccgaggaacggcaaaagaactttgacttctcgttgccatataagttttcttacggaagtgcgattgtacgtgccgatgatttatctggcattgaaacattagaagacctagatggcaaaattgccctaggagcgccaacaacgacgtatatgcaaaaagcggaatcgtatggtgcagagcctttgttctttgacaatgtcaccaatgacgtttacttacgtgcagttgaaacagggcaaggggatgtgattttaaatgatttttacttgcagtctattacagttgaggcgatgccagacatagacgtcgttgtccacccaacgctcttttacgacccgagtgaacaagcatttatgatggcaaaaggggagacccgtctgaaagaggcagtcgacgaagcgcttgaacagctccttgctgatggcactgccagtgagttgtccaaacagttttttaacggccaggatgtcacaacattgcctgatgatattga

SEQ ID NO: 4844 - DNA, 1348 bp, Bacillus clausii
gtgaaagtagcaaaatttggcggttcatccgtcgcaaatgcagagcaaattaaaaaagtggctgccatcatcaaagcggataataaacggaaaatcgtggttgtttcagcaccgggaaaacgtttcgctgatgatgcaaaaatgacagacttgctcattgccttagctgaagctaaagtggcagagcagccagtcgaagcagcatttaatgctgtgatgaacaggtatgaatcgatagcgaacgatttagagcttaatcgcgatgtgattattgaaattgaagctgatttgaaaagccgtcttgagcaaacagtggcggacaaagggcgctttcttgatataatgaaagctagcggtgaagacaataatgcgaaactcattgctgcttatctaagcaaaatcggtctaaaagctacgtacataaacccgaaagatgctggacttcttgttagcgatgaaccagggaatgcccaagtgttgcctgaagcatacgaggcgcttgccaagttggctgaaatggacggaatcgtcgtgtttcccggttttttcggattctcaaaattaggaaatcttgttacttttccaagaggcggctccgacattacaggggctatattggccgctgctgttcaagccgagctttatgaaaattttactgatgttgattctgtttacgctgcgaatccatttatcgttgaggatccagttgaaatcaaacgaatgacttatcgggaaatgcgcgaactttcttacgctggcttttccgtcttccatgatgaggccttgattccggccttccgcaacggtatccctgtatgtgtgaaaaatacaaacaatcctaaatgcagcggcacattaattttggcggaacgtgaacgatcacttaaccctattattggcattgcttccgatgaagggtttgccaccatttatgtacgaaagtatttaatgaaccgcgaagtcggatttggtcgccatctattgcaaattttagaagatgcagggatttcctatgagcatattccttctgggattgatgatacatctgtgattatccgtcaaacgcaactttctgatcagttggaaaacgccattattgagcgcattaaagatgagctcaatgtagatgatgtccacattgagcatgattttgcgatggtcatgctcgttggagaaggcatgcataatacggtaggtgtaacagctagagcttcatctgctttggcaaaagcgggagttaacatcgaaatgattaaccaaggctcatctgaagtcagtcttgtgttcggcattcattcaaaagatactaaacaagctgtccgcgtgctttatgaggagttttttggac

SEQ ID NO: 4845 - DNA, 492 bp, Bacillus clausii; identical to SEQ ID NO: 4789

SEQ ID NO: 4846 - DNA, 311 bp, Bacillus clausii
cactgcaagcaaatacgattgccattgctatggatgaagcatttgggctaaaccgactaactgtcggcatcgtcattgctcttgcagtgggcgttattatctttggcggcattcgttcgatttccgtcttttcaggaattgtcgtgccgattatggccgttgcttatattggtgtcgtcttttttgtcgttgtcagcaattaccaagaaatcccccatatgtttgcccttattatcggtcatgcttttgggttgaaagaggcgacagtcggcatttttgccgggctccttgtcggtgcgcaacgaggattg

SEQ ID NO: 4847 - DNA, 423 bp, Bacillus clausii
ggagaccgttttttcagtatgcgagtctttccttaaagctggtgcaacggaaatggtcttggctgacacgacagggatggcaaaccctcgccaagtagcagaaactgttcgtgggttctatcgtacatttggagaggatattcctttaggcctccatttccacaatacgcgggggctcgggctggctaatgcagtggcagggtatgatgcaggcgtcagacgctttgattcggctgttggaggtcttggtggctgtccctttgcgccaaaagccacaggaaacatttgtacagaggatttagtccacatgttccatgaaatgggcattgacacaggcaccgacctggatggccttattacacttgcccaacaagttgaaaagtggatgggaaaacgccttgaaggccttgtcatgaaggcagg

SEQ ID NO: 4848 - DNA, 483 bp, Bacillus clausii
tatgcgcaaaaaaggagcgacgtcgtcttcatttgatattattgttgcttctggcgttcgttctgctttgcctcatggcgtcgcttcagaaaaaacgattgagcatggtgaattggtaacgctcgattatggtgcttattataatggctattgttcagacataacgcggacgctagcagtaggggatgtatcggatgaattgctagctatttatgaaacggtccgggttgctcaagagcgagctgttgagggcattaaagcaggcataactggcaaggaaggcgatgcccttgcacgagattacattgctgaaaaagggtatggccaatattttggccactcaacaggccacgggctcggcatggaagtacatgaaggaccaagtttatcaacaaaatcggatattgttttgcagccaggaatggtcgtgacggttgagcctggcgtttatatacctggcgttggtggtacgcgtattgaaga

SEQ ID NO: 4849 - DNA, 564 bp, Bacillus clausii
cgcttgaaaggttagcgatcccctattttattagcagcaatggggaagaattggcaaaggccaaggcgttgatcctccctggggtcggcgcttttcctgacgcaatggatattcttacacaaacaaacgtccagccttttttagacaactgggtagcggaaaacaaaccattactcggcatttgccttgggatgcaactattgtttgagtcaagcacggaacatcaaccaacagcaggccttggttacttgcctggacgcgtcgaacgtttttctggaacgacggcagaggggcacgcctacaaagtgccgcatatgggatggaataagcttgaattccataggcccacaccactaacagaaggtgttcctgaaggctacgtatattttgtccattcctatgtcgtccgtacagaaacggacatcatcgttgcaagcagtgattattaccaaagtgtccctgctattgtgcaaaaagggcaagtgtatggcatgcagttccatcccgaaaaaagcagcactgtcggcatggcactgctgaaacgctttggccaactagtggagg

SEQ ID NO: 4850 - DNA, 561 bp, Bacillus clausii; identical to SEQ ID NO: 4840
  misc_feature (1)...(561): n = A,T,C or G

SEQ ID NO: 4851 - DNA, 558 bp, Bacillus clausii
agagagtgccatctatgagaacagaagtgcctttaattgaaaaaaacatcgttttagtcgggtttatgggcgtcggcaaaacaagcattggccaagcgctcgccaaaaaaatgtaccgtgattttattgatatcgatgccaagattgaagaaaagttgaacatgagcattcccgcgatttttgaaaaacatggggaagctttttttcgccaacatgaaaaagaagccgttttttctgcttgcaaggaaaaattgaaaattatttcccttggcggcggcgcttttacacaagaagcggtccgccagcgctgccttgccgactgcattgtcattcacttggatctttcatttgagtgttggaaagaccgtgtccacatgctgattgacaaccgcccgattctccaaggaaaatcgatgcctgaattaaaacaactttacacagtaagacgcaaggcttatgaaaattatcactcccgcttttcgacagacgctttcaatgtcgaggaagccgcggagtatttaaaagaatcgctccacctcgcctatgaaatcgaaggct

SEQ ID NO: 4852 - DNA, 615 bp, Bacillus clausii
agaatctgtcctagtaagggatacaccaggaatggcggacgtcgattcatccttgctgtggttttgtaagcaaattaaaaacgatgtcactgttggcttgtccggggaatgcgctgatgaaatattcggtggctatccatggttccataaagcagaagtgatggcaattgacggttttccatggatgcgctcgcttgatgaacgaattcaattgttgcagcctgattggcagaaacgccttaatctcaaggagtacgtgtatgatcgttataaagaaacgattcaagaaacaccgcggtttgacggagattcttcagaggaagctaggcggagggaaatttcttacttaaatatgatttggtttatgacaaacttgctagaccgcaaagaccggatgagtatgggcgcttcccttgaagttagggttcctttttcagaccaccgcttagtggagtatgtgtggaacattccttgggagatgaaaacgtatggaggcagagaaaaagggatactgcgcaaagcattgcaaggattgctcccagatgatgtactcttccggaaaaaaagcccttacccgaaaacccatcatcctttatatacggcggccgtaacaaa

SEQ ID NO: 4853 - DNA, 555 bp, Bacillus clausii
  misc_feature (1)...(555): n = A,T,C or G
tanctgcttggcctgatgacttaaaagcggcagtgggcgagcaccactatttagtagccggcgggtatgaatacgatggcacgttgatttcagaactagatgaaaatgaaatccgttccgcactggaggctatgaaaggaaacgttaaatccattgctgttacaggcatattttcgccagcccgagccgagcaagaattgaaagtagcgcgccttgcccatgatgtcatgcctggcgtgccgatttcgctgtctcatcaaattggcagcattggtttgttggaacgggaaaatgcgacgattttaaatgcagcgctgcaaacgacaatacgtaccgtcgtttccgggttccgtgaagcacttagcaaacttggcattcctgcgcaaatctttatcggccaaaatgacggcacattaatggaagccgattatgcaatccgttacccgattttgacgattggctgcgggccaacgaactcgattcgcggagcctcgtttttgtccggtttaaaagacgcgcttgtgttggacatcggtggaacgacttctgatatcc

SEQ ID NO: 4854 - DNA, 236 bp, Bacillus clausii
atgacttcctattcccgcttatcagaccgtgtttcagaaatcaagccttcaggcatccgccgctttttcgatttagcttcgcaaatggagaatgtgatttcattaggtgtcggtgaaccagattttgtgacaccatggaatattagagaagaaagcattttctctcttgagcgaggatatacggcatattcagcgaatgccggtttaattgagttgcgcgaggcgatttcgcatta

SEQ ID NO: 4855 - DNA, 465 bp, Bacillus clausii
atgagacgcttggaccagaaatggtttcaccagcttgacggaaaaattgatgtttttgtggcaggcgctggaacaggggggacgttttcaggaacagccgcttatttaaaagaagtgattccaggcattcgaactgttgtggtagaaccagagggttcgattttaaatggcggggagccagggccgcaccggactgaggggattgggatggaattcatcccagactttgtagacacgtctttatttgaagccatttatacgatttcagacaaccaagcgtttaagcggacacgcgaacttgctgaacatcaaggtgtgcttgtcggcagttcttcaggtgctgctcttgaagctgccttgcgagaggctgaaatggccgacgaaggtgcccacatcgtcactgtctttcctgacggggcggaacggtatttgagcaaaggcatttatgaggaggaacctttgtga

SEQ ID NO: 4856 - DNA, 459 bp, Bacillus clausii
ctcacttattatgagacgcttggaccagaaatggtttcaccagcttgacggaaaaattgatgtttttgtggcaggcgctggaacaggggggacgttttcaggaacagccgcttatttaaaagaagtgattccaggcattcgaactgttgtggtagaaccagagggttcgattttaaatggcggggagccagggccgcaccggactgaggggattgggatggaattcatcccagactttgtagacacgtctttatttgaagccatttatacgatttcagacaaccaagcgtttaagcggacacgcgaacttgctgaacatcaaggtgtgcttgtcggcagttcttcaggtgctgctcttgaagctgccttgcgagaggctgaaatggccgacgaaggtgcccacatcgtcactgtctttcctgacggggcggaacggtatttgagcaaaggcatttatga

SEQ ID NO: 4857 - DNA, 660 bp, Bacillus clausii
taagcagttttcaaagctgacggctgaaccacttgttcaagaagggttggcttttttaaaaaacgatgacaggcaaacgttgcatgaacaaattgcgatcgctgaaattcctgctccgccgtttcaagaggaaaagcgggccaagtatgtgcaagaacagtttaagaagcttggtttaacaaaggtaaagcaagatgaagaaggcaatgtctatgggcttaggcctggaaaaaaagacgtgccggcgatagtggtgtctgcccatttagactcggtcttttcagaagagacggatgtcaccgtaaaggaaagggacggtgtctattatgggccaggcataaccgatgatgcccggggcttggcggcattgctgtccgttattcgtgctttccaacatacaggtattcacacggaggcgccgattgtttttctagctacagttggcgaagaagggcctggcgatttgcgtggtgtaaaagcatttattgatggaaatgctaatatagccagttttatttcgattgattcggtttctcctgaagaaatcatttaccaaggcactggcagtttccgctatgaagtaacgttttctgggacggggggccatagcttccagcattttggcacgccgagcgctgttcacgcagctggccgggcgat

SEQ ID NO: 4858 - DNA, 171 bp, Bacillus clausii
ttactcgctttgaatatacaaagaaaaacaataaatcgaacggtccagtattaattgggattgaactgaaatgcagcaaagattatgatgggttaatcgaaagaatggagaagattggttttgcctataatgaagtcaacaaggatgaaaatttgttttctttgcttattt

SEQ ID NO: 4859 - DNA, 786 bp, Bacillus clausii
tgacattcgaatttacatcgttcccttggagttgcgaatactacttagaaaatggaagtatgatgcctgaagatggattggagcaaataaaagattttgattcaattttcttaggagctgtggggaatcaacgtttagttcctgatcatatatctttatgggggcttttaattaaaatccgcagagaatttgaacaagttattaacgtaagaccagctaaattaattaaaggtattaactccccgttatccaacccgaaagattttgatttgcttgttgttagggagaatagtgaaggggagtatagttcgattggtggcagaatttataaagaagatgaagagcttgcgattcaaaacgctgtattttcaagacggggaacagaaagagcaatgcgttacgcctttgaattagcaaaaacgagacgtgggcatgtgacaagtgctacaaaatcaaatggcatcgtgtattccatgcctttttgggatgatgtgtttaaagagattagtaaagattatccgtcagttgaagttgattcgcaacatatcgatgcactagcagcattttttgttacccaacctgaacgttttgatgttattgttgcttcaaacttatttggtgatattttaaccgatattggtgctgcgattatggggagtattggcattgcccctgcagctaatattaacatcaatggtaaatatccatctatgtttgaaccagttcatggctcagcacctgatattataggaaagggtattgctaatcctatgggcagatctggac

SEQ ID NO: 4860 - DNA, 439 bp, Bacillus clausii
atggcaactgcaaaattgatttcacaaaaagcaaaagctcatgccccatccctttcacaagcaactacagcagaaaaaaacaacttgcttcaagcgatggctcaacaactgaaaacagacgcagacgtattgctggaagccaatcaattggatattgccaatgctaagaaaaacgggcttagcgaccacttaattgaccgattgttgttaacaaaagcacgaattgacgcaatggccacagcgattgaccacttgattgagttgcctgacccgattggcgcagtaaaagagcagatcaaacggccgaatgggcttgttatcaaggaaatggtcgtaccgttcggcgtagttggcatgatttatgaggcaaggccaaatgtgaccgtcgacgcttgcacattagcagttaaaaccggcaatgctgtcgtcttgcgaggaa

SEQ ID NO: 4861 - DNA, 405 bp, Bacillus clausii
attattttggctcacaatgcatcgttgtcgccattgatgcgaaatttgataaggcgcttggcacgtggcgcgtgtacacacatggtggccgcaaacagactgactggttagcgaccgattgggccaaggaggctgtccgcttaggggccggcgaactgctcgtaactagcatggatcaagatggagcgaagacagggtttgatttgtcgttgttaaaagcgatcaatgaagtagtgacagtgcccgtgattgcctctggtggagcaggagcggcaagcgactttgttgatgtgttcaaacacaattacgcagatgcagcccttgcggcatcgattttccattacaaagaaacgtcaattcaagaagtaaaagcccgtttacgggaagaaggtgagtgcatccgat

SEQ ID NO: 4862 - DNA, 423 bp, Bacillus clausii
tccgctttgataaagacgggctcgtcccagcaatcgtccaagatgcaaatagcaaagcggtgctaacgcttgcttatatgaatgaagaatcgctgcaaaagacaatggagacgaaagaaacatggttttacagccggtcacgccaacagctttggcataaaggagaaacatcaggcaatacacaacatgttgttgacgtccgctatgactgcgaccaagacgctgtacttgtacttgtggaaccgaaggggcccgcttgccatacaggggcatacagttgtttttcacagtcgctaactggcggtactagcaaggtggcaggcaatcgttttcaaattttaaacgaccttgaagaaacgattgcaaagcgggaggcggaaatgccagaaggggcgtatacaacatacttgtttacagaaggcc

SEQ ID NO: 4863 - DNA, 384 bp, Bacillus clausii
agcatttatggatggcgtctatgcgtgtgtacctacattgttaggttatttaagcattggttttgctgcgggtgtcgttgcaaaaacggcaggtttaagtgtacttgaaattacattaatgtcgttatttctctatgctggttctgcacaatttattgctgcaagcatgatcggagcttccttttcagtcattgccattgcgattacgattttctttataaacattcgccatttgttaatgactgctgctttagcaccttatttaaagaatctttctatcgggaagaatatattgattggtgcacaagtaacagacgaaaacatttggcgtagcagcaaaccgtttaccaaatatgaacggaaaccggttttattggatgcttg

SEQ ID NO: 4864 - DNA, 398 bp, Bacillus clausii
atgtatttacacgggacaatgacaattaacgaagctggccatttggaaattggcggcgtcgatacagtggatttagcaaaaaaatacgatacgcccttgtttgtttatgacacggccctcataaaagaacgagcccacgcttttaaacaagcatttgaggcagaaggggtttcctaccaagttgcctacgcaagcaaggcttttagctgcattgccatgtaccaactagccgcctcactagacttaagcattgacgttgtttcagggggcgagctgtttaccgccctaaaagcaggcgtcaagccagggcggatccatttccacggcaacaataaaagccgaggggaattagaaatggccattaaagcgggaatcggctgtatcgtcgcggacaattt

SEQ ID NO: 4865 - DNA, 617 bp, Bacillus clausii
gcaaaccggctatctgttctggactgcgcggcattgctgcgttagaagtccgcgtaaaaggagcaaaaagcgatttgcactctggcctgtatggaggcgctgtacaaaatgccttgcatgcccttgttcaattgctcgcttcgatgcgcgatgagaacggcaaaatcacgattgacggcttttatgaagggattgaaatcccttctgcagaagaaatggaaagcatcaagtcgttaggaagcggagaagaggcgctgaaagaggagcttggtgtcaacgaactgttcggagaaaaagggtatacagcccgagagcgcacgtggattaggccgacgcttgaattaaacggagtgtatggcggtttccaaggggaaggcgttaaaacagtcatcccagcggaagcaaccgcgaaaatcacatgccgcttaatgccaggacaagacccaattgacatattggaaaaaatcgaagcccatattcaagcacatacgccgcctggagtgacagtggcaacagaacgtcatgatacaggcaagccttttgtactcctgtgacagatctgatttgctgcatgtgcccgcgcttacgaggagtctattagacagaagtgcgtatac

SEQ ID NO: 4866 - DNA, 477 bp, Bacillus clausii
attttacaattggacaacatagctggattgatcaggagcgcatcggtctgactgggggaagttacggtggctttatgacgaattgggctgttggccatacgaatcggttcaaagcggccgttacgcaacgctcgatatccaattggattagtttttatggcgtaagcgatattggctactatttttcagagtggcaaataaaagcagacttgcatgatatcgaaacactgtgggcccattcgccactcaaatacgttgaaaacgtggaaacgccattgcttattctgcacggtgaaaaagattatcgctgtccgattgaacaagcagagcaattgtttattgcgttgaaaaagcatgggaaagagactgtatttatccgtttcccagaagccaatcatgaactgtcaagaagtggtaaacctaatttgcggattgaacgtctcaatgcgatagcagattggttttccaagcggttat

SEQ ID NO: 4867 - DNA, 485 bp, Bacillus clausii
aagcgaaagccgaagaatttgacagtgtcttaaaaaatgggtcggacccacttgcaagatgcagtccctattcgactagggcaggaatttggctcgtaccgcagagtgctagcccgtgatctaaaacgggtaagccgttcggcagaccacctccacgacatcaatatgggtgcaaccgctgtaggaactggtttgaacgccaaaccggaatacattgagaaagtcgcaaaacatttggctgacttgactgatttaccgttgaaaacggcggaggaccttgttgatgccacacaaaatacagatgcctatacggagctttctagttcgttgaaaattttagccattaatttatcaaaaatcgcaaatgacttacgtttaatgagttcgggcccgcggacgggattgaatgaaatcaatttgccaccgcgacagccaggttcatcgatcatgcctggaaaagtaaatccggtcatgtgtgaagtcat

SEQ ID NO: 4868 - DNA, 542 bp, Bacillus clausii
cagaagcgcttgtccgttaccgcaatgtaaaaaaagcatttggcgatacggttgttttgaacaatttagacattgacgtgaaaaaaggcgaaaaaattgccttgatcggcccgtctggctctggcaaaacaacgattattcgcatgttgatgacattggagcagccaacggcagggacgattgaagtggatggagaaatgctctggcataaaaaagtgaacggtgagctaaagccagctgacgaaaagcatttgcgcaaagtacggggcaatatcggaatggtgtttcaacaatacaatttgtttccccatatgacgatcatgaaaaactgtatcgaagcacctatccacgtccttggcttgagcaaagacgaggcaaaagaacgggctgtcgccatgcttgaaaaagtcgggcttgccgacaaagttgacatgtatccatcgcaattgtccggtgggcagcagcagcgtgtagccattgcccgttcactggttatgcagccgaaagtgatgctgtttgatgaagtaacggcagcccttgat

SEQ ID NO: 4869 - DNA, 312 bp, Bacillus clausii
gtggactggattgcgcgggataaagcggcgattatgggaacgtatgggcggttgccccttgttatagaccggggagaaggcaattatttaatcgatgagaacggcaaatcctatttagatttaattacaggtcttgctgtcaatgtaattggccactctcaccctgaagtagtaaaagcccttcaagaacaaggccaaaaatttctgcatatttccaacttgtatgtaaacaaaccggcggttgagcttgccgaacaactaagtgaggctacgcttggcggcaaagtgttttttgcgaattccggcgctgaa

SEQ ID NO: 4870 - DNA, 663 bp, Bacillus clausii
  misc_feature (1)...(663): n = A,T,C or G
tggagagggaaaatgtcgatgagttgcaagcagtcatcaaaaagaacantcctgctgcgctgcttatggaaccggtgcttggctcagggggagtcatcccattatcccattcatttttgcaagaagcacaggctttatgtaaacaggagaatgtgttattttgcatggacgaaatccaaacaggcatggggcgtacaggcaagttgtttgcctacatgcacgccgacttaagccctgacgtcgtcctttttgcaaaaggagtaggcggagggctgccgcttggtggcatcattgtcaagcaggattggagcgggttgtttgcccctggtgaccatgggacgacgtttgctccttcgccattaagctgtgcactcggccttgccgtgctccgtgttctccagcaacaaggcatcctcgccgacagccaacaaacagcagcctacttgcatgatacattaacaaagttgcaacaggaatttccaagcattttagaagcgttacgcggcaaagggatgatgattggcttgccgacaaaattaacggcggaaaacacgaaaaaacttcaacaaatgatgatggaacaaggcgtgctcattgacgtcacccaacaaacgatcgttcgtttgcttccgccgcttacgcttactaaagccgaagtcgaca

SEQ ID NO: 4871 - DNA, 438 bp, Bacillus clausii
aagttcagtgaaggaacggctgcgtcaagaccgcgccgcgcatttagaagaattgagtgcatttttaaaaattccaagcattagctccatttctgagcataaggacgatatccgtgctgcagcggaatggttgaagcaagcgtttcttaacgcaaaaatggagaaagtggaaatcattgaaacgaaaaagcatccaatcgtttatgcagagtggcttggcgcagggccagatgcaaaaacgatattgatctatggccattacgatgttcagccagtcgaccctttgcatttatgggaaacggaaccgtttgagccgactgttcgcgacggcaagctttatgcccgtggggctagtgatgacaaaggccaagtgttcatgcatttgaaagcggtgcaaacgatgcttgaagtagaagggacattgccgtttaacgtcaa

SEQ ID NO: 4872 - DNA, 573 bp, Bacillus clausii
ggttggttcacgaaaaggccttttccattgagacgctgggcgggcctgtttttgctactgtggaggtagacgaggaagggcgtgttggagcagtcgccatcaatatgggacagccgcgtttaacaaggcaggccattccaatgatcggcgaaggggataagcctgttgtcggcgaaaagctagaggcaaatggcgaaacagttcaagtgacggctgtttcgatgggaaatcctcatgcagtcatgtttgtagagcaaatcgaaaaagcgcctgttgagtcgcttggccctgtgatcgaaaaacattctgcattcccagattgggttaacgccgagtgggtagaagtagtcagtgaaacagaacttcattttcgtgtatgggaacgaggttcaggcattacgcaagcgtgcggcacaggggcgtgcgctgcagtcgtcgccagtgtgttaaatgggtatgcgaaacagggggtaccggtaacggtccacttgcttggcggcgatctgacaattgtatggcaagagaatggccatgtgctcatgcgtgggccagcagagtatatttgcacaggga

SEQ ID NO: 4873 - DNA, 209 bp, Bacillus clausii
gtcgtcgggattggcattgctgctattggcgcttttgtcggtgcaggcgggcttggcgaaatcattttgacagggacaaacgctacagatgggatggcgattattcttgctggcgccattcctactgcctttatggcaattattgcagacatgttaatgggttggattgaaagaaagctccatccgtttaaacaatcgaagccacaaac

SEQ ID NO: 4874 - DNA, 593 bp, Bacillus clausii
atgcggtattttgatcaagcggcaacgtcttttccaatggcaaaagcagttgctgacgctgttagcgaagcgattcttgcctatggcgcgaatccaggaagaggaggccataagttagcgaggcaagctgcagacacactttttcaggcaagaaaacggttggcggccttttttggtgcgcccgggcctgagcatatttggttttatccgaacgccacgtacgcgttaaatcaagccatccttggcttccctttacagcaaggagatcgagtagtaagcacagcttttgaacataattcggttttgcggccgttgcatatactcgaaaaagaaaagcaggcgacgatcgtttatgcaagtggaaaaacaggggacgagacagcagcagcagtcgtggaagcaatgacgccaggtacgcgccttgttgttatcaatcatgcttcaaatgttacaggagaaatcgtgcctttaaaatccattgccacccaagcaaaagaaatcggcgccgtcctgcttgtggatgcctcccaaacagctgggaaaattgcgattgacatggaacaagacggaattgacttgttggcgtgcccagg

SEQ ID NO: 4875 - DNA, 1164 bp, Bacillus clausii
aaaagatgtcgcattgatttttgaattaagcaaacaaggacgcattggccatagtttgcctgacttggatattgaagagcagccgcttgaatctctgctccctgaagcatatgtacgtgaggaagagcctgagctcccggaagtgtcggagttgcaaattatgcgccattacacagccttatcaaaacgaaaccatggcgttgactccggtttttacccacttggttcgtgcacaatgaagtacaatccgaaaattaatgaagacattgcccgctcgcctggtttggtgcatgtccatccttaccagccggaggagcaagtacaaggatcgctgaagatgctctattcgttgcaaacagcacttgcggaaattacaggcatggatgaagtgacattgcaaccagctgcaggagcccatggtgaatggacagggttaatgatgattcgcgcttatcatgaggcgaatggcgataagaagcgtacgaaagtggtcgttcctgattcgggcccatgggacgaacccagctcggccactgttgctggctttgaatcagtaacagtacgtacaaacgaagcagggcttgtcgatttagaccatttacgtgaagtggtcaacgaggaaacggctgcccttatgctgaccaatccgaatacgcttggcttatttgaagcagacatacaggaaatggctgatatcattcatcgtgcaggaggaaaactgtactatgatggagccaactccaatgcgatactggggatcgctagaccaggagatatgggttttgatgtagtccacttgaatttgcataagacatttacaggtccacatgggggcggtggtccaggctcaggaccagttggcgtcaaaaaagaactggttccctttttgcctaagccagtgttaatcaacgacggcggctttttccgttttgatgctgatcggccacaatcgattggccgtgtaaaaccgtattacgggaattatggcattaacttgcgcgcctacacgtatattcgcacaatgggcccagatggattgcgacaagtctctgaaaacgctgtgctaaatgccaattatatgatgcgccggctagagccctattatgatttgccgtatacgcaacattgtaaacatgaatttgtcctatctggcaaacgccagaa

SEQ ID NO: 4876 - DNA, 1043 bp, Bacillus clausii
tacacagcttatacgccgtatcacccggaaatttcccaaggtgagttgcaagcgatttttgaatttcaaccaatgatttgcgaactaactggcatggatattgccaactcttccatgtacgatgggcctactgcgcttgctgaagcagcgatgttatcgtgtgggcatacaaaaaagaagacgattcttgtttcaaaagctgtccatccagaggcacgtgcggttttgaaaacaaatgcgtacgggcaacgtttgaatgtcatagaaattgatgctaatgcgaatgtgactgatatcgagtcattaaaggcggcttacaatgaagatgttgcttgcgtcattgtccaacaccctaacttttatggcaaccttgaacctcttgctgaaatcgaggaaattgtccatcaaggtaaagcgcaatttgttgtttcgagcaacccgcttgcccttggcgtcttaaagcctcctggcgactttggggcggacattgtcgttggcgatgcacaaccgtttgggattccggttcagtttggaggacctcattgcggctattttgcgacaacgaaaaaattaatgcgtaaaattcctggaaggctcgtagggcaaactgtcgacgaagaagggcggagaggttttgttttgacgttacaagcccgtgaacagcatattcgccgtgaaaaagcaacctccaatatttgttcaaatcaggcgcttaatgcattggctgcatctgttgcggtgactgcccttggcaagcaaggtgtgaaagaaatggcaaaacaaaatgtgcaaaaaagcgcctatttaaaaaaacagcttacccttgcaggtgtagacatagtaggcgacgggccaacatttaatgaatttgtcatcaactgcggacagcctgtcaaagacgtaaatcgcaaattgttggaaaaagggatgattggcggttttgatctcggcagtgttgagccagaacggaacggacaaatgctcgtttgcgtgacagaactgcgcacaaaagaagagttggatttcttcgcgaatgaaatggg

SEQ ID NO: 4877 - DNA, 699 bp, Bacillus clausii
aggaaaagacaaagtgttgccgatgaatacaggggtagaagcggttgagacagcgattaaagcagctggtcgctgggcttatgaagtcaaaggagtagaagacaataaagcagaaattattgcagccaaaggcaattttcatgggcggacattaaatgcgatctccttgtcgaatgatccaggagcgaccaaacattacggtccttttgtaccagggataaaaaaggtagcgtatgggaatgtggaagccattcgtgaagcaattacgcctaatacagcggctgtgattgtagagccaattcaaggagaagcaggcatcattatcccgcctgaaggttacttacaagccgttcgtgatctctgtacggaaaacgatattctctttattgccgatgaagtgcaaacaggttttgcacgaactggaaagatgtttgcgtgtgaatgggaaaatgtcgttcctgatatttatgtaatgggaaaagcattggggggcggcgtttttccaatatcggctattgctgctgacaaagacattatggatgtatttacgccaggttcacatggatctacttttggcggaaatccgttagcttgtgccgtttctctagctgcaattgaagtaattgaggaagaaaatttagcgaaaaaatcgttagaattaggggagtatttcacaacagctttacgggcaattgataa

SEQ ID NO: 4878 - DNA, 411 bp, Bacillus clausii
  misc_feature (1)...(411): n = A,T,C or G
aattgccatcaaagctaacattgttgccaaagatgaaaaagagcatggcatccgcgcccatttgaattttggtcatacactcgctcatgcgattgaagcagaactggggtatggaaaggtaacccatggcgaagcggtggcaatcggcatgcgttttgcttttcgccttagcctccgttttacgaagaggatttgcggcttgccgattatgaagattggttttcctgcctcgttatnacccttcggtttgccagcagggctttcagcncaacggttgcttncccgtatgtaaagcgacaaaaaaacgcatgcaccggaanattgtcanngngttgctcncgcanatttnnnccccccatacncaaacncagtctatgaacatttgctttnagagttgttagaagaagaact

SEQ ID NO: 4879 - DNA, 642 bp, Bacillus clausii
agatatggttattttaacagggcgttcgttgacgctggatgacatggaagcgattttgtacaaaggggtgaaggtaggcttaagccaatcgtgcattaacgagattgaagcaagccgtcgggctgttgaaaagatcgtccaagacggacgaaccgtatatggcatcaatacggggtttggaaagttcagtgacgttcaaattgctgctgccgatactgaagagcttcaacgaaacttaatcttatcccatgcatgtggggtaggcggttatttttccgatgaaatttcccaggcaatgatggtgctgcgggctaatgcactcgcaaaagggttctccggcgtccgattagaagttgtggaaatgctgctcgagttgatcaataaagatgtatatccgtgtattccttcacaagggtcgctcggggcgagcggcgacttggcgccattatcccatttagcccttgtgttaatcggagagggagaagtccgttatcgcggcgagtgtatgagtactgcagcgtgctttgctaaactcggtattcaacctcttacgctgcaagcgaaagaagggttagccctcataaacggcacacaagcgatgacagccgtcggggttgtcgcttacttagaaccagaaaaatt

SEQ ID NO: 4880 - DNA, 1325 bp, Bacillus clausii
  misc_feature (1)...(1325): n = A,T,C or G
atggttcagtttgattcacaagcacgtagcccttggacgcctttagcaggggtggagcgcctccgtttaacgccgagccaaaagagaataaacgcttcgttagaagtgcctggaagcaagagtgcaacaaatcgcgcattgctgttggcagcagctgcgtcaggcacttctacattaaggaatgcgttaaaaagcgacgacacgtattggtgcatcgatgcgcttacaaaaacaggggtaaaaattgcggtagatggaagcgatatgactgtctatgggaaaggaggggtgtttcattctggctccctttatattggttcagcctggaacagcatngacgttttttgcctgaaatgttggcggcttgcaacgggaaactggcatgtgaagcgagccaaagcatgancaaacggccccattgctcccttggtagaancattacaggcattaggggcaggcattcagtatggcgaccgtaggggccattatcccctttccatctccggtgaagggttgaacgggggaaaagtgaacatgagcggccagctgtccagccaatttataagcggctgtttattggcggctccattggcgaaagaacctgtctcgatcactgttgaaggcggcattgtccaacaggcgtatgtgcgaatcacaatcgacttgatggcagcttttggggtcgaagtgaaagcagcgcctgatttaagcttgcttgaagtgaacccttctccttatgtcgcaaacgacatcgcgattgaagccgatgcctcaacggcttgttactttcttgcccttgccgccatcacagcagggaaaatccgtatacgccatttttcgacgaaaacaagccagccagatattctgtttgtctccatccttaaacgaatgggatgcaactttgaaatcggaccatcgtttgttgaagtagaagggccccctcgtttaaaaggcgggttttccgttaatatgaatgaattatccgatcaagccttaacgcttgccgcgatcgctccttttgctgacggtccaattgccattgaaggagttggccacatccgacaccatgaatgtgatcgcattcgcgcaatttgtacagagttaagccgcttaggtatccgtgtcgaggaaagacatgatggattaatggtttatccaggccagccgacgccaaccgttgtaaacacatacgatgaccaccgcatggcgatggcgctcgctctgattggcgcaagagtagataaaatcgaactagacgatcctggctgcgttgccaaaacatgcccctcttatttttccatgcttgcccaaacaggaataggggt

SEQ ID NO: 4881 - DNA, 654 bp, Bacillus clausii
cgtcgaccagtttttgtttgaaacagcccgagggtattgcgataacttttcgacagcgatggctgtcatgctgcgaacacttgacattccgactagatgggcaaaagggtttacagagggtgaagcacagggaactgtcggcgaggatggaacctatcaagaatacgttattgccaatagcaatgcccattcttgggtagaagtgtactttccagaagttggttgggtgccatttgaaccgacgcctagcttttcaggtttttcctttcaacagcccgaaattgacatagaaaacggcgatgaggaggatacggagcctgaacaaagagaagagcctgagcaggatgaagacgaagtgcaagagcctgaaaacgaagaagaaacagatgaatcacaaacgttaggccaaacgaaagaaggcccgagctggtggctaggagccgctatagggatacttgcagtggcggcgttggttttgtttctgttccgcaaagcgattgcccgtgcttatgtaagcggaatgtacaaaaatgacgggcgaacagagacctttgtccgctcctatgagcgcttgctatggttgctcggttttcatggctataagcggaaaacaacgcagacgttgcgtgaatatgcaaccgacgtggacagcga

SEQ ID NO: 4882 - DNA, 558 bp, Bacillus clausii; identical to SEQ ID NO: 4851

SEQ ID NO: 4883 - DNA, 327 bp, Bacillus clausii
atgcgcaagaaacccgctggtcccatgaaccccccggttctatttcgcatcttcccttcgccagcactccttcgtctgacaagcgtttttctaatcagtctaagggtgggtttttcccatgagttggcctgcttaagaagaaacggtttttaccccctattcctgtttgggcaagcatggaaaaataagaagggcatgttttggcaacgcagccaggatcgtctagttcgattttatctactcttgcgccaatcagagcgagcgccatcgccatgcggtggtcatcgtatgtgtttacaacggttggcgtcggctggcctggaataa

SEQ ID NO: 4884 - DNA, 120 bp, Bacillus clausii
gttttcggattcgccgtgagtccgttgaaaatggcgttgtctgcttaacgtcaattgatacagcacaagcgctgctcagcgtacttgagtcgattacgtttgcaacttggagcatgccgc

SEQ ID NO: 4885 - DNA, 549 bp, Bacillus clausii
atcatgaggaagagttgctgcgctacatgcagacggctgtaaaagtgaatccgaagcaccctgtgcttgtcgaccgctatttgacaggaaaagaattagaagtggatgcgattagtgacggcaacgacgtttacattcctgggattatggaacatattgaacgggcaggcgtccattctggcgattcgattgctgtttatccgccgcaaaccgtgccagaccatttgaagcaacgcttaattgagcggacaacgagcattgctaaaggtttaaacattgttggccttttgaacatccagtttgtttggcataaagatgacgtctatgtgcttgaagtgaatccacgctcaagccggactgtgccatttttaagcaaaattacgggcgtgccaatggctaaggttgccacgcatgtcatgctcggcaaaacgctgcgccagcttggctaccagtcaggctaccacccagagacggatgaagtgtctgtaaaagtgccagtgttctcctttgccaaattgcgccgtgtcgatatttccctcgggccggaaa

SEQ ID NO: 4886 - DNA, 483 bp, Bacillus clausii
atgacacgggagcagaagagattaagcgccttggcgttgatggtgtgcttgtttcaaatggaccaggcgacccagaaaatgtcccggagacagtggaaacagtcaagcaattgcttggcgacatccctcttttcggcatttgcttaggccaccaattgctggcgcttgcttgtggggctacgacgagcaagatgacatttggccatcgcggttccaaccacccagtacgggagctcgctactggacgaattgatattaccgcacaaaaccacggctatacagtcgatgctgcgtcattggaagggactgcgctcgagctgacacatgtggctgttaatgatggctccgttgaaggccttcgccataaagaagggcatgcatttagcgtgcagtaccatccagaagcatcgcctggccctcatgacgctagccatttatttgatacatttatccatatgatgatcgaaaaaaaaggaaaagttt

SEQ ID NO: 4887 - DNA, 582 bp, Bacillus clausii
atgccaaaacggacagacttaacaaaaatacttgttatcggctcagggccaattgtaatcggacaggcagcagagtttgattatgccggaacgcaggcatgccaagcgctgaaagaagaagggtatgaagtcattttaattaattcgaacccagcgacaatcatgacagatacagcaatggcggatagggtttatatcgaaccgctcacgcttgagtttgttacccgcattatccgcaaagaacgccccgatggccttttgccgacattaggcggacaaacgggcttaaacatggcgcttgaattaaaaaatgctgggattctcgagcagtaccaaatcgagctgctcggcacaaaactagatgcgattgagcaagcagaagaccgggaacaatttcgggcgttaatgaacgtgctcggcgaaccagttccagaaagtgaaatcgtccatacgcttgacgaagcgttcgcctttgtcgaaacgattggctaccctgtcattattcgtccagcctatacgcttggtggcactggcgggggaattgcctacaatgatgaggatttagcagaaatcgttgcgagc

SEQ ID NO: 4888 - DNA, 1042 bp, Bacillus clausii
atgaaaggctcgatcgtattggaaacgggagaaacatttgtaggtaactggcatggtgaacctaagcaagtcgaaggcgaaattgtcttctttactggcatgacaggttatcaagaagtgataaccgatccgtcatttaaaggacaaatcgtcgtgtttacgtacccgttaatcggaaattatggcgttaatgagagtgattttgaaagcagcaagccgcaagtcgaaggcgtcattgtttgcgaagctgccagtgacccatcacattggaaaatgaaaaaaagcgttgtcgactatttaagtgaacaccgcattccttatatgtcaggggtagatacacgggcaattgtgaaacgaattcgccaacatggagacatgcgtgcagtattaacgactgattcccgaaatgccaatgtccaggagacgaggcttttgtctgataagtttgttgttgccgatgtgagcgtcacagaacccgtcgtttacaacgccacaggcacaacccacattgccgtactagactatggctgtaaacaatcaatcatccgttcacttgtcaaaaaaggtgcgaaagtgacgcagctgccatacaacacagattttgctgtgctcgaagcactcaaaccggacggtgtcctcctctcaaatggacctggaaatccaaagcagctgcaagcattgttgccagacattaaaaaggtagcggaaacgtttccgacgttaggaatctgcttaggccaccagttgcttgcattggcctatggaggggatacacaaaagctccgattcggccatcgcggcgcaaaccagccggtgcttgacagctgcacagggcgtgtgtgtatgacgtcgcaaaaccatagttatgtagtgacggaagaatcgcttgcttcatcgatccttgagcctcgtttttacaacattaatgatcgatcgatagaaggcctcgttcatccgaaacggccagtaatgagcatccagtttcatccggaagcaagcccaggtccagtcgattcgactgaaatttttgatgcgtttttgg

SEQ ID NO: 4889 - DNA, 378 bp, Bacillus clausii
atgaacggctatttgcgattggcgctttgctgcgaagaggcatttcagtagagaccatttatgaaacaacgagcattgaccgctttttcttgcaaaagctagcgcgtattgttgctctagaagagacgataaacgaggcccgtagcaatgaagcgatgttattgcgtctgaagcgtgctggcttttcagattcctacattggccgtaaatggggcagtgaagagaaagatgtttttgcagtaaggcaacaggcaggaattgttcccgtttataaaatggttgacacctgtgcagcagaatttgcttcaccaacgccttacttttacagcacctatgaacaagagaatgagtcacagcggacagaaaaagacagcattc

SEQ ID NO: 4890 - DNA, 120 bp, Bacillus clausii; identical to SEQ ID NO: 4884

SEQ ID NO: 4891 - DNA, 462 bp, Bacillus clausii
  misc_feature (1)...(462): n = A,T,C or G
atgaagtcgactggagagctgctcatgattggtgaaagtgtagaagaagcgtttgccaaagtgtttgctccttttgaagaaccaatctctttgtataaaccaagagaagagaaatcggtttttgtggatcttgcggatgagcataagcacgatttttctgagattttgcagaaactggaacaagtagggtgttcgttagtaaaagacgattttgccaagtggctagaaagcccccatgcgtgtgcgttaatcagcgtgccgcctcttgggaagcgtaacggagcaaatatgcgaatggcggcactggccaaacaattgaccgtgatctcagcaaaagagacggccacagcaatgcttgcttattttgagcaatcgaaaaaaagctgcaagccaatccaagaatggcatcgcttgcgaaaaacggnaaatggcaggggagacgaattaatatggagacggtaa

SEQ ID NO: 4892 - DNA, 468 bp, Bacillus clausii
  misc_feature (1)...(468): n = A,T,C or G
gggcgccaaaggaaaaagtgncagcgaaacggatcgattggggaataaagccagcttataaaatggttgacacatgcgctgctgaatttgaagcggcaactccttatttttattcgagttattgcggagaaaacgaagccatgccgagtgcgcaaaaaaaggtgctcattatcggctcaggaccaatccggatcggccaagggattgagtttgattattgttcagttcatggcgctaaagccgttcgcaaacaaggctatgaagcaatcattatgaataacaatcctgaaacggtaagcaccgattatgccaccgcagatagactatactttgagccactctcttttgaagatgtatacgccgtttgcgcgttggaacagccagaaggcgtcattgttacattaggcgggcaaacaggaattaaattagtgcaggagcttgaggaagctggcctccctgtgcttggcg

SEQ ID NO: 4893 - DNA, 870 bp, Bacillus clausii
gtaaaccacacatcaagacggtccttgtcattggttcagggccaattgtcatcggccaggcagcagaatttgattattccggcacgcaaggttgcttagcgttaaaagaagaaggcatccgtgtggtgttgttaaacccaaacccagcaacggtcatgaccgatgattcatgtgcggatacggtgtattttgagccgttgtcggtggagacggttgtcaacattttcaagagggagaaacctgacgggctgttggcgacgctaggtgggcaaacaggtttaaatctcgccttgaagcttcatgaacaaggcttgctcgctgcctatggcgtcgaactgctaggcacgccaattgaatcgatccaaaaaggggaagaccgtgagcaatttcgggctttaatgcatcaattaaacgagccggtgcctgatagtgaaattgtccatagtgcgtctgaagcgcttcgctttgctgaacaagctggctacccgatcattgtccgtccagcttatacgcttggtggggcagggggcggaattgccgattgtgaaaaagagttgaaagcaatcgtagaaaatggccttgcccaaagcccgattagccaatgtttgattgaaaaaagcatcgctggctttaaagaaattgaatatgaagtgatgcgtgatgaaaacgacacgtgcattacggtttgtaacatggagaacattgatcctgtcgcattcataccggcgatttcattgtcgtagcgccatcgcaaactcttaccgacaaagactatcaaatgctccgtgccgcgtctttaaaaataattcgcgcttttagggatcattggcggctgcaatattcaaatttgcccttgacccgaacagcgac

SEQ ID NO: 4894 - DNA, 558 bp, Bacillus clausii
ttgcttcaaaagcaactggctatccgatcgcgcggatggcggcaaaactgtcaattggctactatttacatgaattgaaaaatccggtgactggctatacatacgccagttttgaacctagcttggattactgcattgtcaaattcccgcgctggccatttgataaattttttaccgctaaccgcaagcttggtacgcaaatgaaagcaactggtgaagtgatggcgattgaacgttcatttgaagcagctgtccaaaaagcgattcgctccttggaaattgatgtagccggcttggaaatgccggtgctcagcggcagtggggaaaaggagctttggcagcacgtcctccaagcggacgacgctaggttatttgcgctatttgaactcttgcgccgtggtgaaacgtgtgccaacctccatgagaaaacaaacatagatatgtttttcttgaagaagtttgaaaagctggtgcacttagaaaaagaaacaaagcagctatcgctcgaattcatttcaaaagaagcgctgcatcagttaaaaatcgcaggtttttcgg

SEQ ID NO: 4895 - DNA, 657 bp, Bacillus clausii
gggatcattggcggctgcaatattcaaatttgcccttgacccgaacagcgaccgttactatttaatcgaagtcaaccctcgtgtcagcaggtcgtcggcacttgcttcaaaagcaactggctatccgatcgcgcggatggcggcaaaactgtcaattggctactatttacatgaattgaaaaatccggtgactggctatacatacgccagttttgaacctagcttggattactgcattgtcaaattcccgcgctggccatttgataaattttttaccgctaaccgcaagcttggtacgcaaatgaaagcaactggtgaagtgatggcgattgaacgttcatttgaagcagctgtccaaaaagcgattcgctccttggaaattgatgtagccggcttggaaatgccggtgctcagcggcagtggggaaaaggagctttggcagcacgtcctccaagcggacgacgctaggttatttgcgctatttgaactcttgcgccgtggtgaaacgtgtgccaacctccatgagaaaacaaacatagatatgtttttcttgaagaagtttgaaaagctggtgcacttagaaaaagaaacaaagcagctatcgctcgaattcatttcaaaagaagcgctgcatcagttaaaaatcgcaggtttttc

SEQ ID NO: 4896 - DNA, 963 bp, Bacillus clausii
  misc_feature (1)...(963): n = A,T,C or G
ggacaagaatcaataaaaaaatccctcgcctcgttgatgtcctgccaaatgggcctgttggccacacgactgttaaggtatttctcgcaggtggtgttcctgaggttatgctgcatttaagaaaattaggcgtactgcatgaagatgtacaaactgtgactggagaaactcttggtgcaaaccttgattggtgggaaaaatccgaaagacgcgctctaatgaaaaaacagttgctcgaaacagacgggattgatccagacgatattatcatggacccaatcaaagcaaaagaaagaggcctaacttctacggttacattcccgaaaggaaatattgcgcctgaaggatctgtcattaaatcgacttctattgatccttccgtggtaagataacacggaatttatagacataccgggaaagcgaaagtctttacttcagaaaagtctgctataaaggcaattaaacatggaagcattgaagcaggggacatcatggttgtgatgggcggcggcccttccggaacggggatggaagaaacctatcaactatcatctgcattaaaacatttgtcttatggaaaacatgtttccttgattacagatgcccgtttttcaggtgtttctactggcgcatgcattggacatatcngacctgaggcattggcaggcggaccaattggaaaattacncaatggagatgtgatcgaaatcatcgttgaccgcaatgagttagtaggttctgtcaatttcattggaacggaaaatgagcggctttctttggccgatgcaagtcaagtactgaaagaacgctccctccatccagaccttcaaccgaatccagatctgccagacgacacgcgtttatgggctgcgctccaatccgtaagtggaggaacttggcgaggaaatatttacgatacagatcgaatcattgaagttctaaaagctggggtaaaagcgttag

SEQ ID NO: 4897 - DNA, 519 bp, Bacillus clausii
  misc_feature (1)...(519): n = A,T,C or G
tcgttagtgacccatgtgatggccgttcccaaggaacgactggcatgtttgattccctgccgtttcgaaacgacgcagcgattgtatatcgaaggctaattcgctcgttgccaacgcgccgtgccgttattggcgttgcgacatgcgataaaggccttccggcaatgatggtcgctttagcgtccatgcatgacttgccaactattattgttccaggaggtgtcacgcttccgcctacaaacggtgaagacgcaggcaaaattcaaacgattggagcacgatacgccaataacgaaatcaccttacaagaagctgccgatctcgggtgccgtgcttgtgcgacaccgggaggaggatgccaattccttggaacagctggcacctctcaagtcgttgccgaagcgatgggtatcgcgttgcctcactcggcactggcgccatctggccagccgatctggatggagatggctagacaatcagcccgtgcagcattagagnatggagaaaaaagggctatca

SEQ ID NO: 4898 - DNA, 407 bp, Bacillus clausii
atggcaaaagtatattataacggagatgtaaatgaacaagtactagaagggaaaacggttgccatcgttggttatggctcccaaggccatgcacacgcacaaaatttgcgcgaatcaggagtggacgtcattatcggattgcgtccaggaaaatcatgggataaagcaacggaagatgggttttctgtctactctgtccgcgaggcttcagcaaaagcagacatcatcatgattctttctccagacgaacatcagccggcgatctacaaagaatcgattgaaccagaattgacggctggcaaagcgcttgtattcgcacacggctttaatatccactttaaccaaatcgtaccgcctgaacatgttgacgtctttctagcggcgccaaaagggcctggccaccttgt

SEQ ID NO: 4899 - DNA, 621 bp, Bacillus clausii
aggttctgagattttattaaaagcacttgccagcgaaggagtcgaagtcatttttggctatccaggcggagcgattttaccaacatacgatgagatttataaattaggaatgaaccatattctagctcgccatgagcaaggcgcgattcatgcagctgaagggtatgcgcgcattacccaaaagccaggtgtctgcatcgtcacttcggggccaggagcgacaaatgtcgttacaggcattgcggatgcgatgatggattcgctgccgatggtcgtcatcaccggccaagtggctacaaaggtgattggtaccgatgcttttcaggaagccgatatgcttggcattacaatgccgatcacgaagcataattttcaaatccgttccattgatgagctggcgcaaacagttaaagaagcgtttcacatcgctgttagcgggcggccgggaccagtgttgattgatttgccgaaagatatttcggaaaaactgggaatctttgattatgaggaacctgtccacttgcctggctaccaaccaaccgttaaaccgaataagcagcaaattcgcaagcttctggataagtttaaagaagcgaagcggccagtactgcttgtcggcgc

SEQ ID NO: 4900 - DNA, 387 bp, Bacillus clausii
  misc_feature (1)...(387): n = A,T,C or G
gcttgttgaagcaggttatcagccggaaatcgcttactttgaatgtttgcatgaattaaagctgatcgttgcccttatgtatgaaggcggcnttgagtacatgcgttattcgatttctgatacagcgcagtggggcgatttccaagctggaccgcgcatcgtgacagacgaaacaaaagcagcaatgaaagagattttaagcgacatccaaaaaggcaagtttgcgaaaggctggattttggaaaacaaactgaaccgtcctgagtataacgccattaacgaagcggagaaaaatcaccctcttgaagtagttggccgcgaattacgggaaatgatgccatttgtgaaagcatccaaatccaagggagtggtcgcgaatgcgaaaaa

SEQ ID NO: 4901 - DNA, 471 bp, Bacillus clausii
gttactgaaaggaagcggggctatcgccgagcacgacgagtggcgcaagcaagttagcgactggaaacgagattatccactatggtttcatcgcgacggggaggttattaagccacaggagctgatccaaaaactgtatgaacatacaaagggtgaagccattgttacgacggacgtcggccagcatcaaatgtggacggcgcaacattttaagtttaacaaaccaaatcgctggattacatcaggtggccttggcacaatgggattcgggtttccagcggcaattggggcgcaaattgctgaacctgaattgccggtattggcgattactggtgacgcaggctttcagatgacacttcaagaaatgtcgattttgcaagaactagatttgccagtcaaaattgtgattgtcaacaatgcttcccttggaatggtacggcaatggcaacaacgttttcatggcgagcgcta

SEQ ID NO: 4902 - DNA, 732 bp, Bacillus clausii
ttgtgaacagttgctgagctttcatgagcaaacaaagcaattgacgctgattcaattagtcaaaagtggcttgcagccagcagaacaagcttttgccgaagcgcaagcgaaaattcgtacgctaatcggcaaattggaaagtgctaaagcgcctgttttgccacatatggtcacgaaaaagcagctgccgatcgaagttcgctccaactattcgaaacaaggctttataaacgatgtaaaccggatcaaagcttatatccaggcaggtgacattttccaagccgttttgtcacaacggctcgaaatgaccgtttctgttggcgggctcgatttgtaccgtgtgctgcgctatgttaacccttcgccgtatttgtactatattaaaattggaaaaaaagaaatcatcggaagttcgccagaaaagcttgtccaagtgcgcggtgaccatgtcgaaatacacccaattgcaggcacgcgcgagcgtgggcaaacggcggccgaggacgaagcgttagcccgtgagttgctagctgacgacaaagaacgggctgagcaccatatgcttggtgacttggcgcgcaatgacgttggcaaggtttcggtttatggaagcgtagaagtcccctctttaatggaaataggaaaattttctcatgtgatgcatcttgtctctaaagtaacaggcaaattaaagcctgaagcaacgccttatgacgccttaaaagcgcattt

SEQ ID NO: 4903 - DNA, 588 bp, Bacillus clausii
  misc_feature (1)...(588): n = A,T,C or G
gatcttcgggacatgnaaatgtgttaagggattggccaagcactagagcaagatgccgggcgattaaacggtatggcaaggcaaaaatgancaagggatggcccatgcggcaatggcttttagcaagcagatgctccgcaaaaaaatatatgcagtgacaacttctgtaggcccaggagccgcgaaccttgttgcagctgctggcacagcgctagctaacaatatacctgttttgcttcttcctgccgatacattcgcgactcgccagcctgacccagttttgcagcaatttgaacaagaatacagccaagcagtgacgacaaatgatgcattaaagccggtgtcgagatactgggaccggattactcgcccagagcagttaatgtcgagccttattcgtgcctttgaagtcatgacagacccaggaaaagcggggcccgcgacgatttgcatcgcccaagatgtcgaaggagaagcatatgagtatccagaggagtttttcagaaagcgcattcattatttagaacgtagaaagccaacggagcgggaaatcgaagaggcacttgaacggattcgtaggagcaagcg

SEQ ID NO: 4904 - DNA, 516 bp, Bacillus clausii
  misc_feature (1)...(516): n = A,T,C or G
aatgattgttgtagtagataattatgactcattcacatataatatcgtagattatttggggaaaattagtgatttaaaaatagtagtctctcgaaatgatgaaatcagtatagcgcaactttctttattaaatcctgagtacattattatctcgcctggtccaaagcgcccaaaagatgcagggatatcgaaggacattatttcgagctttaaaggtcggatccccatactaggagtttgtctaggtcaccaagctatagctgaagtatttggcagtgaaatagtgaaagccactgagcccaaacacgggaaagtttctttaataagacataacaatgatttgttatttcaaggagttgctaacaatttcaaagcaacgcgttatcattctttagtaataaatcaagataatttatcagacaatatcgaggtattggcgtattcaaaagatgataatgnaaataatggctattaagcataaaagttttccccaatctatgggttacaatttcatcc

SEQ ID NO: 4905 - DNA, 177 bp, Bacillus clausii
  misc_feature (1)...(177): n = A,T,C or G
tatngttaaacgggaaacgttgncctggatgttttgaaattagcgcggaaacagcggaaggggaagtgatggcgattcgccataaggagttgacgattgaaggcgtccaattccatccngaatcgattatgacgaaanaagggaaaacgttgttgcgtcaatttatngattcttacc

SEQ ID NO: 4906 - DNA, 460 bp, Bacillus clausii
  misc_feature (1)...(460): n = A,T,C or G
atgttcctcagtataaacggagctgtcgttgcaaaagagcaggccgccatttctgcgtttgaccatggttttttatatggcattggtctgtttgagacttttgctgctgataaaaacggtgtgntttttgctcgaagcgcatattgaacgtcttttaaaaggcttggaatcagtcggcattgncctactcattgacnaaaagaacgggcgcttgaaaccatctatacattgcttgaagcaaaccagctcgatgaagggtatgtccgctggaatgtatcagctggcatgcgcgagattggcttattttcagatcgctatgaggcgccaacggaaatcgtgtatatgaagccattgcctaaaaagccgcttcgcaaagaagccgttgttttacacactgttcgcaacacgcctgaaaggggcgtacggctaaaatcacatcattatttaaataatgtcctcc

SEQ ID NO: 4907 - DNA, 675 bp, Bacillus clausii
  misc_feature (1)...(675): n = A,T,C or G
gttggaaagtggacagacagggcggtatagcataatnggcttaacgcctgttgctgtgatcgaaggcaagggccacacattaatggtcagcgaccaaaacggcaaccatctttttaaaggcccactgttatcttcgttagaaacggtgcttgccccctaccaaacagaggacaccttaacaggtccaccaatgcaaggtggggcgattggatacttgtcttatgatgttgtccgagaaattgagtcattaaaggaaactgcggttgatgatttgcaactgcctgaagtctattttctcgtttttgaggaagtagctgtgtacgaccatgaggaagagcagttgtggctgtgcgccaatggaagcgatagccaattgctgcaggagaaggtggcgctccttgaacagcggtggctacaagcagagcctgctccgacgtcaagtagaaacccatttacatcccgttcacgcaaagaagcgacattcacaaaagagcagtttgttcgtgctgtcgaaaaggtgcaagactacattcgaagcggcgatgtatttcaagtcaatttgtccgttcgccatacccgcagccttcaagtagaccctcttagtgtgtataaagagctaaggcagcttaatccatcgccatatatgagttatattcatagcccaaaaactcaaat

SEQ ID NO: 4908 - DNA, 981 bp, Bacillus clausii
tagtccaaaatgtatttaaagaagaaggattaaatactgatttaaatgaacttttttacagaaagaaaaggttattagagcaatacactcaactattaaaagatgggcaaaagtatattactgaagaaaaagataagctttttgtgaatactaaattgaactatcaagaaagtatttcaaaaaaagaatatatagagaaagtttcggaatgtaaggagtatattatagagggtgatatatttcaaattcagttatcaagaagattaaaaacgaagttcaatcacagtccaattgaattctatttcaagttaaaggagattaatccatctccctatatgttttttatgaaatttgaggataaatttttaataggagcttcacctgaattgttagttaaagttgaaaatagagagatgtatctgtatccgatagcaggaactagaaagcggtattcaactcgtaaaacagaagaagagataattgacgaattaaaaagtgatgagaaggaaagagctgagcatattatgctggtggatttagcacgtaatgaaattggaagagttagtaaatatggaacagttaaagttaaagagttaatgggaattgaaaaatactctcacgttattcatatggtttccatagttcagggtactcttcaacacggaaaagacgcgatagacgctctaaagtctagctttcctgcaggaacagtaactggagcgccaaaaattcgagcaatggaaattatatcggagatggaaaacgtgcaacgggagttttattctggtggtatggtttttcatgattttacagggaatttaaaatcatcaattattattagatcggtgttgatccaagatgggtatgcatatacgcaagctgcagccggagtggtttatgactctattcctgaaaatgaatttaaagagacgactaataaaatgcaggcatgtctacaagcgctagcagctttagaacagg

SEQ ID NO: 4909 - DNA, 1008 bp, Bacillus clausii
atggaatatatgttagtccaaaatgtatttaaagaagaaggattaaatactgatttaaatgaacttttttacagaaagaaaaggttattagagcaatacactcaactattaaaagatgggcaaaagtatattactgaagaaaaagataagctttttgtgaatactaaattgaactatcaagaaagtatttcaaaaaaagaatatatagagaaagtttcggaatgtaaggagtatattatagagggtgatatatttcaaattcagttatcaagaagattaaaaacgaagttcaatcacagtccaattgaattctatttcaagttaaaggagattaatccatctccctatatgttttttatgaaatttgaggataaatttttaataggagcttcacctgaattgttagttaaagttgaaaatagagagatgtatctgtatccgatagcaggaactagaaagcggtattcaactcgtaaaacagaagaagagataattgacgaattaaaaagtgatgagaaggaaagagctgagcatattatgctggtggatttagcacgtaatgaaattggaagagttagtaaatatggaacagttaaagttaaagagttaatgggaattgaaaaatactctcacgttattcatatggtttccatagttcagggtactcttcaacacggaaaagacgcgatagacgctctaaagtctagctttcctgcaggaacagtaactggagcgccaaaaattcgagcaatggaaattatatcggagatggaaaacgtgcaacgggagttttattctggtggtatggtttttcatgattttacagggaatttaaaatcatcaattattattagatcggtgttgatccaagatgggtatgcatatacgcaagctgcagccggagtggtttatgactctattcctgaaaatgaatttaaagagacgactaataaaatgcaggcatgtctacaagcgctagcagctttagaacaggagggagttcaatga

SEQ ID NO: 4910 - DNA, 693 bp, Bacillus clausii
  misc_feature (1)...(693): n = A,T,C or G
aaacaatacgattgacgactgcacaagcgctagtgaagttcttaaatgcccaatatttgcatgctgacgggaaagaggagcctttcgttgaagggatttttacgatcttcgggacatgnaaatgtgttaagggattggccaagcactagagcaagatgccgggcgattaaacggtatggcaaggcaaaaatgancaagggatggcccatgcggcaatggcttttagcaagcagatgctccgcaaaaaaatatatgcagtgacaacttctgtaggcccaggagccgcgaaccttgttgcagctgctggcacagcgctagctaacaatatacctgttttgcttcttcctgccgatacattcgcgactcgccagcctgacccagttttgcagcaatttgaacaagaatacagccaagcagtgacgacaaatgatgcattaaagccggtgtcgagatactgggaccggattactcgcccagagcagttaatgtcgagccttattcgtgcctttgaagtcatgacagacccaggaaaagcggggcccgcgacgatttgcatcgcccaagatgtcgaaggagaagcatatgagtatccagaggagtttttcagaaagcgcattcattatttagaacgtagaaagccaacggagcgggaaatcgaagaggcacttgaacggattcgtaggagcaagcggc

SEQ ID NO: 4911 - DNA, 177 bp, Bacillus clausii; identical to SEQ ID NO: 4905
  misc_feature (1)...(177): n = A,T,C or G

SEQ ID NO: 4912 - DNA, 765 bp, Bacillus clausii
taaacggagctgtcgttgcaaaagagcaggccgccatttctgcgtttgaccatggttttttatatggcattggtctgtttgagacttttgctgctgataaaaacggtgtgtttttgctcgaagcgcatattgaacgtcttttaaaaggcttggaatcagtcggcattgcctactcattgacaaaagaacgggcgcttgaaaccatctatacattgcttgaagcaaaccagctcgatgaagggtatgtccgctggaatgtatcagctggcatgcgcgagattggcttattttcagatcgctatgaggcgccaacggaaatcgtgtatatgaagccattgcctaaaaagccgcttcgcaaagaagccgttgttttacacactgttcgcaacacgcctgaagggggcgtacggctaaaatcacatcattatttaaataatgtcctcgccaaacaagagctaaaacagtccccccatgctgaaggcatttttttaacaaaagaaaggtatgtagcagaaggcattgtctccaatctattttggataaaaggcgatgtcgtcttcacaccctcgttagaaacgggcatcttaggcggagtaacgagaagctttgtgatcaaacaattacaaagtgtagggcatgaagtgcgcgtaggcttatttaaagcggaagctattcataaagccgatgccctttttctcacgaattcaattcaaggcgtcgtgcctgttacaaaattggacggccgggagctggaaatcggctcgc

SEQ ID NO: 4913 - DNA, 840 bp, Bacillus clausii
atgttcctcagtataaacggagctgtcgttgcaaaagagcaggccgccatttctgcgtttgaccatggttttttatatggcattggtctgtttgagacttttgctgctgataaaaacggtgtgtttttgctcgaagcgcatattgaacgtcttttaaaaggcttggaatcagtcggcattgcctactcattgacaaaagaacgggcgcttgaaaccatctatacattgcttgaagcaaaccagctcgatgaagggtatgtccgctggaatgtatcagctggcatgcgcgagattggcttattttcagatcgctatgaggcgccaacggaaatcgtgtatatgaagccattgcctaaaaagccgcttcgcaaagaagccgttgttttacacactgttcgcaacacgcctgaagggggcgtacggctaaaatcacatcattatttaaataatgtcctcgccaaacaagagctaaaacagtccccccatgctgaaggcatttttttaacaaaagaaaggtatgtagcagaaggcattgtctccaatctattttggataaaaggcgatgtcgtcttcacaccctcgttagaaacgggcatcttaggcggagtaacgagaagctttgtgatcaaacaattacaaagtgtagggcatgaagtgcgcgtaggcttatttaaagcggaagctattcataaagccgatgccctttttctcacgaattcaattcaaggcgtcgtgcctgttacaaaattggacggccgggagctggaaatcggctcgcttgtgccggtcattgctgccaattacacacatgcagcgaatggaggaagcaaaacaacatga

SEQ ID NO: 4914 - DNA, 546 bp, Bacillus clausii
ttggggaaaattagtgatttaaaaatagtagtctctcgaaatgatgaaatcagtatagcgcaactttctttattaaatcctgagtacattattatctcgcctggtccaaagcgcccaaaagatgcagggatatcgaaggacattatttcgagctttaaaggtcggatccccatactaggagtttgtctaggtcaccaagctatagctgaagtatttggcagtgaaatagtgaaagccactgagcccaaacacgggaaagtttctttaataagacataacaatgatttgttatttcaaggagttgctaacaatttcaaagcaacgcgttatcattctttagtaataaatcaagataatttatcagacaatatcgaggtattggcgtattcaaaagatgataatgaaataatggctattaagcataaagtttcccaatctatgggttacaatttcatccagaaatcgatctatactttagaaggattaaggctgatggataattttttacgcattacgaaaaaaaatgcagctccactgataagctaa

SEQ ID NO: 4915 - DNA, 513 bp, Bacillus clausii
ttgacttctataagccgctggccaagaaaaccgtgacagacaaaaaagttgctcgatttggcaaaatcgttacggtcattgtgggaggattatcaattgttattgcgccattgatttcttttgctccggcagggttattccatgtcgtccaacagtttaatgggttgtatagcatgcctttgctggcgatcattattcttggcttctattccaaatacgcgactgcctttgctgtgaaagtgacgtttgccttccatgttgttgcctatacagcaagccaggtgttcttagatatccattatctttatgtatttagcgcgatgtttttcattgatttgtttcttttatgggcgttaagccgtcttaagccattgcaggttccgtttgaattgacagaagcaacaaacaaagttgatttgacaccttggaaaccccgccattgggtaagtgccttcgttattttaacggttttaggaacgtatttgttgttttcaccatggggaatagctaaat

SEQ ID NO: 4916 - DNA, 447 bp, Bacillus clausii
  misc_feature (1)...(447): n = A,T,C or G
atgcggcgaaacggacaaagacagcaagtgaattttatacagctggaggcggtttgactggctggcaaaacgggcttgcgattgcaggcgattacttgtctgcagcctcgtttttagggatagcaggtgccattgctttgtttggctttgacgggttcttttacagcattggctatttagttgcctacttggtcgtaatgtttgttgttgcagaaccactccgaaacttagggaaatatacgcttgccgacatgatccattctcgttttgatggcgagggaaaggtccgcggtgttgctgcagggagcacgattacaatcgtggatcttctacatggatcgcccaattggttgggagctggagcgctcattcaattgntggttcaaattccatatacataccgctgtgctggttagtagggcgttatgatgaccatttatgtggttg

SEQ ID NO: 4917 - DNA, 663 bp, Bacillus clausii
gcagccggtttttgcgcggcgctattttcttaatggctacttcggcaatcgggcctgcttttttaacgcagactgcgagctttacggaaacataccttgctagttttgcatttgcgattttattgtcgctccttattgacatcggtgtgcaaatgaatatttggcgcgtgatttcggtttcaggcaagcgtggacaagaaatagcaaacaacttgttgcctgggcttggttatgtcattgccggtttaattttgttcggcggttttgcttttaacattgccaatattggcggtgccgctttagggttaaatgttctttttaacttgcctttaagtgtaggcggcctcattgccgcggcattaacaatcgggctatttttagttaagcgctttggcccgattatggaccgtgtcatgcaaatatgtggtgtagtgatgcttgtcatggttggttttgttatggtacggacaagccctccttatcaagaagcgcttataaaggcatttgtacccgatgacgctttggcgctgctattgccaattgtgacgattgttggcgggacggtcggaggctatatttcttttgccggcgggcaccggcttattgatgcccggatcactgggaaaaagaaaaacgttcactttgtccggcaaggggcaagca

SEQ ID NO: 4918 - DNA, 957 bp, Bacillus clausii
  misc_feature (1)...(957): n = A,T,C or G
agtgataggttactatggctataaaaaaacagtaagccattccgattatacgctcggtggcagaggtctttcgccaacagtagcagcgttgagcgcaggcgcctctgatatgagtggttggttaatgttggctttgcctggttcgatgtatttgacaggcattggcgccggctggctggcatttggcttaattttaggcgcttatttaaactgggtttttcttgctccgaggttgcgcacttatncagaaacggcgaatgattcgattaccattccagcctttctacaaaaccgatttaatgacacatccaaactattgcgcatgctgtcaagtttgattatcattggcttttttacgctttatgtttcgtcaggcatggtatcgggcggcgtcctgttcgagtcggtgcttggaattgagtaccggacagggcttttgattgtggcaggagtgacgattgcgtacacgctgtttggcggttttttagcagtgagctggacagatgttgtccaaggcggcgtcatgatgttggcgttattgcttgtgccagcttttgcactggctgaggttggcggggtttcaagcacctttacgcaaatccgcgacatcgatccgtttttaatggacattttccgtggcgtgtcggttattggcattatagggtcccttgcttgggggcttggttatttcgggcagccacatatcattgtccggtttatggcgctaaggacggcgaaagaggcaaaaccggcgcggcgcattggcatgacttggatgggattgtctattgttggcgccatgtttactggccttgtcggaagagcttatttaacaggggaaggggttttcttagagacagcagaagcgtcggaaacggtctttgttgtcatgggcgatatgctgtttcacccatatgtcattggctttatttttagcgccatacttgctgccgtaat

SEQ ID NO: 4919 - DNA, 324 bp, Bacillus clausii
ttacctcatttataatgatcgtcggatcaatttggctattcgcttacaaacgaagccgcaatgtcgacctttcgagctcataagggtactttttaggcgggcggagtttgaccggcttgacgattgccggttcagtgattatgaccaatttatctacagagcaaattgttggtcaaaacggacaaagctatgtggccggcatggaagtcatggcttgggaggtaacagctgcgattgcgatcgtcacacttgcattagtgtttttgccaaaatacttaaaatatggtgttgacacggtgaccgattttattgaacggcgctatt

SEQ ID NO: 4920 - DNA, 1269 bp, Bacillus clausii
atgacgatcattattggcatgtatttgctaatcgcgccgcgcctttatgtattgtccaaacgttttcaatttatcacacccgctgattggatcacacaccggttccgctcaaaaagcgtcacgcttctcgctgttgccttaatgctttgggcgctttgcaactatttgcttgagcagcttgttgccatcggccatgcggttgccggcctaactggcggggcgattccgtatgaatatgcagtgatcgggtttattcttgtcatgcttgcttatgaatggatgggcggcatgaaggcagttgcctataccgatgtcctacaaggcctgtccttattagttggcatcattatcttgctaattggcgccctcacattgacaggtggcaacttcgcggaaatgacacaagatttagcaaacaccgttccagagaaaataggcgtccctgacacgatcacatcgatcaactggctaagcatgattgtgctgatcgggtttggtgcgatcatctatccccatgcgattcagcgaatttattcttccaaaagcgaacggacgttaaaacggtcgctggcaagaatggcgtggatgccgccagttacaactggttttgtgttcatcgtcggcattatttgcctttccctgtatccgaatctcgatgttgcccagtccgaacagctgattggcatccttgccaatgatgtagcagccttaaacagcatctattattgggcaatggtcatttttttcggggcgatcgtatcagccatcatctcaaccgccgattcggctttgcttagcttttcttcgatcatttccaaagatatttatggcgaatacataaaccgtaaagcaacagaagcacaaaaagtaaaagtaggcaaagttgccggtgtaatcgctgttgccttgctgctatggattgcttggaaccctccaggaacgttgtaccaaatattcgtcttgaaattcgaattgcttgttcaagtgttcccggcatttgggcttggcctctactggaagaagcttgcccctaaacctgattttatcggcatgttagctggagcgctcctcgccgggctgatgacactcacaggcaacaacaccttttacggtattcacggcggcgtgcttggacttgctttaaatgtctccatttgtgtgatcggttcactaatcgcgccagcttctcatgaagaacaagagaaagccatcgcacgaacggaattaaaagtcgcggacttccgtgacaaaaaagcaacagtcggataa

SEQ ID NO: 4921 - DNA, 303 bp, Bacillus clausii
ccgccattagttctgtcattggctgtgcgtacacaagcatttcatttttacgttcattccatccccttttctctaaatataatagcgtgtttattgccggatttattgcaatctcggctagcatttttttaacgatcggtcagccggttacgttattgatcgtagctggtgccttaaatggattgattttgccaatcgtattgacgacaatcttaattgcctctcgcaaaaaagaaattgtcggcgactatcatcatccaacgccattattggttttcggggtggttaccgtacttgttactg

SEQ ID NO: 4922 - DNA, 398 bp, Bacillus clausii
caggcagtgatgcgttttattaatttacgtcatgccatttatgctgcttgtgaacctgatttaaagcatactggctgtgtcgtcgtttttaacgagcggatttttgcagcccgttatgtcaaaaaagagcatgcctccaatttgcaagggtttaatgcctttggtttcggctatttaggaattatagacaacgatgtgatttttacgtatcaaaagcctgttcgccgggagttttatgaaattggcgatactcctcttaaacaaattggcattgctaaagtttatttaggcatgagcgcagacatgctggaagggatgattgctgtatgcgatgggatggtggttgaaggcgttggccgcggccaagttcctccaaacctagtagctacgttggaccg

SEQ ID NO: 4923 - DNA, 633 bp, Bacillus clausii
ttggcagggctttcagaagaaaaaggcgcgacgggttatttaatcctgcccccctacttgattaacggcgaaccaaaacggtctacgcgcttatttgtcagcaattattgaatcaacttcccttcatgcgattgtttaccagcgtgataacgctgtattagaaggggatacacttgaatcgctgctcgtctacccacagttagtcggattaaaagatggcatcggcaatatggagcaaaacattgaattcactcagcgatttggcgagcggttgctatggctaaacggcatgccgatggcagaattaacgatgcctgcttattggcccattggcttccactcgtattcatcggcgatatctaattacattccacacatttctagatgcttttttgaagctttaaaacgcggcgatcatgaggctgttcgcaccctttataaggatgtccttctgccaattaatgtgattcgccgccagaaaaaaggctatgcggtttcattaattaaagccggaatggagatcgttggcttgcctgttcaagagcatgtccgtgccccgcttgtgcctgtcgaaaaaagccattacaagcagctggcgcagattttagaaaacgctcacaaaaagtacccacg

SEQ ID NO: 4924 - DNA, 312 bp, Bacillus clausii
  misc_feature (1)...(312): n = A,T,C or G
atttaagtacactgattgccagtacatccttaaatgcaattgtttaccatcgcgataactgccaattaaatttggacatccttcagcgtttaatcgantaccctcagttggtcggttttaaagatggaattggcaataatgaattaaataatgagnttacccatgttattggcgatcggctggaatggatcaacggtatgccgctggcagaagcgacaatggcttcctatgtcaatcttggattccggtcatattcttcagccatttcgaattatattcctcatatttcncaaattttttacgatgcccttt

SEQ ID NO: 4925 - DNA, 380 bp, Bacillus clausii
cacttgttacgttttttgatgaaaatggctcagtagataaagaaacgaatttccgactaattgatattctgattgaaaaagaggtagatggacttctcttattagggagcagcggtgagttcacttcaatgacgcaccaacaaaagagcgattatattgatcatgtcatcccctatatcaacaagcgggttaagtgtatggtaaatgtcggaagcaatgttgttgaagaggcggtagatttagcgataaaagctgaaaaagcaggagcggatgcagttttaattgttaatcccttttattggccattaagtgaagcacaactgatcgattatttcagcgaaattattcaatccattaaaatggatgcctatctctataat

SEQ ID NO: 4926 - DNA, 576 bp, Bacillus clausii
gccaatcccgcgccaatcatggggctacgatgaagcgcaagaaagcttagcgccttcctatgacccagaagcagcaaaagagcttttggccgaagcaggttatcctgatggctttgataccgaaatttacgtggccgaaagccgcgtcccatacgcgacgatcttccaaaaccaaatggcagagatcggcgttaatgtaacgatcaatacagtggaatggggcacttattccgacatcgtctctaaaggccaagcaccaatgtcaattggcggttggacctggtatcctgaccctgatttctatttgtaccagctgttccatagcgaccaaattggcgcgctcggaaacggaaaaggctacaaaaatgaggaagtcgatgcgttgctcacaaaagcgacatcggaaacagatgatcaagaagaacgtgccgctatttaccaggaagcacttgaactcattatggccgatgtcccacggatcgaactcgataatacggaaacagcggctggcgtttcctcccgcgtacatggctttcacgtcagcccagacggttctatccgcatcgttacgcctta

SEQ ID NO: 4927 - DNA, 408 bp, Bacillus clausii
  misc_feature (1)...(408): n = A,T,C or G
atgacagcggaagatgtaaaatntggtttggaacgttcagcgaacgaatcggctttaaaccgcctccgtatggtagaagaagttgaagtcattaacgacacagaagtcaagcttatattaaacgcaccaaactctgccttattggctgttttaaccgatgcaggcaatgtgattgttccaaaagaagaagtggaaggccacggggatagctttggctcacacttggtcngaacaggcccttttacactggaacaatggcaacaagaccaaatggtgaagctagaacgccatgaaaattactggggggagacacctaatttagcccagttaaactttcaaatcattcctgacccgactatgatgacaaattccttgcgttcaggcgatattgatatcgccactgattga

SEQ ID NO: 4928 - DNA, 612 bp, Bacillus clausii
atgttggcgtacgcgatccgccgggttcttttgcttataccggttctctttggcatgacgcttgtgacattttcgattatccagctcattcctgggaacccagcgcaaacgattttaggggaacaagcaacgccgcaagcaattgcagcacttgaagagcagcttggcttaaatgagccgttttgggtgcaatatggcgtttacatatccgatttgctatcaggcgacttaggggtttcccttaggacgaataatgacattgcccaagaaatgtggccgtatttggccggaacattagagttaacggtttttgcgatgttgtttgcgatttttgttggcgtcaacgccggaattattagcgcctggaagcaaaactcgatttttgactatacaagcatggttatcgcactgattggcgtttccatgcccgtcttctggctcgcattaatggaacaatggttttttgcccaggagcttggctggtttccagcttttggccgcaacaatcctcgtgaaccggttgaagcgatcacacatctgtatattttagatgcagcattgactgggaattggcagcaattggggacgacgctcaaacacttagtcttgcca

SEQ ID NO: 4929 - DNA, 387 bp, Bacillus clausii
gcatttcagtgcggctccacctccttccttatcacgagcttcaacaattagaactagaacaaaaagcagaccttttgctcggcgagcagcttggctacgatgacaaagtgtatagctatttttcagcgttttttgatcgccaccggtttctttattcccacttgggtacagacgatttggaaaaagccgagcgtttatggcatcaggaattaaaaacaaaaacattgctggctagcttacaatcaatcgaaacatcgctttgccaagcacattatctcctccccctctaccggttaaagcaatttgcgttgtatccagaatacgttaaaaacgtggctttaaatgcttatggctgggtcgattatacaacgatttggctgaaacgcg

SEQ ID NO: 4930 - DNA, 339 bp, Bacillus clausii
atggaaggatctctggtacaaggcgggcgtgtcgactcgaccatgatgcgatcgttgaaattttgtacggcttaccttacttgctagttgtcatactgcttatggttattatgggcccaggtttgctcacgattattatcgctttgactgtaaccgggtgggtcggaatggcccgaattgtccgcggtcaagtgctgtcattaaaacaaaatgaatatgtgcttgtttcaaaagtatttggcggaagcacttcgcatattattcgaaagagccttctgccgaatacaatggggccgatcatcatccaaatgacgttgactatcccctcagcgattttcg

SEQ ID NO: 4931 - DNA, 864 bp, Bacillus clausii
aaacgttgattttattgggaaaattgacttagcttatacgtatattggcttccaaatgggtacatgggatgaagaagaaaataaaaatgtgatggatcctgacaagcaagtgtctgacgtcaacttgcgtaaagccatggcccacgccgttgacaacaatgctgttggcgaacgtttttataatgggtttagatgggctggtacaacattgataccgccatcgcacccaactttccataacgacgaattagaaggttttgcatacgacgtagagcttgcaaaccaaattttagatgacgctggttatgaagatgttgatggtgatgggctccgtgaagatccaaatggggaaaaactgcaattaaactttgcgtctatgagcggtggcgacactgctgaaccacttggtcagtactatattacccaatggaaaaacattggcattgatgtccagcttttagacggaaggttacaagaatttaatacgttctatgaccgcttaaaagcatctgatcaagacattgatgtttatcaaggtgcttggggtgtaggctcagatgccgacccatatggcctttggggtagcacagccgcctttaactacactcgctggaccaatgaagagagcgaccgcttattaaaagaagggacatcagaagcagcgcttgatatggaataccgccaagaagtctataatgaatggcaggaactcatgcttgaagaagtccctgcgtttccgacgctctaccgttcagaaatgcatgcggtgaacaagcgtgtcgttaactattctgagcttcctggatctgaattttacaatgatcgctcacaaatcggcttaacagccgaagaaccagaaacggc

SEQ ID NO: 4932 - DNA, 582 bp, Bacillus clausii
gcaaccgagtttggccacagactggaaaatgctcgatgagttaacgtgggaattctctttaagagaagacgtcgtttttcatgatggaaatgtgtttgatgcagaggctgtaaaagcaaatttcgaacgcaatctagcggaggaaacagcgtctccgactgcatacttgtttcaagctgtcgaagaagtagaagtcattgatccagctaccgtccgctttcatttaaacgctccgtttgcttcattgccagcgcatttatcacaccacggagcttctatcattagtcctgaagtgatagccgaggacaacgaagcagttgccaacggagaagcaccagggtctgtcgtaagcgaaaagccaattggcacaggccctttccaatttgaatcttggacacctgacgaagagcttgtcctcatagcaaatgatgattattggggtggtgccccgcaagtagctggcgttcgtttcaccgtcattccagacgctgctacacgtttagccaatctacaatcaggcaattccgacgttattgatgccgtttcgccaagtagcatggccgaaatcgaagaaaactcaga

SEQ ID NO: 4933 - DNA, 540 bp, Bacillus clausii
agccgattttggaagtaaagcagttaaaaacgtatttttctattaatgggggcatattttccagaaaaatcggagaagtgaaagcagtagacggagtgacattttcggtcagggaaggcgaaattttaggaattgttggcgaatcaggctgcggaaagtcgacgacggggaagtcgattttgcgcttaatcgagccgacggaaggggaagtcgtttttaacggtcaaaaagtgacggctttgtctgctgaagatgtacgaaaattgcgccgagatatgcaaatgattttccaagatccatatgcttccctgaatccacggcacacagttgaaaaaatcataagcgagcctttaaacgtacatggcattggcacgaaggaagaacgaaaacagaaagtcgcagagcttttagaaacggtgggcttgcgtccagaacatgcaaagcgttaccctcatcagtttagcggcggccagcgccaacggattggtattgccagggcgctcgcggtaaacccaaaacttgtgatttgcgatgagccag

SEQ ID NO: 4934 - DNA, 573 bp, Bacillus clausii
tcattatatgtgatgaggctgtctctgcccttgacgtctcgatccaagcgcaaattttaaaattgctcaagtccctgcaaacatcatatgggctctcttatatttttattgcccatggattgccgactgtgaaacagcttagcaaccgtgtcgcgattatgcataaaggcaagattgtcgagatcggagaaacaaacgacattttccagtccccaacacacacttatacaaaatcactgttaaaagccgtgccgccctctcatcctagagacaggcacaaaccatctattggaggataaaacatgaaaaaaccagtttcttttataactatttctgctgttacactggcgctccttgcttcctgcggttttgaagatcctgatgcaaacgatacaaccaatgacgatacagcgtctggcaatggccagctgacgattgccaaccctgccgacatcactacgtttgaccctcataataatagcgtcattacgacttcggctgtactcgtaaatgtatacagtaagttgttaaaacgggatgaagcaggagaaatcattcctgagttggcggaga

SEQ ID NO: 4935 - DNA, 951 bp, Bacillus clausii
atgtttaagtttttagtccgcagattgctccagctcatacctgttatcatcggggtaacattaattgttttttcattaatgcattttattcctggcgaccccgctcaagtacttgcaggcgaatcggctacgcctcaacaaattgaagccattaatgaaagactcggtctgaatgacccttatcccgtccaatattttcgttatatgaccaacttagttcaattcgatttagggaattctttacggaatggacagcctgtttctgatttaattctccagcgaataggcataacactcgaactttcgatatacagtacgattctcagtattttccttggcttgattgcaggtgtcttgtctgcaacaaagcgtggttcattccgtgattctgcgattatggtgttggctttgtttgggatgtccatgccaaacttttggctaggccttgtgctgatccaatggttcgcattaggcaacatcccatttatcggaaaatttatcgatacggcttggtttcctccttctgggtggggcagctttgaacaacttgtactacctgtatttatgcttggaatttcaggggcagcgattgttgcccggatgactcgttccagcatgctagaggttattaaccaagactatattcgcacggcccgtgccaaaggggttagggagcggattgttatatatcaacatgctttaaaaaacgcgttaattccagttattaccgtagttggtttgagctttggcagcttgcttggcggcgccgttcttgccgagagcgtgtttgccattaacggaatgggcaggctgatttacgacgcgattaacaaccgtgactttcctgtcatgcaaggtggcattttagttgcttcgcttttattcgtccttgttaacttgcttgtagacattgcctatcgattcgtaaacaaacgggttgaaactgaataa

SEQ ID NO: 4936 - DNA, 636 bp, Bacillus clausii
  misc_feature (1)...(636): n = A,T,C or G
nattcaaccaagcttggcgacaagccttgaacaantngaagatgatgtctgggaagcaaagttgcgtgaagacgtgacattccacgacggcagtgaatttaatgctgaagttgttaaagccaacttggaccgtgttcgcgacccagatctaggttcccctgttgcgtttttgtttgataaaatcaccgatgtcgaagtcatcgatgagtacacggttcatatccatacagacggcccattttcgccgcttccttcccatttagcccatccagctggtggaatgattagcaaagaagcgattgatgctgattatgaagcaatcgaaaacggcgaacctgctttttcatacgtagatgcacatccgatcggcactggtttttttgaattggacagccgtacatcaggcgaatcggtctctgtaacccggaatgaagattactgggacaaggacaaccttgccaaagcaagcggaattacttttaaaacggttccagaggaagcaacgcgaattgctgagttgcaaggcgatgtagcggatcttatttaccctgttaacccgagcagcatttcggaaatcgagtctgccgaaaacacgactgtgaaacaatctccaagctcgaacttgacttatctagg

SEQ ID NO: 4937 - DNA, 471 bp, Bacillus clausii
tcttgctccaggagacgcgctgagtggagaagtgattgacccaaatacgccacgagaagtgattgaggaacgccgggaagaattaggattgaacgatccggtacatattcaatattggaactggctcaaacgggcagtgacaggcgatttagggatgtcgactcatttcaccggtaggtctgtcagcgagctaatcgggcaacggctcggcaatacattctatttaggcgcatttgcgcttttaattacactcattgtgtcgattccaattggtatttattctgcacgtaaaaaatattctgttttagattatgcggcgacgtcatttgcctttattggcctagcgacgccaaacttttttgccggattgctggcgatttatgtgttttcttttgggcttggctggtttccaacgcaaggttcgatcggttcccctaatttaacgggatttgacgcttttgtgagccggat

SEQ ID NO: 4938 - DNA, 177 bp, Bacillus clausii
taaagacattcaaatgatctttcaagatccttattcttctctgaaccctaaaaagcgagttttagacattatcgcagagccgttgcgaaattttcaaaaaatgacaaaggccgaggaacaaaaaaacgtcgaagaattgctggaaaaagtgggattaagtcgtgaaagtatcgttaa

SEQ ID NO: 4939 - DNA, 309 bp, Bacillus clausii
cacgtggggaaccgtaaccgtcgatgccgattatggcttgtatccgatgttccattcatccaactttggcgcccctggcaacagaacgttctttgccaatgagcaattagacgatttgctagagcaagcgcgtaaagagacggatgaacagaagcgtttggccctttatgaagaagcgcaaaatgtgttggccgaagaagcgccagtcgtcaatttgtaccactctgtgttattggccggcatgggcgatgacattgaagggttctggcaatatccagcaagtattttctatttacgtgatacggaaaa

SEQ ID NO: 4940 - DNA, 273 bp, Bacillus clausii
gtagaattgtggagattgcacagaaagactctttgtatgatacaccgcttcacccttacacggaagcacttatatccgctgtgccttcaaccgatgtcacagttaaaaaagagaagatttccttgaagggagaattgccaagtccggcgaatccaccaaaaggctgtgcgttccatacacgttgcccacatgcttacgaacgttgcaaacacgaacgcccagaaatgacggagcaaaaggccggccattttgttgcctgccatctttatacgg

SEQ ID NO: 4941 - DNA, 657 bp, Bacillus clausii
taaaggcagcagcaagaggtcgtcgctctggaaagaagtgggcaggcgttttatcaaaaagagaatggcgttgtttggcttaattgtcctcatcattgtttttttatttagctttgtcggcccgtttttttctccttataccacggttggcacgaatacgcaggcgattcatcaagctcctagtttttctcattggttaggaacggatcatttaggccgcgatgtgctgactcgtttgatgttggctgggcgcatttcgctgacagtcggacttggcgccatggcattggcagtgacgattggcggcattctcgggattttggctggttattacagggggattgtcgatcaagtcattatgagactagccgatgtattaatgacattgcctggcttgccgttgttgtttattatggcggctgttatgtctgagtggcgggtgccagcggaacaacggctctatatcgtcatggtcatgttaagcctcgtaaattggccaggcttggcacgcctcgtgcgaagccaagtacttagcttaagggaacgggaatttatgcaagcgacagaggcgctaggtttaagagacagaagaaaagtgtttaaccacttgctgccgaatgtcgtccctttattaatcgtaacggcgacgttaagcgt

SEQ ID NO: 4942 - DNA, 768 bp, Bacillus clausii
atggcgtcgccgatccccgcgtccgtgttaagtaggaaggaggacagcatggaacagcaaccaaatattcgctcaacgactcattttcttaaaggcagcagcaagaggtcgtcgctctggaaagaagtgggcaggcgttttatcaaaaagagaatggcgttgtttggcttaattgtcctcatcattgtttttttatttagctttgtcggcccgtttttttctccttataccacggttggcacgaatacgcaggcgattcatcaagctcctagtttttctcattggttaggaacggatcatttaggccgcgatgtgctgactcgtttgatgttggctgggcgcatttcgctgacagtcggacttggcgccatggcattggcagtgacgattggcggcattctcgggattttggctggttattacagggggattgtcgatcaagtcattatgagactagccgatgtattaatgacattgcctggcttgccgttgttgtttattatggcggctgttatgtctgagtggcgggtgccagcggaacaacggctctatatcgtcatggtcatgttaagcctcgtaaattggccaggcttggcacgcctcgtgcgaagccaagtacttagcttaagggaacgggaatttatgcaagcgacagaggcgctaggtttaagagacagaagaaaagtgtttaaccacttgctgccgaatgtcgtccctttattaatcgtaacggcgacgttaagcgtaggccggagcgatcttaagtga

SEQ ID NO: 4943 - DNA, 441 bp, Bacillus clausii
ttattttatcaaacggctattgtacttaatcccaacgttaattggggcatcgatcttgatcttctttttgtactccatgatccctggcaatttcattgactccgatccgaatttgactgctgaacgaaaagcagagttatacgcgctgtatgggtttgaccaaccgacgatcattcgctattttgtgtggattggaaacctgttgaaaggggatctaggttattcgcttcaattccagcgtcctgtcagtgaggtgcttggcaattacatatggagctcgtttattgtcgccggggcgtcgctcattcttacatgggggatcgctctaattgttggcgtcgtttccgcgaccaagcagtactctttctatgacgcggctgttactgttcttgtttttgcggcgatggccacgccgtccttttttctcggcttgattgtgat

SEQ ID NO: 4944 - DNA, 585 bp, Bacillus clausii
aggatacgcacagctagccaatgtcccggtatcgcctatatcgtgggcctatacagatgaagtagaggcgtttccatatgaccctgaagaagcgaagcggcttctagacgaggcgggatggaaggaagggcctgacggcataagagagaaagatgggcagaagttaaccgtctatttctttacaacggatggcagcggcagcaatgatattttcgtaacgcttgcgcaagaaaactataaagacattggcgtcgatttccaaattgaacaaatggattttaatgcgttgctggcacgtgtcgacaacggcgatcatgatctcgtgtctttctcgacaacgatgcagccagatccgcatatcggcgtgcaagcatttcattcaagccatactggcaatacatttagagggtatcaaaatgaggaaatcgatcgtttgatagaagcttccgtagctgtaagtgatcttgacgcgagggcggaggcctaccatgagctttatgaaaagttaaaagaagatccgccgatcattcttctcaattacaacaaatcgcttgcagcaaccaatgcacgagtagaaggatttga

SEQ ID NO: 4945 - DNA, 327 bp, Bacillus clausii
gttatatgtgtgaccggattgctgtcatgtatttagggaaaatcgtggaaatgggcacatatgaacaaatttatcatcacccgaaacatccttatacgaaagcgctgttgtcagctgtaccgaaagaaagcccatttgaacaaaaacagagaacgattttatcaggcgatgtgcctagcccggtcaatccgccgccaggatgccccttccacaagcgttgcccagaggcgatgccgtcttgccaggaagtggttcctacgctcattaaacaaacgaatggccagcaagtcgcttgccatttgatgaacgacaccgaggaggaagcaa

SEQ ID NO: 4946 - DNA, 528 bp, Bacillus clausii
  misc_feature (1)...(528): n = A,T,C or G
ttttagtgactgaagagccgttccnaaatcaaaaaatccgccaagcatttgccaaagcagttgaccgccaggcgatagttgatagcgtcattcgccaaaaccaggaacctgcaggggcatttgtttcctacggatttaccgaacctgacggcggtgatttccgtgaatcaggcggcgatttgcttgagtatgacccagacgaagcaaaagcattgcttgaagaagggatggcggaagaaggctattcagaattacctcctgttacgctttcatatagctcaggagtggatgagcatcagcgcattgctgaaacactccaacaaatgtatgaagaaaacttaggagtttccgttgacctagcagtcgttgaatcaagtgttttcctagatcagcaacgcaatttagaactgcaaatgtcccggtcttcgtttatcgctgactacgctgatccagtcaacttccttgaaagttttgtcacaggtagctctatgaaccgaactggttgggagaacgaagagtatgatcggt

SEQ ID NO: 4947 - DNA, 597 bp, Bacillus clausii
caaagaaccaagcgaggacgaaagcgcttgaactcatcaagcgagtcgggattgggcgagaagaacaagtgttgaaatcgtatccacatcaaatgagcggcggcatgctgcaacgaatcatgattgcgattgccctcgcttgtgagccaaaaatgctgattgccgatgaaccaacgacggcactcgatgttacgatccaagcgcaaattcttgaattgttaaaacaactgaaagacagtcaagggatgtcgatgttgttaattactcacgatttaggggttgtcgcggaagttgctgactatgtcgttgtgatgtatgcaggtaaaatcatcgaacaaggatcggtgcacgagattttctttaacccgaagcacccttatacgaaagggttgctccaagcgaagcctgtcatcgggcaaaggaaaaagaaactttataccatcccagggcaagttccgcctttaattgatttgaaaccgtcttgctactttgctgatcgttgcggacattgcatggacatatgcctcgagcaagcaccctccctcattaatgatggcgatgaggaagaccatcgggtagcttgctggttatacgaga

SEQ ID NO: 4948 - DNA, 480 bp, Bacillus clausii
aaccagtcgtcatggaagtgaatcgattaaagaagtactatgagacaaaagcttcttttttaaatcgccaatcagagcttgtaaaggctgtcgatgatgttagtttcgccatccatgaaggggaaacgtttggtttagtcggtgaatcagggagcggcaagagcacgattgggaaatcgattcttaatttgcagccgttatcagcaggggaagtcgtttatagaggaaaaaatctccaccgtttaagcaaacaagaaatgagaaaggtaaggccccgtattcagtttgtgtttcaagatccattcagttcgttaaatccccgcttacgaattggcgatgctttagcagaaccgttattggatcacggcctcgcgacgaaaaaaacagtcaggcaaaaagtattggaaacgatggagctttgtgggctgccgtcttaccatgtgaataaattcccacatgaatttagtggcgggcaacggc

SEQ ID NO: 4949 - DNA, 861 bp, Bacillus clausii
  misc_feature (1)...(861): n = A,T,C or G
tgggcatcgcccgtgcagtcattatggagcctgattttattgttagccgatgaacccggtttcagcattagacgtttcgattcacagcacaaatccattaattttgtttaaagagcttcaagaaaagaaaaagttgggcctttctattcatctcccatgatttaagcgttgtggaacatttatgtgcgcgtattggcgtgctctacttaggatcaatgatggagctggccgacagagaccggttatacgagaacccattgcatccatacacaaaagcattgttatcagctttgcctgtccctgaccctacacacaaaaaagagagaattcttttaaaaggcgacatcccaaatccagcatcaccgccaactggttgcaagttccatacgaggtgtcctgttgcaaaagaacgttgtaagaaggaagtgcccgcttttagggaagcagagcaagggcatttcgttgcctgtcatttcgcttaaaagggagaaaaacaccctgccgctctatagcgctggcagggtgttcatgttggttagtcccctaagccaaacagctgcaaaaagcgttgccataagctcacgttttcttnggtgttgtcttcttccgtttgcgtttcctcaggcaatgttaggcgctctgtttgaaagacgaattggacgttttcaatgacgtcgttgttttctggcgagacgaaggaaaccggttcgaaatcggatttgtcatactgggaaagcatgtcgtcgatttcggcttgcatttgttctggcacgtctgctgttgcttccgccagctcttcggcgccatgatcgatttcttccatgccagatgacaactcagtcgacccttctgccgtttcgc

SEQ ID NO: 4950 - DNA, 951 bp, Bacillus clausii; identical to SEQ ID NO: 4935

SEQ ID NO: 4951 - DNA, 903 bp, Bacillus clausii
  misc_feature (1)...(903): n = A,T,C or G
atgtntgaaaaaggaagacncttggnattgttggggaatctggttctggtaaaagcattacgtccctatcaatattaaatttgctctcacatccaggaaaagtggtcggtggggagattttgtttaagggcgatgatttgttgaaaaaaacgcctgcgcaaatgcggaaaattcgcggcaacgaaatttcgatgattttccaagagccgatgacatcgttaaacccgacctttacagtcggccagcaaattagtgagtcttttcgcattcatgaacatttatccaaaaaacaagcacgcgctcgttccattgagatgttgaaactggttggcattccttctcctgagaaacggattgaccaatacccgtttgagctttcaggcggaatgcggcaacgtgtcatgattgcaatcgctcttgcgtgcaacccagacttgctcattgcggatgaaccgacaaccgcactcgatgtgacgattcaagcgcaaattcttgagttaattaaagacttgcaaaatcgccttggcatgtctgttatcatgattactcacgaccttggggttgtagcggagacatgcgacaacgtcgccgtaatgtacggtggacaagtcgtggagtacgcttctgtccatgacttgtttacaaaaccgcgccacccatatacagtcggccttatgcaatcgttgccgcgccatgatgaagacgtagaaggcgatttgtctattataaaaggttctgtgccagcgccagccgatatgccaaagggctgccgttttgcgcctcgctgcccatttgcaagcgacatttgcaaagagctgcctgaactcgaaacaaatgaagacggcagccaaatccgctgctggatttacacggataaatgggataagccggaggtgaatgtac

SEQ ID NO: 4952 - DNA, 683 bp, Bacillus clausii
tactaaaagttgaccatttaaagcagtatttcccgattaaagggggctttttagggcggacggtcaaccatgtcaaagcggttgatgacatttcgtttgaagtgaaagaaggcgaaacggtttcgattgtaggggaatccggctgcggaaagtctacaactggccgagcaattctccgacttgacgaaccgacttcaggaaaaatccagttccaaggcgaagatttgctttcactgaaccgcgcccaaatgcgtaaaaaacgcaaagacttgcaaattattttccaagatccttatgcatcaattaatccgcggcaaacggttcgccaagtgctgtcggaagcgatgaccatccaaggggttgcgcctgccaaagatcatgatcggcttattcgcgaactaatgaaaacggtcggtttaggcgaacaccaaattgatcgcttccctcacgaatttagtggcggccagcgtcaacgcgttggtatcgccagagctttggctgtcaatccaaaattgatcatttgcgacgaagccgtttccgcgcttgatgtatcgatccaagcacaagtaattaatttgctcaaaaaactgcagcgtgaactaaaattaacgtatttgtttatttcccatgacttaggcgttgtccgtcatatttcagaccgcgtcattgtcatgtatcttggc

SEQ ID NO: 4953 - DNA, 729 bp, Bacillus clausii
ttggcgagagcggctgcggcaagagcgtaacagcacaaagcatcatgggcctgttgccaaaagggagcgccgcgatcaaacaaggggaaattttatttaaagagcaagatttgacgaagctgcccgctaaaaaaatgcgccgtatccaagggaacgaaatttcgatgattttccaagacccgatgacttcgctcaacccatcattaacagtcgggacgcaattgactgaaggcatccgcaagcatacgtcaatttctgcaagcgaagctaatcataaagcgttggaaatgcttgaagtcgtgggcattgccaacgggaaagaacggctaaagcagtaccctcatgagtttagtggcgggatgaggcagcgactcatgattgcgatggcgcttatttgcaaaccggacattctcattgcggatgaaccaacaacggcgcttgatgttacgatccaagcacaaattttaaagctatttaaagacattcaacggcagacaggagtcgcgatcatgttaattacccatgatttgggggttgtcgctcagcttgctgaccgtgtgcatgtcatgtatgccggaaaaatcgttgaaacaagcaatcgtagagagttgttttataaccctcagcacccttatacaaaaggattgttacattcagttccccgcctagacggcagtgaagctgagcttgagccgattggcggaacgccgcctgatttatttgcacccg

SEQ ID NO: 4954 - DNA, 609 bp, Bacillus clausii
  misc_feature (1)...(609): n = A,T,C or G
aggcatctttacgccgcattttaatacaagtggctatgatggaaatgtgcaagcggtcatgtttccgccccttgttgacataaatgaaaagggggagccattcgggcggcttgcagaggattgggacatctcggaagatgaattaacgtatacatattatttacgggatgatctgaaatttgatgacggctcgcctcttactgccaatgatgttgcttttacggtaacgcttttgtttgaccctgattacccaggaacgacggatttgacagaaacgaacttggttggcggccttgattataaggaaggcgatgctgacagcattgcgggcattcatgtaattgacgatcaaacgattgagtttcagctagaacagccaaatgcgcgagcgttgactatgcttggcggcaccgtgcttagtgaaaactattatgggagagaaatacgaaaaaggcgatttgggattatatgagtgactatcatttaaagccacttggggcaggtccttttnaatttgangcgttccatcctgggagaagagatccgttctcgggccaatgagcattattataatggtaagccagaagtcgatacattggtgtaccgaac

SEQ ID NO: 4955 - DNA, 789 bp, Bacillus clausii
ggttggtcactgttttcctaatcgccgtacttgctatctttgcaccgtggattgttcctcacgatccttttcaaattgatgcgacacaacgcttaatcccgccagcatggatggaaaatggctccagcttgcactggctcggcaccgaccatttagggcgagatgtgctcagccgtcttatttacggaggacgtgtttccctttttgtcggcatcgtctccgttgtgattgctggtttcattggcctgacacttggccttgcctctggctatttaggcggttggctcgatgcactcatcatgcgctttgttgacgctatgcttgccattccaacgttgttgcttgtccttgtagcaatggtaatgcttgaaccgtcaattgccacactcattttgatcattggactgacaagttgggttcagtatactcgcgttgtccgtggggaagtgcttagtgtaaaggaaagggagtttgtccagtctgccaacacgcttggagcaagccgtacttatattgttcggaaacatattttgccaaacgttttatcttcttttattgtgatcgccaccattgggatcggcacagccattttaacagagtcctctcttagttttcttggctttggcgtccagccccctgacattacttggggaggaatgcttaacgacgggcgcaactatttagccacaagctggtgggttgcgacatttcctggtatagcgattacaatcaccgttctttcctttacctttctaggagattggttacgggacttattagacccacgct

SEQ ID NO: 4956 - DNA, 711 bp, Bacillus clausii
atggaaaatggctccagcttgcactggctcggcaccgaccatttagggcgagatgtgctcagccgtcttatttacggaggacgtgtttccctttttgtcggcatcgtctccgttgtgattgctggtttcattggcctgacacttggccttgcctctggctatttaggcggttggctcgatgcactcatcatgcgctttgttgacgctatgcttgccattccaacgttgttgcttgtccttgtagcaatggtaatgcttgaaccgtcaattgccacactcattttgatcattggactgacaagttgggttcagtatactcgcgttgtccgtggggaagtgcttagtgtaaaggaaagggagtttgtccagtctgccaacacgcttggagcaagccgtacttatattgttcggaaacatattttgccaaacgttttatcttcttttattgtgatcgccaccattgggatcggcacagccattttaacagagtcctctcttagttttcttggctttggcgtccagccccctgacattacttggggaggaatgcttaacgacgggcgcaactatttagccacaagctggtgggttgcgacatttcctggtatagcgattacaatcaccgttctttcctttacctttctaggagattggttacgggacttattagacccacgcttcatacgaggaggcataaaggatgacaaatag

SEQ ID NO: 4957 - DNA, 657 bp, Bacillus clausii
ggaatggcttgccaaaactagatggcgtcactttccaagtgatccctgataactcagcgcgcttaacagcgctccaatctggcgaaattgatttaatggatggccttgcccctgatgatgccgccatgattgaaggacaagcaggattaacaacgtttgaacggacgccaaacaacgttggctatctaggattcaacatagaaaaagagccatttgatgatgtccgcgtacgccaggctattaaccacgccattgataaaaacgaaattattaataatatttacggtggattggcagagcctgctgccaatgctgtaccgaaagactaccttggccacaatgatgacgttgtcgcctatgaatatgatatggataaagcaaaagaattgctcgaagaagctggttatggcgatggatttgaatttgatttgtggacgatgccggtgagccgcccttacatgcctgatcctgaacaggcagcggtggtgatccaagatgccctgagtgaattaaacattaccgctaatatcgttacaaaagaatgggcaacgtaccttgaggaaatcgagcttggctatcaagatatgttcatgcttggctggtctggcgttaatggcgaccctgattatttcctcggcagcttgttgtctacagacg

SEQ ID NO: 4958 - DNA, 242 bp, Bacillus clausii
atggaaaatacaccattagtaagtacccatcaaaagaaaacaccgtctggaatgcgtattttatggaaagaaattgttcgcgacaaaatcgcgctcatttcattctttctagttatgattgtcgctttggctgtgtttggtatatcccttgtgcttgatcaatctgaaattgtaaaagttgatttatttgctatttacgaaccaccatcttctcaattttggttaggtccgattatgggggg

SEQ ID NO: 4959 - DNA, 345 bp, Bacillus clausii
gcttcggagtgagattattgatacgaaacaaaaagactttataaaactagcccgatctaaaggggtctatgagtcgagaatatacaataaacatattttcagaaattcattacttccagtagccgcgttaattggttttgaagtttctagcttagtaacaggttccatttttattgaagcgatttttaactacccagggataggccaactcttctttcagtcgatcttaatacgtgattacagtgttgtaaccgcattagtcctattgttcggtgtcatcatgatccttggtgccctgttatcagacatcataatgagcataattgatccaagaatccgtattaa

SEQ ID NO: 4960 - DNA, 653 bp, Bacillus clausii
ggtcttccacccatacagtcaaagcggtaaatggtgttagttttacgcttcatcgcggggaaacagtcggcattgtcggcgagtcgggttctgggaaaagcgtcacggccacctcgcttttacggctgttgccatcgccacccgcggattatccaaaaggtgaaattcgttacaacggcgaagatttgctcaagttgcctgaaaaacggatgcgcagcatccgcggcaatgagatttcaatgattttccaagacccgatgacgtctttaaaccctgtatttacggtgggcgatcaaattatggaagtgattcgccttcataatgggcttagcaaaaaagaagcaaaagaacgggcagaggaaatgttgcgccttgttggcattccagagccgaaaaaaaggctttcgatgtatccacatgagttttcggggggaatgcgccagcgtgtgatgattgcgattgcgctagcatgcaacccgaaattgcttattgctgatgagccgacaacggctctcgatgtaacggtgcaagcgcaaattttaacgttgatgaaagagctgcagcagcaatttaataccgccattattatgatcacgcacgacttaggcgttgtatgggaaagctgcgacaaagtgattgtcatgtatgctgga

SEQ ID NO: 4961 - DNA, 688 bp, Bacillus clausii
ctggcaaggttcagtcagtggcaattgcttctctgctactattggctgcatgtggcggggatgagacgagttcagaaggaggcaataattcttcaagcaacaacgatggcaatggaagctctgaacaagcagccgatatcttttcaattgaagattttgatcatgaaatacgggcagatggcgaagaaattattgacgggggcacgctaaacgttgctttagtgacagacacgccgtttgaaggaacgttaaacagaaacttttaccaaggcgtgtttgatggagacattttgttttggaccgaagaaccgcttttagatatagatgaagattaccaatacacgcaaacaggtgctgcaacattcgaagtagatgatgacggcaggacatttacgttcacgattcgtgatgaagtcaactggtcagatggcgaaccagtaaaagcggaagactgggcatatacgtttgaagtgctcggccatcccgattatccaggggttcgatttacagaggcttcaaatgtggaagggtttgatgaataccgcgcaggggaagccgattcgatttctggacttgaaatcattgacgataaaacgttaaaaataacatttaaggaagcaagcccgtctttgttaccaagtgggatctgggcatacgcgatgcctaagcatatctttgaggacattga

SEQ ID NO: 4962 - DNA, 669 bp, Bacillus clausii
aaacgttgattttattgggaaaattgacttagcttatacgtatattggcttccaaatgggtacatgggatgaagaagaaaataaaaatgtgatggatcctgacaagcaagtgtctgacgtcaacttgcgtaaagccatggcccacgccgttgacaacaatgctgttggcgaacgtttttataatgggtttagatgggctggtacaacattgataccgccatcgcacccaactttccataacgacgaattagaaggttttgcatacgacgtagagcttgcaaaccaaattttagatgacgctggttatgaagatgttgatggtgatgggctccgtgaagatccaaatggggaaaaactgcaattaaactttgcgtctatgagcggtggcgacactgctgaaccacttgctcagtactatattacccaatggaaaaacattggcattgatgtccagcttttagacggaaggttacaagaatttaatacgttctatgaccgcttaaaagcatctgatcaagacattgatgtttatcaaggtgcttggggcgtaggctcagatgccgacccatatggcctttggggtagcacagccgcctttaactacactcgctggaccaatgaagagagcgaccgcttattaaaagaagggacatcagaagcagcgcttga

SEQ ID NO: 4963 - DNA, 667 bp, Bacillus clausii
gtgaacgaagaatggaaccgagattaaatgaaacaccgagtgtgtcccctccaacgccaacgttgtcagaggaaaaaagcgtcagccctacagtccttgcttttcgccggtttcgcaaaaataaattggctctagctggcattgtctttttatcgtttatcgtgttggtcgctatttttgctgatgtcattgcgacacatgatccgactgcttcccagctcagcaaaatcgaagcgaaagcagatggcgaaaactggttaggcacagacggttctggccgtgataacttttcaaggcttgtctatggcgcgagaatctcccttacggttggcttttttgcaatgttgtttacggtgttaattggcggaacacttggttcaatcgctggttattatggcgggaaaatcgattctgtcattatgcgttttacggacattgtcctgattttcccgtttattttgctgtttatgacaattgtggcgattctagaacggacaacagtgccgatttttattctcgttatcgccattacatcctggccgcaagtttgccgaattttacgaggaacgtttctttccattcgcgaaaaggaatatgttttaagcgcccgaagtatcggctgttccgattggcgtatcatccgcaagcattttttacctaatgcggt

SEQ ID NO: 4964 - DNA, 270 bp, Bacillus clausii
gcgcaaagtcggttttgacaagcataccctccgcaatgcgatgattcctattattacgctactaggtatggaaatcggcgtgctattgagcggcgcgttcattgtcgaaaccgtatttaattatccaggtatcggcacgttattcttatccggcatggccaatcgcgattatccagtcattatggcggttaacttgttaattggcttatctgttttagtcggaaacttattggcagacatcttttatgcggtggctgatccgcgcattcg

SEQ ID NO: 4965 - DNA, 267 bp, Bacillus clausii
agaaagcagcagcgggggcacgcttatttttgcccgtggcggcgactcgcaaagccttgattatgcttcggttacagacggggaatcgtcccgtgtgaccaaacaaatttatgaaacgctgattgaatttgccgatgattcatttgaactggagccagggcttgctaaagattgggacgttgatgacgatgggctccgttatgtgttctatttacaagaaggcgttacgtttcacgatggcacgccatttaacgctgatgcggtgaa

SEQ ID NO: 4966 - DNA, 648 bp, Bacillus clausii
taatcgcaagaggctttcctgtttctttggaacttggagtgtatgcgattgccattgcccttgtctcaggcgttattctaggggtcttgtcggcgctaaagcgcaatggcctgattgattatacgctaatgacttttgccgtgcttggtctttcagttcctaatttcattttggctgctttacttatacattcatttaaagattatttgcctattgcgacatggcagagctggcaacatatgatcttgcccgtttttgcccttgctacgtcgccaatggcgattatagctaggttaacaaggtcaacgatggttgatgtactgacacaagattatattcggacggcacaggcaaaagggctatcccctgtgacaattgtcgtaaaacacgcgttgcggaatggcctgatgcctgttgcgaccatacttggcacactaatcgctggcgttttaacaggcagttttgtgattgaaaaaatttttgccataccaggcattggccgttattttgttgaagggatcaataaccgcgactatccagtgattatggggacaacgattttttatagcgccattctgctagttatgctattccttgttgatattgtttacggtttccttgacccaagaattaaactgcatcggaagg

SEQ ID NO: 4967 - DNA, 1161 bp, Bacillus clausii
atggatattattcctgagcatatatttggcgacgtgccagtagctgacattccatctcatgctgggtcgattaacgctggtgaagtgattggcacagggccgttccaattgactgaaatgcttgaaaatgagcaatacgtattaaccgccaatgaagattactacaaaggtgcgccgaaactagattcgatcacgtggaatgttgtctctgcttctgtcgtcgcagggatgttggaacaaggcgagctcgattatgtgcctcgggattttccagctgctgatgttgcgacgattgatgggaatgacaatttgaccgtttttgaacaagcacagctaggctatcaatacttaggcatgaaaatcaatcatggccctaacgatagcttaaccgacccaaattcttgggagccaaacgaaaaactgcaagacgttgagcttcgccaagcgattgttcacgcgatcaatcgccaggaatttattgacggatttttacgcggccacggtgaattattggatgcgccatttccaagcgcctcttgggcatacaatcctgatgcggttgaaggcttagcttatgaccctgaccttgccaagcaaaagttagccgatgcaggctatgaagatgctaacggcgacggttttgtcgaagatccagacggcaatgaactcgttctcaacttagattatccaacgggcaacccagtgcgtgaacaagtcgcgcctgtgatgaaagaacagctagaggcagttggcattcaagtcaacttaaatacgccacgtgaggcgccagctcattttgaaattattgaacaaaacgacacggatgtcgatttattcttggcaggctggtccctttcttctggcgacccagacccatggccaattaatggcggcacagcaggttataactattcacgtttcctcgacgaagagcaagaaaaattgttgcaagaagcggttaatccagaattggcatttgacaaccaagagttccgtgcagaaaaatatggagaatgggcacaactctttattgacaatgcctatacggttccactttacgcagaaacagaacttcatgtgtacaacaaacgtctggcaggcttgactattaaaccgtttacattcaaagacgagacacatgagtggcacttaaccgaatag

SEQ ID NO: 4968 - DNA, 586 bp, Bacillus clausii
atgcttaaatatattgtgaggcgtgttttgcagtttatcccaatggtcttcattttatcagtaatcgtgttcttatttgcatatcttgctccaggagacgcgctgagtggagaagtgattgacccaaatacgccacgagaagtgattgaggaacgccgggaagaattaggattgaacgatccggtacatattcaatattggaactggctcaaacgggcagtgacaggcgatttagggatgtcgactcatttcaccggtaggtctgtcagcgagctaatcgggcaacggctcggcaatacattctatttaggcgcatttgcgcttttaattacactcattgtgtcgattccaattggtatttattctgcacgtaaaaaatattctgttttagattatgcggcgacgtcatttgcctttattggcctagcgacgccaaacttttttgccggattgctggcgatttatgtgttttcttttgggcttggctggtttccaacgcaaggttcgatcggttcccctaatttaacgggatttgacgcttttgtgagccggatccagcacttaattttgcctggccttacacttg

SEQ ID NO: 4969 - DNA, 270 bp, Bacillus clausii
aagtcggttttgacaagcataccctccgcaatgcgatgattcctattattacgctactaggtatggaaatcggcgtgctattgagcggcgcgttcattgtcgaaaccgtatttaattatccaggtatcggcacgttattcttatccggcatggccaatcgcgattatccagtcattatggcggttaacttgttaattggcttatctgttttagtcggaaacttattggcagacatcttttatgcggcggctgatccgcgcattcgacttg

SEQ ID NO: 4970 - DNA, 668 bp, Bacillus clausii
gtgaacgaagaatggaaccgagattaaatgaaacaccgagtgtgtcccctccaacgccaacgttgtcagaggaaaaaagcgtcagccctacagtccttgcttttcgccggtttcgcaaaaataaattggctctagctggcattgtctttttatcgtttatcgtgttggtcgctatttttgctgatgtcattgcgacacatgatccgactgcttcccagctcagcaaaatcgaagcgaaagcagatggcgaaaactggttaggcacagacggttctggccgtgataacttttcaaggcttgtctatggcgcgagaatctcccttacggttggcttttttgcaatgttgtttacggtgttaattggcggaacacttggttcaatcgctggttattatggcgggaaaatcgattctgtcattatgcgttttacggacattgtcctgattttcccgtttattttgctgtttatgacaattgtggcgattctagaacggacaacagtgccgatttttattctcgttatcgccattacatcctggccgcaagtttgccgaattttacgaggaacgtttctttccattcgcgaaaaggaatatgttttaagcgcccgaagtatcggctgttccgattggcgtatcatccgcaagcattttttacctaatgcggtc

SEQ ID NO: 4971 - DNA, 359 bp, Bacillus clausii
  misc_feature (1)...(359): n = A,T,C or G
atgtggaaatttattgttcgaagaatacttgtctccatcccgcagatttttgtgctaagtatactcgtctttataatggctcaatttatgccaggtgatgcgttaacggggttaattaacgatccggatattacaccagaggcgatgcaggctcaaagggaaaagcttggtcttgataatccttggtacatccaatataaagattggattgtaaatgcggtgcaaggagacttaggaaaatctttttctcataaaataccagttactgaattaattgatcaaagaatgtggaatacgattnggctngcatttctttctctagtattcatctatgcgattgcggttccgttaggcattct

SEQ ID NO: 4972 - DNA, 405 bp, Bacillus clausii
  misc_feature (1)...(405): n = A,T,C or G
tgtatgacacgtacgagtacgacccagaacgagcaaaagaaattcttgctgatgctggctatgaagatggcgtgacaatcaatatgtctgttaataattactatacggaaatggcggaagtggttggcggcatgctagctgatgtcggcattacagccaatatcgaactaattgaacaaagccagtttgccaaccgattatttaacggtgaattagaagaagcgatctttgtcggctggggaaatgacatgtttgatgcaagcgtgctcgacttctttaaagaagaaggggtcgccccttatactgaccctgagattgaacagctgcttgaagatgctgcttataatatggatgaggaagaacgtgccgaccaatatcaacaagttcaacaacaattagctgaan

SEQ ID NO: 4973 - DNA, 579 bp, Bacillus clausii
gtttgttgtcgaacaagtctgccgtctttggcggatcgctgattattattctagcaatcttagccgtcatcggcccttggattgcccctcaaggcattaatgaacaagactttgcacttaaattacaagggccttctagtgaacattggttcggcaccgatgattttggccgtgatgtgttctcacgtattttacacggtttaagcattacgtttcgtattggcttcgtttctgtcgccatcgcaggaacagtcggaaccgtcattggcattatttctggctactatggcggtaaaattgatgccattattatgcggattatggatattcttttagcgtttccaagtattatccttgcgcttgcaatcgttgcgacactcgggcctggcttgaataacattattcttgcggtagcaatcagcgcatttccagtatttgcacggattgcaagaggctcaacactatctgtcaaaaaattagaatatatcgatgctgtaaaagcgctgggtgctagcgatactcgtattatttttaagcatatcttaccaaatacaatgtcgccattaattggtacaatcg

SEQ ID NO: 4974 - DNA, 239 bp, Bacillus clausii
  misc_feature (1)...(239): n = A,T,C or G
gaaggtcatttttnaatggtcatgatataccattagaaagaaaagcaaaattagattncggtaaagacattcaaatgatctttcaagatccttattcttctctgaaccctaaaaagcgagttttagacattatcgcagagccgttgcgaaattttcaaaaaatgacaaaggccgaggaacaaaaaaacgtcgaagaattgctggaaaaagtgggattaagtcgtgaaagtatcgttaaa

SEQ ID NO: 4975 - DNA, 304 bp, Bacillus clausii
ttgtggaacatttatgtgcgcgtattggcgtgctctacttaggatcaatgatggagctggccgacagagaccggttatacgagaacccattgcatccatacacaaaagcattgttatcagctttgcctgtccctgaccctacacacaaaaaagagagaattcttttaaaaggcgacatcccaaatccagcatcaccgccaactggttgcaagttccatacgaggtgtcctgttgcaaaagaacgttgtaagaaggaagtgcccgcttttagggaagcagagcaagggcatttcgttgcctgtca

SEQ ID NO: 4976 - DNA, 632 bp, Bacillus clausii
atgacaaacaaaccagtcgtcatggaagtgaatcgattaaagaagtactatgagacaaaagcttcttttttaaatcgccaatcagagcttgtaaaggctgtcgatgatgttagtttcgccatccatgaaggggaaacgtttggtttagtcggtgaatcagggagcggcaagagcacgattgggaaatcgattcttaatttgcagccgttatcagcaggggaagtcgtttatagaggaaaaaatctccaccgtttaagcaaacaagaaatgagaaaggtaaggccccgtattcagtttgtgtttcaagatccattcagttcgttaaatccccgcttacgaattggcgatgctttagcagaaccgttattggatcacggcctcgcgacgaaaaaaacagtcaggcaaaaagtattggaaacgatggagctttgtgggctgccgtcttaccatgtgaataaattcccacatgaatttagtggcgggcaacgccagcggattggcatcgcccgtgcagtcattatggagcctgattttattgtagccgatgaaccggtttcagcattagacgtatcgattcaagcacaatcattaatttgtttaaagagcttcaagaaaagaaaaagttggccttt

SEQ ID NO: 4977 - DNA, 597 bp, Bacillus clausii
ctcaaagaaccaagcgaggacgaaagcgcttgaactcatcaagcgagtcgggattgggcgagaagaacaagtgttgaaatcgtatccacatcaaatgagcggcggcatgctgcaacgaatcatgattgcgattgccctcgcttgtgagccaaaaatgctgattgccgatgaaccaacgacggcactcgatgttacgatccaagcgcaaattcttgaattgttaaaacaactgaaagacagtcaagggatgtcgatgttgttaattactcacgatttaggggttgtcgcggaagttgctgactatgtcgttgtgatgtatgcaggtaaaatcatcgaacaaggatcggtgcacgagattttctttaacccgaagcacccttatacgaaagggttgctccaagcgaagcctgtcatcgggcaaaggaaaaagaaactttataccatcccagggcaagttccgcctttaattgatttgaaaccgtcttgctactttgctgatcgttgcggacattgcatggacatatgcctcgagcaagcaccctccctcattaatgatggcgatgaggaagaccatcgggtagcttgctggttatacga

SEQ ID NO: 4978 - DNA, 903 bp, Bacillus clausii
tcaaagcggtcgacggcgttagttttgacctatttaaaggggagacgctcggtgtggttggcgaatctggctgcggcaaatcaacgctagctaggttgatcaatcaactgattcggccgacggaggggaccgttcactttcatggtaaaaatttagctggcctttcagcagctgaagttcgaaaagtgcgtaaacatatccaaatggtgttccaaaacccgtatgcctcactggatccacgtaaaacggttggtcaactaatcatggagccacttgtcatccatggcgttggcacgagggatagccaaaaaaagcggctttatgagttgcttgaaacagtcgggctgaatgaaggacacgccaaacgttacccacacgaattttcaggcgggcaacgacaacgaatcaatattgcccgggcattagcactccatccagacattattatttgcgatgagccggtctctgctttggatgtctctgtccaagcgcaagtaattaatttgttaaaggatttgcaaagtgagttccaattgacatacgtatttatttcccatgatttgaatgttgtccgttatatgtgtgaccggattgctgtcatgtatttagggaaaatcgtggaaatgggcacatatgaacaaatttatcatcacccgaaacatccttatacgaaagcgctgttgtcagctgtaccgaaagaaagcccatttgaacaaaaacagagaacgattttatcaggcgatgtgcctagcccggtcaatccgccgccaggatgccccttccacaagcgttgcccagaggcgatgccgtcttgccaggaagtggttcctacgctcattaaacaaacgaatggccagcaagtcgcttgccatttgatgaacgacaccgaggaggaagcaatat

SEQ ID NO: 4979 - DNA, 708 bp, Bacillus clausii
atggtgttccaaaacccgtatgcctcactggatccacgtaaaacggttggtcaactaatcatggagccacttgtcatccatggcgttggcacgagggatagccaaaaaaagcggctttatgagttgcttgaaacagtcgggctgaatgaaggacacgccaaacgttacccacacgaattttcaggcgggcaacgacaacgaatcaatattgcccgggcattagcactccatccagacattattatttgcgatgagccggtctctgctttggatgtctctgtccaagcgcaagtaattaatttgttaaaggatttgcaaagtgagttccaattgacatacgtatttatttcccatgatttgaatgttgtccgttatatgtgtgaccggattgctgtcatgtatttagggaaaatcgtggaaatgggcacatatgaacaaatttatcatcacccgaaacatccttatacgaaagcgctgttgtcagctgtaccgaaagaaagcccatttgaacaaaaacagagaacgattttatcaggcgatgtgcctagcccggtcaatccgccgccaggatgccccttccacaagcgttgcccagaggcgatgccgtcttgccaggaagtggttcctacgctcattaaacaaacgaatggccagcaagtcgcttgccatttgatgaacgacaccgaggaggaagcaatatgccattaa

SEQ ID NO: 4980 - DNA, 489 bp, Bacillus clausii
gatgacgattgaggaaaacatggcgatggcgtacagccgcgccaaaaggcgctcgtttttccggatcggggtaaccaaaaacaggcgcgcttttttccaggaacaacttgcctcgctaggcatgggcttagaagaccgtttaaccgctaaagtcggatttctgtcaggtggagaacggcaagcgttgtcgcttttgatggcgacttttacaaacccgtcaattttattgctagatgaacatacggctgcactcgatccatcccgggccgaactgattacagataaaacacgggaaattgttagcaaaacaaaattaacaacactgatggtcacccataatatgcagcaagcattggatcttggcaaccggttgattatgatggacaaaggacaggttatttttgaggcaacagcagccgaaaagcggaaactgaccgtcgaaaagctgctaagtgaattccaaaaaattcgcggcggccaatttgccga

SEQ ID NO: 4981 - DNA, 312 bp, Bacillus clausii
  misc_feature (1)...(312): n = A,T,C or G
ctttaaaatgcgctgaaatggctttagccgaggcaaatgaaagcggacgaagaaccccgattccaacaggagcgacttttgtcatcaaaaccgacttcattattaaagcgattgggcaagcgcgccatcgttggctcgacgatgttggcattgctacacacaacggtgttatttcaattgaccatcactatgaaacatctgtaaaaggcgtttttgcctgcggcgacgcgatattcggccaagggcaaggtgaagcaatggtagttgcggctgccgaacaaggaaagcaancggcgnacgcaattgataaaa

SEQ ID NO: 4982 - DNA, 449 bp, Bacillus clausii
ttgcgagcaattgaagttagaaagccaggggacattcacatagttgaagtaaaaaagccagagcttgaaaatgacacggatgtacttgtcaaagtgcaagctgtagggatatgtggttcagacatgcacatttaccatggcagtaatccgtttactgtctacccgcgcattatcggccatgaagtcggaggcattgttgaagaagtggggagcggcgtccatgaccttcgtcctggcgaccgtgtagcgcttgagcccatttcatcatgcggcgtatgctacgcttgcaaaaaaggtcgcccgaatgtttgcgcaaagttggaagtgtttggcgtacaccgtgatggtgggatgcgtgaatggatggtagctcctgaagctaactggcacaaagtaaaagggaatttgccttttgaagcagctgctcttgtcgagccaatgacaatcgg

SEQ ID NO: 4983 - DNA, 153 bp, Bacillus clausii
aacgatcggaatccatcccattgaatttccaagaagtcgaaccgccattatccacccaagaagcgacagatgaagcaactaggtgcctttattgctatgatgcaccatgcattactgcatgtcccacaggaattgacatcccctcattcattc

SEQ ID NO: 4984 - DNA, 453 bp, Bacillus clausii
taaaagtgcgtgtagcgtgggctggtatttgcggaagtgatcttcacgaatacttgcacggtccggtgattatcccaaaaggagagcctgatcctattactggcggcgaacctccccttacattagggcatgaatttgccggtgtgattgaggaagtaggaacggaggtcaaatcctttcagaagggggaccgtgtcgtcatcaatccactctttacctacggaaacaagcccgcttcagttgatctctatgatggtttctcgtttgctggtcttgctacagatggagggtttgctgattttgcagtgatcccagagaaaaatgtatataaattgcctgataacttaacattggaagaaggagcactcgttgaaccgatggcggtggcggtgcaagcggtaaaagaagccgattttaaatttggacaatcagtcgccggcttttggggcggga

SEQ ID NO: 4985 - DNA, 438 bp, Bacillus clausii
ttgctgctaaagctgcaggcgccagcaaaatcattgtttttgagttatcggaagaaaggctggaaaaagcacggctagtcggcgccacccatacatttaattctggcgaagtcgatcccgttgaaaaagtgaaaagccttgtcccagatggggtcgatgtaagctttgaagtggctggcgtaaatgtaacatttaaccagtctatccaagtagccagatcacggggaatcgtcgtcgttgtttccatttttgccaaaccgattgagttcaatccgatggatattacgggcagtggcgttaagattacgtccactttggcttatgaaccggaagtattccaaacgaccattgatttaatggcagagggagccttaaatccgaaaggcgttataaccgaccggattgagctagagaatattgtagagtctgggtttgaag

SEQ ID NO: 4986 - DNA, 189 bp, Bacillus clausii
  misc_feature (1)...(189): n = A,T,C or G
ttcagcagggaggacagacccgttagcttgcacgcaccatgcgctagcgaaaacaacaatcaacgcaggcgattngtgtgttgtcattggtcctggcccgattggcttgcttgctgcccaagtggcgaaaagcagaggcgcaaacgtcatgataactgggctcaaccatgacaaaattcgtcttgagaa

SEQ ID NO: 4987 - DNA, 591 bp, Bacillus clausii
  misc_feature (1)...(591): n = A,T,C or G
ttacaagacggcggatcgaaccaggagcagatgtggccattatcggctgcggaagcatcggcttgcttgccattcantgggcaaaattgtttggtgccagatatgtatacgcaattgatatcgatgaacaaaaattaaaagtggccaaagaacttggcgccgaccaacgagtgaatccacttgatggcccagtgcatgaacaaattcacgatttcactgctggaaaaggggtagatgtggcgattgaagcagcgggcactccggttacttctgcccaagcattagcattgccgaagaaaggcggagaagttgttttncttgggattccatacggggacctgacaatcgagcgtttttactttgaaaaaattgtacggaacgaattgcgtgtccatggttcttggaatgggctgtccgccccatttccgggcaaagaatggaaaacggcgattcactctatgcaaacaggancaatncaagtaaagcctntcattacacaccggttgcctttatccnatgggccatttgtttttaaggaaatggccagcggttcccctgggtntataaaaacgttgcttttacccaggaaaa

SEQ ID NO: 4988 - DNA, 528 bp, Bacillus clausii
ggaccgtgtcgcgattttaggtgctgggccgattggcttgttgacgcttattgcggtaaaagcgaaaggtgcttcacacatagttgtgaccgatgtgttagactactcccttgatgttgccaaagaaatgggggcaacggccgcgattaatataaagggcaagccggattggattgaggaagcaaaaagtcaagtcggccggtcattcgataaagtgctaattaccgctggcgtgccaggcatcattaatgattcattgaacttactaaaaaaagggggacgtgctgtaacggtcgcgatgtttcatggccaacaagattttgatgtggaacaactacagcaaaatgaaaaagaaattgttggctgcatgacgtataatcgtcccgatacggaagaagcgttggatatcatcgccaaaggcgcgcttccagtcgaaaaagtgatttctcatcaattgtcttatgaacaggctggcaaagggtttgaaatggtcgataaaaagcaagacaactctgtaaaagtgattgt

SEQ ID NO: 4989 - DNA, 183 bp, Bacillus clausii
gcgacgggcatatccacacacccttttgtccccatggttcagcggatacgctggcatcttattgtgaacaagcgatttcaattggactaaagacgattacatttgcagaacacgcccctcttcccgccggttttagcgaccctaccccgaaccaagacagcgccatggcagcttcagacctaa

SEQ ID NO: 4990 - DNA, 525 bp, Bacillus clausii
gggcgacaccggcgcagactgcattacttacctcctattcgtcatggggcccgcgtccgttacccaatttgacattaataagcaaaaaggcgctatgagaagcggagataacgtatggccattgtacccgattattcatacagttgaagatgctcataaagaggcgatggctgtttacggaaaagacccccgctcctacatgttgcaaacaaaggcgtttttcggaaatcaagacggccaagtgactggcttacaaacagtcgaagtgacgactgaaatcaaagacggtcagaaaatcaggacggaaatccctggcaccgaacggacgtggaaagcagatctcgttctccttgccattggctttactggcccagagcaagaattgttgcaacaacttggtattgaaacgacaagtaggacgactgtaaaagcgccatacggtaaatatacgacctcgaagcctggcatttttgctgcaggcgacaatcgccgcggccaaagtctcgtcgtttgggctatacatga

SEQ ID NO: 4991 - DNA, 958 bp, Bacillus clausii
gtggggaagccgacaggttttttagaatataagcgggaagcaccgcacaagagagacccgtttgaacggacgaaaaattggcaggaattccaggtttttatgccggaagacaaactgcggcaacaaggggcacgatgtatggactgtgcaatcccattttgccaagcgggaacgacaatggcaggttcaggagaaatcggatgtcctgtttacaacctcattccagaatggaatgacttagtgtaccggggaaaatggcgtgaagcgctggaccgactccataaaacgaacaattttcccgaatttacaggtcgtgtctgcccggcaccttgtgaaggttcctgtacggttgctcttaacggcgatgccgtaacgattaaatcaattgaataccatatcgttgagcgtggctttcaagaaggctggattcaaccggagccgccaaaaacgcggaccggaaaacacgttgctgttgtcggttctggccccgctggtttagctgcggcagcacagctcaacaaagccggtcacacggtaacggtatttgaacgcgatgaccgcattggcggcctgcttacttatggcattcctgatgtgaagttggcgaatgaagtggtcgagcgacgtgttcagcttcttgaggcagaaggcattacctttaaaacagaagttgaaatcggtgtagacattacagccgaagaacttgaagcttcattcgatgcagtcattttagcgacaggggcaacaaagccacgagaagtccaggcgcctggcaaagagttaaaaggcattcattacgcgatggactttttgaccgctaacacaaaaagcctattaaactcccaactcgctgacggagagtttatttccgccaaaggcaaacatgtcattgtcattggtggcgggcgacaccggcgcagactgcattacttacctcctattcgtcatggggcccgcg

SEQ ID NO: 4992 - DNA, 486 bp, Bacillus clausii
gaagcggagataacgtatggccattgtacccgattattcatacagttgaagatgctcataaagaggcgatggctgtttacggaaaagacccccgctcctacatgttgcaaacaaaggcgtttttcggaaatcaagacggccaagtgactggcttacaaacagtcgaagtgacgactgaaatcaaagacggtcagaaaatcaggacggaaatccctggcaccgaacggacgtggaaagcagatctcgttctccttgccattggctttactggcccagagcaagaattgttgcaacaacttggtattgaaacgacaagtaggacgactgtaaaagcgccatacggtaaatatacgacctcgaagcctggcatttttgctgcaggcgacaatcgccgcggccaaagtctcgtcgtttgggctatacatgaagggcgtgaagcagcacgagagtgtgatcgctatttaatgggaagtacacgtttgccgt

SEQ ID NO: 4993 - DNA, 300 bp, Bacillus clausii
gaagggaatcgattattgttgatgatttaattgatacggcggccactgtgacattagcggccaatgcgttgcaagaaaacaaagtgagtgcaatttatgcgtgttgtacgcatcctgttttgacaggaccagcaattgaacggttgcaaatggcgccaattaaagagattgtcgtcaccaacacgattgaattagacgacgataaaaaggttggaaacttgactgtgctttcaattgccccgctgttggcagaagcaatttaccgagttcatcgggagcaatcggtgagtacgctgttcc

SEQ ID NO: 4994 - DNA, 461 bp, Bacillus clausii
  misc_feature (1)...(461): n = A,T,C or G
aattacagcgatccaagcttaaaggtgtttacgctcnattctaataaagggttggctgaagagattgcccgtcacatcggcgtctcacttggaaagaactcagtgatgcggtttagcgacggagaagtgcaaattaacattgaagaaagcatccgcggctgtgatgtctatttgattcaatcgacgtcggctccagccaacgaacatttaatggagctcctcattatgattgacgcagtgaaacgggcttcagcacggacgataaatgttgtgatcccttattacggctatgcgcgccaagacaggaaagcgcgggcgcgagagccaattaccgccaaactcgttgccaatttacttgaaacagcaggggcaacccgcgtgttgaccattgatttacatgctacgcaaatccaagggttttttgacattccagttgaccagctaatgggcgttccgctctt

SEQ ID NO: 4995 - DNA, 565 bp, Bacillus clausii
atggcaaattacagcgatccaagcttaaaggtgtttacgctcaattctaataaagggttggctgaagagattgcccgtcacatcggcgtctcacttggaaagaactcagtgatgcggtttagcgacggagaagtgcaaattaacattgaagaaagcatccgcggctgtgatgtctatttgattcaatcgacgtcggctccagccaacgaacatttaatggagctcctcattatgattgacgcagtgaaacgggcttcagcacggacgataaatgttgtgatcccttattacggctatgcgcgccaagacaggaaagcgcgggcgcgagagccaattaccgccaaactcgttgccaatttacttgaaacagcaggggcaacccgcgtgttgaccattgatttacatgctacgcaaatccaagggttttttgacattccagttgaccagctaatgggcgttccgctcttgtctgatcactttgagagcaaaaagcttgatgatattgttgttgtatcgcctgaccacggcggtgttgtacgcgcgagaaaaatggcggacccgctta

SEQ ID NO: 4996 - DNA, 576 bp, Bacillus clausii
cagggattgttgaccgttttgaagaggaagggctgcctgtgttcggcccgcgccaaagtgcggcgctccttgaagggtcgaagtcgtttgcgaaagagatcatgacaaaatacggcattccaactggcaaagccaaagcgttttccgattacgaggaagcagtagcgtacgtaatgcaagaaggcgcgccgattgtcgtaaaagctgacggccttgctgccggcaaaggcgtcaccgtcgctttgacagaggaagaggcaatcgctgccctccgccatgtgctagtcgaaagcgcgtttggcgaagcaggcgcacaagtcgtcgtcgaagaatacctcgagggcgaggaactatcgcttatggcgtttgtgagcggcaataccgttgtgccaatggtcggagcccaagaccataaacgcgcctatgatggcgatcaaggcccgaatacaggcggaatgggagcctattcgcctgttccccaattcaaacaagcggacgtggaacgcgctgtagcggaagtgttacaaccaacggctgacgccatggtcaaagaagaccggccatttacaggcattt

SEQ ID NO: 4997 - DNA, 531 bp, Bacillus clausii
atgacaaaatacggcattccaactggcaaagccaaagcgttttccgattacgaggaagcagtagcgtacgtaatgcaagaaggcgcgccgattgtcgtaaaagctgacggccttgctgccggcaaaggcgtcaccgtcgctttgacagaggaagaggcaatcgctgccctccgccatgtgctagtcgaaagcgcgtttggcgaagcaggcgcacaagtcgtcgtcgaagaatacctcgagggcgaggaactatcgcttatggcgtttgtgagcggcaataccgttgtgccaatggtcggagcccaagaccataaacgcgcctatgatggcgatcaaggcccgaatacaggcggaatgggagcctattcgcctgttccccaattcaaacaagcggacgtggaacgcgctgtagcggaagtgttacaaccaacggctgacgccatggtcaaagaagaccggccatttacaggcattttcgtacgccatttcggatcgcacggaaatgcaatgaccgtcacccgcgtgccgtaa

SEQ ID NO: 4998 - DNA, 756 bp, Bacillus clausii
acattgtcgtacagggagctgaaccgctctattttttggattatctagcttgtggaaaagcagtgccagaaaaaattgaagcgattgtcaagggtgtcgccgatggttgtgaaattgcaggctgtgcccttattggcggggagacggcggagatgcctggcatgtacggggaagatgagtatgatttggccggtttttcagtcggggcagttgagaaaaaagacttgctgacaggcgaacatattcaagcaggcgatgtcctgattgggctcccatcaagcggccttcatagcaatggcttttcccttgtccgcaaagtattgttgcaagatgcaggcctgacgttgcaaacggaatgtgccacacttggcaagacgcttggagaagagcttttgacgccgacaaaaatttacgtaaaaccgttgcttgcctgcctcaaacaagggttgcttgctggtgcagcccatattacaggaggcggcttttacgaaaacattccccgcatgctgccaaaaggcgtaggcattcatattgactacggttcatggccgataccgccgattttttcattgatccaagagcaaggcggcctatctgaacaggatttgtttcatacgtttaacatgggcattggcatggtgctcgctgtacctgaggacaaacaccaacaagcgctcgccactcttgaagctaatggggaagacgcctatattattgggcgcgtaacgccaacagaaggaacggtgattgggggca

SEQ ID NO: 4999 - DNA, 341 bp, Bacillus clausii
aggtcgcggtctttgcttctgggacgggaacgaatgccgaagcgctcatcaaagcagcaaaaacaggcgaacttggcggagaagtcgcgcttgtcgtcagcgataagcaacatgctccagtactcgaaaaagcgcggaatttgggggtgaaagcggagcatctttcgccacaatctttttccgataaagccgcttatgaacaagcaatcttgacgcttcttacaaaagaaggcatcgattttattgtgttagcaggttatatgcggttgattggaccgacgttgcttgaagcctatgagggaaagatgatcaatatccatccatcgcttttgcctgcgttc

SEQ ID NO: 5000 - DNA, 264 bp, Bacillus clausii
aaggcgtatttatttttttagcgcctccaagcttaaaagaattgcgcgaccgcattgtcggccgaggcacggaaacagaagacattattaatgaacggatgacagtagcaaaagaagaaattgatttaatgacaatgtatgattacgtcgtcgaaaacgataaagtcgaatgggcggtcgagcgaattaaagcgattgtaacagctgaacattgcaaacgggaacgcctaataaaaaaatacaaagaacttgtggaggtcgaga

SEQ ID NO: 5001 - DNA, 645 bp, Bacillus clausii
aatcaaagactttgaaagggagcctgtgccaaaagaagtgcaaaaaggctggctgccgatggcgactgtttggtttgccatcggcatcgatttatcaggcatgttgttaggcgcacaacttggagcggggatcccatttgtgaaggcgttgctggcagttgcagtcggctctctttttcttggcgtgctgggcgcgatttgtgccaatattggcgctgcaaccggcctgtccacgacgatgatttccaattttgtttttggcgcggctggagcaaaagtgatttcagtcgttatatcgatttcaatgatcgggtggttcggcgtccaagctggattttttgccgaaaatacggtatctgttgttgaacatttaacaggctgggcactgccccttccggcgactgcctttgttggcggactcctgatgatgacgaccgcgtttgcgtttagatggttcgaaaagctaacgaattggacaagcccactgcttgttgtcttaattttagcagcgttggtattagcatttgcacaaagagatgctagcgccgtgttggcaccagtagaagcgaagttttcattcggagtggctgtttctttagtggtaggcatttatgtacttggcacaattctttctcgtgatatttc

SEQ ID NO: 5002 - DNA, 513 bp, Bacillus clausii
atgtcacagcttcttgagccaagcgctgaaacgattaaagccgagcggctatatcgagaaatgggcttgacggatgatgaatttgcactggctgaaaaaatcgtcggcaggccattgaatttcacagaaacaggcttgttttccgtcatgtggtctgagcattgcagctataaaaattcaaaagtactgttgaaaaagtttccgactgacggcgagaacgtgctccaaggcccaggtgaaggggcaggcattatcgacattaaagacgaacaggcggttgtgtttaaaattgaaagccataaccacccgtctgcgattgagccgtaccaaggcgctgctactggtgtcggcggcattttgcgcgatgttttttcgatgggtgcccgtcctgtcgcattgttaaactcgctccgctttggcgaactcgaatcaaaaaaagtgaagtacttgtttgaagaagttgtggccgggattgctgggtacggcaattgtgtcggcgtaccgacggtcggc

SEQ ID NO: 5003 - DNA, 858 bp, Bacillus clausii
agaagcggggcgcattcgcttttacagacgatggcgtcggcattcaagaagcggggatgatgctagcggcaatgaaagaagcagcagcattaaacatggcagttgtcgcccattgcgaagacaattcacttataaacggcggcgctgttcacgaaggccactatgcgaaagcacacggcttgaatggaattccctctgtttgcgaagccgtccatatcgcccgcgatgtgttgctggccgaagcggctggtgcccactatcacgtctgccatgtttcgacaaaagaatcggtgcggacgatccgtgatgcgaaaaaagcaggcatacgcgtaaccgcagaagtgacgccacatcacttgcttttatgcgaagacgatatcagcggcaaagatccgaattttaaaatgaatccgcctcttcgcgcaaaagaagcccgtgacgcattagtagccgggttgctcgatggcacaattgatttcattgcgactgaccatgcaccgcatacagcggaagaaaaaagtgcttcacttgaacgggcgccatttggcatcgtcggattggaaacagcctttccgcttttatatacacattttgtcaagccgggaacgtttacgctgaaacagcttatcgactggttgacagtcaagcctgcgcaaacatttaatctcccctatgggacactccaagttggggcagcagccgatctaacgctgattgacttagaggcaaatgaaacgattgacccgagtacgtttttgtcgaaaggcaaaaataccccttttgctgggtggggctgtgcaggcatcccgcaagcgacgattgtggcaggaaaaaccgtgtataaaaaggagcgtatca

SEQ ID NO: 5004 - DNA, 462 bp, Bacillus clausii
taacgcttgcagaacacacaggccaattgatggtatgaagcaaagtagctggcaaaaactttcttaagcaaccaggaatgcacagaacggtgatgggggatgggttggcgactatgatcgcagccgcagttggcggtccaccaaataccacttatggcgaaaacgtcggtgttgttgccatcacgagagtgttcagcgtatttgttgtcggcggcgccgcggtgttggccatcgccttcgcctttgtcggcaaagtagctgcactgattagttcgattcctcaagcagtaatgggcggtgtttcaatcctcctatttggcattattgcctcggccggcattcgaatgcttgtcgataaccgagttgacatgggtgaaaaacgaaatatggtgattgcttccattatccttgtcgttggcattggcggggcccgcgatccgctttacggattcgttgaaattg

SEQ ID NO: 5005 - DNA, 612 bp, Bacillus clausii
  misc_feature (1)...(612): n = A,T,C or G
ttagaagaagcgggcatcgctgtgtcaacgtttcagatgtaacgggctttccagaaattttagatggccgtgtcaaaccactccatccgaacattcacggcggcctattagcgatgcgcactancgatgaacatatcaancnaatagaaaaacttggcattgagccaattgattatgttgtcgtcaatttgtatccatttgcagaaacgatcgccaacccagaggcatcatttgctgacgcgatcgaaaacatcgatatcggtggtccaagcatgctccgctccgctgctaaaaaccacgcagatgtgacagtggtggtagatccagccgattatgatgctgtgcttgcttcccttaatgcaagcaaagaagagcaacttgcactgcgccaaaaactagctgcaaaagtattccgccatacagcggcctatgatgcgatgatcggcagctacctaaccgatgccgttggcgaggaaaatcccgaaagcttgacggttacgtatacacataaacaaacgctccgttacggggaaaatccacaccaaaaagctgctttttatgaaagcaggacaagttcgccgtcatccattgcccaagcaaaacaacttcatg

SEQ ID NO: 5006 - DNA, 242 bp, Bacillus clausii
  misc_feature (1)...(242): n = A,T,C or G
atganaaaagcaccacttgtnattggcggaaaaacgctgtcatcgcggnttttcattgggactggccgttattnaaacccggttgttcaaaatgaagcgattaaagcctncggagcggaggttttaacgtttgccattcgccgtattaacttanaacatnctgatgaggatgcnattttacagcatttanaagggcgcacttttcaatacttgccaaatacatcangagcgaacaacgctga

SEQ ID NO: 5007 - DNA, 957 bp, Bacillus clausii
atacgttagaagaacaattgaaaaatgggctgtcttccttaaaaggcgcctatgcatttgctgtcatgaacgagcgccaattgatggtcgcccttgatccaaatgggttgcgtcccctttccatcggacgtttaggcgatgcgtatgtcgttgcttcagagacatgtgcgttcgacatcattggcgccacctatgagcgtgaagtaatgccaggcgaactgctcattattgacgatacaggcttgcgcagcgaacgcttcgtttctccagggaaccgggcgatttgcagtatggaatacgtttattttgcgcggccagattcaaatgtggatacaatcaatattcatacagcgagaaaaaatttaggaaaacagcttgcgattgaagcgccagtggaagcggatgtggtgacaggcgtgcctgactccagcatttccgcagcaattggctatgccgagcagtccggcattccttatgaattgggcatgattaaaaatcgctatgtcgggcgtacctttattcaaccttcacaagaactacgggaacaaggagtaaagatgaagctttcccctgtgcgtggcgttgtcgaaggcaaacgagttgttatgattgacgattcgattgtacggggaacgacgagccgccgcattgtccatatgcttcgtgatgcaggggcagctgaagtccatgtccgcatttcatcgccaccgattaaacatccgtgcttttacggaattgatacgtcaacgacggaagaattaattgcttccaaccactcaattgaagaaatgcggaaaatcatgggtgctgattcacttgcttttttgtcgactgaaggcttaaaagcagggattggccgttctgaagccatgcataattgcgggcaatgccttgcctgctttacaggcgaatacccaacggagatttatgccgacaccgtgcatccgcacgcgaaag

SEQ ID NO: 5008 - DNA, 1027 bp, Bacillus clausii
  misc_feature (1)...(1027): n = A,T,C or G
gtgtcaaacgcatataaacaagcaggggtcgatattgaagctggttacgaagcagtaaaccgaatgaaacggcatgtggaacgaacagcaagaaaaggcgtacttggcggtctaggtggatttggcggcaattttgacctttcatcgttagggttaaaggagcctgtccttgtatcanggacagacggcgttggcacgaagctaatgattgcgtttatggcaaacaagcatgacacaatcggccaagatgcagtcgccatgtgtgtcaangacattgtcgtacagggagctgaaccgctctattttttggattatctagcttgtggaaaagcagtgccagaaaaaattgaagcgattgtcaagggtgtcgccgatggttgtgaaattgcaggctgtgcccttattggcggggagacggcggagatgcctggcatgtacggggaagatgagtatgatttggccggtttttcagtcggggcagttgagaaaaaagacttgctgacaggcgaacatattcaagcaggcgatgtcctgattgggctcccatcaagcggccttcatagcaatggcttttcccttgtccgcaaagtattgttgcaagatgcaggcctgacgttgcaaacggaatgtgccacacttggcaagacgcttggagaagagcttttgacgccgacaaaaatttacgtaaaaccgttgcttgcctgcctcaaacaagggttgcttgctggtgcagcccatattacaggaggcggcttttacgaaaacattccccgcatgctgccaaaaggcgtaggcattcatattgactacggttcatggccgataccgccgattttttcattgatccaagagcaaggcggcctatctgaacaggatttgtttcatacgtttaacatgggcattggcatggtgctcgctgtacctgaggacaaacaccaacaagcgctcgccactcttgaagctaatggggaagacgcctatattattgggcgcgtaacgccaacagaaggaacggtgattgggggca

SEQ ID NO: 5009 - DNA, 341 bp, Bacillus clausii; identical to SEQ ID NO: 4999

SEQ ID NO: 5010 - DNA, 414 bp, Bacillus clausii
aaaaagtgctgatgttttgcgaccctggtatcgatgattcattggcgattatgtatgcactttctgccccttttattgaactaattgggcttgtcgttagttacgggaatgtcagtaagaagcaagcagttacaaacgctgcgtatttgctccatttagcggggcggacagacatcccgcttatatctggagcaagcatgccaattgttgaggaaaatttagcatactatcctgatattcatggagagagcggaatgggtccgattcaattgcctgcccatgacgagattctagtccggccgtttgcgatggttcctgaaatcattgcccgttttcagggagaagtgatcattgtcgatacgggcagaatgacagcgctcgcagctgcttttgtcgggtttgagaaagaaatga

SEQ ID NO: 5011 - DNA, 423 bp, Bacillus clausii
cttggaagagcattttttagtagtagatgacatgtctacccctttattatcagttgacaagccggcgagctatcatgaaacgcaagtgccagaaggcggagtgatatcgattccgcctaaaacctttatgcttggaacaacgatagagcaaattcgcttacctgacaatttaaccgcttttgtcgaagggagaagctcgatcggaagactaggtgtgtttattcaaaatgctggctggattgatccaggcttctctggccaaatcacattggaattgtttaatgcaaatcgtgttcctgttcaattgcaggtcggcatccgtgtttgccagttagtgattgcacatgtcgaccaagctacagaagggtatcgaggaaaatatttatatcaacaaggggctacccctagcaaagtatatctgga

SEQ ID NO: 5012 - DNA, 686 bp, Bacillus clausii
  misc_feature (1)...(686): n = A,T,C or G
gtgaaaatcggtatcattggtgcaatggaagaagaagtcaactttttacgagataaaatggaaaaccgcgtagtgacaacgattgccaattgtgaatttactgaaggaaaaattggcgctgtgcaagtagtgctaacacggtgtggaattggaaaagtgaacgctgcactggcaacaacgctattgaatgatcggtttcaacctgatgctattatcaacactggcgtagcaggaggcctcaacgcaagtatggctgttggcgatcttgtcatttcaacggaagtacgttaccacgatgttgacgcaactgtgtttggctatgaatatggacaagttcctggaatggtgccagcgtatttaccagatgcaaccttaattgcagcagcgaagacagccgcgcaaaaagtaggcttccattcagaagaggggctgattgtgacaggagattcctttatgggggaagaaacgcgtgtaaacgaagtcaaaacattatttcctgctgcttattgtgcagaaatggaagcaggcgcgatcgctcaagtatgccaccaattccaaaccccatttgtcattatccgggctttgtctgacgtggctggccaagacgcaaagatgtcatacgatgcatttttagaaaaatcagctgtcaattccgctaaacaagtgatattgatgntcgaccactt

SEQ ID NO: 5013 - DNA, 219 bp, Bacillus clausii
gcaacgcgctattttctaaagaggcgtaccatcaagcatatggtttaaccgaacaacgagaagcactgatggcaaaacagagtatcatcatgcatcctgcacctgttaaccgagacgttgaaatcgccagcgtgcttgttgagtgcaaacggtcacggatttacaaacagagcgccaatggcgttgccgtacgcatggctgtgttaaagcgggcacttg

SEQ ID NO: 5014 - DNA, 232 bp, Bacillus clausii
atggcaatgaaggtgactggtgggtttattcttgacgaaaatggcgaacaagtagcaaaagatgtgtatataaaagatggaaaaattgttgagcatgttgctgaaggggacattcgtgaacaattggatgcaacaggtttgttgatcagcccgggttttgttgacgtacatgttcatttgcgtgaaccgggtggcgagaagaaagaaacgatcgagacaggaaccaaagccg

SEQ ID NO: 5015 - DNA, 699 bp, Bacillus clausii
tctgaaaaacctctttacagagaaggaaaaatataaaacttggctcttgtttgaatcggcattggctgaggcacaggctgaatatgggcttattccaaaaaaagctgcgcaggaaattaaagaggccgccaagcttgaaaaccttgatctcgaagaaatggaccgtatttacaaagaaattggtcatggctttgtcccttttttaaaagttctcgtcaaagcatgtccatcagatagcggaaaatatgttcactacggaataacaacacaaaatatacagcaaagttcgcagctttatattttgaaaaaagctcatacgatatttatgcgcctgattggcgagattttagaaaacttaagcattctggcatcggataacaaacatacggtcatgcccggtagaacacatgggagacatgcgattccgatcacttacggatataaagtgtccgcctggataagcgaatttatcagttgtcagcaacgcatggccgaagcggaaaaaagagtttttcaagtgatgatgggcggggcagtcggcacgttcagttcaatgccggagatagggattaacgtgcaaaaccgtgtggctgcgttagttggtatgtatccgatgactgtaccatctagaaatataaacacgcataaattggaatacatgtcgaatttagctctattggcaaattgctgccttaaaat

SEQ ID NO: 5016 - DNA, 429 bp, Bacillus clausii
catgcaaatctcgcgttcctaaaaaagaaaatgtacgtattttttcaaacgcaaaacaagctctcgatgccaatttccgcccttgtaaacgttgcaagcctacgaatgagagcttgcctgatcgtgaatgggtggctgttataactgaatacattgataaaaatttcatcgaaaagttaacgctagaaacgttagcagagattgctcacgggagtccctatcatttgcatcgaacgtttaaaaaaatgaaaggcatcacaccagtcgaatatatccaacaagttagattaaacgctgctaaagagtatttgcttcacacaaataaagcgattgcggatatcgccataagtgtaggtatgcctaacacgtcctattttattactttatttaagaagaaaatgggacatacaccagcacacttccgtcaaa

SEQ ID NO: 5017 - DNA, 401 bp, Bacillus clausii
atgaaaaaagggctgtttattacagttgaaggcggagaaggcgccggtaaaacgacgatcattaatcttgtgcaagagcaacttgccactcaaggctacgaggtgatccgcacgagagaaccaggcggcgtcgagctggctgaacaaattcgcgacttattgttgcatacgcaaggcgttgaaatggataaccgcacggaagcattgctttacgctgccgcgagaagagagcatttgatcaaaaaaattgttcccgcacttgcggagggagcccttgtcttatgtgatcgttatatagattcaagccttgtttaccaaggccatgcaagaggaataggaatggaagaagtcagagccattaatggctttgcgatcgagacttatatgccggatttaacgtt

SEQ ID NO: 5018 - DNA, 198 bp, Bacillus clausii
tctatagtttgaaaaagcgcggtgcaaaaagcatgcgtctcatttgtcttgtagctgctccggaaggcgtcgcttatgtacaaaaggaacatccagatgttgatatttacttagctgcgcttgatgaaaagctaaatgaaaaaggctacattgtgccagggcttggcgatgccggcgatcggctgtttggtacaaaat

SEQ ID NO: 5019 - DNA, 738 bp, Bacillus clausii
actaacccatttttctgaacgttatcaagcggctaaatcctccattagtgaagacttggtcattattaaagacatgtttgaagaagaaggctatggtgcgttagtgacgataccaggggcaagtggcggcgtaaagtttatgccaaagatgaacaaacaagaagcagagcaattaattggcgaattggtacaggcgttaaacaaacaagaacggattttgccaggcggatacctgtatatgatggacttgttaggcaatccaaagttaatgcacaaagtgggccgcttgtttgcagcggtgcttgccgataaggaaattgatgcggtgatgacagtagcaacgaaaggcattccccttgcctatgcggtcggccattacttaggggtccccgttagcattgtaagaagggatcaccgcattcagaaggttcaatggtcagcatcaattatgcgtctggatcttctgaccgaatccagacgatgacgcttcgcacgaagaagcttggcgccagggtcaaaacgtgttcatcgtcgatgactttatgaaagcaggcggcacacttcgaggaatggtcgacttgctcgaagagtttgaagccgatttagtcggcattggcgtattagtcgagtcggcggaaagtatccagaaaggcttgttgatgattatttgtctttaacaaagttaacgaacgtcaatgttcgtgaaaaagtgatcgatgttacagaaggaaacattct

SEQ ID NO: 5020 - DNA, 477 bp, Bacillus clausii
gcttggtttaagtttaccggcgttaattgtccttactttttctcagtggacgacaaatacaaataatctctattctgcttctttaagcatgtcggtgctaattccgaaagcaaagcgtcccgtgttgacgcttgttatgggagtagccgcttcggcattagcgtttataggcatatttgaccactttattacgtttttatcattaatgacgatgttaatcgctccagttggaggagtgtatgctgctgaatattatgtcgtcgacaaacagaaattctcctttcaagctcttcacagccgtaagctgatcggacgttctctggccgtatggctagtcacgtcattgttttgttggctgacgacgccagcgccagacgggttgggcctgctcgtttttacaaccattccagcacttgatggctttatcgtcgcgtttgtcttgcaagcgctaattggaaaagctgtgttcgcacgcaa

SEQ ID NO: 5021 - DNA, 480 bp, Bacillus clausii
taacccatttttctgaacgttatcaagcggctaaatcctccattagtgaagacttggtcattattaaagacatgtttgaagaagaaggctatggtgcgttagtgacgataccaggggcaagtggcggcgtaaagtttatgccaaagatgaacaaacaagaagcagagcaattaattggcgaattggtacaggcgttaaacaaacaagaacggattttgccaggcggatacctgtatatgatggacttgttaggcaatccaaagttaatgcacaaagtgggccgcttgtttgcagcggtgcttgccgataaggaaattgatgcggtgatgacagtagcaacgaaaggcattccccttgcctatgcggtcggccattacttaggggtccccgttagcattgtaagaagggatcaccgcattcagaaggttcaatggtcagcatcaattatgcgtctggatcttctgaccgaatccagacgat

SEQ ID NO: 5022 - DNA, 514 bp, Bacillus clausii
  misc_feature (1)...(514): n = A,T,C or G
atggaacaatacttgcagttatgcgagcacgttttgcaaaacggctcgccaaaatcagatcggacaggcactggcaccattagcgtatttggttaccaaatgcgctttgatttagaaaagggttttccaattgtcacaacgaaaaaattgcatatgcgttcgatcatccatgaattgctttggtttctaaaaggcgacacgaacatccgttatttgcaagaaaatggcgttcgtatttggaatgaatgggctgatgaaaacggcgaccttgggcctgtttacggaaaacaatggcgctcctgggaaggggcaaacggcaaaacagtcgaccaaattactgaagtggttgagcaaataaaaatgaatccgaattctcgccgcttaattgtcaatgcgtggaatgtcgcggagattgaagaaatggcgctcgcgccatgccattgctnggttcagttttacgtaaacgacggaaaactttcttgccaattgtaccagcgcagagccgatattttct

SEQ ID NO: 5023 - DNA, 528 bp, Bacillus clausii
  misc_feature (1)...(528): n = A,T,C or G
atggaacaatacttgcagttatgcgagcacgttttgcaaaacggctcgccaaaatcagatcggacaggcactggcaccattagcgtatttggttaccaaatgcgctttgatttagaaaagggttttccaattgtcacaacgaaaaaattgcatatgcgttcgatcatccatgaattgctttggtttctaaaaggcgacacgaacatccgttatttgcaagaaaatggcgttcgtatttggaatgaatgggctgatgaaaacggcgaccttgggcctgtttacggaaaacaatggcgctcctgggaaggggcaaacggcaaaacagtcgaccaaattactgaagtggttgagcaaataaaaatgaatccgaattctcgccgcttaattgtcaatgcgtggaatgtcgcggagattgaagaaatggcgctcgcgccatgccattgctnggttcagttttacgtaaacgacggaaaactttcttgccaattgtaccagcgcagagccgatattttctnggtgaccttttaa

SEQ ID NO: 5024 - DNA, 414 bp, Bacillus clausii
tctttttgaaagtcattctcgccctttcatttagcgaagaagcaaaagcgattttgcaccagaaaaaaaacacccgtctgctagaagtcgctgtcaccaaaggcgagctggagaaaaagcttgcctccgtccatggcggcttgctcattcaggaagaagaccatttaggctttgacgacggggacatccgcattccaacgaaacgggaaccgacagaagaagaatggactgcgttgaaactcggctggaaagttgtcaagcatgtgaagtcaaacgcaattgtgcttacgaacggcgaaatgacagtcggcattggcgctggccaaatgaaccgcgtcggtgccgcggcgattgcaattgaacaagcgggtgaacgagcgcaaggcgctgccctcgcatcagatgcgttctttc

SEQ ID NO: 5025 - DNA, 747 bp, Bacillus clausii
accaatattcgactgaccctgagggcggcatgtttttcatgagaattgaatttgcatggcaggaagaaaaaacagcgttttccgaaatcaaacaagctttttctgatcttgcagatgccgaacattaccaatggcggatggagcaagcatcgcgaaaaaagcggatggcgattttcgtctcaaaagaaaatcattgcttgtcagagctgttatggaagtggcgagctggcgaactttatgctgaaatcccacttgtcattagcaatcaccctgacaataaagaagaagtggaagcttacggcattccctttttccacataccgtctacaaaggctaatcgccgtgaagcagaagacaaagcgattgaacttctccatgaacacaatattgaacttatcgttcttgcccgttacatgcaaattttatcgccaacatttgtcagcacgttccctcaacaaatcattaacatccatcattcgtttttgcctgcttttatcggcgccaacccttatgctaaagcatttgaacgaggcgtaaaactgattggcgctaccgcccattacgttacagatgatttggatgagggcccgattattgaacaagatgtgttgcgagtgaaccaccgccatacaacagctgacttacgaatcgccggccgtcaaatcgagcggattgcattggcccgagctgtaaactggcatttaaatgaccaattgattgtttataacaacaaaacgattgtctttt

SEQ ID NO: 5026 - DNA, 1554 bp, Bacillus clausii
atgattcctggcttaatcgatatccatttgcatatcgagagctcgatggtcacaccagaaactttttcgtgggcactattacgaaatggcgtgacaacgatcgttgcagagcctcatgaaatggccaatgtgtttggaatcgaaggcattaaagccatgattgaggcaagcgcagcctgtacggttgatatgaaatatgcgatccctagttctgttcccgctactagcttggaaacgactggcggcgccatcggaatcgcagaaatggttgaattaatggacacagaggacatccaatgcttaggagaaatcatgaactatgtcgatgtcatttcaaagcctgagtcaaaaacaaaccaaatcctcaagcatttccggcgttcctatcctgctcttcctatcgaagggcatgtgcctaagctgacagggctcgaccttcatcaaattgttgctgccggaattgggtctgaccatacacaccaaacgagagaaggaatggaagcacgcattaaagctggcatgtttttagaaatccaagaaaaatcgatgaccgacgacgtgctttcctatttgattgaaaacgacgtccgagaacatttttgctttgttactgatgatgtcatggctgattctctttataaacgtggccacttaaatgttcttgcaaacaaagcgctcgcagcaggaatgaagtttgaggacgtcatttatgcttgtacaatggcacctgccaagcggatgaaacttgatgaccggggcgcgattgctcctggaaaaatcgctgacttcagtcttcttgcagaagacggccaatttgttttttccgctgtttataaagatggaatgctcgcctttgatgcagcaagcccgtacaaacaaacgccaaagccaaggcagtttccaccccatttttacgaaagcgtcaagcttgctcctctacaggatgaggattttcacgtggttgccgaccgccaagacggcatccatgtttgccgggtgatgaatgtcgcagatggctcaacctttacaaaggaaactcaggaaagggtgcctgttgcaaacggcctccttcaatggcaagacagcgactttcgtcttattgccacatttgaacgctacggtaaaacgggcgggcgtgcccacggcctgatcgccggagacattatacagcgtggagcaatggccacaacgtattctcacgacaaccataacttgctcgttatcggcgcaaacgtcagagacatggtttgtgcagcaaacgcagtcatccaagcacaaggaggctgtgcggcagtagagaacggggaagtgaaagcgatgcttgaactgccagttggcggtattctttctgaagcgcccctaaccgagcttgcgccaaaggtcgaatcgttcgttaaagcgctaacggcattaggttataagcattacaatccgattatgtcactgtcgacgttatctttgccagttagccctgccctgaaaattactgatttcgggttaattgatgttaataacggcaaagtcgttccattgtttgtaaacgaggaaagctag

SEQ ID NO: 5027 - DNA, 213 bp, Bacillus clausii
  misc_feature (1)...(213): n = A,T,C or G
attaaagcntggtgaatttatccacacgtttggngatgcccatttgtacagcaaccatattgaacagacgaagcttcaattaacgcgtaaaccaaaacagctgccaacgatgcatatcaatccagaggtaacagacctgtttgcgtttacttacgatgattttgaactgaaacattatgatcctcatccgcatattaaagcagaggtgtccgt

SEQ ID NO: 5028 - DNA, 537 bp, Bacillus clausii
ccatttatcatacaaacgacatccacagcggttttgccacatggccgcgaattgtctcatatataaagcggcatcgccatccccttatgcgctatgtcgatttaggagaccatgcagacagggcaaacccgcttacagaagcgacttacggaaaaggaaacattgagcttttaaatgaagcaggcgttgattttgccgtacctggcaacaacgaaggtgtgaccttttccaaacaaatgcttcacgagatgtacgagcacgcttcattccaagtgcttgccgccaatttgattgaccaacaaacagggacttatccgcactgggtcaagccttattgggtcgatgaaatggaaggtggcattcggatcggctatattggctacactgcctccatgatccacttctatgagcagttgggttgggatgttgctttttctatagacagacttcgccagttggcgcaacaagttgctgccaaggcagatgcacttatccttctctcccatctagggctgccccgggatgaacaaattgctg

SEQ ID NO: 5029 - DNA, 426 bp, Bacillus clausii
  misc_feature (1)...(426): n = A,T,C or G
tgatgggaagcgctttaggagggctcgaagcaggaacaagagcaggaaaacagcggcggaaattcntcgttgtcacgcagctgacgagcacggacagccgtatgctcaatgaagagttgctgattgataaggcgatggatgaagttgtagtacggtacgcgcagcttgcccaggaaagtggattagacggtgtcgtttgctcggcccgtgaagtcccccttatccaagcagcgtgcagcaatcgatttttgactgttacgcctggcattcgcaggcaagacgaccaagtcggggaccaagtgcgtgtcgtcacaccaggggaagcaaaagcgctcggcagttgggcgattgtcgttggccgaagcattacagcagcagcagatcctctagctgtttaccgagaaatgaaccaagattggaaagggg

SEQ ID NO: 5030 - DNA, 447 bp, Bacillus clausii
gcagaacgattgcgaaccatttacttgatataaaagcggtgacactttcacctgcaaaaccgtatacgtggagctcgggattaaagtcgccaatttattgcgataatcgtttaacactttcctatccgcatatacgcaacgaaattgctgaggggctagttgctatgattagagatgctgcccctgaagctgacatcattgccggcacggcaacagctggcatcccacacgctgcttttgtggctgaaaaacttcaattgccaatgatttacgttcgttcgagtgccaaaggccatggaaaacaaaatgcgattgaaggacatttgccgcctggcagcaaagtagttgtaatcgaagacttaatctcgactggtggcagttccattgcagcagcggaggcattgcgcgcggctggggcagaggtgctgttcgttgccgcgatctttt

SEQ ID NO: 5031 - DNA, 409 bp, Bacillus clausii
  misc_feature (1)...(409): n = A,T,C or G
atggaacgtttgcaaataagcttgccaggcttagagatgaaaaatccggttatgccggcatcaggctgttttggtttcggaaaagaatacggccaattttttgatttaaatcagttaggggctattgcgataaaagcaacgacaaaagaagcgcgctttggcaatgaaacaccgcgagtggcagaaacaaaagcaggcatgcttaatgccatcggcctgcaaaatccaaggcttcaaggggtaatccaancaagaattgccaccgtttgaccattaccatgtgccgatattgggcaatattgctggctccaccatggatgattactccaaattgctgcaaaactgtcacaacaaccgaacgtttccacaatccaatttgaatatctccntgccccaaccttaaacaggg

SEQ ID NO: 5032 - DNA, 813 bp, Bacillus clausii
cgaccataaagatattcaaaaaggccaagcaaaaggtgtcggcaataccgttatgtatgtcggcgcaagcacaggccgcgatggcattcatggtgctacttttgcctcggaagaattaagcgaagactccgatgccaaacgtccggctgtccaagtgggcgacccgtttatggaaaaacttttgctggaagcatgcctagaagtggttcagtcggatgcgcttattggcattcaagatatgggcgccgctggccttgtttcttcttcagccgaaatggcgagcaaagcagggtcagggatcgaaatgaacttggacctagtgccacagcgtgaagcagggatgacgccgtatgaaatgatgttgtcagaatcacaagagcggatgttgctcgttgtcgaaaaagggcgagaacacgaaatcaaagcgatttttgaacggtggaacctccatgctgtggaagtcggtgttgtcacagatgatcgccggctccgtttaacccataaaggcgaagttgtcgctgatgtgccggtcgatgcgctggcagaagatgcgcctgtttaccataaaccatcaaaagtgcctgcctattttgacgtttttcaacagcaggctccttatattcctgagataacagacgcgaatgaaacgctgctgaagcttttggctcagccgacgattgctagcaaagaatgggtgtatgagcaatatgattatatggtgcaaacgaataccgttgtcgagcctggctcagacgctgcggtgatccgcatccgcggcacgaataaagcattagcaatgacgaccgactgcaa

SEQ ID NO: 5033 - DNA, 342 bp, Bacillus clausii
  misc_feature (1)...(342): n = A,T,C or G
atgccgtgcttcttccaggtggcttttcccatggcgattacttgcgttctggagccattgcccgctttgcgccaattatgccagcagtcatccaagcggctgaggcaggcaagcctgtactcggcgtttgcaacggattccaagtcctgcttgaagccggtttgcttcctggggcaatgaagcgcaatatcgatttgaaatttgtatgtcgcacagtcgaattagttgtcnnaaacaccaaaacgatgttttcttctggctatgaacaagggcaaacgattcgcattcctgtcgctcatggcgaaggcaactatgaatgtgatgccgaaacgctagcagaac

SEQ ID NO: 5034 - DNA, 480 bp, Bacillus clausii
attgcaaacaatcgggcagcggaccagtgttcgtttgacttcggctggccaaaaagacttgggcgttaacgactttacaaaaatcccaaatggcgggcctattattgaagaccgcttttcgctcctgtattcagaaggcgtagccagagggcgcatcggcctcaacgagtttgtcgacctcgtctcgacacgagcagccaaactgttcggactgtatccgaaaaaaggctgcatcgctgttggagccgatgcagacatcgttttgtttgaccccgaagaagagcgtgtgctatcagctcgtacacaccacctcgctgttgattacagcgcctttgaaggaatgcgcgtaaaagggacgccgcggaccgtgctgtcgcggggaaaagttatcgtccgcgatcaaacctatgtcggcactccaggagaaggagcgtttttaaaacgggcgcgttatggggagttatggacgaatgatttagt

SEQ ID NO: 5035 - DNA, 747 bp, Bacillus clausii
  misc_feature (1)...(747): n = A,T,C or G
gagtggacggtcttgaactaaattttggctgtccccatggcatggcggaacgaggcatgggttcggcctctggccaagtgcctgcgctcgttgaacagcaaacagcttgggtaaaagaagtggcaacgacacctgttatcgtcaaacttacgccaaatattactgatattaccgccactgccgaggccgctgctcaagggggcgctgatgccattagtttgattaacacaatcaacagccttgccggcgtcgacatcgacacttggcaaacgataccgaacgtcgatggcctaggcactcatggcggctactgcggcccagctgttaagccaattgccttgcatatgcttggcgattgcgcccgccatccgaatgtcgatataccgatttcaggaattggcggcattgctacttggcaagatgcggtgcaatttttgctgatgggcgcttcaaacgtgcaagtgtgcaccgctgccatgcaccacggctttcgcattgtcgaggatttgcttgatgggctatccgcctatttagaggaaaaagggcttgcttctgtgcaagatttagttggccaatcggttcatcgctattctgaatggggcaacctcaatttaaaccatcaagtcgtcgctcgaatcaatcaggatgtntgcatcaactgcaacaaatgccacatctcttgtgaagacacggcccaccaatgcattggccgctatacagacgaaaacggtgctccttactttgaaa

SEQ ID NO: 5036 - DNA, 519 bp, Bacillus clausii
  misc_feature (1)...(519): n = A,T,C or G
ncttaaagtggaccaatttttaaaccaccaagtcgataccaacttgatgagcgcaattggcgaggaatttgcccgcctatttgctgacgaacangtaacgaaagtcgtgaccatcgagtcgtctggtatcgctccaagctttatgtgtgcccattctcttcaagtgccactgatttttgctagaaagaagaaatcagtgacgatggacaaagaaaacgtctattcgagtcgcgtgtactcctttacaaaaaaggaatattcggaggtgaccgtttcaaaggattggctttgcgctggtgaccgtgtgttaatcattgatgatttccttgcaaacggacaagccgctacaggactcactcaaatcgtcgaagaagcaggcgccactgtagccgggattggcatagtgattgaaaagtctttccaagacggaagggcgctgcttgaaggaaagggctatcggattgaatcgctggcacgcatttcttcactagaaggcaacaaggttcagtttgtagaaga

SEQ ID NO: 5037 - DNA, 558 bp, Bacillus clausii
gcacggccgcacaactgcttgcaattacgacagtgaacggaaatgtctctttagaaaaagcgactgttaacacgttaaaagtgttgacacttcttcataaagagggcgacattcccgttatccaaggggctcatgcgccacttcggcgcccgtgcttttttgaacatagcgtccacggcaatgacggccttggcggtgctttgcctcattttgagccaacggcacagcctgccgacggttatgctcctgattatataatcgaacaggcaaaccgttatccaggcgaactcacgcttgtcatgacagggccgctgacgaacttggcgttagcgcttgaaaaatgccctgatttgccaaaactcgtggcaggcgtcgtctatatgggtggtgccgcctttacacatggcaatgtcacccctgtggctgagtacaacatgtatgtcgatcctgaagcagcgcgcaaggtgatccatgccggcttcgccccccttgtgcaagtcggattagatgttacccgcaaagcacttcttcactagggaaaacattggatcgctcgtt

SEQ ID NO: 5038 - DNA, 540 bp, Bacillus clausii
aggacaacattcatttccaagtcgagcgcgagtccaaaaatgtgatcgatgctgcttcgaacggagcattggatggactaaaattagcgctcaatgtgggcgcgatgctgattgcctttgtttccttaattgcactgatcaacttgtttttaggcacgattggcggatggtttggctatggttccattacgctagagcaaatcctcgggtacgtgtttgccccggtggcctggatcattggcgtcccatgggaagaggccgtgcaagcgggctcgtttatcgggcaaaagacgattgtcaacgagtttattggttttgatgcccttgtgtcggctgcgggcgaggtgtcagaacgaacatatgtcattacgagctttgcgttgtgtgggtttgcgaacattagctcgatcgcgatcttgcttggcggccttggcggactcgtgccagaacgccgtcctttaatcgctaaatatgggttgaaagcacttattgccgcaacgcttgtcaacttaatgaacgctgcaattgcgggcatgcttg

SEQ ID NO: 5039 - DNA, 205 bp, Bacillus clausii
atgaatcgaatcgttgtcattggatcagctggctctggtaagtctaccttgtctcgaaaactcagtgaacgtttatcgttgcccgttattcatttagaccgtttttattggaaacctaattggacgccaaccccgaacaatgaatgggattcgtttcttaaagattcggtaagccaaaataaatggattatcgatggaaattatt

SEQ ID NO: 5040 - DNA, 471 bp, Bacillus clausii
  misc_feature (1)...(471): n = A,T,C or G
nccgttccagcgggaaaatggtatttttcaacctggcggcgaatggctaaagcttgcagtcgtggaacgccatcaggcgacgggacatatcggacttgccattgtaaagggctttcctttttcagagggggcgattgccgcgactgtagcccatgattcccataacctcatcgctgtagggggagatgatgaaagtttgtaccatgccattcaccatgttgctggcttagggggtggaatggccgtcgtaaaggaaaacaacgtgcttgcggcaatgcctctcaaactgggcggcttgatgtcaacggcttcagcggaaacagtcaaacaacagctcaatgagctccagcaatcactcgtccatctcggctataaagagcaaatcgatccgtttttaacattggctttccttgcactcccagtcatccctgcacttaaactgacgtcaaaagggctgtttgatgtcaacgc

SEQ ID NO: 5041 - DNA, 339 bp, Bacillus clausii
gcggcggtttgcctttgcgacagatgataagcatctagatgacttgctgaaagaaggcagtgttgactttaatgtccgcaaggcgattgaactcggcatggagccactccaagcgatccaaatcggcaccttaaatgcagctgaatgctttcaacttgatgataaaggggccattgctcctggaaaagaagcgtcgtttctgttcgtgtcagacctttccacgtttcaagtcgatgccgtgtatgcaaagggcatgctcgtagccgaaaaaggcgaactaacgagcccgatccgcgctccttaccccgtgccagagcgattattgaacagtgtccatat

SEQ ID NO: 5042 - DNA, 726 bp, Bacillus clausii
gcgctgatgcaattgtgctcgacgtaaaatgcggatctggcgcttttatgaagacgttggaccatgccgttgagcttgcggaagccatggttgaaattggttcgagcgttggccgtgagacgatggctgtcatttcagacatgagccaacctttaggcagggcagtcggcaatgcgttagaagtgaaagaagcttttgctgttttgaaaggtgaaggtcctgctgatgtccgcgagctttgtcttgtattaggcagccatatggtttatttggctaaacgagcagagtctgttcaagcggcgcggcaacttcttgaagaggcgattcaaaacggtgacgcgctagagacgctgaaagcatttatcgcttcacaaggcggtgacccatcggtcgtcgaaaatccagcacaaatgccccaagcatccgagcaaatcgctgtctctgctaaaaaatcaggctatattaaagaaattgcagccgataaaattggcacagccgccatgcagcttggcgctggaagggcaacaaaagaggacgagattgatttagctgtcggccttgtgcttgaaaagaagacaggcgattacgtagaggcaggagaaacacttgcaaccctttatgccaacgaacaaggaatagaggaagcaagaaagcttgtagaagatgcttatcagattgtcgatgagaatgtggaacgaccaacgctcgtttataaagaaatctacg

SEQ ID NO: 5043 - DNA, 637 bp, Bacillus clausii
atgaatttaattttaatgggattgccaggcgccggcaaaggaacacaggcggagaaaattgtgaacgactatggcattccgcacatttctacaggcgatatgtttcgcgctgcgataaaaaacgaaacggagcttggcttgaaagcgaagtcgtttatagacgcaggtgatcttgtccctgacgaagtaacaattggaatagtcaaagagcgtttgtcggaagacgattgcgagaatggttttttgctcgatggttttcctcgtaccattgcccaggcggaagcgctggaaggcattctttcatccctcggccaacagcttgaccatgtgttgaatattgcggtcccgaaagaacttctgatggagcgtttaacggggcgccgcgtgtctcctacttcgggtaagacgtaccatattgtttataacccgccaaaagtagaaggcaaatgtgatattgacggcagcgatttaattcaacgcgacgacgacaagccggaaacagtcaaaagacgcctagaagtaaatgaaaagcaaacgaagccactcattgacttttatgaagcaaaaggctacttaagacaagtagacggcaaccaagacatgaacactgtgtatgctgagataaaagcgattctat

SEQ ID NO: 5044 - DNA, 456 bp, Bacillus clausii
  misc_feature (1)...(456): n = A,T,C or G
tcaccgctggacgaaaacaaggctgcgggaacatctaagtgttgtaaaaggggagcgcccgccaacaatagtcttaaaaaatgctacgtatttaaaccatgccagaagaagatggctgaaagcaaatatttggattgcggatgaccaaattgtttatgttggcaaaagcttgccagagcagataggcgatgcggaagtggttgattgtacaggcgaatacattgttcctggttatattgagcaccatgcccatccatttcaactggataatccatacagtttggcaaaatatgcttatgagcgtgggacaaggacacttatcaatgagaacttgggttattttttgaacttggaaaaaaagaaagcgctttccttgatcgagaaactggaagaattgccgacaacgatgtactggtgggcgcgctacgattcacaaacngaggtaatcaaagatga

SEQ ID NO: 5045 - DNA, 329 bp, Bacillus clausii
  misc_feature (1)...(329): n = A,T,C or G
atggaacgtatttcatgggatcaatattttttagcgcaaagcaaattgctttcgctgcgaagcacatgcccacgtttaaaggtaggcgcaacaattgtgagagacaagcggattattgctggtggctacaacggatctgtttccgggtcggaccattgtnttgataaaggctgttatgtagtcgacaaccattgtatccgtaccgttcatgcagaggtaaatgcgttgctgcaatgcgccaaatttggtgtgccaaccgctggcgcggaaatttacattacacattttccttgcatccattgtaccaaatcgctgattcaagctggcat

SEQ ID NO: 5046 - DNA, 288 bp, Bacillus clausii
  misc_feature (1)...(288): n = A,T,C or G
aacaaaaaaagccagttttgatttttacatcaggaatggatacacgggatgaagtcggctatgtgtccagccgtgtcggccttcgtcgccgggcggtgccagtattcgatgacacaaatatttttgactatgttgaaagctgcccacaaaagccgtactgtgtattaatcgatgaagtgcagtttctaacaaaagcgcatgtcctccaactggccaatattgtcgaatacatttaaaacattccgggtaatgggttttgggcctaaaaaatgaattttcgcnacgagt

SEQ ID NO: 5047 - DNA, 792 bp, Bacillus clausii
  misc_feature (1)...(792): n = A,T,C or G
aatctgattttgaatggcaggcggttccgcaagggcggcggcgtggtttttggcaaatgtttgtgttaatggtaggcttcacatttttttcggcgagtatgttggcggtaggcacgcttgggcaaggcttgtcttttagtcggtttctcattactgttttagtaggcaattttattcttggcgtatatacaggggcactggcctacatcgcagcaaagacagggttatctacccatttgttgacacggtttgcgtttggtgaaaaaggctcctatttgccttccctgcttctgagcgttacgcaaattggctggtttggcgtagggttaatgatgcttgccgtgcctgtgcaaaaagtaacaggtgttgacttatggctgcttctccttttaggcggcgtcctgatgacagcgactgcctatttaggtgtaaaggcattgacgatgttaagctttgtcgcagtaccagcgatcgcagtattaaggacaatctctagttccattgctgtcaatgatatgggcggcccggctcaattgtttgcttatcagccgacggaaggaatcggcatcgcggctgccttatcggtttgtattggctcctttataagcggcggcacgttgactcctgattctgcccgttatggctcaagcaaaaaagtcgcggtgtcgacgacagtgattgccttctttttaggcaactcgttaatgtttttgttcggtgcagtcggcgcaatatccactggttttgctgaaatttcagaagtcatgtttacacaagggctgatttgcccng

SEQ ID NO: 5048 - DNA, 402 bp, Bacillus clausii
aattccccaaagaagacgtggcgaaaattcgcgagaacgcaagcttttgtgtagatcgtattttggaaattgaagaagaaacgcgccatgatgtggtcgccttcacgcgggctgtttcagaaacgcttggcgaagagcggaaatgggttcattacggcttaacgtcaacagacgtcgttgatacagctctgtcgtatttgctaaaacaagcaaacgcgattctggcagaagacttaaaccgctttttagacattataaaaacaaaagcgcaagaacataaatatacgatcatgatggggcgcacacatggcgtccacgcagaaccaacgacatttggcttaaagctccgccctttggtacgaagaaatgaaacgaaacattgaacgcttccaccatgcggcg

SEQ ID NO: 5049 - DNA, 476 bp, Bacillus clausii
  misc_feature (1)...(476): n = A,T,C or G
atgtcttcagtcgttgttgttggaacacagtggggcgatgaaggaaaaggaaaaatcacggactacttatcagaaaaagcagaagtggttgcccgctaccaaggtggaaacaatgctggccatacgattgtgtttgacggtaaaaaatacaaacttcatttgattccttcagggattttttacaaagataaaatttgcgtcattggcaacggcatggtaattgatcctaaggcgcttgtcgaagagcttgcgtatttgcatgaccacggcgtcgatacgagcaatttgcggatttcaaaccgcgcccatgtgatcttgccttatcatataaaacttgatattgtcgaagaagaccgaaaaggcgccaataaaattggcactacaagaaaaggcatcggtcctgcctatatggacaaagcagcgcggattggcattcnaatcgccgatttgcttgaaaaagacacgtttgctgcaaa

SEQ ID NO: 5050 - DNA, 192 bp, Bacillus clausii
  misc_feature (1)...(192): n = A,T,C or G
gcgacacagcacatacgattaccagtcggcatcggcgccgttncctcgattgcggcatgacgtccgattgggcgcgcattccatggnacgtgctggaaatcatctccacccggatcgtcaacgaagtcgaacacgtcaaccggattgtgtacgacattacgagcaagccaccttctacgattgagtgggagt

SEQ ID NO: 5051 - DNA, 131 bp, Bacillus clausii
gaagcaacggccaaaatggtagagcaactcggtgggaaagtggtcgggattgccttcctgattgaattggcttatataggcggccgcgataaactaaagcagtatgacttgttttcattaatgtcttacga

SEQ ID NO: 5052 - DNA, 336 bp, Bacillus clausii
  misc_feature (1)...(336): n = A,T,C or G
aggtgcccaactgntaaaagttttggaaancggagtgagtggctatccagaaccgancggcggttttccgcaaattagcgggttttcgtttcagttcgatcccancaatgaacctggacagagagtccattctgttctcgttaaaggcaaaccgctacaagaaaacgaaacatacttgcttgctacaaatgattttcttgctgctgncgcagatgaatactcggatttggccaatgcnccgattgtcaatgaatttagcgcagtcgatgaattgctgattgagtacttgcaagacgcaggcgnaatcgctcctaaaatagaaggcagaattcaaat

SEQ ID NO: 5053 - DNA, 247 bp, Bacillus clausii
  misc_feature (1)...(247): n = A,T,C or G
atggactctctgtccaggttcattgntgggatcgaactgaaacgaaaacccgctaatttgcggaaaaccgccgntcggttctggatagccactcactccgntttccaaaacttttancagttgggcacctggtcacttctacggntacggcgtaattgccaaaaggggaaacctcgactaagtcccctttcgttatcattcctgcttgaacggaagcacggatgccgccttcatttgtcaaggcaat

SEQ ID NO: 5054 - DNA, 786 bp, Bacillus clausii
cggcggatgaattaaaagaaatgaacccaatcggcattatcttttcaggcgggcctaacagcgcgtatgcagaaggttcccctaaatgcgaccctgccatttatgatttaggcattccgattttagggatttgttatggcgtccaattaatgacacatcactttggcggcaaagtcgacaaggcttcccatcgtgaatacggaaaagcgttattaaatgtggaaaaccaatcgtcgctctttaaaggcttgcccattgagcaaaccgtttggatgagccatggcgacaaaattgtggctcctccagagggctttaccgtcgacgcttccaatccttcctgcccagttgcagctatgagcgatgagtcccgcaacttgtacggcgtgcagtttcatcccgaagtgcggcattccgaatttggcaatgaccttttgaaaaattttgcgtttgacatttgcggcgctaaaggcgattggtcaatggaaaacttcattgaagaggaaatcaagaaaatccgcgaacaagtaggggaccgccacgtgttgtgcgcattaagcggtggtgttgactcctccgtagtagcggtgctcatccataaagccattggcgatcaattgacatgcatgttcattgaccatggcttgcttcgcaaaggagaagcagaaagcgtcatggaaacattcagccaaggctttaacatgaatgtcatcaaaattgacgcatcagaacggttcttgactaaattaaaaggcgttaccgatccagaacagaaacggaaaattatcg

SEQ ID NO: 5055 - DNA, 564 bp, Bacillus clausii
ggccatgtatcgggcgatcacatttgcggcgttagctgagggcgttgatttgcacgacggggaagcgcttggcaaacttctagaaaagagcgagctgcgtttggaatcatccaatgaagggacggctgttttctggaacggcgctgacattaccgctgcgattcgtacagacgaagtgaacagcaatgtgtcgcttgtagcgagccaccgggaagtacgggaaggcatgacagcgatgcagcaggagctggccaaatcgaaaaacgccgtactagacggacgcgatattggaacccatgtgctcccagatgccaatgtaaaagtgtttttgactgcttcagtcgaagaacgggctcgacgccgccatcttgagcaattggaaaaagggctcccgtcggatttcgaacaactaaaaaaagacattgctaagcgtgatgaactggattcaacacgagcgatcgctccccttaagcaggcagccgacgcgcaagtcgtcgacacgaccagcatgggaattgatgaagtcgttgagacgattctcgatttagtaaaggagcattcgcg

SEQ ID NO: 5056 - DNA, 591 bp, Bacillus clausii
agaaaaaggccaatccaatcgtctcgatttataaagccattaaacgcggcgacgacatttctctgtttaaagcactagtagcttctgtctacttagaaagctttttgttctacagcggtttctactacccgctttatttctacggccaaggaaagttgatgcaaagcggcgaaattataaacctcattcttcgcgatgaagcaatccatggcgtatatattgggctgttggcgcaagagatttacaacaagcaatcccctgatacgcaaaaggaactgcaccaatttgcgattgagctcttagatgaactgtataaaaatgagctcctctatacggaagatctgtatgatcaagttgggctttcccacgatgtaaaaaaattcattcgctacaatgccaataaagcgttaatgaaccttggctttgatccttattttgaagacgaggaaatcaacccgatcgtcctcaacggactgaatacaaaaacgaagtcacatgactttttctcgatgaaaggaaacggctacaaaaaagcaactgtcgaaccccttcgtgatgaggatttcttctttccagaagccgaggaaaaag

SEQ ID NO: 5057 - DNA, 648 bp, Bacillus clausii
caatcttgcggtccgaatctggctacccatacattatgtttgccgacaacgtaaacaaggcccatgcaaatggccatattagtaatgtcaagttttcaaacttatgttcagaaatcttacaagcctcggaagtatcgacttacaccgactacggcgaggaagatgagatcggtcttgacatttcctgcaaccttgggtcgattaacattatgaacgtgatggaaaacaaatcgcttgaaaacacagttagcctggcgacagacgccttaacgcgcgtatcagagtcaaccaatattacgaatgcgccagcagtgcgccgcggtaacaaactgatgaaatcaatcggcctcggcgcaatgaatttgcacggttacctagccaagcagcatattgcttacgaaagcgaagaagctcgtgattttgccaataccttttttatggcgatgaactatttctcaattaaacggtctgccgagattgccagggatcagggtgaaacgtatcacggttatgaaggcagtacgtacgctgacggctcctactttaaaaagtatatcgagaatgacttcacgcctaaatttgacaaagtcaaagcgctgtttgacgggatgtttgtgccacaaaagaagattggcaagctttgcaagc

SEQ ID NO: 5058 - DNA, 554 bp, Bacillus clausii
gatttaaattacggaaagccaatgatcgacatatttaaccttgttggcttagatgcatttacaattggcaaccatgagttcgattacgggcaagaccatttaaaaacgaacatggaacaggcaaactttccttggcttgccgccaaccttgatacaggggcgacggatgtcgaaaatacgaaaccttatgtgttattagatgcggatggcatctccgttgcattatttagcttaacgcaggcgccgccagcaacagcaccagcaaatgtagttggtatggattttgataatgattatataggaacagcgcttgcttataaagacgagttggaaagtcaagctgatgtcattattgctctgactcatatcggctacgaccaagaccgccgccttgcgaatgaggtcgagtattttgatgctattataggcggccattctcatacgacattaaacgctcctgccattgtaaacggcacgccaattgtccaaacgggttccaatttgcaacatataggtgaactggagtttacctacaatgaaacgactgatgaggt

SEQ ID NO: 5059 - DNA, 654 bp, Bacillus clausii
gattgatttgcaaacatcaggtctacactacgaaattataacaggaatgacaggcaactttattgacgtgaacgtatcaattgatggccagccacttgaggcagactccacttataaagtggcagttgctgactatattggcactggcggatcaggataccattttgaaggcgaaatcttacaagaaacagtcggcctaatgacgacggcaatggaacaatatgctttggaacgtacggctgcaggccacgcgcttgactacgaaagcgaggggcggattgctttaaaagtggatccaactgcgccaaatccaggggagatcatcggctcgacgaacacaggcctttattctgaaaacaaaaacaaacaagatgttggccttggcaacttatacgccgattcaattcgcgctaaaacaggcagcgactttgcgcttttaaacggttcttccatcactggagaaattcctccaggctcgattacagacaaacaaattgaagctctcgaccgttatggcaacaccattgttgttgtcgaaacgacaggttcccgcttaaaagaagttttactcgagcaatcacgttaccatcgaggcgttgatttgcaaggttctggcttgacttacacgctcattccagacgagaacagcggctt

SEQ ID NO: 5060 - DNA, 480 bp, Bacillus clausii
  misc_feature (1)...(480): n = A,T,C or G
tgctattatcaacactggcgtagcaggaggcctcaacgcaagtatggctgttggcgatcttgtcatttcaacggaagtacgttaccacgatgttgacgcaactgtgtttggctatgaatatggacaagttcctggaatggtgccagcgtatttaccagatgcaaccttaattgcagcagcgaagacagccgcgcaaaaagtaggcttccattcagaagaggggctgattgtgacaggagattcctttatgggggaagaaacgcgtgtaaacgaagtcaaaacattatttcctgctgcttattgtgcagaaatggaagcaggcgcgatcgctcaagtatgccaccaattccaaaccccatttgtcattatccgggctttgtctgacgtggctggccaagacgcaaagatgtcatacgatgcatttttagaaaaatcagctgtcaattccgctaaacaagtgatattgatgntcgaccactt

SEQ ID NO: 5061 - DNA, 519 bp, Bacillus clausii
gaatcattttagatggcgatgcgattcgccgcgcgattacacgaatgtcccacgaagtgattgaacgcaataaaggcgttgacaactgtgtgattgtcggcattaaaacacgtggtatttatttggctaaacggctcgctgaacggattgaggaaattgaaggccaggctgtccctgtcggcgaagtcgatattaccctttaccgggatgacttgacgccgtctacatcaaacaatgagccgcttttgcgcggcaccaatattcccgttgatgttaccggccgtaccattattcttgtcgacgatgtcctttatactgggcggaccgtgcgagctgctcttgatgcactggtcgatcttggccgtccagcatcgatccaacttgctgttcttattgaccgggggcaccgggaactgccgatccgtcctgattatgttggcaagaacgtgccgacctctaaaaaagaacgaatctcggcgcaactaagggaagtagacgccgaagacgctgttacaatta

SEQ ID NO: 5062 - DNA, 192 bp, Bacillus clausii
atgaagcaaacgaacatgagattaggcatcaaagaaattccacgccctggagagtggctgctgtttagcttacagcatttatgcgccatgtttggggcaactgtacttgtaccctttcttgtcggaatgagcccggctacagctcttttttcaagcggtctcggtacacttgcatttattcttggcacgaaa

SEQ ID NO: 5063 - DNA, 410 bp, Bacillus clausii
atggttaaaggggaattgctttacgaaggcaaagccaaacggattttccgcagcagcgaagaaggagaactgtgggtcgaatataaagatgacgccacggctttcaacggtgaaaagaaagagacgcttgcaggcaaagcacggctcaataatgaaatttcttctctcatctttgccacgcttgcgaaaaaggggattccgtcgcactttatacggagattatctgacacggaacaactggtcaaacaagtagacatcattcctcttgaagtagtcgtccgcaatgttgtcgctggcagcatggctaaacgacttggcattgaagaaggaacggtgctgaaaaagcctcttgtggagttttattataaggacgatgccctcggtgacccattggtgaccgaggaccacat

SEQ ID NO: 5064 - DNA, 1377 bp, Bacillus clausii
atgccgatcactgcctacgcttgctggatgaattgtggctacaaacgactttacattaattgttggaggaaacaacgaatgattgaacggtacacacgcccagaaatgggtgctatttggacagatgaaaaccgctataaggcatggcttgaagtagaaattgtcgcttgtgaggcttgggcggaactaggcgaaattcccaaagaagacgtggcgaaaattcgcgagaacgcaagcttttgtgtagatcgtattttggaaattgaagaagaaacgcgccatgatgtggtcgccttcacgcgggctgtttcagaaacgcttggcgaagagcggaaatgggttcattacggcttaacgtcaacagacgtcgttgatacagcgctgtcgtatttgctaaaacaagcaaacgcgattctggcagaagacttaaaccgctttttagacattataaaaacaaaagcgcaagaacataaatatacgatcatgatggggcgcacacatggcgtccacgcagaaccaacgacatttggcttaaagctcgccctttggtacgaagaaatgaaacgaaacattgaacgcttccaccatgcggcggaaggcgtccgctttggcaagctttcaggggcagttggcacatatgccaatattgacccacgcgtcgagcaaattgtgtgcgaaaagcttggcttaaaccgagcgccgatttccacgcaaacgctccaacgtgaccgccacgccgaatacatggcaagcttggcgttaatcgcgacatcgattgagaaatttgccgtcgaaattcgcggcctgcaaaaaagcgagctgcgcgaagtcgaggaatatttcgcaaaagggcaaaagggctcttctgcgatgcctcataaacgcaacccaattggctctgaaaatatgacaggccttgcccgtttaatgcgtggttacatgaacacagcttatgacaatgtcgtcttgtggcatgaaagggatatttcccattcatcggccgagcgtgtcattttgccagatgcaacaattgtgctcaattacatgctgaaccggttcggcaacattgttaaacagttaacggttttccctgaaaacatgaagcgtaatatgacacggacgtacgggctcatttattcacagcgtgtgctccttagcttaatcgacaaaggcatggtccgtgaagaagcctatgaccttgtccagccgaaagcgacacaagcgtgggaggaaggcgttcaattccgtgaactggtggaaggagagccacgcattacgaatgtgctgtcgccagaggaattaaatgagtgctttaactatgaacaccatatgaagcatgtcgatacgatttttacacgtcttggtttaaacgactaa

SEQ ID NO: 5065 - DNA, 1297 bp, Bacillus clausii
atgattgaacggtacacacgcccagaaatgggtgctatttggacagatgaaaaccgctataaggcatggcttgaagtagaaattgtcgcttgtgaggcttgggcggaactaggcgaaattcccaaagaagacgtggcgaaaattcgcgagaacgcaagcttttgtgtagatcgtattttggaaattgaagaagaaacgcgccatgatgtggtcgccttcacgcgggctgtttcagaaacgcttggcgaagagcggaaatgggttcattacggcttaacgtcaacagacgtcgttgatacagcgctgtcgtatttgctaaaacaagcaaacgcgattctggcagaagacttaaaccgctttttagacattataaaaacaaaagcgcaagaacataaatatacgatcatgatggggcgcacacatggcgtccacgcagaaccaacgacatttggcttaaagctcgccctttggtacgaagaaatgaaacgaaacattgaacgcttccaccatgcggcggaaggcgtccgctttggcaagctttcaggggcagttggcacatatgccaatattgacccacgcgtcgagcaaattgtgtgcgaaaagcttggcttaaaccgagcgccgatttccacgcaaacgctccaacgtgaccgccacgccgaatacatggcaagcttggcgttaatcgcgacatcgattgagaaatttgccgtcgaaattcgcggcctgcaaaaaagcgagctgcgcgaagtcgaggaatatttcgcaaaagggcaaaagggctcttctgcgatgcctcataaacgcaacccaattggctctgaaaatatgacaggccttgcccgtttaatgcgtggttacatgaacacagcttatgacaatgtcgtcttgtggcatgaaagggatatttcccattcatcggccgagcgtgtcattttgccagatgcaacaattgtgctcaattacatgctgaaccggttcggcaacattgttaaacagttaacggttttccctgaaaacatgaagcgtaatatgacacggacgtacgggctcatttattcacagcgtgtgctccttagcttaatcgacaaaggcatggtccgtgaagaagcctatgaccttgtccagccgaaagcgacacaagcgtgggaggaaggcgttcaattccgtgaactggtggaaggagagccacgcattacgaatgtgctgtcgccagaggaattaaatgagtgctttaactatgaacaccatatgaagcatgtcgatacgatttttacacgtcttggtttaaacgact

SEQ ID NO: 5066 - DNA, 469 bp, Bacillus clausii
  misc_feature (1)...(469): n = A,T,C or G
atggttaaaggggaattgctttacgaaggcaaagccaaacggattttccgcagcagcgaagaaggagaactgtgggtcgaatataaagatgacgccacggctttcaacggtgaaaagaaagagacgcttgcaggcaaagcacggctcaataatgaaatttcttctctcatctttgccacgcttgcgaaaaaggggattccgtcgcactttatacggagattatctgacacggaacaactggtcaaacaagtagacatcattcctcttgaagtagtcgtccgcaatgttgtcgctggcagcatggctaaacgacttggcattgaagaaggaacggtgctgaaaaagcctcttgtggagttttattataaggacgatgccctcggtgacccattggtgaccgaggaccacatcggcatttaacgtcgnncgncagaggaagtagcgcaattaaaacaatgccgctgcttgt

SEQ ID NO: 5067 - DNA, 249 bp, Bacillus clausii
atgtataaagtgaaagtctatgtcaccttgagagaaagtgtgttagatccccaaggaggcgctgtcaaaagtgcgcttcacgcgatggattaccaggaagttacagatgtccgcatcggcaagtatatggaattgcagcttgaatctactgaaaagcttgaagagcgcgtcaaagagatgtgtgagaaattgcttgccaataccgttattgaagactaccgctttgaagtggaggaggttgtcccatca

SEQ ID NO: 5068 - DNA, 684 bp, Bacillus clausii
atgaagtttgcggtcatcgtgtttccaggctctaattgcgatgcagacatgtatcatgccattaaagacggacttggcgaggaagtcgaatatgtcttccatacggaaacgtctttagacggttttgatgccgtgcttcttccaggtggcttttcccatggcgattacttgcgttctggagccattgcccgctttgcgccaattatgccagcagtcatccaagcggctgaggcaggcaagcctgtactcggcgtttgcaacggattccaagtactgcttgaagccggtttgcttcctggggcaatgaagcgcaatatcgatttgaaatttgtatgtcgcacagtcgaattagttgtcgaaaacaccaaaacgatgttttcttctggctatgaacaagggcaaacgattcgcattcctgtcgctcatggcgaaggcaactatgaatgtgatgacgaaacgctagcaaaccttcgtgcaaacaagcaaattgtctttcgttacaatgagcatgtcaatggctccaaaggcgacattgctggcattaccaatgaacggggcaacgtgcttggcatgatgccgcacccagaacgggcaacagaaacattgctcggaaacgatcaaaggattggctgtttttacatcgatcttacgcaactggaggaatctcatgtcacagcttcttga

SEQ ID NO: 5069 - DNA, 330 bp, Bacillus clausii
gcgctgaaacgattaaagccgagcggctatatcgagaaatgggcttgacggatgatgaatttgcactggctgaaaaaatcgtcggcaggccattgaatttcacagaaacaggcttgttttccgtcatgtggtctgagcattgcagctataaaaattcaaaagtactgttgaaaaagtttccgactgacggcgagaacgtgctccaaggcccaggtgaaggggcaggcattatcgacattaaagacgaacaggcggttgtgtttaaaattgaaagccataaccacccgtctgcgattgagccgtaccaaggcgctgctactggtgtcggcg

SEQ ID NO: 5070 - DNA, 846 bp, Bacillus clausii
  misc_feature (1)...(846): n = A,T,C or G
cccttgtcaacgcaatgtgtgtcngtttgatcgaccataaagatattcaaaaaggccaagcaaaaggtgtcggcaataccgttatgtatgtcggcgcaagcacaggccgcgatggcattcatggtgctacttttgcctcggaagaattaagcgaagactccgatgccaaacgtccggctgtccaagtgggcgacccgtttatggaaaaacttttgctggaagcatgcctagaagtggttcagtcggatgcgcttattggcattcaagatatgggccccgctggccttgtttcttcttcagccgaaatggcgagcaaagcagggtcagggatcgaaatgaacttggacctagtgccacagcgtgaagcagggatgacgccgtatgaaatgatgttgtcagaatcacaagagcggatgttgctcgttgtcgaaaaagggcgagaacacgaaatcaaagcgatttttgaacggtggaacctccatgctgtggaagtcggtgttgtcacagatgatcgccggctccgtttaacccataaaggcgaagttgtcgctgatgtgccggtcgatgcgctggcagaagatgcgcctgtttaccataaaccatcaaaagtgcctgcctattttgacgtttttcaacagcaggctccttatattcctgagataacagacgcgaatgaaacgctgctgaagcttttggctcagccgacgattgctagcaaagaatgggtgtatgagcaatatgattatatggtgcaaacgaataccgttgtcgagcctggctcagacgctgcggtgatccgcatccgcggcacgaataaagcattagcaatgacgaccgactgcaatc

SEQ ID NO: 5071 - DNA, 648 bp, Bacillus clausii
gaaaaattgcgattgcggaagcagcgcggaatcttgtttgttcaggagcgaagccacttggcgtaacagactgcttgaattacggcaatccggaaaagccagaaattttctggcagctagaaaaatcgaccgatggcttaagcgaagcatgccgggagctagggacgcctgtcattggcggcaacgtctccctttataatgaacggtctggcggtgctgtttatccaactcctgtcatcggcatggttggcttggttgaagacgttgctcatattacgacgcagtcgtttaaagatgcaggcgacctgatttatgtaatcggtgaaaccaaagcagagtttggcggcagcgagctgcaaaaaatgctagctggcgaactgtcagggaaagcgccggaaattgatttggctgtagagaaagcgcgccaacagcaattgttgagcgcaatcgaacaaggcctcgtccagtctgcccatgatgttgccgaaggcggacttgctgtttccttagcggaaaaaatgatggaatgcccgtttggcgctgaaatcagtctatccctaagcgcagctgagctgtttgctgaaagccaatcacgttttattgtcaccgtgaaacctagcgatcaacaacgatttgaagatacggtcc

SEQ ID NO: 5072 - DNA, 795 bp, Bacillus clausii
ccttgttcgtagctgttgtcgcaaccatgtattttcaaaggatttttaaacttaatcccgattttattaggcttaattgctggtatttgttcgcactatggcaagggttgattgatttagagccgatccgcgcagccaactggttttccgtacctgaactaatcgttccgtttgtgacatactcgccaactgttaactgggcaattgttgcgatcatggcgccagttgctctcgtaacgcttgcagaacacacaggccaattgatggtattaagcaaagtagctggcaaaaactttcttaagcaaccaggaatgcacagaacggtgatgggggatgggttggcgactatgatcgcagccgcagttggcggtccaccaaataccacttatggcgaaaacgtcggtgttgttgccatcacgagagtgttcagcgtatttgttgtcggcggcgccgcggtgttggccatcgccttcgcctttgtcggcaaagtagctgcactgattagttcgattcctcaagcagtaatgggcggtgtttcaatcctcctatttggcattattgcctcggccggcattcgaatgcttgtcgataaccgagttgacatgggtgaaaaacgaaatatggtgattgcttccattatccttgtcgttggcattggcggggccgcgatccgctttacggattcgtttgaaattgccggcatgtcccttgcaactgtcattggccttattcttcacggattgttgccgaaccgcagtgttagttacggacaaaaagacatgtttgaatcagacg

SEQ ID NO: 5073 - DNA, 150 bp, Bacillus clausii
caagcagggagttgctccttgccgatgaaatatcgccagatacgtgccggctatgggataaagacacaaaggaacgttttgataaggatctttttcgcagaaatctaggaaacttacaagaaggctatcaagaaattttatcccggctag

SEQ ID NO: 5074 - DNA, 249 bp, Bacillus clausii; identical to SEQ ID NO: 5067

SEQ ID NO: 5075 - DNA, 618 bp, Bacillus clausii
atgaagtttgcggtcatcgtgtttccaggctctaattgcgatgcagacatgtatcatgccattaaagacggacttggcgaggaagtcgaatatgtcttccatacggaaacgtctttagacggttttgatgccgtgcttcttccaggtggcttttcccatggcgattacttgcgttctggagccattgcccgctttgcgccaattatgccagcagtcatccaagcggctgaggcaggcaagcctgtactcggcgtttgcaacggattccaagtactgcttgaagccggtttgcttcctggggcaatgaagcgcaatatcgatttgaaatttgtatgtcgcacagtcgaattagttgtcgaaaacaccaaaacgatgttttcttctggctatgaacaagggcaaacgattcgcattcctgtcgctcatggcgaaggcaactatgaatgtgatgacgaaacgctagcaaaccttcgtgcaaacaagcaaattgtctttcgttacaatgagcatgtcaatggctccaaaggcgacattgctggcattaccaatgaacggggcaacgtgcttggcatgatgccgcacccagaacgggcaacagaaacattgctcggaaacgat

SEQ ID NO: 5076 - DNA, 297 bp, Bacillus clausii
  misc_feature (1)...(297): n = A,T,C or G
gacgcttgacatgaagctgaatgaangagatgccgtcatatttttagatatgcctagactgttatgcatctataggattataaaaagaagactgatttatcatggaaaaacaagacctgatttgaacgaggattgccctgaaaaactagattgggctttttttgtttgggtttggaattacaagaagagaagcaggcccaaagtgattcaagcgcttgagcaagtaaaagagcgaaagcgcgttgtcatactaaagacaaggaaagaagtccaacgttttttagaccaggttaacga

SEQ ID NO: 5077 - DNA, 203 bp, Bacillus clausii
atgaatcgaatcgttgtcattggatcagctggctctggtaagtctaccttgtctcgaaaactcagtgaacgtttatcgttgcccgttattcatttagaccgtttttattggaaacctaattggacgccaaccccgaacaatgaatgggattcgtttcttaaagattcggtaagccaaaataaatggattatcgatggaaatta

SEQ ID NO: 5078 - DNA, 543 bp, Bacillus clausii
ggacaacattcatttccaagtcgagcgcgagtccaaaaatgtgatcgatgctgcttcgaacggagcattggatggactaaaattagcgctcaatgtgggcgcgatgctgattgcctttgtttccttaattgcactgatcaacttgtttttaggcacgattggcggatggtttggctatggttccattacgctagagcaaatcctcgggtacgtgtttgccccggtggcctggatcattggcgtcccatgggaagaggccgtgcaagcgggctcgtttatcgggcaaaagacgattgtcaacgagtttattggttttgatgcccttgtgtcggctgcgggcgaggtgtcagaacgaacatatgtcattacgagctttgcgttgtgtgggtttgcgaacattagctcgatcgcgatcttgcttggcggccttggcggactcgtgccagaacgccgtcctttaatcgctaaatatgggttgaaagcacttattgccgcaacgcttgtcaacttaatgaacgctgcaattgcgggcatgcttgtagg

SEQ ID NO: 5079 - DNA, 131 bp, Bacillus clausii; identical to SEQ ID NO: 5051

SEQ ID NO: 5080 - DNA, 342 bp, Bacillus clausii
tctatgaagatgacgaaattgctgccttttttgacatttcgcaagtgacaaaaggacacgcattagttattcctaaagcacaccatgccgatattttcagcctgcctgagaaaacagcagcaacgctgtttgcagcagtgccaaagctagcttcagccttgaaagcagagttcgctcctgtaggaatgaacattttaaataacaatggcgaggctgccgggcaaaccgtctttcattaccatctccatctcctccctcggtatggcgagacaggtttatatggctcattatggaaagaagctactgtaggaacgccggatatggaatcattgcaagcgtctg

SEQ ID NO: 5081 - DNA, 333 bp, Bacillus clausii
atgaagacagaagacttttattgtgaagaagtgttaagtggcaaaacagcagtgaaaaaggtaatggaaacagaaaatgtcctagcttatcaccatacaaatccttattaccctgtacatattgtcgcgatcccgaaaaagcatattccctcattattgtcgttagaggaagaagactatgcccttttgcttgaactgttttctgttatcaaaacagtcgctgcacaagttaaggccgagcacggagcctgccgtgtgttgacaaaccttggcaactaccaagattctaaacacttgcattggcatattgcgtttggccagccccttaaatga

SEQ ID NO: 5082 - DNA, 330 bp, Bacillus clausii
atccatttaataaaggacatgtactaatattgccaaaagaacactttgaagaattggatcagttaaataggaaaactgcaaatataataattgaaacttcacagattatatcacaggctataaaagaactatataagccagacggaattacagtatgccaaaatgggggtatttttagtgaactaactcattttcacatgcatattgtacctagatatatcaatcaatcgtttgctcctttttattcagaagaaccattccagaatggcaaactgaagaaagagttgtctgatacgcataaagagctagaatataaaatcaaccagttaa

SEQ ID NO: 5083 - DNA, 471 bp, Bacillus clausii
aaaaatggatgaatgtggctttagaagaggcggcaaaggcagaggaaatcggtgaagtgccgattggcgcagtgattataaaagaaggcaagctcatcgcctctgcctacaatttacgcgaggccaatcattcagcgctcgcccatgctgaactgttggcgattgaacaggcaaacaaaaaacttggcgcttggcggctggaaggctgcacgttatatgtcacccttgaaccatgcccgatgtgtgctggcgcgattgtgcaatcgcgtattccaaccgttgtttacggggcaagggaccaaaaagcaggctgtgctggcacattgatgaatcttttacaagaggagcgctttaaccatcgttgtgaagtaattagcggcctgctggaagaaagatgtggagagaaattgtcggcatttttccgggaattgcgcgctaaccaaaaaaggaagaaacaggatttgtaagaag

SEQ ID NO: 5084 - DNA, 214 bp, Bacillus clausii
atggatcattcgatgtatttagccaaaacgattaacctagcggctcaaagcattcaaaggggaggtggcccttttgcggcgattatcgtgaatgaaaatggggacattattggccaaggcaccaactctgtgacgaatgccaatgacccgacagcacacgcagaagtggttgcgattcgcgatgcatgcaacacgatcaaccacttcagcttga

SEQ ID NO: 5085 - DNA, 542 bp, Bacillus clausii
  misc_feature (1)...(542): n = A,T,C or G
atggctatgtcgtcattgaagacggcgtatttacggcgattgagcaaggggagccggcagaagaggctgcaaaaggagcgaatgtagtcaatgctgataaaaagtggcttatgccagggctaatcaacacgcacggccatacaggcatgtctttgttccgtggcgttagcgatgacgtgcctctgtctaagtggcttgcagaacacatttggccactggaacaaaaacttgaccaaaaagcagtagaagcagcccgccttttaagtatggtggagatgattgaatctgggacaacgacgtttttagaaatgtnccatttgcatttggacgatttcgctgcggcaattgaaaaagcaggcatgcgggcaacattgatgcggtctgtgatcggcctctgttcaaaagaagaacaggaagaaaaattagcggaatctcttggtttcgcaaggagatggcataaacaggcaaatgggcgtattcaaacgatgcttgcccctcatgccccgtatacatgcccgcctgattacatcgagcgcattgtc

SEQ ID NO: 5086 - DNA, 885 bp, Bacillus clausii
gcaaagcaattatgcctggcacagtgaatgcccataaccattcttttcaaagcttgctaagaggcattgctgctgatcagccgtttttagagtggcgcgacaaggcactgtaccgatacacgcctttcttggatgaggatgcaatttatacaggggccctctttgcttttggtgaaatgttgaagtacggcgcgacgacagtcagtgactttttctacgtccatcgtggcggtgtggaaaccgatgaagcggtcatccaagcagcgaaagacgtcgggatacgcctcgtttttgcacggacaatgtatgattgggctggggcgccgcaagcataccaagaatcagtcgacgaagctgttgcacggacacggaaattggcggccaaatacgagagtgatccgatggtgtcgatccagccagcccctcatagccctcatgctgcctcgccagaaatgatcaaggctggccatcgtcttgctcaagagctaggcacaccattccatatccatgtagcagaagagccgtttgaagtcgacgaaacgttgaatgcatatggcttgcggcccgttcattatttggactcattaggcgtcgttgatgaaagcatgattgcgatccaccttgtctggcttgacgattgggaagtaactctgcttggaaacaaaggggcaggattggcctattgcccgtcaagcaacatgtttctttcagatggcgtgacgcgcattcctgatctccagcaagcgggcgtgcgcattggcctcggttcagatggagcttgcagcaataaccgcattagcgtgtttgaagaaatgcggatgtgctcattgctgcaaaaagtcacgcgtctggacggcacatgcatcactgggaaacaagtatttg

SEQ ID NO: 5087 - DNA, 557 bp, Bacillus clausii
aagaaaaactaacacacgaagatgtcaaagaacgggcgaccaaagcgctcaaatggcaaattagccaagggattcaacatgtgcgcacacatgttgatacgaccgatcccaatttgacggcgctcaaagcactccttgaagtaaaggaagaaatgaaaccatttgttgatatccagctggtcgctttcccacaagaaggcattctatcttatccgcaagggcaggagctgctagaagaagcactaaaactaggcgctgacgtcgttggcgggatcccccattatgaatttacaagagaaatgggcgtaaaatcagttgaggttgcctttcatctagccgagaaatatgacaaactccttgatttccactgtgatgaaacagacgatgagcaatcgcgcttcatcgaaacggtagcggcgcttgcttacgaaagcggaatgaaagagcgggtaacagcatcccatacgacggcgatgcattcgtacaatggcccatatgtcagcaaattgctccgtgtttgccagctggctgagctcaattttatcgccaacccactt

SEQ ID NO: 5088 - DNA, 1149 bp, Bacillus clausii
tcgtttttttctcgataccagcacatggccacacgaaccccactattccggtggtaagcgaattagtaaataaagggcaccaagtttggtattattcttttttagagtttcaacataaaataaaagaagctggcgctatatttattgcttgtgataattttttacctcaagtttcacaaaaagagctggatagtaaagtaggtaaagactttgcagcattgattgaaatgacagcccgagacaacaatggccttggatcaaaaggtttgtaaaagaattaaaagaaattcaaccagcactgtattgtgtacgactcgatgtgcatgtgggggaaattatttgctgaaaaactaggaataccctctatttgttcgactacttcgtttgcttttaatcaacatacagcaaaattgatgaagaggagcttcatagaaatctggagaatgattgtaggcatgcgaagggtaaacaaaaagattaagcaattaaacgatcacggttatcgagtaaagaatgtagtgtccttaattcaaaatgataatgaaacggacaccattgtgtacacgtcgaaggattttcagcctctggcggatactttttcagaacgctatacgtttgtcggaccatccataaggcaaacggagccactacaggatggtataagagggagaaaaacaatctatatctcccttggaacggtactcaatcaaaatcaagatttttacgaaaactgccttgttgcatttgcaaacgcggattatgatgtggtgatgtctgttggtgataaaacggatatttcgtctcttggtcgtatacctgaaaacttcacagtaaaaaacgtggtggagcagatctctgtattacaggaagcagatgtatttattacccattgtggaatgaatagcacaagtgagggcctctattttggcgttccattgattttatttccacagcatggcgaacaaagaatggtcgctgatcgggttgcagagctaggcgcaggatttaaacttaactctaataagccaaagcatttagcggcagcagtagctgaagtgcttgtgaatcctacctataaaaaagaagcacagaaattggcaaaaagctttcgggaggcaggcggtgctgccaaagcagccagtgtgattc

SEQ ID NO: 5089 - DNA, 318 bp, Bacillus clausii
gcttgaatatgccagggctgctgcttgcatttgtgttcgcgcaaattttgcgggcatcccttggaagcgctaccgttgccttgatcacaacgtcgtctattctaggcccaatggccggagaattaggggtatcgccggttttgcttgggcttgcaatttgtgctgggggcattgggctttccttgccaaatgattcaggcttctgggttgtttccaagttcgggcgcctatcgatggtcgaaacgattaaagtgtggagtattggcggttttgttgcgggagtgacagcgctcggcttcatttatttgctaagtctcg

SEQ ID NO: 5090 - DNA, 456 bp, Bacillus clausii
  misc_feature (1)...(456): n = A,T,C or G
tattccngtatccctgtttaagctcgccgattatccgcaccgntttataccggttgcgattgtgttcggttccatttcgttcacgatgacttcacctggctcacctgaaatccnanncatcattccaaccgagttctttggcacacaaccgactgctgncggttggattggtgttgtaagcgcggtcttcattatggttgcaggcggcctatgggtcaggtatatgttgaaaacagcnctnaaaaaaggcgagtgtttttcgctcccgcaagacagtcccctatacgggctagaggaagaagcgcttgatgaactggcggcagcaaaagagcgcgtgttgccaaagccattgtttgccttgttgccgttagcgattgtgcttgtttctttaaatgtgctgtcgctttatatggcggccaaaacggctgtattggttgcgttgcttcttggaatcgg

SEQ ID NO: 5091 - DNA, 474 bp, Bacillus clausii
  misc_feature (1)...(474): n = A,T,C or G
atccgtttgtcgctttaatcctggcaacgttgcttgcgatgtactttctaggaaagcgccgcggcgtngctaaagaacatatgcaaacgattacaacaaaagcattggaaccagctggcattgtcattttaattacaggcgccggcggcgtttttaaagaagttttgattcaaagcggcgttggtgaaacgatgggtaatttaatggcggcttctggctttccgcttgtgttgctagcttttctcatctccacatttgtccgtgtcgcacaaggatctgccactgtcgcgatgattacggcagcgggactcgtttcgcctattgtagatatggcagcgctctcgcagccgtctctcgcattgattgcgattgccatcgcttgtggcgcgactgtcctttcccacgtaaacgactcaggtttttggctcgttaaccagttgttggatatgtcggaaaaagacacattgaaatcgt

SEQ ID NO: 5092 - DNA, 324 bp, Bacillus clausii
  misc_feature (1)...(324): n = A,T,C or G
gtgcagcaagtcaaccgntngntagcctggctttgtttgtcacggtcatttgcgggattaccggatctgcatcaggcggccttggtattgctttgccgctcattgcccccgattatatggaacgcggcgtagacccaggagcgatgcatcgtatttccgcgcttgcttccggcggtctagactcattgcctcataacggctttgtcgtaacgacgattcgggctatatgcggagaaacccataaacgagcatatgggcctattttcttagtgtgcaccatgttaccgactgtcgcacttgccattgccgncgctctctatacgn

SEQ ID NO: 5093 - DNA, 652 bp, Bacillus clausii
  misc_feature (1)...(652): n = A,T,C or G
atgccattatttatcgtagcagttggaattgtcttgttactcattttgattactggattcaagttaaatacatttgtttccttaattattgtcgcttttatcgtagcgttggcactaggcatgcctttagaaaatgtagtgtcctccattgaaggcggattaggaggtacacttggccatatcgcgttaatatttgggctcggtgctatgcttggcaggttaattgcggacgcagggggtgcccagngtatcgccatgacgttaattaacaagtttggagaaaagagaattcagtgggccgttgtcgttgcttcgttcattgtaggcattgccctattttttgaggttggcttagtattattaattccaattgtgttttcgattgcaaaagaactaaaaatttctattttatacttaggcattcctatggccgccgctttattagcaacgcatagtttcttaccgccgcacccaggaccgaccgtaatagctggcgaatatggggcagatcttggcgtcgttttactctacgggattatgattgccataccaactgtcattatagctggccctctctttactaaggttgctaaaaaaattgcaccggatgcattcaacaaaacagggaatatagactcgttaggagaacaaa

SEQ ID NO: 5094 - DNA, 555 bp, Bacillus clausii
ataatacgatcatagagatcattcgccttgtcggaaacccttcgtctgccatgttactatctttattgcttgcattttatacaatggggatagcaagaaagatcccaatcaaacaagtgatggattcatgttcatcatcaattgcagcgattgggatgatgctattaattattggaggcggaggcgcctttaagcaagtactcattgatggcggtgtcggagattatgtagccgaactatttaaagacacgtccatgtcccctcttttatttgcttggctcgttgcggcaatcttgcgtatatctttaggttcagccaccgttgcggctatatctacagcgggatagttgtgccaatgctagcccaatacggatgtcaatttagccttggtcactcttgcaactggagcaggcagctcgatttgctcccatgtgaatgatgccggattttggatgatcaaagaatactttgggttaagcatgaaagaaacattttcaacatggacgatcttatcgacaattacttctgtcgttggattagggtttattttattat

SEQ ID NO: 5095 - DNA, 321 bp, Bacillus clausii
cttgcgagaaagcgtgtcaaaaaagacaggaaaatcaatcgtcgctcttgctattgctcttgccggcggcgcggttgtcattcatagtgctgttccaccgacgccaggtccccttggagttgcaggaatattcgatattgacatcggttggatgattatctcaggcatgttgtttgcggttccaattgtcattgcaatggtcatttacgcaaagtggcttggcaagcggatttaccaagttccgagcgaagacggaatggattggattcgtccagaaaaacagctagatgtagaacaatggttgggaagaaaaagaacaaa

SEQ ID NO: 5096 - DNA, 240 bp, Bacillus clausii
ggcgcctccagacgtggtgaacgccattacagaaggatttggcagcacgctcggctcgattgcaatcgtgattggttttggcgtgatgatgggccgaattcttgaagtatcaggtgcagcggaacggctagcctacacgatcgttaaagttcttgggaaacgtaaggaagagtgggcgatggcaattacaggctatatcgtcgcgattccaatctttgtcgattcagcctttattagatt

SEQ ID NO: 5097 - DNA, 573 bp, Bacillus clausii
agaactcagtaggattgaggataatacgatcatagagatcattcgccttgtcggaaacccttcgtctgccatgttactatctttattgcttgcattttatacaatggggatagcaagaaagatcccaatcaaacaagtgatggattcatgttcatcatcaattgcagcgattgggatgatgctattaattattggaggcggaggcgcctttaagcaagtactcattgatggcggtgtcggagattatgtagccgaactatttaaagacacgtccatgtcccctcttttatttgcttggctcgttgcggcaatcttgcgtatatctttaggttcagccaccgttgcggctatatctacagcgggatagttgtgccaatgctagcccaatacggatgtcaatttagccttggtcactcttgcaactggagcaggcagctcgatttgctcccatgtgaatgatgccggattttggatgatcaaagaatactttgggttaagcatgaaagaaacattttcaacatggacgatcttatcgacaattacttctgtcgttggattagggtttattttatt

SEQ ID NO: 5098 - DNA, 483 bp, Bacillus clausii
ttttggttcgcctgtcattgcagtagggatcgccgtactgcttgctatctacgggttgttcggccatatccaacgctcagaagcattggagcggatggaagaaggcattaagcaagcgggaatcgtattgcttgtcaccggcgcaggcggtgccctcggctttgtcttaagacagacaggtgtaggcgagcatattggcgaaatcgtcgtaaacacaggaatccctgcaattttgcttcctttcgtcatcgctacactcatccgctttattcaaggcagcggcactgtcgcgatgattacagccgcatccatttcagcgccaattttagccgatatggatgtcaatatggtgcttgctgcacaagcagctgctctcggttcactattcttctcttattttaatgatagtttgttctgggtagtcaaccgcacaattggcattaagcaggcgaaagaacaaatccttgtctggtcagtgccgac

SEQ ID NO: 5099 - DNA, 336 bp, Bacillus clausii
gtgcagcaagtcaaccgttcgttagcctggctttgtttgtcacggtcatttgcgggattaccggatctgcatcaggcggccttggtattgctttgccgctcattgcccccgattatatggaacgcggcgtagacccaggagcgatgcatcgtatttccgcgcttgcttccggcggtctagactcattgcctcataacggctttgtcgtaacgacgattcgggctatatgcggagaaacccataaacgagcatatgggcctattttcttagtgtgcaccatgttaccgactgtcgcacttgccattgccgtcgctctctatacgttttttttactaa

SEQ ID NO: 5100 - DNA, 369 bp, Bacillus clausii
  misc_feature (1)...(369): n = A,T,C or G
agtatccccgcaaaagaaagtggtggcgatagcgctattaacagcancggctgtgcttggcgatgcaatgttgtttantgtgttgcccctttactggcaggagtttggccttacagctctttggcaaattggcatattgttatctgtcaatcgcttcatccgtttgccaattagtccccttgtcggctggttttatagcaagtttgaantgcggactggcgtgcaattggccctcattttggcaacggccacgactttttcgtacggctttttccaaagctttgctacccntgtcgtggcacgggccgtttggggantcgcttgggctttgatgcgtatcggcggcatgcttgctgtantggaattttc

SEQ ID NO: 5101 - DNA, 603 bp, Bacillus clausii
aaaacgaaatttgttcatcatgtggtttgccaacttttttgtttcggcaagtatgacgatggtcattccttttttatcgctatacattgaatcgtttggtcactacaacgttgatgaagtccagcgctgggcaggatatgtgtttgctgtctctttttttgttgcctttcttgttgccccgctttggggaaaagttggcgacaggtttggacgaaaaaaagtgttgctcggtacaggattaggcattgccttatccgtcttttttatgggatacgttcattctgctgaacagttgtttgtattgcgcgcttttatgggccttgccacgggcttcattcccgcctcaatggcgttgattgctgcccaaagtagtaaaaaaacagcaggtgaaatgctaggaactttgcaaacagggacagtttccggcggtttgcttggacctctttttggaggattgatcgctgatacagtgggaatggaacttacatttttgttgacgtcatcgattctcctaatcgcaacagtcctcgttttaattggcgtaaaggaagttgtttacgaagaaaaaggggagaggaaaagaaagtatcgttcaaaagaagt

SEQ ID NO: 5102 - DNA, 351 bp, Bacillus clausii
tgtgttcgcaacaggcctaacgatggggtttgttgtgttcggactgttttcggttacgctcagcccgcttgttgagcgcgcaatgggtggccaaccgctggaagcatttggtgtcatcatcggcgcagcttcgattgcaggaatccttcaagccttgcgctgggcctgggatccattcgttgcccctttttatgggaaaatgctagaccgcaggccgctttcgtattcgtggatttacttgcctatgctcgggatttgttgtttattttcgctatttgcgctgcttaattcattttggcttttgttatgtgccgtacttgtatttcaacttctgtccaccttttttgtaac

SEQ ID NO: 5103 - DNA, 420 bp, Bacillus clausii
  misc_feature (1)...(420): n = A,T,C or G
actattagtaacaattgtgcttactggtttagttttttcactaacacaacccttcttatctatatttgctgtggaagtagttggaatgaccccaacacaattaggaatttatatgagtttaactgctatttttggggttataatcagtactttaattgcaaaagtatcagatggaaaagttactaggaaattaattataataatagttagcctagctggagttatcggatatactatttttgctttttcgagacattatgttgttttattggtttctgccattagttttcttgcagtagtttcttcaggttttccccaattatttgcgctggccagagaaacagtagtaaatgaaggcagcacanaaaaagagttggcgattagtaatttgagaatgtttttttctctagcatgggtngt

SEQ ID NO: 5104 - DNA, 432 bp, Bacillus clausii
atgaaaacacgatcatttttacatgaaagaaattttatgattttgctttctggcgtgtttattaatggaattggtgcaggcgtttatgcggttactggtatgttgcttgtcctctatttgagcggaaatgtcttttattcaggtctcgcttatttcgcagtaacattggcaaatgcgttggctttcttaatcgcgccatttgctctatatgtcacgtacaaaaaaggcttaatcgtatgccaagtgttgaagtccgcattgctatttacactaccactgttctacgcaacgattggcctgaacgtttattatgttatcacactgctatttgcggtttctttgctagccaagtttacatacccaatcgaatcaacgattatgccgattattgctggtaaagaaaacattattaaagcaaatgcgtacttgcaa

SEQ ID NO: 5105 - DNA, 534 bp, Bacillus clausii
atgaaagccacgattacggtagcgatgtccaattatttagaagcaggcgctattgttgcgggcgctggtgggctaacattatgggtcgagtatttgcagttgaccgacatgtgggtagggttgctaggcgccttgagtgctaatggctttggagcagcaatcggggctctgattggcggtgctttagtcgaccgctatggcaggaaatttatttacaaatatgatttgttgctatatatggcaggcatgcttcttattgtctttgctttttcctttcctatgcttcttgccggctatgtcatcgttggcattgctgttggcgcgttaattccagcagcttggacgtatattgccgaagaggcgccgcctaacgaacgggctgccagagtcggttggtcccagtttgcttggtcgattgggcctgctattacgctttttttgtcggtagcgctcgctcccccttggtttactaggcagccgtttgatctttgcgcaattgtttgtggtggcgatcatcacttgggtattgcaaca

SEQ ID NO: 5106 - DNA, 1077 bp, Bacillus clausii
  misc_feature (1)...(1077): n = A,T,C or G
atgccatggatcatttacgaattaacgggctcctctttttatatgggagtcatgttctttctagagacaattccttttttgttcgtttccccattggcagggctgttggcggatcgcttttcccataagttgctgttgtttctctctgcttttttacaagggttctttttgttaacgattgtcataggaaacgcagcagccagtcaaattccgattatctggatttttgtttgcggattttttattgcttgtgggggagcggtgtttagcgttgtattaaacagcatcattccatcaatgtttccaaaagataaaattgtgatcgttaattcgtcatttcagttccttgactccacttcgctgctttttggcagtgctttggcagggatgttgattagcatgttcggtggttttacggtgttgcttcttgatgctatctcgttttttatcatttgcgccgttgtcttgttttatcgaatcaaaaaagataacattaaaaaaattgctggcggcagctcttggaaacatttagtccaaggggcaagctacgtgaaaaaccacgaaattcttaaaccgcttcttttgattatgatgttagtgaacatttccaatgctgtcgttgtcgccttgcttgtcttttttgcaagggatacattggcactggattcatcccagacgggactcatttatacgatcgctgccgtctcgcaagtacttctgacgttttttattccattgattacgaaaacattcaaacgaacgaaccggatgctcctcgtatgcttaatggtcagcagcggcggcattggcattatttcgcttagcacagggtgggttacgctagggctagcgatgatggtccatacagtaccgattattatttttaatgttgttaataaaacgttaagaatgcaaattgtccctgatgatttaatcggccgaatcaacgggctgtttttaatgctnaacaagtcgacgttgcctgttgctggcttaatcngtgggtgttggcngccagaattttatccatatccgcatcgtgttcgcctgctgtgtatttttatcattagcctttga

SEQ ID NO: 5107 - DNA, 735 bp, Bacillus clausii
atgcaagtcgtccaacacatttcctacacagcgctttttctaacgactgtatttttatctgttacggggctattgcttgcaatgttcatcgtgtataaacccgtaaaaaaagcggctgaacccctttctgtagatcggtttattgcccttaaagcggtgcctgtcagcttttgctcatcccttgcctcctttgcttacggcggtatattaagttttattacgttgtacgctgtcaacctcggcatggactccgcggcaagtgctttttttctagtgtatgcccttgtcctcctaggttcccgtatgattacgggcaggatttttgaccgctttggtgaaaatgtcgttgtctatccaacacttgttttatttgcaatcggcctttttacccttgcgcaagcaggcagcttatcgatttttctaatcgccgctgtcttaatgggcgccggcttcggctctgtgctgccaagcttccaaacgcttgccgttcaatctgttcccccaaaacaagcggtgcaagcgacaagcactttttatattttttatgaccttggcatcggcctcggttcttacgtgcttggcctcattgtcgcaggctctacctattcgtttatgtacattatctcagcctcaatcgtcatgctggccatcgtaacctatcctgtcttgcatcatcgcaaattaaacaacttaggtttaaaatgcatggccgatgccgacttggaagcatcataa

SEQ ID NO: 5108 - DNA, 1092 bp, Bacillus clausii
atgatgttaggggatattgtgtctggatttgcactagttgtgttgctcgtacttattatcaatggacatattcaagtgtggcaaatctgtgttagtattggggttagttctttgttttcggcattgttaaatccagcctataaagctacgattaccgaccttctaacagaggaagagtatgccaaagcaagtgggatggtgggcattgcatcgtcttcaaagtttttgatttcccctattttagcggggttcattctagccttttctacgattgaagtggtgcttatcattgatattctgacttttccaatagcggttattgccattttttcgataaggaaatcacttgcgataaagccgcaggtcaaggagaaattgaattttttcaaggatttaaaggaaggatggttgattattcttgaatcgaaaggagtattgcgattaattgtccttgtatcttttttaatgttttatatggggatgatccaggtgctgtccaaaccgatgctcctcgcaattacagatgaaaaaacaacaggcattctacttacgatcattgcctgcggaatgttggtgtccagcattgtcataggcaacggcatccttaagaaaaactatgtcaatgtcatggtaggaagctttatcgtcgctggggttacaatggcgggttttggtgctacaacaagcattccggtcatccttctctcaggttttttattctttgcctcgctgccatttgcgaatgcaagtatcgatgtgctcattagaaaatcaattgataatcataaacaagggagagcatgggggcttatttcattaatatcgcaagtaggatttgttgttgcttttgtcattggcggctttcttgcagaccatgtatttaaccctgcctttgcagaaggtggtgtgcttgcaggtacggttggcaaaataattgggacaggtgaagcgagagggatcggatttttaattattcttgctggactagggcttatcattacggcactgtttgtctctaggtcaaggggcattagagacatggataccccaaatagagtcgggacagataggacgggcatctcaaaaacgtga

SEQ ID NO: 5109 - DNA, 543 bp, Bacillus clausii
accccttattttacagggttgttaatcatcttgatcacttcgtcggattgtcccaatttgagacagtgttaggactttttgttgaccataagtatagctatacgcccaatgaaattgcgtggttaattatgatcggtgcaatcgtcggcgctgtgatgcagctgacgctctttgggcggctcatcaattggattggagagaagaagctgacggtctattgcttgctggtgatggctgtttttatggttgcgacaattttttcggcccaatattggatgatggttgtatcggtaacgcttgtttttctggcagttgattttgtacgcccggcgataagcacttacttttctagaattgctggcaatgaacaagggcttgtcgccgggttgaatgcttcctacacgagtctcgggaacatcggcgggccgattctcgccggagccttgtttgatgtccaaatcaactccccgtttctggtaggcagtctgatcgctttaggcggctgggttcttagtctacgctggatgcgcacgcaaacggaac

SEQ ID NO: 5110 - DNA, 382 bp, Bacillus clausii
  misc_feature (1)...(382): n = A,T,C or G
atgaaggcactggcaacaagaaacagaggggctattttattgctcatgtttaatatctttataggatttgtaggcgttggcttggttattccaattatgccgacgtatatgaacgttcttggcatttctggaacgattgttggcctgctggtcgctgtattttcattaattcaatttttggtggcgccttatgcaggcagttggtctgatcgttatgggcgaaaatggattattgtcactggtctgctgctttttgctgtatctgagctgctttttggcctggctacgaatgcggtcttgctgnttatctcaagactgcttggcggtgtatctgtcgcctttattatgcccgctgtcatggnctacgtcgttgatattacca

SEQ ID NO: 5111 - DNA, 885 bp, Bacillus clausii
atgattccccgtttagttgaaaagaaacaattactgaaagcaaacagtttcttaacgatggttgatcgtacgaccgaactaggtggatggccattaggggcgattcttgtcgtggccataggtgccgatcatcttatttggctcactgttttgctttatcttttcgcggcgtttgtaacgacacggattgaaaataagcaaacgaagagggaagtgttcactgagtcgaggcgttcctttttatcgcgttcactagcgggctggcgttttatcttgaacaaaccgtatttacgcgccattagcgtggctgatgttttggaaaacagtgcaaatgtcgtttggattgcggcgatcctatacgtttatgtggatgaggtactcggaaccggtgaagaatggtggggttacattaatgccagcttttttggaggtcttttaataggcggcatgcttggctaccgatatgcctcctttatggaaaaacagataagtcgattgattcatgttggcacgtttgctgtttttcttacaacactggctttcagtctcatttcaacgccgtgggttgccttactgttttccaccctttttgggttttcaagtcaactaaaaggggtcgcattgcaaaccattgtgcaaacaaatgtcccagaaaaagagctggctcgagtatattcagctcaggaagctgccggcttcgcctcttttggtctttcaaccattcttttcggttttttaaccgatttacttggagcccgttttatattcgcgttagccgcagccattctgcttattagtgcattgtatttattcgtcgtacgaaaagaactctatttgcatcaagtcgtccaaacagaagagccgatagaaaagcgtgaatcaacc

SEQ ID NO: 5112 - DNA, 474 bp, Bacillus clausii
aaatactccgttgtttataatagacacactatctgaagagaactcaaccgtagggatactgtttagtatttctgcagcactcgaaataccatttatgattctacttggacttaaaactacactatcgaataagtcaaatatattgttattagggacactaacttattctatttactttctcggcttatttctatctaattatatatggcaaatattaattctacaattatttggagcattttcaactgctgttattatggcaaatggaatgatatattttcaagatttattgccagataaacctggaacagtaactacgttattttcaaatacaaacaagttaggtggcatgctagcaggatttataacaggaacggtagccgattttttaaactatagatctgtttttatagcttgtttaattatgacaaccatatcgggaatgctgattttctttgtatcaaaaatacaaaa

SEQ ID NO: 5113 - DNA, 585 bp, Bacillus clausii
aaatatggtcaccatcatttatttttattttagtttcaaatggtttgctttttatggttttcgagatgctgcttcctacgctgcctctctttattacagaaatgggaggagcagctagtcaagttggagtagtaacaggaatatttatgttatccgccattctaattcgtccatttgcaggcattctggcaagtaaaatcgacaaaaaatttctcttaatctttggcatcttaataaatgcattggcaactggagcctattatctttctactgatattactactttattgattattcggctttttcatggagctggttttggattggctacaacttattttgctaccctagcagctgaaatcattcctaaacagcgacgtggagaagggattggatactttggtttaggggaaaccgtcgccatttctgtcggtccaatgataggtatcatggctatagaactgtatgattttcaacgtttgttcttaggtggtatgtcagtattgctattagctcttatgatggggatatttgttaagagagcgccagatggaaaggcattagacaagaaagctaatgtgaaaa

SEQ ID NO: 5114 - DNA, 357 bp, Bacillus clausii
atcggggatgattctcttgccgggaacggtcttgttggcgttgacttcatttgcctcaggcaagctgtttgactcattcggcgggagagctcttggtttaagtggttatgggattctagtgttggtattcactatctttatgtttatgggagatcaaacgggcattcctctgctagttgtctgtttttgtgcgtttatggttggaattggcttcacaatgacgccagcgacagcgatagcgatgaacgctctaaagcaagcagaacttgcccacggaacggcgattgccaatacgatcaggcagtttggcgcagcgctaggattaacggtattgacgacacttgtcagcgtcaacgc

SEQ ID NO: 5115 - DNA, 445 bp, Bacillus clausii
atgagacggtatgtaggcctcatgctcgttttagtaggagcagtatgttgggggatgggcggaaccgtcgcccaaaaattgttccagcaagacgctgttaatataaattggcttgtgtccataaggctcttaattgcaggagcaatgttattaattatacaactcttgttaaagaatcggacgcaaattttaggcgtttggaaaacaaagcaatcagctgcacggcttcttacttttggaatttttggcatgcttgccgtccaatatacgtacatggcatcgattaaaaatggcaattcggcagttgcgacattgctgcaatatttagcacctgtcatgatcattctgtatatggtagttcgcgggcaaaatcgattgactaggcgtgacctgatttatgtgtctcttgctttgactggttgctatcttctgttaacaaatggtc

SEQ ID NO: 5116 - DNA, 522 bp, Bacillus clausii
atgctaggcagcgggcgcttcgtttcatttgcagctaggggcacttattatcctcgtaggcgcttttggcgaaagcatctattttgtttttcaacgccaccttttgccgatatacggttttctgccactgactatttatgccattttaacagggacgctgtttatgctggcgtttacccctggcctagggcaagtggtgttagctgcaccttcctctgtcaattggaccgttttgtacttagggcttttcccaacggttattccttatttttgcctcgcctatgctacagcaaaagttggcgtctcagaagctacgagcactctgtttttaaccccggtcgtggcgctttttcttgcttggctttggctcggggagacacctgccttgttgtctcttgcaggcggtgcacttactcttgcaggagtggcggttgccataaccggaaaacaaagttaacaatacggcgaaatttgcatagttattgctgccgaatgatcgcgacagaatcggcacctttttga

SEQ ID NO: 5117 - DNA, 438 bp, Bacillus clausii
attgggatcattatgctaggcagcgggcgcttcgtttcatttgcagctaggggcacttattatcctcgtaggcgcttttggcgaaagcatctattttgtttttcaacgccaccttttgccgatatacggttttctgccactgactatttatgccattttaacagggacgctgtttatgctggcgtttacccctggcctagggcaagtggtgttagctgcaccttcctctgtcaattggaccgttttgtacttagggcttttcccaacggttattccttatttttgcctcgcctatgctacagcaaaagttggcgtctcagaagctacgagcactctgtttttaaccccggtcgtggcgctttttcttgcttggctttggctcggggagacacctgccttgttgtctcttgcaggcggtgcacttactcttgcaggagt

SEQ ID NO: 5118 - DNA, 429 bp, Bacillus clausii
ccatggctgcctaccaaccgttcttttttacggctgtgtcaatgactggtgttgcggcgggaacggttatcgccattgggagcgcaccaatagtagcaggtttgctggaatgggctttttttaagcggattccaggaaagcggtggatgcaagcaactgccatggcaatcgctggctgtgtgttgctaatgaccgctggcgatcagtccgtagttgtgacaccgatggggcttttgtttgctataggggcagggctttcctttgccgcttatacattagcaagcaaagggcttgtagccaaaggagagcctgaagtcgtcgtggcattcatattttcttttagcgcgatcgtattgttgccaacgttctttttatttgaggtcagctggctgcttcaatggcaaaatgggctcgttgttttgcatttaa

SEQ ID NO: 5119 - DNA, 486 bp, Bacillus clausii
atttgttgttggcgatttgcctgatacttagtttttttccggttttgacgatggcagcaactgcttttcttgaaacaagccagttgtttgcaggcggcttgcaattgttgccgattccgcctacattagaccattttagccaagtgtgggagtcgatcccgattttacgctatatgggcaactctttcttcgtcgcaacagtggtcacattgatacaactgttcactagcatccttgctgcttacgggtttactcaatttcaattccgaggaagagagttttgcttttacttggtcattgcgagtatcttcatccctattcaagtgacgatgctgccaaactatattcttttaagtgatctagagcttgtaaacacctatttcggtttaatattgccgcaaatcgcaaatgggatcggcgttttcctgttaaggcaatcgtttcggtctgtccctgccagcctaattgagtctgctcgcgtggacc

SEQ ID NO: 5120 - DNA, 465 bp, Bacillus clausii
ccgcatgaacacattggcaaaaaaacgattaaaaagcatctacgcccataccattttaattcttgcatcgattttgtttttagttccgtttgtatggatggtgtctacttcttttaagccgattacgcaagtctttacgtttccgccagaatttttgccgcggcctttccaatgggagaattatattgaagcaacgaagtatattccgttttggacatacacatggaacactgccgttattacaggattaagcacactcggagtcgttctttcctgccccctagtagcctatagttttgcaaagctccgatggcgtggccgcaatacgttgtttgcgattacgattggcgtcatgatgattccgacacaggtgacgatgataccgctcttcttgctttttaaccagttaggctgggtgggaacaaacttgccattgattgtgccagcttttttcggtatcccttt

SEQ ID NO: 5121 - DNA, 207 bp, Bacillus clausii
  misc_feature (1)...(207): n = A,T,C or G
cagcagttcacattaccttaatacgatgacccaaggttctgnaagccctgctgattcattgacattttacgtcatgtatctgtatgacaacgcgtttagttatttccggatgggctatgcatcggcaatggcatggattttgttcgtcatcattatggcattgacggccatcgtcttttggagttcaaaacgatgggtccattacca

SEQ ID NO: 5122 - DNA, 299 bp, Bacillus clausii
ttgatcatgctaaatgaaataaaaggtgggctaattgtttcttgtcaagctttagaggatgagcctttgcatggatcgatgatcatggcaaaaatggcgaaagcagcaaagtggggaaacgcagttggcattcgcgcaaattcggtggaagatattcaagcgataaaaaatgaagtagaccttcctgtaatcggaattattaaacgggagtatcccgaatcagaagtatatattacacctaccaaagcagaggtaaatgaacttttaaggacaggtgttgacatgattgcaatcgatgc

SEQ ID NO: 5123 - DNA, 201 bp, Bacillus clausii
agaagcagacaatttgctagaggaagcagagaaggaaatcaatgtcgcccataaagtgcaaaccgagatgatccaaagcaatgcgcggggggaggaaatcaacctttctattctgctcatccatgcacaggatcacttaatgaccgctatgttggcgatagacttagcgaaagaaattctattgttgcataaagataaagt

SEQ ID NO: 5124 - DNA, 317 bp, Bacillus clausii
  misc_feature (1)...(317): n = A,T,C or G
atgccttggattgtagacgaaccacgctcacaacaagaactagcaacgtcattttacaaacagatgacagaaaagagaattttgcaaattccaggtgcacatgatgccatggctggcttaatcgcaaaacaaacgggctttaccagcctttatttgtcaggagctgcttttacggcgagcttaggattgcctgatcttgggattgtccattcaaacgaagtcgctgcccnagcacgggaaatagtgcgggctacaaacctgccgcttttagtcgatatcgatactgggtttggcggtgtgatgaacgttgcccgaac

SEQ ID NO: 5125 - DNA, 618 bp, Bacillus clausii
ccagctttttttcgcgccaggccgtgtgaacttaattggggaacataccgattataatggtggttttgtctttcccgccgctttaacaatgggaacttacttagcagtccgccgcacaaacacgaatgaatttcgtttagcgagcaaaaattttagccaacgggttgctttcccaaacaaagaactttcgtacaataaagaagatgattggggcaattatcctaaaggcgtcatcgcttattttcaacatcatggttttgacttaggcggggccgacctttatttttttggaaacattcctaatggggcaggattgtcttcttcagcctcgattgagatggtgacagcctatatgatctcttcccttacaggcgccaattgggatcgcctcgaccttgtaaaagcatgccagcatgttgaaaacaactttatcggcgtgaacagcggcattatggaccaatttgctgttggcatgggcaaagcggaccatgcgctatttttgcaaacggactcgttgcagtacgaacttgtgccattaacattgggcaatcacgatatcgtgattaccaattcaaataaacgcagagggctagctgattctaaatacaatgaacgacg

SEQ ID NO: 5126 - DNA, 1332 bp, Bacillus clausii
agtctgcagttttaaagacgtgaagcagagtgaagagaagcggattgtcatcattcatcaagaacttgccctaattccagagcttagcatcgccgaggatatctttttaggaaatgaacaaaaacaacgaggcatcatcgattgggccgagaccgcaacgaaagcgcaagcgctcctcaaaaaagtgaaattggcagaatcacaccagacgctgattaaacatatcggtgtcggcaaacaacaattggtggaaatcgccaaagcgctcgctaaaaacgtaaaattgctcatattagatgaaccgacggcttcactaaacgaaagcgacagcgaaaacttgctgaaactgttagcggaattaaaagaacaaggcgtgacgtccattatcatttcccataagttgaatgaaattaaggcaatcgccgattcggttacgatcttacgggatggcaaaacaatagaaacgcttgatttgcacacggaagatgtgagcgaagaccgcatcattcgagggatggtcggcagagacttaacaaaccgctatccagaagggcaaagtgagatcggcgatatcgtgttttcgatcgaaaattggaatgtgtttcatccagtgcaaagggatcggcaaatcatccatgatgtcagtttgcacgtaaggaaaggcgagattgttggcattgctggcttaatgggtgccggtcgtacagaactggcgatgagtttattcggcaaatcgtatggcacaaacataacgggcacgatcaagaaagatggcaaagccatctcgatcccttctgtacgggcagcaatcgatcacggcctcgcctacgcgaccgaagaccgaaaatcctatgggctcgtgttgatgaatgatataaaagaaaacatctcactggccaacttacctgcggtctcccaaaatcaaatcatcgatcaaatgaaagagacacaagtagcagaatcgtttatgaggaaattgcaaattaaagcgcattccatcttgcaagaaacaggcaagctcagtggcggcaaccaacaaaaagtcgtgttaagcaaatggattttatccgaccctgatgtattaattttagacgaaccgacacgtggaattgacgtcggcgcaaagtatgagatttatacgctcattcgcgagcttgctgccaaaggaaaagcaattctattgatttcttctgaactgccagaactacttggcatggcagaccgtgtttatacaatgaacaaagggcgcatcacaggagaacttgaaaagaaagacctttcccaagagcgtttgatgaggcgaatgacaatggaaatggaggatcaccatga

SEQ ID NO: 5127 - DNA, 471 bp, Bacillus clausii
ttcaaattaaggggagaaagaaacagcttcatcatgatttgccggttgctagtcctgcttggtttgctgtgaaattagtagccattgcagcggttattttagtgtttacctatgtattagccagttaccgcggcattccaaacattcttatcttgcttgtcgccttgattgccttttacgccttcgtcacgaaaagaacggtgtttggccgccacatctatgccgttggagggaatgaaaaagccgccgcgttgtctgggattaaaacaaaacgcgtgacgtttgctgtgtttgtcaacatgggtatacttgcagcgctgtcaggcctcatttttgccgctaggctaaatgctgccaccccacgggcagggaatttattcgaactcgatgcgatagcggctgcctttattggtggtgcttctgcctatggcggcgtcgggacgatcattggcgctgttgtcggcggcctcg

SEQ ID NO: 5128 - DNA, 570 bp, Bacillus clausii
tttaacagttctttactatagtgtgatgaatgtcgacccgcaaaatccaacatgggaagatagggatcgttatattcagagtaaaggtcatgccgttgaatcttattgggcggtattagctgatagggggtttttcccaaaagaagaattaaaaacgttttctaaattcaagtctagattaataggacatccgaataataaggtttcaggcgtggagatgaacactgggtcattagggcacggattatcaatatcggtgggaatggctttagccgctaagcaggatcataaatcctatagagttttcacattaatgggggatggtgagctagcagaaggctctgtttgggaagccgctatggctgcatcacaatataagctagacaacttaattggaatcattgatagaaatagattgcaaatcactggtcgtacaagcgatgttatgaataatgaaccacttgataaaaagtgggaaagctttggttggagtgtggttgaagttgatggcaatgatgtagctgaactagtaagagttctaaatgaagtgcccaagacgattggaaaacc

SEQ ID NO: 5129 - DNA, 312 bp, Bacillus clausii
  misc_feature (1)...(312): n = A,T,C or G
aacgaaagaggttctgacnccagaggatttaaaagggttaaaaatccgggttccaaacaatcagatgtatattcatacgttcagtgtgcttggtgcttcaccgacaccgnttcctctatccgatatgtatgcttccttgcaacagggcgtaattgatggggctgagaatccgctgcctgtcctctctggctcaaaaacgcatgaagtcgcgaaatttctagcgttaacgggacatacgaagattattagcccatgggtgactggnnacgagtttatggactctctgccaantgatttgcgggncattttaca

SEQ ID NO: 5130 - DNA, 177 bp, Bacillus clausii
gcgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcacctgaatggcgaatggcggcaat

SEQ ID NO: 5131 - DNA, 189 bp, Bacillus clausii
gaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggccggcaatagttacccttattatcaa

SEQ ID NO: 5132 - DNA, 566 bp, Bacillus clausii
aatttggcttgcggctcaggcatggtgatggtgtcgagtcacttcttggctttgatggagaatatcagaaagtgtttttagatcgtaccaatgcagggctggaaccgataatcgatcgcaatggccaaccatttccgttcggacagcgctatgaggcagattatgatgcaaaacagggtttcatgaagctggatgtacttgtcgatgaatcatcgatcgaatggtttatcaatgatggtgagcttacgtttacatcccttatttatacggatccaacgaatgcagggattgaatggtatgctgacggcggctccatccatgtccagcatgcacaagcaatccacttgcataatgtgtggcgtgcccgtgtgcccggggggcagctggagcggattgtgaccaatgaagaaacagttcggttggagattggggaaacaaaagagcttattgccgatttgaaaccagattacaacgtgggcgaagaaatgatcgagtggggaagcagtgatgaggacatcgtcaccgttatcgatgaaacagaacgaggagtgatgatcgataacggt

SEQ ID NO: 5133 - DNA, 273 bp, Bacillus clausii
cgccgacacatatggtagcaggctcattacaccagttgaagatttttgaatcgagacaagcgcttgccactgcaacaggagaacggacagcgattgaattgccagcatcaaatgtactgaagtacacacttgaggacggctcgtggttctgtgtgcgtccttctggaacagaacctaaagtgaagttctattttggtgttgtcggttcaagcaatggagagagtgaacaaaaactgaatcagttgcaacaagcggtcatgtcttatatggaag

SEQ ID NO: 5134 - DNA, 708 bp, Bacillus clausii
tttattaaaaagccggtggaaaattgcacttggcgtaataccagccttgcttgtttattgtatctttagcatcattccgatttttatctcgttctattactctttcatgtcgtggaacggattttcaccgatggactatgtaggtctagcgaattttagggccattcttagtgattcagtgttttggctgtctgttcgaaacaatttaattgttgttgccgcttctatatttgggcaaatcccgatagcgcttgtgcttgctttgttgttaaaccgcaaaataaaaggagcgaagttttttcggacgattgcctttctccctgtcgtgatatcaactgttgttatttcgctgacgtggcgaatgatttacaacgtggagcaaggactattaaatcatctactaaataaccttggtctaagcgcgcttgcgcaaaattggctcggcaatcctgattatgcgatgtacgcgattgccgccgttattatttggcaatttgtcggtctttacttcatcatctttttatctgctttgcaaacggtaccgaaagacattttggaagctgcagagctagatggagcaacagaatggcagaaaacccgctatgttacactaccatcgatctggggtgtcattatcatcgcagtcgttctctgtattagcggcagcttaaagacctttgacttgatctatgtaatgactggcggcgg

SEQ ID NO: 5135 - DNA, 1709 bp, Bacillus clausii
actattgaagagaaaatcggccagcttgttcagctgactggtgatttttttgaaggagatctagatacggttgtcacaggaccgcttaaaaaactggggctgcaccaaaattataatgtgtataacaccggttcgatcctcaacgtgaccgatcctgataaaattattcggctgcaaaccgattatctcgaaaaatcgaatcataaaatcccattgctgttcatggcggatatcatctacggctatcggacgatctttccgattcccctcgcccaagcgtgcagctggaactttgagtgtattgagcacgcggcatcgattgctgcccgggaatgttatgaggaaggtgtacacgtaacattctcccctatggtcgatatcgtcagagatcctcgctggggccgggtaatggagtcgtccggtgaggacacgctgttggccaagaagtatgcagaaagcatggtgcacggcattcagggccgacaaggggaaagcagcattcctgccgacaaaattgctgcttgtgtcaaacactttgccgcctatggcgcacctgtagccggacgggagtataacgccgtagatatgtcggagcatatgcttagggaatattatttgcctggctatcaggctgcaatcgatgcaggagtcaagctcgtcatgactgcctttaatacgctgaacggcattcccgccacaggcaacgaatggctgaaccgggatctgctcaggcaggaaatgaagtttgacggagtcctgatctcagactatgcagctgtggaagaactgatcatgcatggttatgcggaagatgaagcagcagccgccaagctcgcttttggtgcccggtgttgatatcgatatgaagccagccgtttacgccaatcagttggagaacgtaataaacggtaatgaggaattgcagcagcttctcgatgacgcttgtgtaccgcgtctttaaagctgaagaacgacttaggactgtttgaggacccattccgcggtttaaaggacagccgtcagttgccggcaacgtgcatcttgtcagacgaacataagacggccgcccggtctttggcagagcaatccatcgttctgttaaagaatgagcaagaactgctgccgttgtcgaaacaggcaaagatcgctttaattggtccgtacgcagaggaaacttccaccctcggtatgtgggcgattaagggggatgaaagggatacggtgaatttgaaaacaggaatgctcaagcatgtggatcctgagcaaatttccgtatgcaagggttcacacctcctgcctgatgaggaaagggatgcgcttggcaagtatgtagacaaactgcctgttgaaacggttgacgaggatgttttgctccaggaagcaattcgtaaggctagcgaagcagatgttgtgattctcgcgttgggagagagcatctaccaaagcggagaaggcggttcgcgcacgaatcctacattgccagagccgcaactgaagttgctccacgaagtcagtcaactgaacaaaaaacttgttgtgattgtgtacagcggccggccgttaattttaaccgaagtagccgcccaagctgatgccctcatccaggcctggtacccgggaacaatgggcggggaagcgctggccaatatcctatacggaacagccaatccgtcagggaagctggcgatgacatttccccgcagtgttgg

SEQ ID NO: 5136 - DNA, 684 bp, Bacillus clausii
acaatccgatcattccagggttttatcctgacccgtcgatttgcagggtaaacgaagactattatttagtcacgtctacatttgaatatttccctggcgtgccgatttttcattcaaaagatcttgtcaattggaagcagattggccatgtgttagatcgtccagagcagctcaatcttgatggcaccccgaattcacggggcatttatgcgccgacaatccgttacgataacggcttgttttatatgattaccacgtttgtggaaagccaacacggcgcaagacgcaatttctttgtaaccgcaacagacccggctgggccttggtcagacccaatctggataaagggggcgcctgggattgacccatcgttgttttttgatgatgatggccgcgtctattacacaggcaatcgtgtttcccctacagggcaaacgcacgccaagcatatggaaatttggctccaggaaatcgatcccattacaggccgcctgcttggcgaaccgactgggatttgggatggtgcgctaaaaatagcccatgcccaggaagcaccccatctttataaaaaaggcgattactattacttgtttattgccgaagggggaactggattcacccatgcggtgacagttgcgcgaagccgggagattgccggcccttatgaggcgaattggcgcaacc

SEQ ID NO: 5137 - DNA, 953 bp, Bacillus clausii
gcttgcaagattggcgtgatcgttcgaccgatagggctaaggcggcctatgagcattttgctcctttggatgggacatttgcagacaatgtcattttgcaaattaaaaacggcccaatggattttcaagtgcgggaacctgtctcgcccctatttggagcattaacacaaacgaactacgtcatggaactacaaattacccaggaatacaccgggcagcaaatcgatgtttgttacttgccgatgcaacggcaagaaatattggcattcgacacacatgcaaatggagagggcaccaatatagccgctcttctttctagccaccaacagcacggaaaggggaaaggcgtaacagctgttacaaacataggaaacaatcaaaactggacggggcatgcatttgctcaagccaatttatacggttatggcctactcgcctggaatcctgagcagtgcccaagaaaggttgctgaagaatgggcaaagcggacgtatgcgcacttgtcagctgaggtgcggcaaacgatttgttcgattttaaagcggtcatggcgagtttatgaagcttatacagcccctcttggtgtcggttggatggtcaacacaggccatcattatgggccaaatgtaaatgggtatgaatactcgccatggggaacgtaccatttctctgaccgaaatggcttaggggttgaccgtaccaaaatcggaagcaattacgttagccaatacaaacaacctgtggctgagttgtatggaaatgtagcgacttgcccagacgaattgttattgttttttcaccatgttccttatacccatatgctaaaaagtggaaagaccgtaatccaacatatttatgacgcccattttgaaggtgtagaggaggttgaagcgtttctagaagcatgggagggacaaaaggaagcagtgcctgacagtctttataagcatgta

SEQ ID NO: 5138 - DNA, 543 bp, Bacillus clausii
aaaagaactgggcgtccaactcgaagtcattgtgcctgctacccatgacactgcttcggcgattgcggcgctcccagaaaaacaaacatcggtttacatcagctcaggtacgtggtcgcttatcggtattgaaaaccgcacgccgatatgtagccaacaggcgatggctgccaattttacgaacgaaggcggcgtcggctcccgtgttcgctttttaaaaaacatcatgggcttatggatgatccaagaagtacaaaggctgctccctgggcattggagcttttctcaactggcgcaagcagccagtgggtcaacgtataccggggaaattgatgtcgatcaacatcgttttctaaagccagaaaacatgattgaggaaattcaacaagcttgccgcgaaaaggggcttgctgttcctgattcaccaggcgatttggctaagtgtatttatgatagtttaatagctagttatgacaaagctgtaaccgaaattgaagctatttcaggaaagacgtatgaacaaatccatattattggcggcgg

SEQ ID NO: 5139 - DNA, 408 bp, Bacillus clausii
  misc_feature (1)...(408): n = A,T,C or G
tgcaccatattttgtacatgccatttnggacaacaagccttggcggctcgatgattgtcgatggcacactngncgaaggcacacagcgaatttncttcgcacagctcgctgatccaagcgtgactcaattctacgaaggaacgtcgcgcttnatgtccgggcgtnttattacgatgatgtncggtttgctcggngcatgcttagccatttaccacacagcaaaacctaaaaacaaaaagatcgttgctggccttntactctcagcagggctcacttcctttttgacaggcattactgagccaattgagttctcattcctgntcattgctcctgctctttatgncgnccatgccttntntgatggtcnagccttnatgctcgcccacatctnttcgattacaatcgggc

SEQ ID NO: 5140 - DNA, 678 bp, Bacillus clausii
cccgttccttatcggttattttccggatacgttcgggatttacggccaagccccacagcttcttaaacaagcgggaataactgctgctgcgtttggacggggcgtgaagccaactggttttaataataccgtttctgatgctaaagcatttgaatccccttattctgaactgaattggtcggcgccggatggttcatcggtattgggcatcttgtttgccaattggtattcgaatggaaatgaaattcctgtgaatgaaaacgaggcaaaggcatactggaccacgaaattggctgatgcaaaaaaatatgcctcgacgagccatttgctcttcatgaatggctgtgatcaccagccagtgcaacggaatttgccggaagcaattaagacagcgcaagcgctgtttcctcatatacaatttattcaatcagattttacatcttatattgaacgggtacgaacggaattgccgccaacaatccaaacgattactggcgaactgcggaaccagcggacggacggatggtcgacgctagtcaacacagcttcgagccgtatttatttgaagcaattaaatgaaaaagcgcaaatgcgcctagaaaaacaagttgaaccactgcttgcgattgagtggttgctcggacatgaagtcgatggggcatatgtacgctatgcctg

SEQ ID NO: 5141 - DNA, 348 bp, Bacillus clausii
atgagtagggagggggcaaatgtggacattgaaccgctgaaaccgtcgatgggggctaggaaaaaaacgactcggtttgcgagaaaagagcatcttgctggctatctgtttacgctgccggcgattttaggcttgctcgtttggacaattggcccgattgttgccagcttggttttgagctttaccgattaccaagtgatcgcggacacaatcaattggattgggttcgacaattatataaccattttcacagaagatctttattttaacgcaagcacttgtcgttacgttgtattttgcgtttgccagcactgccgccacactcgtcgctgccttgttgatcgctct

SEQ ID NO: 5142 - DNA, 411 bp, Bacillus clausii
cgccgaaaagaaggtggaacggggtcaaacgcaactgggatctttatttgcttatccttccagttgtaatctattgtttgatctttaagtgttaccctatgtatggcgtgcaaattgcctttaaagattttatcgccgccgaaggaatttggggcagtccgtgggtcggatgggaacattttattcgtttttttgaaagtttttattttgaacgcttgatcggaaatacgattggcttaagcctctataacttagtgattggctttccaattccgattattcttgccttgctcattaatgaaattcgttataaaaaagcaaagggttttgtccagacagtcacgtatgcgccccatttcttgtcgactgtcgttgtcgtaggaatgctgtttttactgctatcacctaatg

SEQ ID NO: 5143 - DNA, 489 bp, Bacillus clausii
tcgttaaccagatacttggcttgttaggcatttcggaaattgcctttatgacttcgcctgaatggtttaaaacgacatacgtgttttccgatgtatggcagcaaatgggttggagctcgatcatttatttagctgctcttgccggcattgacccacagctgcacgaagccgctaaaatcgacggcgctagccgcttaaggcgaatttggcatgtcaacttgccagggattcgctcgacgatcaatatctgctgattttggcagacagggagcatcgtgagcgttggttttgaaaaagtatttttaatgcaaaatcagctaaacatggaagcatctgacgtgatcgctacccatatttaccgaacgggaatcgctggtgcccaatacagttattcggcagcgatcggcctatttgaatcagcgattaacttttttattctgatttttgtcaattacacagcaaagaaaacaagccagacgagtttgtggt

SEQ ID NO: 5144 - DNA, 440 bp, Bacillus clausii
  misc_feature (1)...(440): n = A,T,C or G
tgaaacaaagtacaggcgatcgtttttttggtatagccgtttacatgtgtgtggcgcttattacattaatcgttttgtatccactcgtttatgtgctcagtgcttcgtttagcgatccagcagccattttaagaggagaattgtggttgtttccaatcgatccaacgatcgagtcttataaaagcgtgtttcaaaatgaagacgtctggatagggtttcgcaatacttttctctatacgactttaggaacggccttcaatttacttttgtcgattatggtcgcctatccgctatcacgaaaagacttttatggcagaaacgtgttgacgattttccttgtttttacaatgttctttagcgggggaatggtgccgacctatttgctcgtnccgtgatttaggaatgttgaacacgattgggctgtgatcgtgcctggggca

SEQ ID NO: 5145 - DNA, 762 bp, Bacillus clausii
agcacaattaaatcctgacgttatcaaaggttttgcgacaaacattggcggtcgtacgtctcactctgcgatcatgtctagatctttggaaattcctgctgtggttgggacgaaagaagccactgccaaaattgaaaacggtgcacttgtgattgttgacggcattgatggccacgtcattgtcaaccctaccgaagaagagttagctgcttacgaacaaaagcaagctgactatgaagcacaaaaagcagagtgggcaaaacttgtcaacaaaaagacgacaacgcaagacacgcaccacgttgagctagcagctaatatcggaacgcctaaagatttagacggcgtaattaacaatggcgctgaaggaatcggcttatatcggacagagttcctttatatggggcggacagagcttccaagtgaggaagaacaatacgaagcttacaaagaagtagtggaacggatggatggaaagccagtcgtcatccgtacgctcgacattggcggcgacaaagagcttccttatttggacttgccacacgaattaaacccatttttagggcatcgagccattcgcctttgccttgaaaagcaggacatgttccgggctcagctccgcgctttgcttcgcgcaagtgcacatggcaatttgaagattatgtttccgatgattgcgacgttggaagaattgcgtcaagctaaacaaatcttacacgaagaaaaagataagcttcaagcgagcaatgttgatgtcagtga

SEQ ID NO: 5146 - DNA, 132 bp, Bacillus clausii
aaggttaccaaagcaggggctgaacatcgtacaagggccaggaaacgacttagtatctgtcacaaaccttgctgcagctggtgcccatatcgtgctgttcacaacaggaaggggaaccccgtttggcgggcc

SEQ ID NO: 5147 - DNA, 513 bp, Bacillus clausii
  misc_feature (1)...(513): n = A,T,C or G
tcattccaatgggagtgggacaggccttaatcatttacggaaacaagcatgggataaagacgtattagcttttcttnaaattagtgaagataagttgtctttgctngtgcccaccacttncgaattgccnccgctaacagcagaggcacaagcgctgcttccagttggaacggattgccgtttttttattggcgcagggnacggcgtattggccaatattggcgctgacgcgctagaaaaaggaacggttgcgattactattgggacaagtggagctgtgcgaacacttgtagatgacgtagtgacggacgagttacagcgaacattttgttatgcgcttacagaaggaaagttcatcgcaggcggtgcgaccaacaacggcggtatggcattgcaatggtttattgaccaattttcaaaaggaatgcaaacggaagcaaatggacgctctatccatgaattgattattaagtcagcggccaatgttcctgctggttccgaaggtttgctgtt

SEQ ID NO: 5148 - DNA, 582 bp, Bacillus clausii
  misc_feature (1)...(582): n = A,T,C or G
atggaatggtggagaacaagtacagtttatcaaatttaccctaaaagctttaacgatacgacgggaaatggcattggcgatttgcaagggatcattgaaaagctagactatttaaaagaactaggcatagacgtcatttggttaacgcctatttatgcttcaccgcaaaatgacaatggctatgacatttccgattattatgcgatccatgaagactatgggacgatggctgatttcgaaaaactcctgagtgaaacccataaacggggaatgaagctaattatggacttggttgttaaccatacgtcgactgaacatcagtggtttaaaaatgcgaagctaagcaaacaggcgaagtaccgtgatttttatatttggaaagaaggcaaagacggaggcgcaccaacaaattggcaatcgaagtttggcggttctgcgtgggaatacaatgaagcgacaggtgattactacttgcatttgtttgacgttacgcaagcagacttaaactgggaaaacgaacaactgcgcaagcatgtctacgagatgatgcatttttggttnaataaaggcnttgatggcttc

SEQ ID NO: 5149 - DNA, 483 bp, Bacillus clausii
  misc_feature (1)...(483): n = A,T,C or G
ccatttcctactattactcttccatggtttcagcaaaaaagaatgggatgagtccgatcgacgtaagcaaaaacccacatcttaaagccaatccatggggctgggccgttgatccaaaaggcttgtatcacgcattatgtcaatactatgatcgttaccaagtgccgatcatgattgcagaaaatggttttggcatgtatgacaagctcgaggatggcaaggtacatgatgattatcgtatctcctatcttgcagagcatatngcacaaataaaagaagcgattaaagacggcgttgaaatatttgcttattgcgcatggggaccaattgatattgttagttgctcttcagctgaaatggaaaaacgntatggctttatctatgtcgatatcgacaacgaacgaaacggctcacggaaaagaataaacaaagacagtttttattggtatcaaaccgtgattgaaacagacgaagagacgcttt

SEQ ID NO: 5150 - DNA, 906 bp, Bacillus clausii
atgacccatatttccgactcgagccatttatggcataagaccgctgaggaatttgccaggcttgtcgaagaaaaaacgaatggaaatgtcatcatcgatatttatccgaatagtcagttgggcaatgaagtggacaacattaattcgatccgctttggcgcgaccgatttgacgattaccggcgaaacattggaagtgtggacgccaaacgctattttgttagcggttccatatgcatttgaagaccaagaccatatggagcgtgtgattgagggcgagatcggtaaaaagattgaacaagatatacaggaagacgtcggtttaacgccattgttttatatgcaacgggcgccgcggaacttgacgtcgaattacccgatttcgacgccggaagagttgcgtgggtttagcatgcgtgtgccaaacgtgccgctgttccttgacgcttgggctgaagctggggcaagcccgcaagttattagtttgaatgaagtctttactggtttacagcaaggggtaattgaaggccaagaaaatccaaatgatttaattgatagcaatggcttttatgaagtccaacaatatttaaatttgacggagcatgtccgctcatggatttatgtcgtagtcggtaccgagcaattgaaagcgttgccagaagacgagcaggccgctgtgttggaagcggcagaggaagcggaggcgtatgcccagagcttgttggaggaagaaacggaattggttttggagcgtcttttatcacgagggatgacattgaatgaagaagtcgaccaagacgctttccgcgaggcgatgttgcctgctttaaaacaaaacttaggaaaagaacagtatgagctttatctgcaaatggtagcagagggagaggaaggaggcagcgaatga

SEQ ID NO: 5151 - DNA, 1103 bp, Bacillus clausii
atgaagagcgcatggaaagtgtacgttctagccttgattagctttttagttggaacatccaattacgtcatttctgggatattagaccggatcgcagagacgttgggaacaagcgttgcgacagcaggccagcttattacggtttattccctggcctatgcggtcgttacacctatattgatggcgctgacggccaagatggaccggcgcaagctccttcttgattcgctaggtctctttattgccgcaaatctgctgacatatatattgtccggcttcggtcttttcattgccgcgagaatcattacggcaataggcgccgaggtagtcaccgttaacgcgctcagcatcgccgccaaaatcgctccgtccggcaagcaggccagcgccatcgctaacgtcacgatgggcattaccgcatcgctcatcatcggcgtcccgctcggcagaatggtagcctcggcttttggctggaaagcgatatttttggtcatcgcaattgtcggggccatctccatgcttgtcatagctgcagtttttccacgtatgcagggcgacaaacctgttccactaatcaaccaatttgctttgttaaaaaaacctcaggttctggtagctttagcgattacgttcttctggttgggaggatattccctcgcctatacttacatcaccccttttctgctagaggtgactcatataaatgaatcattgataagtgcagctctgttcgtgttcggcattgccagtttaattggttcaaaagtcggtggctacagcacggataaacgtggcatcaaattcacgcttatttcagggatggtgcttcacgtcatttcgttgattttgctagccttagtcgggcaatcggtcatcgccgtatttgcaattttgatcctctggtcttttgccgcctggtcatccgcacctgcgcagcaatttaacctggtctcgcttgttcctgaatcctcaggagtaatgttgagcttgaacagttccatgatgcagctttccatggctgttggcgcaggaatgggtgggctgatcgttaaccgtatttctttggcatccattacttggttcggggtactcggcgtacttat

SEQ ID NO: 5152 - DNA, 783 bp, Bacillus clausii
tctttttgtttgcgcactgctcgtcatcgctccttttgtatggatggtgagcataagctttgaccgaatggccaatattcaagtaccgtttccgccaagttttattcctgatttgttttcgatctttaactatgaattggtatttgaaaatggccgcattttccgtgcgtatcttaattcaggattggtaacgtttggttcagtcattttacaagtgtcagccgcgctattaggaggctatgccttttcaaaagggcgctttaaagggaaaaagctgctgtttcttgtcgtgcttgcgacgatgatggtgcccattgaagcgcggcttatcccattgtattcgatgtttaatcgcgttggcttgctcgatacattttggccagtgattttgccctcgattttgtatggcctaggcgtgttcctcactaaacaattttttgaccaaattcctgccagtttgcgggaagcagcctccatcgacggcgctagtgaattcagaacattttttcaagtttacgcgccattggccggcccgattacagcgacattcatcatcttgtcgtttatgggcaactggaatgagtttgtatggccgctcgttgtcttaaactcggaacagctccagacgattccactctttctcgccagcttttcgttagaaaacggaacggcattagccggaatgacgatggcgctggcaacgataagcgtcgtgcccattattatcgtatttgtttgtttgcagcgctatattatccaaagcattgcccttagcggcttaaa

SEQ ID NO: 5153 - DNA, 453 bp, Bacillus clausii
ttgctttggcttgccgacgtccccatggctatctgatccgtcgacctcaaaagcaggcgtcattttgctggctgtttggcattggctcggctttgtcattattatttgtttggccaatttgcaagcgatttcaccggaattgtatgaagccgctgaaatcgacggcgcctccagtttgcaacaatggctgtttatcacgattccgaacatggcagggacattcgcttttctgtttatcatgggctggatttctggtttacagcggttccaagaagtgtttgtgctcggcggtccagggggcagtcctagccgttccatgcagacagtggtcgccctcatttatgagcggggctttggcgggtttgaatttggcattgcctctgccatcacggtattgctgtttctcatcattcttgcatttacagtactgaacctcaagctgacacgcttgaa

SEQ ID NO: 5154 - DNA, 342 bp, Bacillus clausii
  misc_feature (1)...(342): n = A,T,C or G
acgacatccatatgctttgcccatgtatggcagtccantntntnaaaggcgcccatcagattcggcgtgacaggaatggacggcgtatgctttttgactgtttcgtattccagcnngtaacattcgagcaaactgtcggaatggaagcgcatatagtcgagggagattccttggaaattcggctccgtccgcccgatcgcacctgtccactcctcgctcagtccgctaggcaaaacgatgnctncccaactatggaacgngtgcccccaaaatccggnatnccaggctcgatncactacancaagggaaccgnaacgcgccntcgcccatacccggaaagcg

SEQ ID NO: 5155 - DNA, 597 bp, Bacillus clausii
  misc_feature (1)...(597): n = A,T,C or G
aagcattagaagaagaaccgctcnattcttcctttattatggggcgcatggctctcgccgcnnaacaaggcggcgcttcaggaattcgtgccaattcgaaagaagacatacttgaaatcaaatcaacagtcgacttgcctgtcatcggaattgtgaagcgccattatccaggaagcgacgtttatattacggcgacgatgacggaagtggacgaattaatggaagccaacgtggacatgattgccatggatgcgaccaaacaaaaacgccctaagcaatcgctggcggaaatggtagcagcaatccgcaacaagtatccggacgttgcccttatggcggacgtctctacactggaagaagcaatcgaagcagaccgccttggctttgactgcatctcgaccacattagtcggctataccgcttatacggcaggcgcgtcggcgtcagacaatgattttgctcttttaaaagagatggcccaatccgttaaagcgccagtcatcgcagaaggaaaaatgaacactcctgcccttgccaaaggtgctcttaaagcaggcgcccatagcgttgncgtcggtggagcgattaccccgccct

SEQ ID NO: 5156 - DNA, 402 bp, Bacillus clausii
caagggttttcggcagctgaaatcgatgtccttagaaatgaattggaaccttcaatatggagagatcgcgaaaattttccgcggcggctgtattatccgcgctgcctttttgcaaaacattacggatgcatttgcgcgggacgccaacttagacaacttgctgcttgatccgtacttcgaaaacatttccagaaagtatcaacaagcactgcgtgaagtggtcgctctagcagttgaatacggcatcccagtaccagggttttcgagtgccatttcttactatgacagttaccggagtgaacgtctgccagcgaacttgctccaagcacagcgtgattactttggcgcccatacgtatcaacgcattgacaaagaaggcgttttccatacaaattggcttga

SEQ ID NO: 5157 - DNA, 528 bp, Bacillus clausii
ttacgatgctgagattttcgccgaagcaggcgttccggaactagagcctggttatacgtgggatgattatatagaggcagtcaaaacagttaacgaaaacttggacggcatgtatgcgtatgctttcggagataatttaaacttttttaagcattatttgcgccaacatgatttgtggttgtacaacgaagacaacacaggacttggctacgacgacgacaagtacctgatcgattttttaaacatgtataaagacttgctcgacagtggggtggctgcgcctcctgatgtcaaagccgaggtccaaggcatccaagatgagctaattgtccacagccgcgcttcaacgttttcccctcacagcaatcaaattgtcgcactcaatgaagctgctggccgtaagcttcagatgacaactttgccagcaatggaaggtggatcagaagcctcctttatcaaaccgtcattgctattttctgctacaagccaaggggacaagagcgaagaggctgcgcgattcatcaattt

SEQ ID NO: 5158 - DNA, 256 bp, Bacillus clausii
ttggccataaaaacctcagagattttgtcgtcaaaacagcagaggacaacaacattcctttccaatatgatactattccaggaggagggacagatgcaggcgccatccatttaactgccaatggcgttccggctttgtcgattacgattgcaacccgctacatccatacccacgcaggtttacttcatcgagatgattacaacaacacagtcaaactgctcgttgagttgattaaacggctggatggggaaacggt

SEQ ID NO: 5159 - DNA, 720 bp, Bacillus clausii
  misc_feature (1)...(720): n = A,T,C or G
tttggatcaacaattgcaaatgctaaaagcgctaactgatgcaaacggggtttccggttttgaaaaagaagcacgggacgtcatgaagtcatatattgctccttttgccgattctgtggaaacggaccatttgggcagtttgattgcaaaaaaaacgggcaatgcagatggtccgaaaattatggtcgctggccacttagatgaaattgggtttatggtgaaaagcattgatgaaaaaggatttttgcgtttccaaaccatcggcggctggtggggccaagttttgctagcaagccgtgtaacagtcatcacagacaacgggccgattcctggcgttatcggttctaaaccggcccatgtgctgtcgccagaagcacggaaaaaaccagtcgagattgacgacatgtttattgacatcggcgccacatcaaaagaggaagcacaagagtttggcatcaagcctggaaacccaaatgcgcctgtgtgcgaatttacagggatgaaaaatgagaaattgttgatggcaaaagcatgggataatcgtatcggctgcgccatcnccattgacgtactcaaatcattacacgaggtcgaacaccccaatgttgtctcngagttggaacgatacatnangaagnngtttgcgcggggcaaaaacgagtgcacatgcaatacagccaagacatcggcttcgcaattgatgttggcatttggtgcaga

SEQ ID NO: 5160 - DNA, 551 bp, Bacillus clausii
  misc_feature (1)...(551): n = A,T,C or G
aagggtatttcacagatctagggatcaatacgatttggatttcggctccttatgaacagatccacggctgggtcggcggtggcccagatggcgattttgcccattatgcgtaccatggttactatgcgttggactatacaacagtcgaccaaaatatgggcacagtcgaggaaatgcgcgagttcgtcaacacagctcacgaacaaggaattcgcgtcgtcctagatgtagtgatgaaccatccaggctacaacaccattaaagatatgaatcaatatggattcgggaatccaggcgtatccgaggattggacaccaagtgaagggcaaacttggcatgatgtccacgaccatattcattatgatgatgcctcggcgtggagcacatggtgggggccttggattcgcgcaggaattggcgggtatgaatcatgtggaaacagtgagatcacaatgtgcttagccggtttgcccgactttcggacggagttaacgcatagtgttggcttgcctcccttgntagagacgaagtggggccaagagcgacaagag

SEQ ID NO: 5161 - DNA, 699 bp, Bacillus clausii
aacaatcttttataaatggcgatgttattaccataggagaaggagttgaagccggagaagaagtaacgcttcagcttaaggcggagaacgaattcggctctactgaagaaatgtatacgtttacaaaaacagcagggttaaccgtttacttcaaaaagcctgacacatgggggacaccgcacatttactattacgatacagatcctaaagtggaggaaccatcatggggttcagctccagaaatggagcctttcgagaatggctggtatatgtacacaatcgaaggggcagaaagtgtgcgaattttatttaaagatgatggcgctaatcaatggccaggacctgaagaggatgggttttatcgagaccaagacggttggtttgatggggagtggcatcccgaaaaacctgacctagcaaatgccattacgatttactataagaccggttggaccgacccacatattcattattccctcaaccaagaagcttggaccactttgccaggggtgcctctaaactcgtcggagtataatggctacgcgaaaataacgattgaagcagaagagggaagtcggctcagggcagcttttaataatgggcatggacaatgggacaacaatcagggaagagactacgtcttccattcaggagtaaatacattagcagatggcgtgatagtcaggggcacgcctaagt

SEQ ID NO: 5162 - DNA, 457 bp, Bacillus clausii
atgacgattatttctgatgtttatgcacgtgaagtccttgactctcgtggcaacccgactgtagaagtacaagttcatctagaatctggcattatgggccgtgccctcgtgccaagtggcgcctcgactggcgaatacgaagcggtagaacttcgcgacggcggagaccgtcatatgggcaaaggtgtccaaaaggcagttgacaatgtaaatgaaaagatcgctcctgaactaatcggcgaaaacgcgttggaccaaattggcatccaccgtttgatgatcgaacttgatgggacagaaaacaaaggcaactttggcgccaacgcgattcttggcgtgtcaatggccgttgccctcgctgctgcaaatgcactagacattcctctatatgtctatcttggcggctttaatgcgaagcaacttccagtgccaatgatgaacatcattaacggtggag

SEQ ID NO: 5163 - DNA, 435 bp, Bacillus clausii
aaagctttaaagaagcgcttcgcatgggtgcggaaattttccataacttgaagtcagttcttaaagcgaaaggctacaacacagcagtaggcgacgaaggaggctttgctccgaacctttcttcaaacgaagaagcgcttgccacgatcattgaagcgattgaaaaagcaggttataagcctggagaacaagtgaagttggcaatggacgttgcttcttctgagctttacagcaaagaagacggcaaataccaccttgctggcgaaggcaaagttctttcttctgaggaaatggtttccttctacgaagaacttgtttcgaaatacccaattatctcgattgaagatggccttgatgaaaacgattgggaaggccccaaacttcttacagagcgccttggcgataaagttcaacttgttggtgacgatttgtttg

SEQ ID NO: 5164 - DNA, 879 bp, Bacillus clausii
taatgataagtattgccttggtattcgtgttaattggatgttctgcttcggcaaatgccaatttagaacagaaaaaggttatcagcatagcgaccgtacagcctgataaccattcaataacgatcgccctaaacgcatttaaagattacattgaagaaaaacttggggataaatttgaaattaggatcttttcccacagtataatgggcggaaatacggaagcaattgaattgctgcagatgggcagtctcgatattgttgcgactagtggaagcaatttggaatcctttgccaatgaatataagattttcggttttccgtatttgtttaatgatgaagcaagctttcgcaaagtgatgaataatgaggagtttataatggaaatttacaacgctactgctgataacggaattcagggagtagcctggtttgccaatggtgtaaacaacttttattcttctaaaagaattgaaactcccaaagatttaaaagggttaaaggttcgcgtacaatccagtgaggcaaatgtaaagatggtacaagcttttgatgctgcagcagttgtcatggctcatggtgaagtatataccgcattgcaaaatggcgtgattgatgcgggtgcaaacccagagatggcactggtaagcttgaagcatggtgaggtcgccaatttttattcccggacggaacatcagatttttacagacatgctcatggccaatacgaaatttctggattctcttacggctgaagaaaaagaaatttttgaatacggctttaaaatgaccacacaagttcaaaatgaagaatgggataaacagattccggaagtaatagaagaggcagagaagatgggagtagagtttgtgaccgtcgaca

SEQ ID NO: 5165 - DNA, 607 bp, Bacillus clausii
atgaaattcagcaatggctgctggatgaaccgagcaggctttgaaattcgatctccgcaagaagtatatgacattcgcaaaacagattcagaggcaacactgtatggcccattccaaaaaatcgcccatccagggatgacacttgacggcggcatgatgaccgtcactgtatcggcccctatgaatgatgtgattcgtgtccatagcgtccaccacggaggcggcattgacaagggtcccgatttccctctttatacggaaaaagcagacattgcctgcaaagaagacgaacagtccttttttttccaaagcggcgaccttctgctaacagtcaataaaaacgactggcgcttcgctttttcccgaaaaggcgaagccgttacgacgagcgaaaggcaatgcttaagccacattatcgatgacaacgggatcccttttatgcgcgaacaactgtcgcttgacgtcggtgaatacgtatacgggctcggtgaacggtttacgccgtttgtcaaaaacggccagtctgttgacatttggaacgaagatggcggcactggcagcgagcaagcttacaaaaacattccgttttacgtgagcaataaaggct

SEQ ID NO: 5166 - DNA, 285 bp, Bacillus clausii
atttttcgcaaagtgattttccctaatgtaaccccagccttgtcctacaattgttatttacaatttcgtcttcttgtggacagagtttatctttgcactcatcttgctaacaacaagaagtaagatgactttgcttcttggactgcaaaatttttacggcgagttgatgatcaacgttcctggtctaatggctgctattacgctcgctagcttgccgattttgttattatttattatcgcccaagaacgtgttgtcaaaggtctgacaggcggcgctttaaaagg

SEQ ID NO: 5167 - DNA, 960 bp, Bacillus clausii
atatcggccagaaatcactgctatttgcctaagccaaacagaaaggttacttgctaaagcgccctgacggcagcgtgtggcagtgggacaaatggcagcctggccttggcgtagtttactttacaaatgaagaggcaaaaacgtggtatacagacatgctggaaacgttaattgacatgggcgttgatagctttaaaaccgatttcggcgaacgaataccgacggacgtcgtttatgcaaatggagctgaccctctgaaaatgcataactattacacgcaactgtataacgaaaccgtttacacattgcttgaaaagcgcctaggaaaaaacaaagccgtcctgtttgcccgctcggcaacggttggcggtcagcaatttccagtccattggggcggcgatagcttttccacatacgcttccatggctgagacgctccgtggcggcctttcacttgggttagccggctttggctattggagccacgacattggcggatttgaaacaggctcaacgcctgatctgtacaagcgttggacgcaatttggcttgctgtcctcccatagccgctaccatggaagcggcgattacaaagtgccatggctgtatgacgaggaagcggtagatgtcacacggctgtttacgaaattaaaaaaccgattaatgccttatttatttgccaaagccgttgaagcaagcaaagatggcgtgccaatgctgcggccgatgctgctcgaataccgagatgacgaaacatgccacacacttgaccgccaatacatgcttggcgacggcctgctcgtcgcgccgatttttaatgacacaggaaacgtccgctattacgcgccagcaggcaaatggaccaacctcctgacaaacgcgttcatcgacggcggaaaatggcatagcgaacaccacagttacgaaacattgccactgctcgtccgcgaaaacacgattc

SEQ ID NO: 5168 - DNA, 774 bp, Bacillus clausii
tgggctgcaatgggcgaaagcgattttagcaggcgccgaattgcaacaatcgccagtaattgcagctgcttctgatcgtttgattgactacttaggaggctttcaaacggttgtggccatgatgggggcattaaccgatgaacttggtataacggtgcctgtcgtgctccatcttgaccacggtttaagtattgagcgttgcaagaaagcagttgacgctggcttcagttctgtcatgtttgacggctctcaatatccaattaacgagaatattgacatgacgaaagaggtagtggcttacgcccacgcacgtcatgtgtcggtagagggagaggtcggtacagtcggtggcatggaagatgggctaattgccggaatcaaatatgccgatgtggaagaatgccagcggtttgtctgcgaaaccaatgtcgatgctctcgccgccgcgctcggctccgtccatggcaaatacaagggtgagccaaagcttggatttaacgaaatggctgccatttccgcccgcacggatgtgccgctcgtccttcacggtgcctcgggcatacctgatgaacaactacaacgggccataaagcttggccacgctaaagtcaatataaacacagaatgcatgatcgcatggtctgatgcttgccggacaacatttgccgagcaagaaacggcgtttgagccgcgactgctcttacaagagggcctagcgatggtccaggctacggttgaaaagaaaatcaagcaatttggagcagctaataaagc

SEQ ID NO: 5169 - DNA, 207 bp, Bacillus clausii
aaaagaatggaggtctctcatggctttactaacattagaccaagtgacggtcgcttaccaaaaacaagacattttaaaacagtttgatttaaaaatcgagaaaggcgagctcctttccttactaggaccaagtggctgtggaaagacgacgacattgcgcctcattgctggttttctcgaatcgaaatctggccgcttcttatttaa

SEQ ID NO: 5170 - DNA, 566 bp, Bacillus clausii
gcattagcaaaactcacagcggacaatgtccattactctcctgccaacattgtctctcttggatggtctaaggcgtttgttacggcaatacagctgcttccaaacccgtatcacatgtattatttccaaaaggaggaggtgctgaaaagggatcttgctgcctttagggaacatgggacgagggcgcaaatcgtcaaacaagttgaaaagtcgcttttccacacgtatgaaaatccagcattgtcagaaaagccaaaagaactggaacagcgcggcggggcttattacagcgaagcagcgtgcaacttagtagaaagtcttcataccaataaacaagatattcaaacagtgaacacacgtaataatggaagtatccgagatttgcctgatgatgcagtcgttgaaatcaatgctgtcattacgaaagaaggccctaggcctcttgctgttggaaacatccctctacaagtcaaaggaatcatttcgcaaatgaaagcgttcgaacagcttgtcgttaaagctgcattgtccggcgattattacgatgcgtacaatgcgcttgttat

SEQ ID NO: 5171 - DNA, 414 bp, Bacillus clausii
tcgatggtgaagcttgcatccgtttattatcagtctctggggtgtcggcggcggcatgattatttatttggccggcttacaaggtgtacctccaagtttgtatgaagcggctgagattgatggggccggaaaatggcggaagttctggcatattacaatcccaatgacttctcatgttatttttttcaatttgattatgggcgtgatcgggtctttccaaatgttcactcaagcttatgtgatgagtggtggcgggccaaattatgcgtctttgatttacgtgctttacctctaccaaaatgcatttgagtttttcaatatgggctatgcatccgcacttgcttggatattgcttgtcattgttttgatcttcacgttgctgcaattcaaattttttggcaagaaagtttatta

SEQ ID NO: 5172 - DNA, 630 bp, Bacillus clausii
gcccaaatgcagagcggcaagaaaaagcccatgcccattttgccggttttacaccagatgaacgatacattgtagcggtcgatctaggtacagacgaagtcgtgctgtatacacttgatggcgaaaacttggcaaaacattttacgtttaacgccactccaggctctgggccccgtcatattgctttccacccgacggaaccatatgcctatattatgactgagttatccaatgaagtcattgtgtgcgcttttgacgcgattcctggaacattaaaggaaatacaagtagtgtcaactttgcctgaaggctatgaagaccttagccaaggcagtgccatccatgtttcccgcgacggcaagtttgtttacgttggcaaccgcgggcacaattcaattacaagtttccgtgttaatgaacattcaggcgaactgagcttagtcgaatttgtttcgactgaaggcaattggccgcgggactttcgccttgatccaaccgaatcaatagttgttgcttctaaccaagaatcaggggatttaaccgtctattcccgaaacaaagatacaggcaaactcagcctgcacaaagccaatatttctgtgccatatcctgtttgtgtagcatttttaa

SEQ ID NO: 5173 - DNA, 867 bp, Bacillus clausii
atgaaaggaatctttcgcaaaaccaattacgcgcctggggagctgtccaccgccggtaaagtcttcacttacgctgcattagcccttggccttgctttctttttgttccccgtattatggatggtgtttacgtcgctgaaatcgctggaacaaattgtttcagagccactgtcattgctgccgaataactggaattggagcaattacatcgaagtgtttcaaaaccacccttttggcacctatttatggaatacaacgtggtacacaatcgtcaccgtttgcggcactgtgttcttctctgccttcattgcttttggctttgcccgcttccgtgcaagaggaaaaacatttttatttgccatcgtgctgagcacgatgatgctgccgccacaagtgacgatgattccacaatacttgctgttcaataaaattggctgggtcgactcttacttgccattaaccgttccaatgctagccggcagcgcttttttaatctttttgttgcgccagttttatatgggattgccaaaagaactagatgaagctgtcactatcgacggcggcggctactttacgatttttttccgcatcattttgccgctgtcgtttccggcaatggctacggctgccattcttgaatttatgtttcgctggaatgacttgatcggaccgctcatttatttgaacacgcaagatttgtatccgctttcattagggctcgccaatttcaccgctgcttatgcagcaacaccatggcagcttttgatggccgcctcagtgatggccgtcataccgccgctcgttttgttcttcttggcgcaaaaatactttatccaaggtgtcgtgatttcagggacaaaagggtaa

SEQ ID NO: 5174 - DNA, 603 bp, Bacillus clausii
accatctaggggatcaaaaagcagccgcgattgccgatttgttttttaaccgcagttttttagacgctgttgtccttggttcttttcctaaagagcttgtcgccttgcttgatgagtatgggcaattgccaacctatgaaaaagaagatgttgctcttattaacgcacagcggattgacttgcttggcgtaaattattaccagcctcggcgtgtaaaagcaaaagaacatttgcctaatcccgcgtcgccgtttatgccagaatggttttttgaccattatgacatgcctggacggaaaatgaaccattaccgtggctgggaaatttacgaaaaaggcatttatgacattatggtcaatttaaaagataactatggaaacattgagtcgtttgtatctgaaaatggcatgggcgtacaaaacgaagaacggtttatggaaaatgggcaaattcaagatgagtaccggattgagtttataaaagggcatttaaaatggcttcaccaggcgattcaagaaggctgcaatgtccgcggctaccatttatggaccttcatggacaactggtcatggaccaatgcctataaaaatcgctatgggttat

SEQ ID NO: 5175 - DNA, 609 bp, Bacillus clausii
cccgcaacacgtcgatgagacgaccggtgttattccagttggcgttttaggcgcacaaggaatgtttgtcgggattattacagcatttgtgtctgcggaactgtaccgctcttttgtaaacaaaaattggcagattaagatgccaagcggtgtgccagatgcggtgtcccgttcgtttagttctttgattccaattacgatgacactttcgtttttcttgttggtgcgtatcgccttttcgtttacaccttttgagaccgtgcaaaattttgtgtacacatcggttcaagcgccgttaacagcacttggaagcggcttgactgcaacgatcatcgccgtgctgttgatacaagttttctggtttttcggtttgcatggccaaattattatcaactctgtccttgacccgatttggttcacattggcgggagaaaacttggatgcatacaacgcaggcaatgagctgcctcatattgtaagcaagccgtttatggaatcgtttattgtcggtattggcgggtctggtatgacgctagccgttattattgcgattttcttgattggccgcagccgccaactaaaacaacttggaaaaatcggtggccctcc

SEQ ID NO: 5176 - DNA, 1007 bp, Bacillus clausii
atggcttcgattcaattaaaaaatgtgtacaaagtatatgatggggatgttacggctgttacagacttcaacttggacattgaagacaaggagtttattgttttcgtcggcccatcaggctgtggtaagtctactacattgcggatgatcgctggtcttgaagagatttcccaaggcgaacttatcattggcgataaacgaatgaatgatgtcgctccaaaagaccgggacatcgcaatggttttccaaaactacgcattgtatccacatatgaacgtatacgataacatggcattcgggcttaaactgcgcaaatttaaaaaagaagaaattaaaacccgcgtccataatgcggcgaaaatccttggacttgaggaaatgcttgaccgaaaaccaaaagcaatgtccggcgggcaacgtcaacgtgttgctcttggacgggcgatcgtccgtgacccgcaagtgtttttaatggacgaaccactgtccaacttggacgcgaagcttcgtgtgcaaatgcgtgccgagattacaaaattgcataagcgcttacaaacgacgacgatttatgtaacccatgaccaaacagaagcgatgacgatggcgacacggattgtcattatgaaagatggctttatccaacaaatcggcacaccgaaagatgtgtacgacaatccggaaaatattttcgtcggcggttttatcggctctccatctatgaactttatttcaggccatttagatggaagcgatttcgttgttaaagagcagcgcatacgcgtcccagaagggaaaatgtctatcttacgggaacagggctttcaagataaagaactgattctcggcatacgccctgaagatattcatgatgagcccgtattcatttcttcatcgccagatacaaaaatcaatgcgttgatcgatgtagcagaattgactggtgctgaaatggtgctttactcatcgattgacggccaagaattcgtcgctcgtgttgattcacggac

SEQ ID NO: 5177 - DNA, 531 bp, Bacillus clausii
  misc_feature (1)...(531): n = A,T,C or G
ggtactgttcggtgcactagcctcttatttcctagcaagatttcaatttaaaggccagaaattactttactcttttttcattctaggcttactagtgcccattcacgccncgcttgtacccatgtttatcttaatgcaaaccattggcttgcttgatacgagattagcgcttatcttcccgtatattgcctttaacttgtctattacgatcttcttattaacgagctttatgaagtcgttctcaaaagagattgaagagtctgcgattatggacggagccggcgtgtttaagatcttttggtcgattattttgccaatgacacgccctgttctagctaccgttattattattaatttcattaacaattggaatgagtttagttttgcactcgtcctcattaatgatgatctattaagtacattgccactcggtcttgcgaattttgcaggacagcattcgacaaactatacagcacaaatggctgctttgncgattgtgctcgtccaancncttctcttctatttatttat

SEQ ID NO: 5178 - DNA, 464 bp, Bacillus clausii
attgctgctttgaaaaaagcggctccgtcgctagtcatcattgctcgcaccgatgcaaggggcgtggaaggacttcagtcagctattgaccgcgccaagctttatctcgatgccggcgcggatggcattttcccagaagcgttgcaaggcaaagaagagttccgtgcctttgccgaagcagtcgaagcgcctttgcttgcaaatatgacggagtttggcaaaacgccttattacaaagcagaggaatttgaacagatgggctttgcgatggtcatttatccggtcacatcgcttcgcgtagcggccaaagcatatgaacgtgtgtttaccgatattatggagaacggcacgcaaaaagcaagtttggctgacatgcaaaagcgcagcgagttatacgaagcgatttcatacgatgaatttgaagcgttggatgcgtctgtcgcaaaaacggtattaacaagcga

SEQ ID NO: 5179 - DNA, 570 bp, Bacillus clausii
  misc_feature (1)...(570): n = A,T,C or G
tcctcatggacttagtgaaagcgctttaatttatggggttgctattttgtaagttttcgaatgaaattcctngggagactttagatggaaaaggggtgagaattgtttgtctcttttgcgtacaggctggagatgggcgtgaaaaggagcatttgaaaatgctggctaagttagctggaaaactaggtaatgatgaagtggtaaacaacatattgaaagcggatacagtccatgagttaaagcaagcatttgcttaaatgaaaatgagaggagatgtcaggatgaatattgttggaattgcggcgtgtacggcaggaattgcacatacgtatattgctcgtgaaaaattagtttcagcagctgaaaaagcgggtcatcgcatccatattgaaacacaaggaaccattggtgtacaagatgagctcccacaggaattgattgatcaagcggacgtggccattattgctgctgatgtgaaggtgggtggcaaagatcgatttaagcatatacgaattattgaagttcctacagaagtggtgattaagtcgcctaataagtttattaaaaagg

SEQ ID NO: 5180 - DNA, 551 bp, Bacillus clausii
ggagatgctgttcagcttggcaaagcagtgcttgttgatgacctagctccatacattgagcgcaagttattcacagtcaacactgggcacgcggttgccgcttatgtcggctatcgtaaaggaaagaaaacgattaaagaggctttggctgatgattatattaaacaccgtgtccgcggtgctcttaatgagacgaaagcgatgcttgtagaggaataccagtttgatgccgaagcccatgaagattatatcgacaaaattcttctccgttttcaaaatcctcatcttgaagacttggttgaacgagttggccgcggccctatccgtaagcttggaccagcagatcgactcgttaaacctgcgaagtatttagccgaaaaagggcttcatcctgagtctttggcagaaacgattttcgatgcccttcacttttatgcggaaggggacccagaaagcgagcagctgcgagctcttgtcgatgaaaaagggtatgtggacgcgttctgtgaaatttctaaattagaaaaagatcacccgcttgttgaaatcgt

SEQ ID NO: 5181 - DNA, 633 bp, Bacillus clausii
acttgaaataccatattacggccgacacacgggcctattaaatgacccaaacgggcttgcccatttccaaggtcagtatcatgttttttatcagtggaatccctatggcaccgaacataaaaacaaaagctggggccatgtcgtttccgataacctagtgaactggcacaggaaagagatggcattggaaccttcggaatggtacgacaaggacggcatctattccggcgggagcattgttcatgaaggaaagctttatctcttctatacaggcaatgtcatcaacaaagatggaacacgggcaagttatcaatgcgctgctgtttctgaagacgggcaacagttccagaagctcggcccgttattcgagcatcctgttggttatacgaggcatgtccgcgatccgaaagtctggaaagacgattcaggcaactggtggctgatcgtaggggcccagcgagaagatcttacgggagatgcccttgtctataagtccgaggacttgatcagttggtcgtgccagggatcgtttctcgaacaggagcattctttcggatatatgtgggaatgtcctgatgtgctccagttccctgaacatgatgtctttgtcttttccccgaaaaggcttactag

SEQ ID NO: 5182 - DNA, 429 bp, Bacillus clausii
  misc_feature (1)...(429): n = A,T,C or G
gattctgcagtcttcattcggaatngtctgcttcatctatggtggcattaatcaatttatcgttgtgactggtctccatcatgccttaaacttgatcgaaattcaaatgctaagtgacactggctggaatatggtcaatgcgatcagctctggttcaattgctgcacaagcgggagccgcgctagctgttggcttgaaggcgaaaagcctcaaaacgaagtcaattgcttatccttcttctctgtctgcgctgctaggcattacggagccggctattttcggtgtgaacatccgttacggcaagccgtttctgatgggcttgattggtggcgccgtcgctggattctttgcccggatcctcgatgtccaggcaacaggcatgtcgattacagtcattccaggtatgctgntggacttaaaagcgcaaat

SEQ ID NO: 5183 - DNA, 219 bp, Bacillus clausii
cttcctttatcaaatcagtaaaagggccactaccgatggtgcggatgatgccgacagggggcgttgatttaaccaacttagcctcgtttataaaagcgggcgcagttgcagtcggtgcaggaggctctttgctcgacaaaaacatcatcgctgcccgcgattggccgcgtttgacggaactcgctaagcaatatgtcgattgtgcgcaaacggcaaggg

SEQ ID NO: 5184 - DNA, 288 bp, Bacillus clausii
ttggccagtggaatgcttggtttgatacgtatttgtacaatggcagcaatccagacttgacaacattgcagtatgacctgatgaaaatcttgcaaaatacgacgatgggcggttctggcgatgccaacgcttaccgcagcataagcggcgaacaagccgcacaaacggtctcgcctgagtcgattaaaatggcgatttccatggtgacggtcgtgccgattttattggtttacccatttttacagcgctttttcgtccaaggcatgacgctcggtgctgtaaaaagct

SEQ ID NO: 5185 - DNA, 735 bp, Bacillus clausii
acgagtgctgatctatctaatcttaatggtgtttgcgattgtcaatgcctatccgattatttggatgatccttaattcatttaaatcaggtcaggaatttgcgttaaacccatttggtttaccgacagaatgggtgtgggcgaattatgtggaggcttggtttacagccaatattaatacgtacttttttaatagcgtattcgttggcggggtggccgttatcctaacggtactgttcggtgcactagcctcttatttcctagcaagatttcaatttaaaggccagaaattactttactcttttttcattctaggcttactagtgcccattcacgccacgcttgtacccatgtttatcttaatgcaaaccattggcttgcttgatacgagattagcgcttatcttcccgtatattgcctttaacttgtctattacgatcttcttattaacgagctttatgaagtcgttctcaaaagagattgaagagtctgcgattatggacggagccggcgtgtttaagatcttttggtcgattattttgccaatgacacgccctgttctagctaccgttattattattaatttcattaacaattggaatgagtttagttttgcactcgtcctcattaatgatgatctattaagtacattgccactcggtcttgcgaattttgcaggacagcattcgacaaactatacagcacaaatggctgctttgacgattgtgctcgtccc

SEQ ID NO: 5186 - DNA, 392 bp, Bacillus clausii
gaaattttagacatacttgatcaatttaatgcgaaagcgactttttttatgctcgaacctgaaatgagaaaatctccagaaatcgtaaaacgaattataagggacggtcacagcgctggtctacatggtgttactcatgacaaagatcaattttatcaatccgaacaagcggcacttcaagagatggtaaaaactcaagaaacattgcatgatatttcgggggtgaaatcggacttaattcggacgccttatgggagtatcccttatttaacagatagcttcagagaggtattcgatcaacatggcttcaagttgtgggattggaatgtcgatagcgaagactggaatttatcaacagaggcttctttggatagtgtgatttcacaaataga

SEQ ID NO: 5187 - DNA, 819 bp, Bacillus clausii
aaaaaaaacgcggccggatccgcatctcacaaatcttgttgcacttagctttaatcattggctcgatcgttatggcaggcccgtttatttggatggcgcttagcagcttaaaatcgtttgaacaaatttttgccgttccgcctgtttggattcctgatccgtttgtatggagcaacttcaccgattccttgcaagcaatgccatttggacgtgcctattttaacagcttttatatttcaacgattgttgtcgtcagccaagtcttgacgtgttcaatggcagcctacgctttcgccaaattgaaatttccaggctctaaggtgctgttcatcgcctttttggcaacaatgatggtgcctatgcaagtaacgctcattccgctttacatcattatggataacatcggctgggtcaacacacatctgtcaatcatcgttccgaatgcgctatttaatgcgtttggcgtgttcttgttaaggcaatttatgatggggattccaaaagaaatggaagaggcggctgtgatggacggcgccaacccattgtatatttatgcgaaaatcatgctgccactcattaaaccggcactagcagcattcgcgattttttcatttatcggcatctggaataactttatccagccgctcgtgtttttaagtgatacgacattgtttactgttccgttgctattagcaacatttaaaggactttatgtcactaactggccgttaatgatggcgggtgcaacgatttccgtcgtccctgtgctgattgtttacttttttgctcaacggcaaattattgacgggtttatccttt

SEQ ID NO: 5188 - DNA, 849 bp, Bacillus clausii
aggtttgctgtttgcgatccatttcttgcgttgctcggaacagagcctctttttaaagcttccaagaaaacaagagattccgaatatcgctaccctgaaagtgtcccacctgccagtatctaggtcatttgaagcgttgattccagcctttgttacactggtcgttcctttggaacattggtgtttctcctacaatccaatgtttggcttaggactgcaagaaatcgtaacagaggttatccaggtgcctcttaaggccattttccaaggtttagtcggcattaacgttgtgatgacctttcaaaatctactgtggggaatgggtatccacgggacgttcgttcttgggccgataacagaaccgacgttgctcacagcgattcaggaaaatatcaatgcctttcaaactaatatagaaattcctaatattgttacaaaaccatttattgatagtttcgccatgcttggaggcggcggatgtacgatcggattgatcattgccattttcattgcctcaaaacgagcagaatatcgagaggttgctaaattttcgctggcaccaggtttgtttaatattaatgaaccattaatgtttggactgccagttatactaaaccctattttagcgatcccccttatccttgtgccattggttaatttaaatattgcttacatggctacttcgttagggttcatatcaaaaaccgttgtcatggttccttggacaacacctcctgtactatctgcttttttatcaacggcaggtgactggagggctgcgcttttagcggtgctgttaattggtatttccgtattcatttaccttccttttgttatcgcagcgaataa

SEQ ID NO: 5189 - DNA, 513 bp, Bacillus clausii
  misc_feature (1)...(513): n = A,T,C or G
taacggtgcctgtcgtgctccatcttgaccacggtttaagtattgagcgttgcaagaaagcagttgacgctggcttcagttctgtcatgtttgacggctctcaatatccaattaacgagaatattgacatgacgaaagaggtagtggcttacgcccacgcacgtcatgtgtcggtagagggagaggtcggtacagtcggtggcatggaagatgggctaattgccggaatcaaatatgccgatgtggaagaatgccagcggtttgtctgcgaaaccaatgtcgatgctctcgccgccgcgctcggctccgtccatggcaaatacaaggggtgagccaaagcttggatttaacgaaatggctgccatttccgcccgcacgggatgtgccgctcgtccttcacggtgcctngggcatacctgatgaacaactacaacgggccataaagcttggccacgctaaaggtcaatataaacacagaatgcatgatcgcatggtctgatgcttgccggacaa

SEQ ID NO: 5190 - DNA, 435 bp, Bacillus clausii
aatacagccattatttctttgatttagacgggacattgctccatgggggcatgttgttgccaggggcaaaagagctagtcgatgctttatgcgccaacggcaagcatgtttattttttaacgaaccatcctgttcgctctaggaaagtactaagtgctgatttgcaaaagttagggctggagattacgtataaccagttgcttacccccgttatgggcttaatcgaatacgtgcactcaaatggcttggcaagcaggaaactctatgtggccggttcgaacatgattagagaagagctctctgaactaggtttgcatataggtgaccgtgaaaagggcaacgggccggagcaaatagctgtagtgcttggcatgtcgcctgatttgacgtaccgccaattgcaagaagcactttggctcattcaaaacggggccg

SEQ ID NO: 5191 - DNA, 276 bp, Bacillus clausii
aagaaaaatcggtgactccatacagcaattcggcagaacgttgcttctcccgattggggtattagctccaatcgggatgcttttggggatcagcggagcgcttacacaagactatatggtagataaagttcctttcctcggcaacgaggccgtcaataccatcttggtaagtataaaaacaatcagtaatgttgttttcgataatatccctttattgtttgcgatgggcgtcgcctatggaatggggaaaaaggataaaggtatttctgtgtttgc

SEQ ID NO: 5192 - DNA, 672 bp, Bacillus clausii
  misc_feature (1)...(672): n = A,T,C or G
ttccacaatcgaagttcgctttcacagacatcaatcaggaaaatttgcaaatggtgacacagttatgccaacgtgatattaatgaaaacggccttcctattcaaatccacgccacccttgaccgtagagaagcgttaacaggggcgcgttacatttttaacgttgtccgcgttggtggacttgaagcatttgagcaagacatcgatattccgctccgttacggcatcgaccaatgtgtgggcgataccctttcagcaggagggattatgtacggccaacgaggcatccatgaaatgctcgccatttgcgaagacatccgtgacgttgctgaacaagactgcctcctattaaattacgccaatccaatggcgatgcttacatgggcgtgcaaccacttcggcggcgtcaacacggttgggctatgccacgggcgttcaaggcggccatcgtcaaattgcccgacgtgtttgggcttcagccagaagaagtcgacattgtctgcgccggtatcaatcaccaaacatggtacattcaaatcaaacatgacggcgaagatttaacgggcaagttgctcgaagcgtttgaaaaccaccctgaatacagcaaaacagannaaagtacgcatcgatatgctcaagccgttttgggctattacaggacaagaatcgaacg

SEQ ID NO: 5193 - DNA, 330 bp, Bacillus clausii
tcattcacgaaaattttatgctgcaaaataaaacagcagaaacactttaccatacgtatgcaaaaacgttgccgattatagactaccattgccatgtccctccacaagaaattgccgaaaaccgccaatttaacaacattagcgaaatttggcttcatggcgaccattacaaatggcgggcaatgcgtgctgtcggtgtcgaagaaacgtttattacaggcgatggggatgacaaagagaagtttcttaaatgggcggaaacggtcccttatacaatgggcaatcctctctaccactggacgcacttagaattgaaacgttattttggca

SEQ ID NO: 5194 - DNA, 633 bp, Bacillus clausii
atgggtattaactcgccgttcccattggcattttcgcgtaaaaatgaaaaggggggttttgcaatgagacagaaagcggcgatagttgtttgtatttcgatgatggcattgtttgttctcagtgcttgtggcaattcaaatgaagacgcaggaacggaaagcgagggggaaagccatcaaggagacattgtattagagctttggcaaaatgacgcgagcgaaaaagaaaaagtatatcaagatgcgattgctcgttttgaagataaaaacccaggtgtaacggtgaacatgcaatatattccgaatgatgattataaacagcgcatggttgttgccatgtcaggaggagaccctccagatgtctttttttcctggggtggcagctggcttaaagagtttgctgatgccgggcaagttgtgtcactaaatgactacgatatcgactttgataaatttcttgatgttgcgctaacgaatacaacatttgaagacgatgtttacgggcttccgttagggcttactcaaacactgttcttttataacaaagaaatttttaatgaatacgggctagaggagccgcaaacatatgacgagtttcttgaaattgtggacacgttaaaagagaacgatatt

SEQ ID NO: 5195 - DNA, 266 bp, Bacillus clausii
atgggaaaacagcggttgttcagtagtttgctggcgtttatgttcatcttggcgattgccactcctgcacaagcaggtgacatccagcaaaacaaggcgtttcacaaacaaggactaaaaagcggtgcaccgacgtttacggaagcgtctgtccatgacccttccgtcattaaagcagacgggatgtattatgtgtttggttctcatttggcttcagcgaaaacaagtgatttactgaactggcagcaagtctccactcatgtcca

SEQ ID NO: 5196 - DNA, 956 bp, Bacillus clausii
ggtcatatgagagccgaatattacgctgacctttatcgtcgttatcaaacgtatgttaggaattacggcaacaacaagctttataaaattgccggtggagccaatgttgacgattaccactggacggaagtgttaatgcgggaagcgagccagttaatggacgggttaagcttgcattactatacggtgccaggtgataactggaatgaaaaaggcgcagccttagataagcatgagtcgcaatggtttaaaacattgaaaaaagcctttcgtatggatgatttgctgaagaggcactcagcaatcatggatcaatacgatccagcgaaacgcgtaggcttaatcgtagatgaatggggaacgtggtttgacgtggaaccagggacgaatccaggctttttataccagcaaaacacgattcgtgacgcgttggtggcgggcgtccatttccatatcttccacgagcataacgaccgcgtccacatggcgaatatcgcgcaaatggtcaatgtgctccaagcgatgattttaaccgaaggagagcgaatggtgcgcacgccaacttaccatgtgtttaatatgtataaagtccatcaagatgcgacgaggctagaagtcaaagcagatgccggcttgtatcgcttcgatgatcaagagctgccagcaatgacggctaccgcttcaaaagatagcaacggagccattcatattagtatttgccatcttgatccaaaccatgctgcatcactagcgctcaaacttgaaggaatagagaggccattgtctgctgctaacgtttctggtgaactgctaacagcaaatgagttaaatgcgcataacacatttgaacaaccgaataaagtcgaacctgtggcgtatcagccgacttctatcagtggacaggaattgaagttagatgttcccccttcttccgttttgcgagtaacaatcaggcc

SEQ ID NO: 5197 - DNA, 531 bp, Bacillus clausii
caatatcgcgatcacgaaggaagtcgtcaaacttgcacataacgtaaatgtttccatagaagctgagttagggacaattggatcaaatgaaggaagctctgaaggcggggctgacgaaatattgtatacagacgctaacgacgcaaaaacatttgttgaagatacagggatcgatacgttggcgattgcgattggtacttctcatggtcaatataagcacgcaggcaaaccagagttaaagctagacttgctcgctgaaatcaacgaaaaagtaggaattcctcttgtccttcatggaggaagtgacaataaagatgaggagatttcgcaaacgtatcttcatggcgtagcaaaaatcaatttatcgacagacatgaaaagtgctttctttgaagaaatgcggcgtttcttaacggctaaccaaagtgcttatgagccagacgtgattatgccaagtgcgcggaaagcagctcaacaagttgtaaaacaaaaaatggatttatttaattcgacaaataaggcacacctcta

SEQ ID NO: 5198 - DNA, 558 bp, Bacillus clausii
  misc_feature (1)...(558): n = A,T,C or G
atgagaatgtttgtatattgcctcataaagggaggggaaacgatgaagctcaacggccgtttaacgccaactttttttattggcccgcatttaatcttctttctcgttttctttcttttgccgtcgataacaggtatttatgcttcttttacacaatggaatttaatcaacgatcctgtatgggtaggaggaagcaactatagaacgattctgtttgatacaaattcaacctttcatcaccaatttatcaatggattaaaaaacacgctgctgtttgttgccttaagtgtcccgctgctcatcgtaatccctttgttaatcgctgtctctttagaacataaaaaagtgaaaatgaaaaatctcatccaggcaattatttatgtcccggggctgatctcgatttcggcagcggcgctaatatgggggcttattttcaataaccagctaggcgtagcaaacaatctatttggtgttgatgtcgcatgggcagcgacacaaccttacgcttggatcatcattattatcattacattgtggggagggttggcngcaatttaa

SEQ ID NO: 5199 - DNA, 444 bp, Bacillus clausii
  misc_feature (1)...(444): n = A,T,C or G
gcntgcgccaaacaatcggtgacactatcggaattgncggcttgttccggtcattgcgtaccatcccagttttgcttgatattgcccaagacattgaagaagtggcgccaaacgcttggtttttaaactattcgaacccaatggctgtcttaactggcacgctttcacgctacacaaacgtgcaaaatgttggcctttgccatagcgttcaagtgtgtacacgtgacttatttaaacatcttgggatggaccatacagggattgaggaaaaaattgctggcattaaccatgttgcttggctccttgaagtgaaaaaagacggccaagacttatatcctgaaatcaaacggcgcgccaaagagaaaaacaaagaaaaacaccacgatatggtacgttttcagctaatggaacggtttggctactatgtgaccgagtcttccgagc

SEQ ID NO: 5200 - DNA, 921 bp, Bacillus clausii
caaattgcccgacgtgtttgggcttcagccagaagaagtcgacattgtctgcgccggtatcaatcaccaaacatggtacattcaaatcaaacatgacggcgaagatttaacgggcaagttgctcgaagcgtttgaaaaccaccctgaatacagcaaaacagaaaaagtacgcatcgatatgctcaagcgttttggctattacaggacagaatcgaacggccatttaagcgaatatgtaccttggtaccgaaaacggcaagaggaaattggcgattggattgacctcggcacgtggattaacggcgaaaccggtggctatttgcgcgtttgcaaagaagggcgcaactggtttaaagaagactttcctaattggatgaacgagccggctttcgtttttgctgaaagcgagcgcggccaagaacatggttcttatattgttgaagcgttagaaacagggcgtatctacagagggcattttaatgtggtcaaccaaaacgtcatctccaatttgccctctgattgcattattgaagcccctggctacgtcgatagaaacggcatcaatatgcccgtcataggtgacttgcccattggctgcgccgccgtttgcaacgtgagcattaatgtccaacgccttgcggtagaagcagccgtagctggagatgaccagctcttgcggcaagcgtttatgatggacccactcactggggccgtatgcaccccacctgaaatttggcagcttgtcgacgacatgctcattgcccaagaaaaatggctgccccaatataaaacaagcattgccgaagccaaacaaaggcaacaaacgcagcaacggctagcgacaaaggacacgagcggcgcagcccgcctgaaaacgaagactgttgccgaaatgaaagaaaatcgagcggaagcaatgaa

SEQ ID NO: 5201 - DNA, 521 bp, Bacillus clausii
atgaaacaaatgccatttaaagttgcctttattggcgcaggcagcatcggctttacccgcatgttattgcgggatttgctgtctgtttctgccttttccacaatcgaagtcgctttcacagacatcaatcaggaaaatttgcaaatggtgacacagttatgccaacgtgatattaatgaaaacggccttcctattcaaatccacgccacccttgaccgtagagaagcgttaacaggggcgcgttacatttttaacgttgtccgcgttggtggacttgaagcatttgagcaagacatcgatattccgctccgttacggcatcgaccaatgtgtgggcgataccctttcagcaggagggattatgtacggccaacgaggcatccatgaaatgctcgccatttgcgaagacatccgtgacgttgctgaacaagactgcctcctattaaattacgccaatccaatggcgatgcttacatgggcgtgcaaccacttcggcggcgtcaacacggttgggctatgcca

SEQ ID NO: 5202 - DNA, 540 bp, Bacillus clausii
  misc_feature (1)...(540): n = A,T,C or G
gtttaatggcgatgcnattcatcttttttcgatgttccttggaattgtgctaacagctgttttgatcgcgattcaaattaaggggagaaagaaacagcttcatcatgatttgccggttgctagtcctgcttggtttgctgtgaaattagtagccattgcagcggttattttagtgtttacctatgtattagccagttaccgcggcattccaaacattcttatcttgcttgtcgccttgattgccttttacgccttcgtcacgaaaagaacggtgtttggccgccacatctatgccgttggagggaatgaaaaagccgccgcgttgtctgggattaaaacaaaacgcgtgacgtttgctgtgtttgtcaacatgggtatacttgcagcgctgtcaggcctcatttttgccgctaggctaaatgctgccaccccacgggcagggaatttattcgaactcgatgcgatagcggctgcctttattggtggtgcttctgcctatggcggcgtcgggacgatcattggcgctgttgtcggcggcct

SEQ ID NO: 5203 - DNA, 333 bp, Bacillus clausii
agaagcattgaatttaatctcaatgcaaatgattttgcatgcaggcgatgcccgtaatgatgtgatggaagcattaaaatgttgcgaagaagaagagtatgaccgcgctgagaagctattagaaaaagccaataaagatatcgtagcaactcataagctgcaaacagaaaccgtccaaaaggaagcacgtggagaggaatcgattttttcgctattgtttgctcatgcccaagacacactcatgaccgtgaaaagcgaatatgaactagccaaacggttgattcgggtctttagaagattggatgaaaaaatagacggaaagagaggtcaatc

SEQ ID NO: 5204 - DNA, 339 bp, Bacillus clausii
tggtcgggcgacgatcatcccatcggtcttcaatattaatgaaccgttgatgtttggcgcgccaattgtctttaacccatttttaatgattccgatgtggcttaccgcgattgtgatcccaagtatcacatactgggtactgcatttaggctgggtaagcattccgacgaagacatttttactttggtatatgccaatgccgatttcttcctatttagcaactcaagattggcgggctattattttagctattgtattatttgtcgtcgcatttatcatcttcttcccattttttaaagggtacgatgttcaagagaaaaagaaagaatcagagttaaa

SEQ ID NO: 5205 - DNA, 513 bp, Bacillus clausii
gcggccaagaacatggttcttatattgttgaagcgttagaaacagggcgtatctacagagggcattttaatgtggtcaaccaaaacgtcatctccaatttgccctctgattgcattattgaagcccctggctacgtcgatagaaacggcatcaatatgcccgtcataggtgacttgcccattggctgcgccgccgtttgcaacgtgagcattaatgtccaacgccttgcggtagaagcagccgtagctggagatgaccagctcttgcggcaagcgtttatgatggacccactcactggggccgtatgcaccccacctgaaatttggcagcttgtcgacgacatgctcattgcccaagaaaaatggctgccccaatataaaacaagcattgccgaagccaaacaaaggcaacaaacgcagcaacggctagcgacaaaggacacgagcggcgcagcccgcctgaaaacgaagactgttgccgaaatgaaagaaaatcgagcggaagcaatgaaaa

SEQ ID NO: 5206 - DNA, 678 bp, Bacillus clausii
aaggcttggaaatcggcaaagagcttggcgctgaaaattatgtattctggggtggccgcgaaggctatgagtcattattaaatacggacttaaagcttgaaatggacaatctcggacgctttttccatatggcagttgattatgcaaaagaaattggctttgatggccagtttttaattgagcctaagccaaaagaaccgacaacacaccaatatgattttgacgtggctacaggatatgcctttctccagcattatgggctccaagattcatttaaatttaatattgaagcaaaccatgcaacccttgcagggcatacgtttgagcatgagctgcgttatgcccgtattcatcatatgcttggttcagtggatgcaaaccaaggagaccctttgcttggctgggatacagatgagtttccgacagacctttattcgacaacgctagcgatgtacgaaattttgcaaaacggcgggcttggcagaggcggcttgaactttgacgcgaaagtacggcgtggttcatttgaagctgatgacttgtttttcgcccacatcgcaggcatggacagttttgcaatcggcttgaaagttgcgcagcagcttatagatgaccgcgttcttgagcaatttgtcgacagccgttatcaaagttataaggaaggaatcggccgccaga

SEQ ID NO: 5207 - DNA, 720 bp, Bacillus clausii
ttattatttgtatttgacttttggcgggcttgatgcgacgggcggttataatatgcgtgtagcacgagcaaaacagccgacggggccttatgtcgatgcagaagggcgttttatgagcggcgcgaaaggggcgccaggcacattttttgatgacgcttcgattgaaccattcggcgtcaaacaaatgggcaattttttgtttaaacgtgagccaggtgaaactggttcaagtttaggaacaggctacgtttcccctggacacaattctgtttactacgatgaagaaaaagaaaagatctttctctttttccatacacgtttccctgaacggggagaactacacgaaattcgtgtacaccaaatggttatgaatgagaaaggttggccggtcatagctccttaccgttatacaggggaatcgttggctaaagtagaagacgaagacgtagtcggtgactacaagttcattaaccatggcaaggagatcacggctgacatcaaggagtccacaatgatccgtttagaggcaaacaagcaactttcaggtgctgtgacaggaacgtgggaaaaaacaggcgattacaatgtagagttgcaaatcaatggcgccacctataacggcgttttcatccaccaatggaatccagtgtccaatagggaaacgctaacctttacggccttatctgatgaaggtatcgcgatttggggcagtcaaatcga

SEQ ID NO: 5208 - DNA, 456 bp, Bacillus clausii
ttctatctttctatgaccagctcatggagccggagaacgcaaacttaatttactggggcatcgaagacgagcactacactattgaagacggcaaagccgttgcgattgaagatacgcaacggacggagcgcgaagtcaaaccgtaccaatcgattgaaatcggcgaagctgaaacaaatggccgctacttagggcaaagccattatccagtcaaattaaaggccgatgaactcgaaattgataacgagtcttatttggttcacgacccgacaacgacgcttcattcgccaacggcgcaaacacatggcgaacgtttgcagcaaattattaacgatgcaacgtaccagtatatccttggacaaaccgacctcgctggctttgagcaagcagttgaaacgtggagaagccaaggcggcgatgacatgatcagcgagtacaacgagtcatacaaccagc

SEQ ID NO: 5209 - DNA, 915 bp, Bacillus clausii
aagcagaaaggcgccaggaactatggcgcaaaatcaaaaagaacaaatggatttacttaatgattgcaccgggtcttctctatttttttgtctataaatatattcccatgtatggattaatcattgcgtttcaagattataaaccgtatctcggcatcactggaagcgagtgggtcggattggaccatttccgccggctgtttgccgatcccgacttttggatgatctttaaaaatacgctcgttctctttgcgttgcaagtgtgtatttcgtttccagtgccaattatactggcgctcatgctcaatgaattgcggagccgcgcgtaccaacgcagcattcagacgatgatttacattccccattttatgtcgtgggtcgtcatcgtttcaatcagctatgtcatgctgacgcttgatggcgggattgtgaacaacattttgcgagcgctccagtttgaccaaatcaatttcttgctcaaccctgaatggtttcggccaatgtacattttgcaaattatttggcgcgaggctggctggggcacaatcattttcttagcagcaattgccgcagtcgatccccagttatacgaggcggcaaaaatggatggcgccaaccgtttccggcaaatgtggcatattacgctgccagcgatccgcagtgtcatcatcgtcttgcttattttgaaaatcggcgatgtgcttgaattaggatttgaacatgtctatttgctattaaatgcgtccaaccgcgaagtggcggaaattttcgacacttatgtttatacagccggattgaggcaaggccaatttagctacagtaccgccgttggcttttttaaaggggttgttggcttaattcttgtcgtgatggccaactggctggcgaagagatacggagaagaaggaatttact

SEQ ID NO: 5210 - DNA, 307 bp, Bacillus clausii
atggttggcgataaatcgttatcaagccgcatttttaatgcgaccaatatcattattctaggcatcattgccttgctttgcattttgccgtttatccatgtcatcggcagctcgtttgcgacaggcgctgaaattgcccaacgcagctttttgctgttcccgacacaatttagtttagacgcctatcgctatattttttcaacagacacgcttctgcgctccatgggcgtttccatcggcgtcacgttaggcggtacgttgtggagcatgctgttgtccgttttaaccgcctatggcttgtcgcgga

SEQ ID NO: 5211 - DNA, 533 bp, Bacillus clausii
tggatcaacaattgcaaatgctaaaagcgctaactgatgcaaacggggtttccggttttgaaaaagaagcacgggacgtcatgaagtcatatattgctccttttgccgattctgtggaaacggaccatttgggcagtttgattgcaaaaaaaacgggcaatgcagatggtccgaaaattatggtcgctggccacttagatgaaattgggtttatggtgaaaagcattgatgaaaaaggatttttgcgtttccaaaccatcggcggctggtggggccaagttttgctagcaagccgtgtaacagtcatcacagacaacgggccgattcctggcgttatcggttctaaaccgccccatgtgctgtcgccagaagcacggaaaaaaccagtcgagattgacgacatgtttattgacatcggcgccacatcaaaagaggaagcacaagagtttggcatcaagcctggaaacccaattgcgcctgtgtgcgaatttacagtgatgaaaaatgagaaattgttgatggcaaaagcatgg

SEQ ID NO: 5212 - DNA, 951 bp, Bacillus clausii
catgaacattaccttaaaagggattgagaaagcatatggatcattccaagctgtaaaaccgcttgatttaacaatcgaggacaggtttgtgacaattcttgggcaatcagggtgcggaaaaacaactttgcttaaaatgcttgctggcctgaccgagccaacggcgggagagttgtttttcgatgaccaccttattttctcgaaagcaaggaagacgaatgtcaaaccgaataaacgaggcattgccatggtatttcaagactttggtttgtggccccatatgactgtgtacgacaacatcgccttcggtttacgcaacatacgttcaaagaaagataggcgcgatgcagtgaacgaagcgttaataaaagtaaggctcgaagataaagcgactaaaaagccaggcgaactatccggagggcaacagcaacgtgttgcgttggcaagggcgattgcggtaaatccaaagctgattttatttgatgaagcgctcagtgcccttgatgcgatcttgcgtgagcagatgcgggaagagattttggcgattgtccaaaaaattggcgcgcaagcgatttttgtgacacatgaccaaacagaggcaatggccatgtcagacatgatgatcgtgatggaagcaggaaatgtagttcaaacagggcgacctgaacacatttatcgatctcccgcacacgcttatgtcgctgattttatcggcaaagcgaattggatgaaaagccaagaggggatgattagacctgagcgcatttctttgcagccaaaagagcatgcacgcgctcaaacagggcacgtccgcaaaagcttatttacaggagaccgctatttgattgtggctgaagttaatggccagcattggcaattctatgatcaaaatcctcatgaaacgggttcctctattacgttgtacgtacaagaaagcgacattcattattt

SEQ ID NO: 5213 - DNA, 387 bp, Bacillus clausii
gctgtctccccctggcaatatggcagtgacaaagcaagcaatcaagcttgccaaagaaaatggcgtaaaagttgcttttgacccgaatatccgcctgcgcctttggagcaaagaggaagcgcgacttgctctgtacccgcttttgcaagaagtcgacattctcctcacaggcgatgaagagatggagattattctcggaacaagcaatccagctgagattatcgccgaaacgacgaagcttgggatagacttagtagcaatcaaacgaggagagcatggctcggtcggcagttatcaaggtaaagtcgtcgaggcagcaccggtgccagcggcaaaagtcgtcgacacagttggcgctggagacggctttgatgctggactgttgta

SEQ ID NO: 5214 - DNA, 171 bp, Bacillus clausii
  misc_feature (1)...(171): n = A,T,C or G
acaangtntttngggttgcatggtggggcgggcaggagcgccatacaangactctggacgtgatcgatctgtnngaanaaaaatatcctgatataacggttgagccagannacacgacctgggacaactatnggnaacggctaacnacacaagccgcaggaagcaacttgt

SEQ ID NO: 5215 - DNA, 453 bp, Bacillus clausii
  misc_feature (1)...(453): n = A,T,C or G
aacgacgatttattacattccctccatcattgncggnagtgttgcgatcgccgntgtgtggcgccagctatttggccgcgaaggcgcaattaatacgttatttgcctctgttggccttnatggcatcaattggctcggcgatccgtcatacgcgctatcgattttaattgtgcttgtcgtttggcaatttggttagccgctcattatctttttggcagggctaaggcaaattccccaggagctctatgnagcagcaagcgttgatggtgcgtctacattgactcgtttctttcgaatcacgttgccgatgtnnacgcctgtcattttctttaatttaatcatgcaaacaattggagcgtttatgacattncgancancgtttttnntaacaaatggtgggccaatggatgcgcctcgtttttacgcggtctatttatatggcacggcatttga

SEQ ID NO: 5216 - DNA, 666 bp, Bacillus clausii
atgggctatgacgccgaacactcggatccattgtacaaacatatccctttttacatcacacaccaacctgaatcagccttttcttacggcttgttttatgacaatttggctcctggctattttgaccttggcaaggaactggataactaccatgggctataccgctattttgaggctgaagcaggtgacctagattattacatgattgccggtcctacgatgaaggatgtcgtacaaacctatacatggatgacagggaacacagcgctcccgcctaagtggagcattggctattctggttcaaccatgacttatacagacgctgaaaatgcccaagaacggctatatgagtttatcgaaaaatgcgaggaaaacgatattttatgcgattcatttcaactatcctctggctatacatcgattggcgataaacggtacgtctttcactggaacaaagacaaattccctgatgtccaaaagcttgcccgtgactttagcgacaaggggctacggcttgcagccaatattaagcctgctttgcttaaggaccatccacagtatagcgacttggaacaacaatcgttttttattaaaaacggcaacggcgaaacagaaacggcttcaattttgggatggcggcggagcttatatcgattttacaaatga

SEQ ID NO: 5217 - DNA, 630 bp, Bacillus clausii
tgtaacgattgacgctatgggctatgacgccgaacactcggatccattgtacaaacatatccctttttacatcacacaccaacctgaatcagccttttcttacggcttgttttatgacaatttggctcctggctattttgaccttggcaaggaactggataactaccatgggctataccgctattttgaggctgaagcaggtgacctagattattacatgattgccggtcctacgatgaaggatgtcgtacaaacctatacatggatgacagggaacacagcgctcccgcctaagtggagcattggctattctggttcaaccatgacttatacagacgctgaaaatgcccaagaacggctatatgagtttatcgaaaaatgcgaggaaaacgatattttatgcgattcatttcaactatcctctggctatacatcgattggcgataaacggtacgtctttcactggaacaaagacaaattccctgatgtccaaaagcttgcccgtgactttagcgacaaggggctacggcttgcagccaatattaagcctgctttgcttaaggaccatccacagtatagcgacttggaacaacaatcgttttttattaaaaacggcaacggcgaaacaga

SEQ ID NO: 5218 - DNA, 684 bp, Bacillus clausii
catgaaacgttttatgaaacatctctatgataaccgggtatggcttgtaatggtcctccctggaacgatttggtttttgttgctcgcttatttgccgatggccggcaatatattggcctttaaagattttcgctaccacccagacggatttatcgaaagcattcgtacaagcgaatgggtcgggtgggagaatttccagtttcttttctcaacaagcgacgcctggattattacgagaaatacagtattgtacaatgctgtatttatagtggttggccttatcttagctgtggcgttagcgattttactcagccaacttgtcaaccggaagctcgccaagatctaccagacaggcatgttgtttcctcatttcttatcctgggtagtcgtcagttactttgtgtttacgtttttaagcatggatcggggattagcaaacaccattttaggcttttttaatattcctccgatatcttggtacaatgagcccgcttattggccatttgtattaacgttcatcaatttttggaaaggtgttgggtttgctagcattgtttacttagctgccattgctggaatcaaccgcgattattatgaagcagcgatgattgatggggcaaacaaatggcaacaaattaaacatgtgacgctgccagcgcttatgccactcattgtcatattgac

SEQ ID NO: 5219 - DNA, 1060 bp, Bacillus clausii
atgacaacaaaaatcacaggcttacgaaaagcatttgacgcatttgaagcattgcgctcgatcgatttgtcgattgaagctggcgaatttgtggcagtacttggcccgtcaggctgcggcaaaacaacactccttcggttaatcgctggttttgaacggccaacagatggggagatttacatggacggagtttgcgttagcacaaaaaaacatgtcgtcccacctgaacgccggaacatcggcatggtcttccaatcttttgcgttgtggcctcatttgagtgtacaggagcaggtagaattcccattgcgccatcatccccatacgcctgctgacctgaaaaagtactataaagaacgggctcttgacgttttaaagcttgtagggcttggccatttaggaaaacgaatgccaaatgagctgtctggcggacaaaaacaacgggtagcgctcgcccgggcaatggcccaccagccatctcttctgcttatggacgaaccactaagcagtttggacgccgagctgcgggaagagatgcgccgcgaaattcagaatgtgcaccggcatacaaacagttccgtcgtttatgtcacacatgaccaaggggaagcattggcgatggcagacagaattgtcattatgaaagaaggagaaattgaacaaatagggacgccagaagacattttcctttatcctaaaaccacgtatgtcgcgacatttgtcggcaaagcgacaattctatctggaaagtggaatggcaacgattttcatcctgacgttgaccctacattacgttgggatggaacagacattgctgctgcgtttaaacaacagcaaacgtatccagttcgccctgcccaatggcgactcaacgatcagcaacgagggattaaagcaacaatagcgaatgtgctttatcaaggaagggaaatccaatatgctgttcaattaggggaggaaacggtaacggtttacggctcactaaatgagcgttatcggataggcgatacagtctgtttgcaaaaggaagaagcaccagtaccacgcaaagcccaaatcg

SEQ ID NO: 5220 - DNA, 881 bp, Bacillus clausii
gcagaagtatacttaaaaggattgcaagccaaatttgatgaagttgactcggtaagctggcgactgtgcacggccgttactatgcaatggatcgcgacaaacgttgggatcgagttgaaaagtcataccgtgcaatggtttatggcgagggccctgcctataagaacgggctagagctgctagaagacagctacaaaaacaacattgttgacgagtttgtcattccgtctgttatcacagaagagaatggtacacctgtagcaactgtcaaagacgatgacgccgtcattttctgcaattttcgccctgaccgtgctatccagctatcacaagttttcacgaatgaagactttcgtgggttcgaccgaggggaaaagatgccgaaacgcctccattttgtctgcttaacgaagtttagtgaaacagtgaaaggctttgttgcctttaagccgactaacttggacaatacgcttggcgaagtcctttcccagcaaagctacacacagctacggattgcggaaaccgaaaaatacccacatgtgacgttctttttcagtggcgggcgtgaagaagagtttccaggcgaagagcggattttgatcgactcgcctaaagtcgctacttacgaccttaaaccggaaatgagcgcttatgaagtaaccgatgcgctcgtcaaggaaatcgaaggcgaaaaacatgatgtggttatcttaaactttgccaaccctgacatggttgggcattctggaatgttggagccaacagtaaaagcgattgaagccgttgacgaatgcttaggccgtgtggtcgatgcattgcttcaaaaaggcggagcggcgattattacagctgaccacggcaatgccgacgaagtcgtgaca

SEQ ID NO: 5221 - DNA, 720 bp, Bacillus clausii
  misc_feature (1)...(720): n = A,T,C or G
tagtagcaatcgcaggatgcggtgccgaaaatgaaagcgcttcctctgaaggagaaaagccttctgctgaagaaggcccgtttaaatttacaattatggctaatttgcatacagcagaagtgccagaaaaagaagtccaacatttattggaagaggcgacaaacacagagctcgacattcaatgggtgccagacagcaattatgaagaacggttaaataccgcgtttgcgacagggacgttgccccaagctgtttatatgaaaaaccaaacaacctatgaccagtttaaagatgcgatccgcgatggacaattttgggaaattggcccttatttagatgaatacgagaacttgaaaaaactaaagccggaagtcgtggaaaatacaatggttgatggaaaagtatatgcgctctaccaaggcccgtccgttagcgccgtttcaggcattcatctattcgcaaaggacctgggcttgacaacccttgggcttagaggccgccaaccaaccgattggaaagagtttccgcagaaatggcgcgcgcttttacagaagacgaccctgatggaaacggccgcgacgacacgattggcttaacagaccggaacgacctcgtttatggggcctttaaaacagtcgcgtcgtggcatgggacgcccaaatgggatggggccgaaaaaagacngcgagcttttgccagaatttatggttgatgagtatt

SEQ ID NO: 5222 - DNA, 351 bp, Bacillus clausii
gattgcgatcgccacaacgttttggaagcataaatttacgaagcaacaacgagagtcagggcggacaaactatgtccttggcgcttctttcattacagaaggggcgattccgtttgcggcggcagacccaatccgtgttatctcggcaagcgttgtcggcgccgctgtggctggcggtttaaccggattgttccatatacagctccctgcgccacatggaggcatttttacaatgttcctagtcaatgagagcacatggtcttacatcggcctatatgcgttggccatcgtgattggcgcgattgtgactggaatcatatatggaatcattaaaaagccaattgaaaacaa

SEQ ID NO: 5223 - DNA, 1701 bp, Bacillus clausii
cgattccacatgctaaaacggcagctgtcaaaacgccagcgattgcgtttggtcgctcgaaagcaggtattgattacgaggcattggacggacagccaagccatctgtttttcatgattgctgcctccgaaggggccaacaatgagcatttagcaacgttagcaaagctgtcgacttatttaatggacgacgattttcgaaaaggcttgctcaacgcagcttcattggatgacattctggcattgattgatgaaaagcaagcactggaagacaaagaagcggagccagaggaacaaaccgaaagcgcttccgaagattctggcaaattcattctcgctgtgactggctgtccaactgggattgcccatacgtttatggctgccgatgcgatcaagaaagaagcgactgaccgcggctataaagtaaaggttgagacaaacgggtctggaggcgtgaaaaaccggttaacagcaacggaaattgacgaagctgacggcattattgttgccgctgatacgaaggtagaaatggaccgttttagcggcaaacgcgtggtcattgctccagtagcagatggcgtccgcaagccagcagagttaattgatcgttccctttcaggaaaagaacctgtttaccaaggcagtggcggcaaaggcgaaaacgagcaaagtgaagagaagaaatcaggcggcgctgctatttataagcatttaatgaatggcgtttccaatatgctcccatttgtcatcggcggcggaatattgattgccttaagctttgtatttgagacagctttcggcgaagataacccgatccgcgaattgttaatggcgattggtggcgataatgcatttgcactctttatccctgttcttgctgcgtttattgcaatgagcatagccgaccggccaggatttgcccctggtttaattggcgggtttatggccgtaaatggcaattctggatttttaggcggcttgctcgctggatttttagcaggctacttagccttgtttgtacgcaaattgctgtctggcattcctcaatcgcttgaagggttaaaaacgatcttatttacacctgtgctaaatattttgtttacaggcacaattatgtactacttaattgcgccccttgcttgggtgaacacaggaatgcaaaattggctaggcgacctcggcacagggaacatggtcattctaggcgctgttcttggaatcatgatggcgattgacatgggtggcccgattaataaagcagcctatacgtttgggattgcgatgattgatgctggcaaccttgggccccaggcagcagtcatggctgcaggaatggtgccgccactagggattgcgatcgccacaacgttttggaagcataaatttacgaagcaacaacgagagtcagggcggacaaactatgtccttggcgcttctttcattacagaaggggcgattccgtttgcggcggcagacccaatccgtgttatctcggcaagcgttgtcggcgccgctgtggctggcggtttaaccggattgttccatatacagctccctgcgccacatggaggcatttttacaatgttcctagtcaatgagagcacatggtcttacatcggcctatatgcgttggccatcgtgattggcgcgattgtgactggaatcatatatggaatcattaaaaagccaattgaaaacaagt

SEQ ID NO: 5224 - DNA, 264 bp, Bacillus clausii
taaaagcttcaaaattagtgatttggaatgggccaatgggtgtatttgaactcgaatcgtttgcaggtggcacaaaagcggtcgcaaatgcgctggcagaggcgtcagatacgtattcagtcattggtggcggcgattcagcggcagccgttgaacaatttggccttgccgacaaaatgagccatatttcaacaggcggaggcgccagccttgaatttatggaaggcaaggcacttccaggcgttgtcgcactatcagaaaaat

SEQ ID NO: 5225 - DNA, 754 bp, Bacillus clausii
atgcgtaaaccaattatcgcaggaaactggaaaatgaataaaacaatcggcgaagctgttgattttgtcgaagcagtaaaaacgaacgttcccgcagatgcaacggttgattcggttgtttgcgcaccagccttgtttcttgaccgtttgctccaagcggtaaaaggaaccgagttaaaaattggcgctcaaacgatgcattttgaagacaatggcgcgtttacaggggagatcagccctaaagcattgtctgacatgggcgtccattacgtgattatcggccattcagaacggcgagaaatgtttgccgagacagacgagactgtcaacaagaaagtgcatgccgcattcgcccatcagttggttccgattatgtgttgcggtgaaacggctgaagagcgtgaagctggtaaaatggaagctgttgtaaaagagcaagtagaaaaaggtcttgctggtttaagcgaagaacaagtaaaacaaacggtaattgcgtacgagcctatttgggcgatcggcacaggcaaatcagcgacagaaaaagacgcgaatgaagcttgcgcttacgtgcgtcaaacggtggccgctaatttttctgaagcagcagctaaggcaattcgcatccagtacggcggcagcgtaaagcctggcaacattaaagactacatggcccaaccggacatagatggcgcccttgttggtggagccagcttggacgcagattcgtttttagaattagtgggggcagcacaat

SEQ ID NO: 5226 - DNA, 774 bp, Bacillus clausii
atgcagcgaggtgatactatgcgtaaaccaattatcgcaggaaactggaaaatgaataaaacaatcggcgaagctgttgattttgtcgaagcagtaaaaacgaacgttcccgcagatgcaacggttgattcggttgtttgcgcaccagccttgtttcttgaccgtttgctccaagcggtaaaaggaaccgagttaaaaattggcgctcaaacgatgcattttgaagacaatggcgcgtttacaggggagatcagccctaaagcattgtctgacatgggcgtccattacgtgattatcggccattcagaacggcgagaaatgtttgccgagacagacgagactgtcaacaagaaagtgcatgccgcattcgcccatcagttggttccgattatgtgttgcggtgaaacggctgaagagcgtgaagctggtaaaatggaagctgttgtaaaagagcaagtagaaaaaggtcttgctggtttaagcgaagaacaagtaaaacaaacggtaattgcgtacgagcctatttgggcgatcggcacaggcaaatcagcgacagaaaaagacgcgaatgaagcttgcgcttacgtgcgtcaaacggtggccgctaatttttctgaagcagcagctaaggcaattcgcatccagtacggcggcagcgtaaagcctggcaacattaaagactacatggcccaaccggacatagatggcgcccttgttggtggagccagcttggacgcagattcgtttttagaattagtgggggcagcacaatga

SEQ ID NO: 5227 - DNA, 383 bp, Bacillus clausii
agaaagtggaacgctggaaccaatttgcacaattagaaccagatgtgcgtcaacaattggacgccattttggataatgataaggcgcttgaagattgtttttaccgggaacttgcctttggaacaggaggcatgcgtggggaaatcgggccaggaccaaaccggatgaatacatatactgttcgaaaagcagccgaaggattggcccgctttattgaaaaacgaggcgagaaggcaaaaagcaaaggagtggcgatcgcttttgattcccgccataagtcggcaaagtttgctcatgaagcagcaatcacgttaggcgctcatggcattaaagcgtacgtttttgaaagtttgcggccgacgcccgaattgtcgtttaccgtc

SEQ ID NO: 5228 - DNA, 294 bp, Bacillus clausii
aaaagattggctccgcagatacaacgcctgtccatttgcaatacaggcatgatagcgaagaccggtttaacacgcctgaggcatatgagcggctcctctttgattgcatgatgggcgatgccacaaactttgcccattgggatgaagttagtttgtcatggtcccttgttgatgcgatctccaaagcgtggtcagaaagcggtgaaaaactgccaacttatagagcaggttcaatggggccgaaagaagcggataagcttcttgaagcagacggcttttcatggtggcctgttg

SEQ ID NO: 5229 - DNA, 261 bp, Bacillus clausii
aagttccatgcgttgccaatcgttccggcattacgcctacctatgttggcgagcttccagagcaactagctgctctaaacaggacgaacattaatacacagttattaacgattgaagcggcaataacaaaaaaacgcgaacatatttaccatgctgccatgctcgacccgcatacgtcttccgaactgtccatcgatgacattgttagcttatgcgacgatttaatcgaagcacatggcaattatttgcctgaataccgat

SEQ ID NO: 5230 - DNA, 600 bp, Bacillus clausii
  misc_feature (1)...(600): n = A,T,C or G
gtgggcagaaagaagcctacgaactcgtcaagccaatgtttgaaaaaattgcggctcaagtaaatgggggnccttgcacgacttacatcggtaccgacggtgccggccattacgtaaaaatggttcataatggcattgaatatggggacatgcaattgatttgcgaagcctattcgctattagtaaacgtgcttggcctgaacgctcaagagttgcacagtgtgtttaaggaatggaatgaaggagaactcgatagttatttaattgagatcaccgccgacattttcacaaaagtcgatgaagaaacaggaaaaccgatggttgatgtcattttggatacagccggtcaaaaagggactggaaaatggacaagcaaaagctcacttgatctaggcgtacctctccctgttattactgagtcggnctttgcccgcttcctttccgctatgaaagaagaacgcgttaaagcgagccaaatattgnctggcccagagaaaaaaccattcacagggaaataagcaggaattaatcgaacgaattcgccaagcactgnatttcagcaaagngctntnctacggcccaagggtttttcgcagctgg

SEQ ID NO: 5231 - DNA, 624 bp, Bacillus clausii
atcagttaacaatggagcaagttaaagatatgctgcttcgtattgcagacgtattgattcaaaaagaagacgagctaggagagattgatcgacagataggtgatggcgatcatggagccggaatggctactggtgcccgagcgattcaaaaagaactagaagagctggaaatcacaagtgtgaaccaagtttttcagaaatcaggtacggcgatgatggaatccatgggtggtgcttctggtgtgctgtttagtagcttatttttagccttaggaaaaataaggcctgaagcttctgaaatagacgtggcaagcttttccgaaggagtccgtcaagctgttaatgatataaaaataagaggcagagccagtctcggagacaaaacaatgcttgatgcgttagagcctgcaagcgcggccttgacagaatataaaaacgcgacttttgtagaagctttggcagctgccaaaagtgcagcacaacagggagtggaaaagaccaaaggttatgttgctaaatttgggcgaactaagtttttaggagagcgttcgcttggttatcaagacgcaggcgcaacttctatcgctattatgatggatgaaatgtatcaatttgtaagggagg

SEQ ID NO: 5232 - DNA, 642 bp, Bacillus clausii
atgtgcaatcagttaacaatggagcaagttaaagatatgctgcttcgtattgcagacgtattgattcaaaaagaagacgagctaggagagattgatcgacagataggtgatggcgatcatggagccggaatggctactggtgcccgagcgattcaaaaagaactagaagagctggaaatcacaagtgtgaaccaagtttttcagaaatcaggtacggcgatgatggaatccatgggtggtgcttctggtgtgctgtttagtagcttatttttagccttaggaaaaataaggcctgaagcttctgaaatagacgtggcaagcttttccgaaggagtccgtcaagctgttaatgatataaaaataagaggcagagccagtctcggagacaaaacaatgcttgatgcgttagagcctgcaagcgcggccttgacagaatataaaaacgcgacttttgtagaagctttggcagctgccaaaagtgcagcacaacagggagtggaaaagaccaaaggttatgttgctaaatttgggcgaactaagtttttaggagagcgttcgcttggttatcaagacgcaggcgcaacttctatcgctattatgatggatgaaatgtatcaatttgtaagggaggaattcaaatga

SEQ ID NO: 5233 - DNA, 384 bp, Bacillus clausii
ggacccaggcaaagtcggcgaatacgcggaggaaatgatgaatggcttgcaggcagagggcgtcatcgctacactgaagcattttccaggccacggtgatacggtcgttgactctcaccatgcaatgccgaccattccccatggcttaaaacgccttcgacaagtggaacttatgccttttaaagcgtgtataaaagcaggtgcagaagcgatcatgagcgctcatatccatttccccgcactggagacggagccagtgcctgcgacgatgtcatataaagtaatgacggaacttttacggcacgaactaggctattcaggcgtattgatgacagactgcttagaaatggaggcgattgccgggacaattggcaccgcccgagg

SEQ ID NO: 5234 - DNA, 293 bp, Bacillus clausii
atgaatattttactcgtttgctctgctgggatgtctacaagcatgcttgttgatagaatgaaaaaagcagctgaagaattagaagtacacgcaacgattacagcaacggttgaagcagggttggctaatgagcttgacacgacaaacgtcattttaattggaccgcaagtacgctatttggaaaacaaaattacaaaaaaagcagaaccctatggcattaaagtcgccgttatcgattcaattgcctatgggacgatggatggaaaaaaagttttgcaacaagcattggcttt

SEQ ID NO: 5235 - DNA, 375 bp, Bacillus clausii
atgacatcaatgcaacgaaagagctttgcttggaaattattgaactacacaaaaaatttgctaaggagcgtcgttaatatgaatattttactcgtttgctctgctgggatgtctacaagcatgcttgttgatagaatgaaaaaagcagctgaagaattagaagtacacgcaacgattacagcaacggttgaagcagggttggctaatgagcttgacacgacaaacgtcattttaattggaccgcaagtacgctatttggaaaacaaaattacaaaaaaagcagaaccctatggcattaaagtcgccgttatcgattcaattgcctatgggacgatggatggaaaaaaagttttgcaacaagcattggctttatga

SEQ ID NO: 5236 - DNA, 415 bp, Bacillus clausii
atgaatccagtgatgcagtggatggagaaacattttattccgattgcgggacggatcggttcacaacgtcacttagttgcgattcgcgacggttttgtcgcgatcatgccgttaatcattattggctcattcgctgtcttgattaacaatttgcctatcgcgtttttccaaaactttatggccgacctattcggcgaaagctggacaacgcttggcggcaacatctgggatgggtcgtttgcgatcctttcattgcttgtcgtggcaggaattagttacaatttagctaagtcttatgatgtggatgctctgtctgctgcacttcttgctgttggctgctatatcattttgacgccaacgacggatgattggggactcatcattcgcttgggacggggagcgcaaggtctgtttg

SEQ ID NO: 5237 - DNA, 168 bp, Bacillus clausii
atccttactatagctcagatgcatctgctgctattaaggcaggccatgatttagtccacggcttaattgggccaggcattgaaggttcccattcgatggaacggacacatcagtcttcactggaagccacataccgccttctatgtgcctacacttattcggagatga

SEQ ID NO: 5238 - DNA, 387 bp, Bacillus clausii
  misc_feature (1)...(387): n = A,T,C or G
gctaatgaacatgaagataaaagggcaagggctgtggcggacgctcttttatttgcctgtacttgtgccagcagtggcagcaaacattttatggatgtggttgtttaatccagaatttggcctgctcaatggcattctccgcttctttgggctccctgcctntatgtggatntcactgacgaggcatcggttatcccgtcgnngattttgttaagnatatggggntgtggcggcgctgcgctcatttttctagcacggtttgcaagaaatcccgaaagaccaattggaagcagtcgagttggatggcggaaatgcttggcaccagttccgctttgtgacaatccctactatttcgccaatcattttcttcaatttgattatgggact

SEQ ID NO: 5239 - DNA, 615 bp, Bacillus clausii
  misc_feature (1)...(615): n = A,T,C or G
atgaaaggtctgttaaagnacgcctgtcatgttgtcacgcttctagccgcctttagttgttccggctgcctgtttgcttctgtcggcaccaatgacccagtagagctgcgttttacctactggggtgggccgctagagcgagaagcagttgaaacattaattgccacatttaataacgagcatccagggattcaagtgagggcaccgcttgtcccgattaatagctatgtggagaaaatgaatgtgatggctgcatcgaaaacacttcccgacgtaggctattttccagagggcagcttgtacccgtgggtggaaaacggcatgcttcgcgatttgacgccattgttgacaggagacgaagcaaacgaaaagctcgattatacgctatatcagtttcatgatgggccgattgctaggggcagcgtcgcgaatgaagtgataaacatttattacaacaaacaattgtttgcagaagcgggagtagaactgccgccgacaaaagcagaagaggcatggagctgggatgaatttgtcgaagtcgccaaaatgcttactgtagatcggaacggacngagggcgaatggagcctggnctttgatgaagaaccgggattga

SEQ ID NO: 5240 - DNA, 453 bp, Bacillus clausii
  misc_feature (1)...(453): n = A,T,C or G
ttatgccagagcantttattttgatccatatgagatgcccagggcgaaaaagtgaacccttcacagnagggggggagatttatgaaaaagggattttatgatttggcttattaatgttcccgtgaccattaacgggaaacattgagtgctttatttctgaaaatggcatgggtgtcgaaggtgaagaacgatttcgtaacgaccagggggttattgaggacgattatcgaatcgagtttataaaaggtcatcttaaatgggttcatcaagcattgcaggaaggagccaatgtccaaggttaccatttgtggacgtttatggataactggtcatggttgaatgcttacaagaacaggtacggcttggttgccgtcgatcttgaaaaaggtggccatcgaaccgtcaaaaaaagcggctggtggctaaagaacgtcatcgagcaaaaagggtttt

SEQ ID NO: 5241 - DNA, 435 bp, Bacillus clausii
tcaaagaattgatggacattatgaaaaagctgactgaagaaggcaaatccatcattttaattacacataagctaaaagaaatcaaacaaatttgcgacgtttgtaccgtcattcgacgcggccgcgggattggcaccgtcgaagtggcaagcgcgacaacagccgagctagcagaaatgatggttggccgtgaagtcaatttccatgtacaaaaaacgccggctgtgccaaaagatactgtacttgaagtaaaaaatctttatgtcaaagacggccgtggcgtggaaatggtccaacagcttgatttaacaattcgcgccggcgagattgtcggtcttgctggcattgaagggaacggccaatcggagttaatcgcagcgattgccggtttgctcccggtagaaaaaggagaaattcggttaaacgggacaaaac

SEQ ID NO: 5242 - DNA, 464 bp, Bacillus clausii; identical to SEQ ID NO: 5178

SEQ ID NO: 5243 - DNA, 606 bp, Bacillus clausii
  misc_feature (1)...(606): n = A,T,C or G
gggaatattgattgcnttaagctttgtatttgagacagctttcggcgaagataacccgatccgcgaattgttaatggcgattggtggcgataatgcatttgcactctttatccctgttcttgctgcgtttattgcaatgagcatagccgaccggccaggatttgcccctggtttaattggcgggtttatggccgtaaatggcaattctggatttttaggcggcttgctcgctggatttttagcaggctacttagccttgtttgtacgcaaattgctgtctggcattcctcaatcgcttgaagggttaaaaacgatcttatttacacctgtgctaaatattttgtttacaggcacaattatgtactacttaattgcgccccttgcttgggtgaacacaggaatgcaaaattggctaggcgacctcggcacagggaacatggtcattctaggcgctgttcttggaatcatgatggcgattgacatgggtggcccgattaataaagcagcctatacgtttgggattgcgatgattgatgctggcaaccttgggccccaggcagcagtcatggctgcaggaatggtgccgccactagggattgcgatcgc

SEQ ID NO: 5244 - DNA, 492 bp, Bacillus clausii
acggtgtccacacgtcttttattgaaataagcggcgacacccgtatcaacattaagctaaaagccgatgtggaaacagaagtcaatggcgtttctccggcgattgcagcaaatgatgtagcagcacttgaagagcagttgacacaactgaaagcaaacgatgtggtcgttttcgcaggcagcgtccctccaagccttgagacaaatgtatatgcgaaatggagcaagttgctcaaagaccgcggtgtttctgtctttatagattcaagcggaaaaccgctagaagaagcagttgctgcacagccagatttcattaagcctaaccaacatgaattggctgaatttgcacgcgaagcgatcgattctctcgaagcggctgttccccatgccaaggcgcttgtggcgaaaggaatcggccacgtattcgttacatttgctggggacggtgcgttgcttgctacagagcaatcgattttattggcgacaacgccaa

SEQ ID NO: 5245 - DNA, 234 bp, Bacillus clausii
tgaaaagcttgcgagacaaattatccaagaggtaggcggtaaagagaatattaacagcgtgatacactgtgtgacgcgcttaaggttcaagcttaaagatcaatctcttgcgaaaacagaagtgataaaaaatttgcctggagtaatgacagttgtaataagcggtggacagtaccaagttgtaattggtaatcaagtttccaatgtttatgctgaagtatccaaattactcgg

SEQ ID NO: 5246 - DNA, 585 bp, Bacillus clausii
ggaaagtcatcagtgatactctgctacatttggcaaaaaaaaataaagacattttagtattaacaagtgattccagaggttcagcatccatggcgtcaatcgcagatgcgctgccagaccaactggtagaagtaggaatagcagagcaaaacttagtagggattgcagccggcttggcggcgtctggaaaaaagccgtttgtagcttctccggcctgttttctaagcatgcgaagcatagagcagattaaagttgatattgcttactcaagaacgaatgttaagttaattggaattagcggcggtgtgagttatggagcgcttggtatgtcacatcactccctacaagatttggccgtgaccagagccataccggatttacacgtcatgatgcctgctgatcgtcatgaagccaaaaaaatgaccgaagccttagtggattatcatacacctgtttatatgagaattggcagaaaccctgtggaggattcttatataaatgaaaattacgattttgaaattggcaaggcagttacgatgcatgaagggaaacgatctaaccatcattgcatcggggagaaactgt

SEQ ID NO: 5247 - DNA, 447 bp, Bacillus clausii
ggttggttgctatttatacaaacacagaggggggcgaagcccaatcgattgcttacagcatagacgatggacggacgtgggaacggtatgttggcaaccctgttattccgaacactggcatgaaagatttccgcgacccgaaagtgttttggcatgaggaaacggcaaagtgggtcatggtagtctcaacgaatcagaccgtcagcttttaccattctgacaacttgattgattgggcatttgcgagtcagtttggtgacgaggaaggattgcatgctgcagtgtgggaatgtcctgatttgttccgccttccagttgacggcgatgaggacaatcaaaagtgggttctccacgtaagtgtaggcgataatgatgaaaccaatggctctactgcgcaatattttgtcggtgaatttgatgggactgcctttacaaacgacaatgatg

SEQ ID NO: 5248 - DNA, 261 bp, Bacillus clausii
atataggccaggacttttatgcagcgcaaacattcgcgaatttggatggccgcacggtctggctcggctggatggcgaactggcggtatccgtaccaatcgccaaccgatccatggatgggagcgatgtcgattccaagagagttagggttgtatacaaattccaacgggcaagtgcgactacggcaaaagccgatatccgaacttgacacgatttatgccaaacaacaggattttgctccttttgacgttgccaacgagg

SEQ ID NO: 5249 - DNA, 863 bp, Bacillus clausii
  misc_feature (1)...(863): n = A,T,C or G
gcagacgcggatgccgacgcggacgctgatgctgacgctgacgcggatgccgatgcggatgcggacgccgatgcggatgcggatgcggacgccgatgcggatgcggatgctgacgcggatgcggacgccgatgccgatgccgacgctgacgccgatgcggacgctgatgcggatgcggatgccgacgcagacgcggacgctgatgctgatgctgacgcggacgccgatgccgacgcggatgcggacgccgacgcggatgccgatgccgacgcggacgctgatgccgacgctgatgctgacgcggatgccgacgcggacgcggatgcggatgcggacgccgatgccgacgctgacgcggatgcggatgcggacgcggatgcggacgccgatgccgacgctgacgctgacgctgatgccgatgccgatgcggatgcggatgcggacgccgatgcngatgcggattcggacgccgatgccgatgccgatgccgacgccgatgcggacgctgatgctgacgcggatgccgatgccgatgcggatgcggacgccgatgcggatgcggattcggacgctgatgcggangccgatgcggatgctgacgcggacgccgatgccgatgcngacgctgacgctgatgccgatgcngacgctgatgctgacgccgatgctgatgcggatgccgataaggacagggatactgataaaaatcgagtcgatcgagnctatactggtaagcaagactcttcgaaagatgggaagaagctcccagatacagcaacttccatttggactgtaggagttacgggaatggcagcactattagctggaataagtgctcgtctatttagaagaaagaaatagaa

SEQ ID NO: 5250 - DNA, 639 bp, Bacillus clausii
  misc_feature (1)...(639): n = A,T,C or G
tgggcaactgggccggttcgggtggatatgtttcgtttctgtacgccatcgttccccgagttcaaggggataaacngatttccgttgtccaagcaacttgcttttcttgaaaaacggaaacgtagcgctagggcttgcgattacctttttctggctcggcggatactcgatcgcctacacctacatttcaccgtatctacttgatgttgccggattgaaagaagggatgctgagtggagtgctgttggcgttcggcatcgctagcctgctcggatccaaatttggcggtttcagtacggataaatggggggtattcccgacactgtcagggggaatgctccttgcacgtcataagcgcttgcttctcctctctttaaccgttacctatacgcaagcatggctgccgattgtcatcctcttgattttgtggtcgtttgcggcatggtcttccggtccaacgcaacaagtcaatctagttcggattgaaccgaattattctggaatcatgctaagtctgaaccaatccatgatgcagttgtccatggctgcgggcgctgcaatcggaggcgtcatgatcaaccgtgtgtctctatcatccattacatgggtcgggatggttggagtcgctattgcgatcgt

SEQ ID NO: 5251 - DNA, 576 bp, Bacillus clausii
tgaagaaatcgttgctttgcaaaagcaggtgaaggaaagcgagtggaggcaaacatatcatattcagcctgttaccggcttgctaaacgaccctaacggttttgcttattttgcaggagagtatcaccttttttatcagtggtttcctcttggaacgtaccatgggcttaagtactggtaccatacggcttcaaaagaccttgtccattggcgcaatgttgggaaagcgatcgcgcctgatacgtcttttgactcccatggcgtttactcaggaagtggcatcgttaaagactcacaattgcatttaatgtatacagggaatgctagggacgagaattggaacaggcaaacgtcccagtgcatcgctgtaatggatgcaaatcgagccgtctcaaaatgggcgaagcctgtcattgatcaagttccagcaggatatacagcccattttcgtgatccgaaagtatggaaggacgacgatatgtatcgctgcgtcatcggcactcagcggaatgacttcacaggcaccgccgtcgtgtatgagtcgcctgatttgttggaatggcgattcattgggga

SEQ ID NO: 5252 - DNA, 425 bp, Bacillus clausii
  misc_feature (1)...(425): n = A,T,C or G
atcgaaaaccaagaaggcgttgacaacatggacgaaattnttgaagtatcggacggccttatggtcgcacggggagacttaggcgtagaaattccagcagaagaagtaccgcttgtgcaaaagcagctcattaaaaaatgcaatgagttgggtaagccggtcatcacggcgacgcaaatgcttgattccatgcaacgcaacccgcgtcctacccgagctgaagcaagcgacgtttccaacgctattttngacgggacagacgccattatgctttttggggaaaccgctgntggtgattaccctgtagaatcggtgcaaacgatgcacaatattgccgaacgaacagaacaagccctcaattatgaaaacatgctgcgtcggaaaagcaaagaagtgaaaacatcgattacaagtgcaattggcca

SEQ ID NO: 5253 - DNA, 246 bp, Bacillus clausii
  misc_feature (1)...(246): n = A,T,C or G
caaaaagaagtcaaccatccaacttaaatcaggtttgcaggctcggccagcggcgatgttagtccaagaagccaatcgattttcgtctgaagtgtttattgtaaaagacaatgccaaagtcaacgcgaaaagcatcatggggttaatgggcttggcgctcggcaaaggcacgacgatcacgattntcacagaagggcacgatgaaaaagaagcactggatgccttggttgcttacgttgaaaacga

SEQ ID NO: 5254 - DNA, 600 bp, Bacillus clausii
  misc_feature (1)...(600): n = A,T,C or G
atactttactggagaagcntttactgcgatgctccagcagcttgattaaaagccatttcctgtttttaaagngttcgatagtgcagggaatccagtggaagcaacatttacgcaaatggagacggcttttggctacgaattgcctgacgatggcttccgaaagccttattacgctagacgtgtaaacatgcaagcccatgtaaaacttcccgcttttggctatacaacaatttatgtgcttcaaggcaagcaggaagcaaacggagaaacgatcgccgccgctgacgggcggtcattggaaaacgagtggctaaaagtaacgatccatgatgatggcagctatgacatgatctgcaaacaaacaggaacccattacccgaaccttggtgtttatgaagacagcggcgatatcggcaatgaatatatgtataaggaagcaaatgggacgcgcttaacgacgaaaggcaacgaggcgacagttgaaatcgtgnaaaatacagcgcttgaggcaaggatcgcgattatccataaatgggagctgcgtaagtcggcagatcgatcgtttgtagatgaaaagcgggagttgcgctggcaccctaa

SEQ ID NO: 5255 - DNA, 882 bp, Bacillus clausii
agtagacaatcgggaaattgccaagcaggtcattgaagccgtcggcggcagagacaatattgcttcctttgcccattgtgcgacacggcttcgcattatggtccacgatcaacagaagatcgacgagaaaaaagtagaaaatatcgccaaagtgaaaggcgcgtttttccactctggccagtaccagattatttttggaaccggcactgtcaaccaagtctttgaagcgattgagagcttaggcgtagaaggcacaagcaaagaccaactaaaagcagaagcaaaaaagacgggcaatgtatttcaacgagcgatccgcacttttggcgatgtatttgtaccgattattccagtgttggtggcaacaggattgttcatgggcctccgcggcctgctcacacaagaaacggtgctagcttggtttggcatgacgcctgccgatatttcggccaattttctcatgttcacagaaatattaacagacacggcgtttgcatttttgcctgccttggtagcctggtcggcgtttagagtttttggaggcagtccggtgctcggtattgttcttggattgatgctcgtaaacccggcactaccgaatgcctacagtgttgccaacggctccgaagaagcgcttgttatgtttggcttcatacctgtggtcggctatcaaggttcggttttgcctgcattcttcatcgggcttattggcgcaaagtttgagcgctttttgagaaagcggattcctgaagcaatcgacttgatcgtaacaccgtttttaacattgctggtcatgattacactcggtctgtttgccattggcccgatttttcattcgtttgaagaagtcgtcctaaatgcgacaacctatttgctgggtct

SEQ ID NO: 5256 - DNA, 477 bp, Bacillus clausii
cgacggcaaattgctacagaagccagtagtagaactacagaagctgagacaaaagcgaagcgacgtacaggatacgttaacgaatgaagcaaaaacgtatgatggcattaccggcgccgcttttgagatggtctgtacatttgatccaatcgaggccgaagccgtcggaattgaaatccgcgccagtgaaaaagagcgtaccgttattacttataataccgttatgcagaaggtaacaatggatcgttcaatggctggagaaataatcaacagcagctacggggcgactcggtcctgcaggctagtggcagaacagattcaatttcacttgtttgtcgacacctcttcagtcgaattgtttatcaacgacggcgaagaagtgtttacaagccggatttttccacagcccgaaagcaagggaatccgttttttcgtaaacaacggcaatgcccacttaaaagctaccaagtgggattt

SEQ ID NO: 5257 - DNA, 522 bp, Bacillus clausii
ttgtttatgatggaaaaaaacttcgcttgggggaacagcagggaatattagtgcaaaatgtgaagatggctatttaatttccgttactgggacctatttaggcgaattagaggtagaggattttgcttattgccaaggaggagagcatcttgctggcaaaaagccttcaaaggaatatgtaatgcatgaaggcatttacgaacagcggccagaaatcggggcggtgctccactcatccccgttttatagcacattgatcgccaacagcgaccttcatttgccatcgaactactttgtcgagtcgatgtattacttggagagaatggtgcgtattccttactatcagccaggcagtaaagagctagcccaagccgttaaagagagagcaaaggaggcaaatgtctttctgctagagaaccacggcattatcgtctgcgatgtgaatctgaaagaagcacgcacggcgttgcaaacgcttgaatacacagcgcgcatgcatatcacagcattggagaaaggcat

SEQ ID NO: 5258 - DNA, 576 bp, Bacillus clausii
gcttctactgccctttcaaaagggttaagcgatttaaaagatgttccaatgcttctcgatcaagtacaaatcacgcggaggggattcacatggcaaaagtaaagattgtcgctgcaacgggctgtccgacaggcattgctcatacttttatggcagcggaagcgctgaaaaaagcagcgaaaaacatggacgtggagatcaaagttgaaacgcatggccaagcgggaatcgaaaatgcgttaacaaaagaagaaattgaagcggcagacggtgtcattgtcgctgccgacaaagatgtcaatacggaacgctttcatggcaagcggcttgttgatgtcccagtagcgaaggcattgcgaggcgccgaagaactaatccaacaaattattgataaaagcgcgccggtttatcgagccaaaggtggagtgctgccagaagaagcgactggcgaagacaatcagccaactggcaaaaagaacattggtcgttcactttataagtcactgatgaatggtgtttcccacatgctgccatttgtagttggcggcggcgtgttgatcgcaatttcctttttgt

SEQ ID NO: 5259 - DNA, 591 bp, Bacillus clausii
  misc_feature (1)...(591): n = A,T,C or G
gggtcaccaaggcttaattaatggcgacataaaaaaaatggagcttggttctgtcggtgatatcattcaccgtggcggaacaatgctttacacagctcgctgtgaagaatttaaaacgttagaaggccaacaaaaaggcattgaacagctgaagaaatttggaattgaagggctagtcgttattgggggagatggttcttaccgtggcgctcaacagttgacgaaacatggctttccaacaatcggcgttccagggacgattgacaacgatattccaggcactgattttacaattggttttgatacagcattaaatacagtcattgacgcgattgacaaaattcgtgacacggccacttctcatgatcgtacatacgtgattgaagtaatgggccgccatgctggggatttggctttgtgggcaggccttgccgatggtgcagagaccattgttattcctgaggctgagcataacatggagcagatattaccaacgattaaacgtggccaagaacgtggcaaaaagcacagcattattgtcgtcgctgaaggtgtcggttcangcatggagtttggcgaccggatctgcca

SEQ ID NO: 5260 - DNA, 390 bp, Bacillus clausii
  misc_feature (1)...(390): n = A,T,C or G
aaaaatttcaattgcccctgattcgtttaaagaaagcttgaccgcccttcaagcggcacaagcgattaaagcaggatttaaacgagatttccccaatgctaattacgaatgcatccctatggctgacggaggagagggaacggttcaatcacttggcgacgcacttggcgccacaattcgtacagctactgtaacaggacccctcggcaaccaagtcgaagcagcctacgctttcgtcaaaaaagagcaagtagcagtcattgaaatggcggcagcgtctggcttgcatctcgtgccaaaagataaacgcgacccangggaaacaacaacgtttgggaacaggcganttaataaaaanacgcgctggaaacanggcgccaaacggattat

SEQ ID NO: 5261 - DNA, 975 bp, Bacillus clausii
  misc_feature (1)...(975): n = A,T,C or G
atgcttgaaggccttgcatttgaatggaaaaaatcaggaacgattcaaccttttttggcgctactctccccactgctcgcatctaatcaatctgctgaactgctggagacgatcaaacagtactttattcacaatggcgatattaagaaaatcgccgatcagcaatttgtacacagcaatacagtccaccaccgtttaaataaaatcaaggcgctgactggaaaaaacccaaaagtgattcgtgatttaactgatttgtatatcgcctgtgtgctgtaccaattaaattgtatgcaagaacaagggaaaactcttgtagacgcgtttcctttgtgcttcgccacagtgcttacaggccagcgattgctttataaatgttgttgtaaccgatttcaaaaaattgaattgaacgcaacagcgcctagcgtaacggtgaagtggaacgttgctgacagtgtaatgccccttcacatggtctacttggcgccattgcatctcaaagcggtgccctcgctaaagccctacagcgaggggcattttccacgattccattcacgaaaggagaacacgatgcaaaaaatttcaattgcccctgattcgtttaaagaaagcttgaccgcccttcaagcggcacaagcgattaaagcaggatttaaacgagatttccccaatgctaattacgaatgcatccctatggctgacggaggagagggaacggttcaatcacttggcgacgcacttggcgccacaattcgtacagctactgtaacaggacccctcggcaaccaagtcgaagcagcctacgctttcgtcaaaaaagagcaagtagcagtcattgaaatggcggcagcgtctggcttgcatctcgtgccaaaagataaacgcgacccangggaaacaacaacgtttgggaacaggcganttaataaaaanacgcgctggaaacanggcgccaaacggattattnctcgggct

SEQ ID NO: 5262 - DNA, 405 bp, Bacillus clausii
ccaacttctcgaacaaacgggaagcaatccattcaacgcgatcgtcacagccgcaatagcggcacaaggcgcagcctgtcttgccgtcggcctgaaaacgaaaaacaacaaattaaaggcactctccttgccttcttcgttctcggcctttctcggcatcacagagccagctatattcggcgtaaatttgcggtatgtaaagccgttcgtcatgggcttaatcggcggaggcgttgggggctttatggcttcaatatttcagctaagtgcaacggggatggcaatcacagtcattccaggcacgctattatatttaaatagccagcttccactctatattttgtgcaacgtaacagcgagcgtcattgccttcgtgctcacttggctgtttggctttaacgataa

SEQ ID NO: 5263 - DNA, 681 bp, Bacillus clausii
tgaaccctattcgatcttagagctcccttatctattcgaagatttgaatcatttagaggaatttgtctatggagaagatggtaagcgattgcaagaagagacgttagaagcaacaggggtaagagggctggagttttggctccgtggagcacggtagctaacaaccaataagcttgtggagtcacctgaagaccttcgcggcgtaaaaattcgtgtaccaaacattgaggcgtctgtagaaggctggcaggcaatgggggcaagcccgacaccgatgaactttggtgaagtgtattcttctttgcagacaggcgtgattgacgcgcaagaaaatccaattgagttcaccgcaagtgcgagaattcatgaagtccaagactatcttgtaatgacggaccacgtttttggttatgtgcaattattaatgagtgacaaaacgtaccaagagttaacagaggacgaacagcaagcggtcatggaagcagctgaagaagcgcgtatgtaccaaaatgaaatcgtttccgcggaagaagagagcgctttgcaaatgatgctcgatgaaggtgtcgagcaaatcgaagtcgatcaagagccgtttcgtgagtctgttcaacgtgtcaatgagagattagctgataaatacgggagagaactttacgacacgatccaaggtatgaggga

SEQ ID NO: 5264 - DNA, 567 bp, Bacillus clausii
ggggtttttaggcttagtcattggcccgatgatcgcgtcgctttattactcattcactgattttgatatgttgacgagccctaattgggttggcttggacaattatatcacgatgtttaccaatgatccgaggttccgtacttcaatcacggtcacgcttcttttcgtgtttgtgtcaacgccaatcaaactagcgtttgccctgttgattgcgatgctgtttaacaataaacgcaaagggtcagggttttatacaacgctgttttatattccttccattatcggcggcagtgttgctgtagctgtgatgtggcgccagttattcggcggacaaggagcaattaacgatattttgttgtttttcggcgtagaaggaaaaagttggattgccagccccgaccatgccttaatggtgttgatcttgcttgttatatggcaatttggttctcctatgatcatctttttggcagggcttaggcaaattcccgaagatttatatgaagcagcttccgttgatggcgccgggaagtttcgcaaattcttgtccatcacaattccattgcttac

SEQ ID NO: 5265 - DNA, 816 bp, Bacillus clausii
ttacgatgctgagattttcgccgaagcaggcgttccggaactagagcctggttatacgtgggatgattatatagaggcagtcaaaacagttaacgaaaacttggacggcatgtatgcgtatgctttcggagataatttaaacttttttaagcattatttgcgccaacatgatttgtggttgtacaacgaagacaacacaggacttggctacgacgacgacaagtacctgatcgattttttaaacatgtataaagacttgctcgacagtggggtggctgcgcctcctgatgtcaaagccgaggtccaaggcatccaagatgagctaattgtccacagccgcgcttcaacgttttcccctcacagcaatcaaattgtcgcactcaatgaagctgctggccgtaagcttcagatgacaactttgccagcaatggaaggtggatcagaagcctcctttatcaaaccgtcattgctattttctgctacaagtcaaggggacaagagcgaagaggctgcgcgattcatcaatttttttgtcaatagtatagaagcgaatgagattttaaatgctgaacggggcgtgccgatttcagaaaaggttcgagatcacctttatgatcatgtcagcgaaaatacacaactgcaatttgattatgttcagttagttgaacagagggctgcgccgatccatccaccagacccagcaggtacaggtcagattttggatttatatgcgcgaatgatagaagaattcgagtatgagttgctgagcgccgaggaatttgccgagcgtttccggggcgaaggtgagatcatttt

SEQ ID NO: 5266 - DNA, 369 bp, Bacillus clausii
  misc_feature (1)...(369): n = A,T,C or G
caggtatattggaaatcatcgccgccgattttggcgtttccatttcancggctgggcaattattaactttttactcgttaccatacgcctttggtgcgcttgttttantcttggcaaccgccaagtataaccgaaaaaacatgcttttgctttcgctcgctctcttttttgtatcaaatttaatcgccttttcgantgttaattattggatgctgctcacggcacggattattatggctatgagcggcggactttatattgtcattgccactcattatgcttcgagtctagcagccccacaaaaacgagggaatgcaatggcgatcatactcactggattnacatttatcnttggttgtgggcgtccca

SEQ ID NO: 5267 - DNA, 477 bp, Bacillus clausii
atgaaccctattcgatcttagagctcccttatctattcgaagatttgaatcatttagaggaatttgtctatggagaagatggtaagcgattgcaagaagagacgttagaagcaacaggggtaagagggctggagttttggctccgtggagcacggtagctaacaaccaataagcttgtggagtcacctgaagaccttcgcggcgtaaaaattcgtgtaccaaacattgaggcgtctgtagaaggctggcaggcaatgggggcaagcccgacaccgatgaactttggtgaagtgtattcttctttgcagacaggcgtgattgacgcgcaagaaaatccaattgagttcaccgcaagtgcgagaattcatgaagtccaagactatcttgtaatgacggaccacgtttttggttatgtgcaattattaatgagtgacaaaacgtaccaagagttaacagaggacgaacagcaagcggtca

SEQ ID NO: 5268 - DNA, 384 bp, Bacillus clausii
  misc_feature (1)...(384): n = A,T,C or G
ttggctgtgactctttggtggacagtcggctttaatatggattctcnacttgacggcgttgcaaggtatccccgatgagctatatgaagcagctgaagtcgacggagcaacaaggcaacaaatgttttggcgtatcacattgccgcaactattgccgatttcaaggttgatttttctcttgcaaatcctcgcttcattcaaagtgtttgcgcaaattttgttaattactgatggcggtccagggacgtcaacacggccgatcattttgtacatttacgaaatgggctttgaacgctatgatcttggctatgcagcggctatgtcgtatttgctgtttatggttctcctcgtcttatcggtcattcaacttcgtttaggcggtaa

SEQ ID NO: 5269 - DNA, 942 bp, Bacillus clausii
ttatgaatattgtcttggctccatcaggctttaaagagagtgtcagcgcagaacaagtcgctgccaacatgaaggagggaattattcgggctttgcctgaggcgaaggtgatctctgtccctttagtcgatggaggggaagggtttacagaaacgatggtagcgtggacggccggcacattgcattcagtggaggtgaccggaccaataaaccaacaagtgacagcgatatttggttttttgggcactcgtgagaaacgtacggctgtgattgaaattgctcaagctgcggggttgaaactcgtaccgaaagagaagaggaacccgttgttcacgtcatcatttggtgtaggggaattgattaaaaaagccctcgattttggggcggagcgtatccttgttggctgcggcgattcaggcattagtgatgggggcatagggatgggacaagcgttaggcattcgttttttcgatcaaactggatcggtagtcgacgcaaggaagggggctgttgttttgccatctattgctgctattgaccttagtggcatagaccgccgtctagcttatatccccatcgatgttgcctgtaattggcataacgtcttatgtggaaaaaatggggttgcccgtatctttggggcgcaaaaaggcgcatcccagatgcaaattgatttattggatcgtggtcttcaaaatttggcagaacgaatcgtggaaacaactagcgtccgtgtaagggacattccaggaggtggtgcttcaggagggttaggcgcttgctttcatggattattgggagcgagactgtatccaaggtatgaagtgatttttacatatttagacattgaccgtcatatccaacaagccgatttagtatttacggcagaaggaagcattgattttcaaacaccaaaagggaaaatcccagcagaggtggcgg

SEQ ID NO: 5270 - DNA, 846 bp, Bacillus clausii
  misc_feature (1)...(846): n = A,T,C or G
tttcttctttgtattgccagcgcttcttgtttatagcgtatttattttatatccgattttttcaacattctattacagccttcatgagtggaatggtgtacaacctcaacgcacctttattggactggataactatgtgactctccttaaagacgccacttttttggcaagcgctgcnaaacaataatttngcttggtccttggtttcctgtttttggtacaaaattccgctnaggggcttatcntggcacttgttctcttcagccctgtcatcggtaaaagattgttaaatgttatctactttcttccctatttaatgtctacggtggcgatagggcttctctggatttttatgtatgacccgataaacggtccgattaaccaattgttgcaagtatttggttttgatgcgatcccctggttggcggacgccaatgtggcgatgattgccattttaattgtcgttatttggcaattctctcctttttatatgattttatttaaagcagcaatggtagggattccaaatgaattgtatgaagcggctagcattgatggcgcaaatggaaggcaacagtttttttacatcacgttgccagccctcgttcctactattgtcagttcttccgttctcgccgttgttggttcactaaaagcatttgacattttttacattatgactggcggcggccctggaggggcaacagaaatattaggaacctatatgtacaagcaaggctttatccagtttagcatgggctatgcgagcacagtcgcggctgccatgtttattattgcctttatttgtgtagccatcatccaatttgttgaataccagcgaaagaa

SEQ ID NO: 5271 - DNA, 454 bp, Bacillus clausii
  misc_feature (1)...(454): n = A,T,C or G
atgaaggggcaaaccatttgcatggcggagctagcgggcttcaccaaattcgctttgaaacagaaacgtttacatcccccacggggctcaggtgtgcggtttcagcaccgctctcctgatggggatggcggctatcctggcaatgtggacatcgacatcacgtatacattgaccgatgacaatgaatggattctttcatacacagcgaaaactgacaagcggacgccgcttacattaaccaaccatacctattttaatttggccggagaaaaaggggcaacgatccatgaccatgtgctggaaatggatgcatctgcctaccttgagctcgacaatgagttgattgcaactggaaacgtcataaaggcaaaaggcagtttatttgatttnccgccaaggccgtgctttccggcaaggactagaagacgggatagagcaaaaccggtgtgtcgga

SEQ ID NO: 5272 - DNA, 660 bp, Bacillus clausii
  misc_feature (1)...(660): n = A,T,C or G
ggaaaagcatggttatgactttattggaaattcgaacagaagataagctgccctggaatatttaaaaacccatacattaagctgatttaaaccaattttttgcggagagccgtcttaaaccactggcgcttaatgccnttgttttttttaacaatttaggcgaagcagcctataaggaaatgatgaagcagttttcaagaaatgcttccatgtcgccgagcagctcaacatcccttatatcgtagcggttccacttataacaaagcagccgcttttaagagaggaaatccgtaaaagctgtgtcgagacattgtttactttggctgaggaggcgcagcagttgaaagtgnagnttgcccttgagtttgttggccatcctgnntgcactgtcnataagtttgccgaagnttaccgcattcantggagnngttnattggggaaaagttggaattgtgtttgnttgtttccanttttcatgcnatgggtttcggaccttggagatttacaacaggccgatggcggaaaaattctttattgttccatattgaacgacacagatgattttcccgttggcgcacttcgggatgaacaccgtgtctggccaggcgagggagccattgacctcgctggtcagtttaccgcattaacagcgatcggtta

SEQ ID NO: 5273 - DNA, 631 bp, Bacillus clausii
atgaaattacaattagcattagatcttgttaacataccggaagcgattgagcttgtagcggaagttcaagattctattgatgtagtagaaattggaacgccaatcattaatagcttaggtcacgaagctgtacgtgcaatgaaaaaggcttatccaaacttaacagtcctggcagacgtgaaaatcatggatgctgctggatatgaagtacaacaagcatcagctgctggagctgacatcgtaacgattctaggtgcagcagaagatagctccatccgtggtgctgttgaagcagctaaagaagaaggaaaagaaatcctagttgatatgattgccgtgaaggacatcgaaacacgtgcaaaagaattggatcagctcggagtagactatatctgcgttcatactggatatgatcttcaagcagaaggaaaagattctttcgaagatcttcgcaaaattaaaactgtcgttaaaaatgcaaaaacagcgatcgctggcggtatcaagcttgagactcttccagaagtaatcaaagctcaaccagaccttgtcattgttgggggcggcattacgtctaaagaagataagaaaacagctgcacaagaaatcaaagcacttatcaaccaagggt

SEQ ID NO: 5274 - DNA, 531 bp, Bacillus clausii
atatgctagttggcccagggctggtctttttaattttcactgtcgtttttcctcttttgtttatgatcgggcttgcttttacaaactataccctttacaatgccccaccacgaaacttgcttgactgggtagggtttgaaaattttgtccagcttgtcactgtaccgatttggcgagaaacattttttagcgtcttttcgtggacgttaatttggacatttgtcgctaccacatgccaagttgggctaggcttattattagcgattatggttaacgatccacgaattaagtttaaaaaattcattcgtacgatccctatcctcccatgggctgtgcccgcctttgtgaccattttaattttttcagcaatgtttaacgacaattttggtgcaattaatcgggatatattcatccctttgtttggccactgttttccttggctgaccgatcctttttgggcaccgtttgcgctaattatgattcaaacatggctcggctttccgtttgtattttgcttctgttcaccggtgt

SEQ ID NO: 5275 - DNA, 426 bp, Bacillus clausii
gcagttagttacgattttttcctttgtatacgcccattggtaccccgatccttatggcgttgactgctaaggtggaaagacaaaaactgctggtttgggcgctaggtatcttcgtagttgggaatgtactgtcattcgttttgcctggctatgcatcgtttctcgcagctcgcgtcattatggctctaggcgcaggaatggtcgtggtaaccgctttggacatcgccgcgaaaattgccaccccaggcaaacaagccagcgcgattgctacagtagtgatgggctttacggcttccttgattatcggcgtgccgcttggacgtatcgttgcagcacaattcggatggaaagctgtttttggtatattggcactggccggtctggtggctatgttcgttctgtacgccatcgttccccgagttcaag

SEQ ID NO: 5276 - DNA, 552 bp, Bacillus clausii
ttgtccaagcaacttgctttcttgaaaacggaaacgtagcgctagggcttgcgattacctttttctggctcggcggatactcgatcgcctacacctacatttcaccgtatctacttgatgttgccggattgaaagaagggatgctgagtggagtgctgttggcgttcggcatcgctagcctgctcggatccaaatttggcggtttcagtacggataaatggggggtattcccgacactgtcagggggaatgctcttgcacgtcatagcgctgcttctcctctctttaaccgttacctatacgcaagcatggctgccgattgtcatcctcttgattttgtggtcgtttgcggcatggtcttccggtccaacgcaacaagtcaatctagttcggattgaaccgaattattctggaatcatgctaagtctgaaccaatccatgatgcagttgtccatggctgcgggcgctgcaatcggaggcgtcatgatcaaccgtgtgtctctatcatccattacatgggtcgggatggttggagtcgctattgcgatcgtgg

SEQ ID NO: 5277 - DNA, 861 bp, Bacillus clausii
atgatgtggtccattgtattgccaagtctagcgataattgcagtgacgtatgcactggctcgtttcagcttcgggttattcttgccagacattgctggttctctcgatctaagcgcagcaaatggcggatttattggcgcacttgcgtttgcttcctacacacttgcgctagttgcttcttctcgtttgatccgttatttcgggcaatacaacattatgttggctgctggtatgagcgctatcgtcggcatgcttggcattgccttttcgccaagcttcgcttttttggccatcgccgtatttatcgctgggttaggaagcggtctcgcttcccctgtattgagtcaagtggcgtatgccaaactgccttccaaccagttagatcaagccaacacttggatcaatagtggcacaagcattggtctcatcataaccgggcctgttgtattattgttttccgaacattggcgattatcgtatcttatcttcacggttattggaatcattgtcttaatatgggcagcccgttcgatttcccctgaccaaaacaaaacgaagcacccaacgcacatttcaaatgggcgttctatactttctagtgcaacgcatttgctagtttcatctttcatcattggcttaagttcctcgatttactggaccttttcaaaaagctacctaacatcggtcccgtttacaaccgcaaacgagagtattgtcttttggatgcttatgggaagtgccggcattttagggggaattgctggaggggttattcaaaaaatcggtttaacttggtcttaccgattagccttactgattatgctcgccttccttatcatcctgctcttgccgaaccggatc

SEQ ID NO: 5278 - DNA, 636 bp, Bacillus clausii
  misc_feature (1)...(636): n = A,T,C or G
cggttttgcaagcgattttacaaattatgaatgcagcgggttcaggtgtatttaatgcactccctcttatattcgcagtaggtatagcgatagggttagctaaaaaagaaaagggccctgctgctttagcggctgttgttggttatttcgtgttaattattacaattaattctttattaacgattactggcgatatagccccgccagatgcggaccctagggctttcgggcaaggctcacagtttggcgtcttgacgcttcaaatgggagtgtttggaggaattttaacaggcattgtcactggtttcattcataatcgtttttacaatataaagttgcctgaaatgcttgctttctttggaggatctaaattcgttccaattgttaatacatttgtattcctcattgttggagcaatgatgtatataatctggccgtttattgggagtggcatcgcttcatttggagaatttgctacagggctaggcacactaggatcatttttatatggcttgatgttacgtacattgtatttgtttggtcttcatcatgtcttttatttaccgttctggacaactgcggcgggtggcacgttanaaattgggggacaagtgtacaaangattccaaaccatct

SEQ ID NO: 5279 - DNA, 342 bp, Bacillus clausii
  misc_feature (1)...(342): n = A,T,C or G
gtgtttagtanntgtcgtggcgctggcancatgctcatcntcggaaacggaagtggccgaaggacaaggcggcgagaaancggacttanaaagcggccaaaccgagctgagagtcccatggtggggctcgcaagcacggcatgaccgcacaatcgaagcgattaaactgtttgaagctgaaaatccggatatcgccgtcacgaccgaatttactggctgggatggttattgggaacggatgtctacgcaagcggcaggcagaaacttgccacacgtcattcnaatggatttacactacatcaacnaatatgtctcccgtgatttgcttgttgatcctaaccc

SEQ ID NO: 5280 - DNA, 399 bp, Bacillus clausii
ctgacatctggcaagggatgggttggggagcaattttatacttggctgcattaacaacgattgatgactctctctatgaggcggcaaaaatcgacggagccaatcgttggaagcaaacgttgcacatcaccattccaggaattcttccaacgattattacattgttaattctaaatattggtagttttttggctgtcggttttgagaaaattttacttatatacaacccattaacctatgaaacgtcagatgtcatttcaacttacttgtatagggtaggcctggaatctagcaactttagttatgcgacggcgattggcttatttgaatccatcataggcttagtactgattttaacagcaaacggtatttctagaaagttaacggaaagaagcttgt

SEQ ID NO: 5281 - DNA, 555 bp, Bacillus clausii
aatccatccagtacaagatttttaaagtattcaatgtgtttattttgctagtcattgtcttttgtacgctttatccttttttaaatgtggttgcacaatcttttagtagtgaagcttatattagcgctggagaggttaatttaattccaaaaggctttaatattgaaacgtataagacagtaattgaagatagaatgttttggattaactataaaaatactgttgtttatacagtggttggaacaggcatttccatgtttttcacgacgatctttgcctatgcactgtccaaaacaccgttggttggccgcacgtttttaacattatttgccgttttcacgatgttttttaatggaggtttaatcccgaactatctcctaatcaataacttagggttccataataccatttgggcgattgtgatccctggagcgattagtatttataacatgcttattatgaaatcgttttttgaaaatatgcctgatgagctagaagaagcagccgcaatggatggaatgaatacgtatggaattcttctcaaaatccgttttg

SEQ ID NO: 5282 - DNA, 442 bp, Bacillus clausii
  misc_feature (1)...(442): n = A,T,C or G
atggatgtagtaagcataggtgaaacaatggtgttgtttgctcctaaagaggacggacagcttcgatacgcttctaatttttcagcccgtgtggccggcgcagagacgaacacgttgatcggattagcgaaacttggtcataaaacaggctggattagtcgagtcggcgctgacgagttaggagcgaaaatcatccaatctgtccgtggtgaaggcgtcnatacaacgtatgtaaccatggatgagcaggctccaacggggctttttttgaaagaacaaatgactgcgaagacggcgaatatcctctactaccgaaagggttctgcggcgagccgtttagagtctgccgatattgatgaggactacgttnagaaagcgaagtttctatatttaacagggattacgccattattgagcaaatcatgcgagcangcaacgttcg

SEQ ID NO: 5283 - DNA, 314 bp, Bacillus clausii
  misc_feature (1)...(314): n = A,T,C or G
atgacatttaagtggtacggagaaaacaacgacagcgtaacactggagcaaatcaaacaaatccctggagtaaaagggcttgtttgggcgttgcacgataaaatggctggcgaagtatggcctttggaagacatcatgaaagtaaaggaacaggccgaccgttatgggtttcatttagacgtggttgaaagcattaatgtccacgaagatattaaactaggcttgccgacgcgtgatgcatacattggagcaattatanagaaagcattcgttatgtcgccaangtcggtgcgaangtgatcttgttncaactt

SEQ ID NO: 5284 - DNA, 385 bp, Bacillus clausii
  misc_feature (1)...(385): n = A,T,C or G
atgaaacccataacggtcggcctgttcctttactttcatgatgtcttccaaaggccatacttcgccagccattttatcgtgcaacgcccaaacaagcccttttactccagggatttgtttgatttgctccagtgttacgctgtcgttgttttctccgtaccacttaaatgtcattgtcacttgctctcatcctctctatcaaagattaacactgctntacggacattagcaggctccttttcaagcaactcgattgcctttttcacctcatcaaaatcaaaacgatgggatataatcgaggctgggtcaaccttttgttcattcacttgcctaataacgccgggaaattggtttgtttgcagccttgagcntgctnacagccaat

SEQ ID NO: 5285 - DNA, 680 bp, Bacillus clausii
  misc_feature (1)...(680): n = A,T,C or G
atgggaggtgcccaantcaagttnntatttcgttttttcgtttccttgaaaatggggttcgttctttttgggcggcattcacgactgtttcaaacggcatgcagcagcgcagacacgggtacagaggagcttgaggaagaagtgattaccgtcgaaggacggacgacggtcacttattggcataactatactggaaaaggactggaagccatcgaacaggtggcttctgactttaatgaaagtcaggacgacatttttgtgcaaccgatttatagcgcctcttctgaaggagacgaccagcggcttttgacagcaattgctggcggcaatcctccagatcttgcccatttcgaccgtttcaaagtcgcccaatatgcggcagagaattcccttgaaccgctgacgccttttattgaagccgatcactacgatatgggaatttattatgactatgcggttgaagaatcgacttacgagggcgacatttatgccatgccgctgacaaccgattcaaggctgcttttttacaataaagaccgctttgtcgaagcggggctagaccctgatcatccgccatcaacgattcaggaattagaagaggcgattgaaaagctctcaacgattgaagatgggcgcgtgcaggagcttggtatggtgccatggacggcgcaaggttggtt

SEQ ID NO: 5286 - DNA, 1318 bp, Bacillus clausii
atgagctattttcctgctgtaaacaacatttcctatgaaggcgctaagtctgacaacccgtttgcatttaaattttacaatcctgatgaggtcgttaacggaaaaacaatggccgaacatttacgttttagcattgcctactggcacacatttacagaagcgttgtcagacccgttcggcgctgggacggcgataaggccttggaatgcgtacacagggatggacttggcaaaggcgcgtgttgaagcagcatttgagttcttcgaaaaaatcaatgtcccatacttttgcttccacgatgtcgatatcgcccctgaaggaagttctttgaaagaaacgtatgccaatttagatgtcatcgtcgcgatgataaaggactatatgaaagacagcaacacaaaactgctttggaacacagcgaataattttacacatccccggtttgtaggcggtgccgcgtcttccaatgaagctgatgtcttcgcctactccgctgcaaaagtaaagaaaggcttggaaatcggcaaagagcttggcgctgaaaattatgtattctggggtggccgcgaaggctatgagtcattattaaatacggacttaaagcttgaaatggacaatctcggacgctttttccatatggcagttgattatgcaaaagaaattggctttgatggccagtttttaattgagcctaagccaaaagaaccgacaacacaccaatatgattttgacgtggctacaggatatgcctttctccagcattatgggctccaagattcatttaaatttaatattgaagcaaaccatgcaacccttgcagggcatacgtttgagcatgagctgcgttatgcccgtattcatcatatgcttggttcagtggatgcaaaccaaggagaccctttgcttggctgggatacagatgagtttccgacagacctttattcgacaacgctagcgatgtacgaaattttgcaaaacggcgggcttggcagaggcggcttgaactttgacgcgaaagtacggcgtggttcatttgaagctgatgacttgtttttcgcccacatcgcaggcatggacagttttgcaatcggcttgaaagttgcgcagcagcttatagatgaccgcgtccttgagcaatttgtcgacagccgttatcaaagttataaggaaggaatcggccgccagattgttttaggaaatacggattttcaccaacttgaagcgcatgcgctgtcacttggcgaaatcaaaacccgttcaggccgtgtggaacggataaaagcaatcattaacctgtatttattaaatgcatttgcat

SEQ ID NO: 5287 - DNA, 789 bp, Bacillus clausii
ttgaaacatgtcattggtgttgatttaggcacaagcgcagtgaaattgcttgtcgttaacgagacgggtgaagtggtcatggaagtgtctaaaccatacccgttgtctcaccctaaatcaggatggagcgagcaagatccaaacgattgggtcagggaaaccgttgctggattatcggacatagcagcagccttgccacaagcaacgactcaaattgagggaatcagtttttcggggcaaatgcatgggctcgtcttgctcgatgaacaaaacgaagtgttgcgtccggcgattttatggaatgatacacgcacctccccgcaatgcaaagcgatttacgaaaagctaggcgctgaaaggctgcaacaattagccaaaaatccagcgcttgaaggttttacgttgccaaagctgatgtgggtacgggagcatgaaccggaagtgtttacaaaagcggccaaattcgtgcttccaaaagactatttgcgcttgaagttgactggtgcattgcataccgactattctgacgcagcaggtacactcttgcttgatatcgaaagaaaaacatggagcgaaccgctatgttcggcatttggcattgatccatcgctttgtccgacgctagtggaatcacacgcttgtgtcggccagttgacggaagaaatcgcattagcgacggggctgccaagcaaaacacccgtttttgctggaggagccgataatgcgtgcggagcaataggagctggaattttagaaaacggcaagacgctcgctagcattggcacgtca

SEQ ID NO: 5288 - DNA, 735 bp, Bacillus clausii
  misc_feature (1)...(735): n = A,T,C or G
ttgctcaggatgtaattaaagggcttggtggaaaagaaaatattatatcgatggcacactgtgccacacgtcttagactgattgtcaaggatcgggaaatcattgatgatgactttattgagaacgtggacaaggctaaaggggtcttttttacttccgggcaatatcaaatcatttttggaaccggtaccgtcaatagggtatatgaagcgatgattggagaggacgtctcttctacttccaaagcggaattgaaagagaaagcttctgagcaagatgatcatttctttaaacgaatgatccgggtgttcggggacgtattcgtaccgattatcccggcattggtcgctactggattattcatgggtgtcagaggccttattacgcagcctgccatcctcgcatggtttggacttactccagacagcatttccgacaattttttagtgttcacgcaaattttgacagacactgcttttggtttcttgcctgtgctcgtatgttggtcaaccttccgggtatttggcggatcaccgctgcttgggattgtgctcggcttgatgctcgtcagcccttccctgccaacgtcctgggatgtcgcccagaatgtccaggaaccgctaatgttccttggatttattaaagtagccggttatcagggatcggtgttgcntgcgtttattatcggtatagttggtgcgttgttagagaaaagaatccgcaaactcgttcccn

SEQ ID NO: 5289 - DNA, 687 bp, Bacillus clausii
  misc_feature (1)...(687): n = A,T,C or G
acaatccgatcattccagggttttatcctgacccgtcgatttgcagggtaaacgaagactattatttagtcacgtctacatttgaatatttccctggcgtgccgatttttcattcaaaagatcttgtcaattggaagcagattggccatgtgttagatcgtccagagcagctcaatcttgatggcaccccgaattcacggggcatttatgcgccgacaatccgttacgataacggcttgttttatatgattaccacgtttgtggaaagccaacacggcgcaagacgcaatttctttgtaaccgcaacagacccggctgggccttggtcagacccaatctggataaagggggcgcctgggattgacccatcgttgttttttgatgatgatggccgcgtctattacacaggcaatcgtgtttcccctacagggcaaacgcacgccaagcatatgggaaatttggctccaggaaatcgatcccattacagggccgcctgcttggcgaaccgactggggatttgggatggtgcgctaaaaatagcccatgcccaggaagcaccccatctttataaaaaaggcgattactattacttgtttattgccgaagggggaactggattcacccatgcggtgacagttgcgcgaagccgggagattgccggnccttatgaggcgaattggcgcaacc

SEQ ID NO: 5290 - DNA, 269 bp, Bacillus clausii
  misc_feature (1)...(269): n = A,T,C or G
gatgtgcgaagtgaggtgacggatgcttgcaggcgtgacgggctttcgttccnccnagcgttttnaaaagggatgttcacagtaccaggcgatggctgcattgactttacaaaagtataccgacgtcttattcgagggggctacgatggctggattgtcgtanaggcggagcaagatccaaacattgcccacccgctggagtacgcattaaaagcaagacgctatattgattcctatttgctggcaggcggcgagaagcaggcaaccat

SEQ ID NO: 5291 - DNA, 612 bp, Bacillus clausii
ttaacacgttatttgtttcaaccgtcacggttattggcgtgttatcttttgttccccttgccggatttacattcgcgaaatttcgttttccaggaaaaaacatgctgttcactgctttgctgttaacgatgatgattccttcacaaatgagctttgtcccttctttcctgctaattgccgagtttggctgggtcgattcgtacaaagcgttgatcattcctggcctcgccagtgcatttggaatcttttggatccgccaattctgccaggacgcggttcctgatgaattgctcgaagcaggaagattggatggctgcaacacgttccgtctatactggaatgtagcgctgccctcgctccggccagcgctgacctttctcggcatctttacattcatcggtgtgtggaatgactatttatggccgctcgttacgatcaactcaccaagccgttatacactacaagtcatgctcgcacaactgaacggggtttatgacaccgattacgcgatcatcatgacaggcacattgatggcgacattgccactcattatcttattcatcatcttcagcaagcaatttatgaaaggtgtcccggaaggagctgtgaaag

SEQ ID NO: 5292 - DNA, 405 bp, Bacillus clausii
  misc_feature (1)...(405): n = A,T,C or G
gaaatgaggagacgagtgtacgccaagcaatgccgctgccggttttgcaaacctcaattcccaggaagtggtgtttgttaaaggaaattccggcaagcaacccagtagcattaacctttgattaatgggcctaatcctccgtttactgaacaagtattgacgaaaanctcaatcaacttcattttcctgctacgttcttcgttttaggaaaacgggttgaagcgaatcctgaattgttggtgaggttaaatcaagcgggccataaagttangaaaccatacgttttcacaccccaaatttatcctgaaggtagccttgagcaccttgaagcagaagtgacgaaaacggaggaatttatagaagcgacgattggctaccgacctcgtttgtttcggccgccctatg

SEQ ID NO: 5293 - DNA, 495 bp, Bacillus clausii
catgttggacgttcttaaacgccaagtatgggaagcaaatcaaagtttgccgaaacacgggcttgtcacattcacgtggggaaatgccagtggcattgaccgtgaaaacaaccttgttgccattaaaccaagcggattagattacgacgagatgcatgtagaagatattgttgtcgttacccttgatggtgaacttgttgaagggaagctcaacccctcatcggatcttgagacacatctcgttctatatcgaacctttccagatatacaagggattgtccacacccattctcggtgggcaacaagttgggcacaggcgggcatgtcccttcctccctttgggaccactcatgcagactatttttacggggaagtgccatgtacgcgaaaaatgacgccagaagaaatcaatggcgcttatgagaaagagacgggccatgtaattgccgagacattccgttttcaagatccacttgagacacccgctgttttcgt

SEQ ID NO: 5294 - DNA, 707 bp, Bacillus clausii
tattaaaaagccggtggaaaattgcacttggcgtaataccagccttgcttgtttattgtatctttagcatcattccgatttttatctcgttctattactctttcatgtcgtggaacggattttcaccgatggactatgtaggtctagcgaattttagggccattcttagtgattcagtgttttggctgtctgttcgaaacaatttaattgttgttgccgcttctatatttgggcaaatcccgatagcgcttgtgcttgctttgttgttaaaccgcaaaataaaaggagcgaagttttttcggacgattgcctttctccctgtcgtgatatcaactgttgttatttcgctgacgtggcgaatgatttacaacgtggagcaaggactattaaatcatctactaaataaccttggtctaagcgcgcttgcgcaaaattggctcggcaatcctgattatgcgatgtacgcgattgccgccgttattatttggcaatttgtcggtctttacttcatcatctttttatctgctttgcaaacggtaccgaaagacattttggaagctgcagagctagatggagcaacagaatggcagaaaacccgctatgttacactaccatcgatctggggtgtcattatcatcgcagtcgttctctgtattagcggcagcttaaagacctttgacttgatctatgtaatgactggcggcggg

SEQ ID NO: 5295 - DNA, 534 bp, Bacillus clausii
atgcctgtcatgattattcctttaattgcaaccgctttctctggtttgctcatgttgacaatcattggccagcccattgccaccatgcaaaactcactgctaggtctgttgcaatcaatggaaggtggttcgcgcttctttatggggacgatcctcggcgcaatgtccagttttgacttcggcggtcctgtcaacaaaacggcctcgttatttgccgatgggctgcttgtagaaggcatttatgaaccagaatcagtaaaattcattggctcccatggtgcctgtcttcggtattgctctatctttcctatttacaagatacaaatatacaaaagcagaaaaagaaacattaaaagcagccgtgccaatgggcatttgtatgattaccgaaggggttatcccaattgctgcgcgggacttgatcccgcgttgtcgcttcgtgctcatttggctcagcaattgccggcgggctttcgatggtatggggagtcggaagcactgtgccacatggcggtttgtttgttgtaccactga

SEQ ID NO: 5296 - DNA, 601 bp, Bacillus clausii
atgcgcttgccgccattaacgaaaatgcagttcattcatcgccccaatcgttttgttgtcgagttaaagcgggctgacacaggggaaagcgtcctggcccatttgcctgatccaggacgtttgcgtgaattgttagtagaaggcgccgtcatttgggcggagcctgctgttgacccgttacgaaaaacggcgtggacagctgtgctatgtgagacgcctggcggtgaccttgtttcattgaaaacgacttttgccaaccaattagtagaagaggcgctagcctcccattcgcttgaagcatttagtggctggcagctagaaaaaagagaagcaacaataggtaaatcgcgctttgattttttgctttcgaaaaacggacggacgctggtgcttgaagtaaagagtgtaacgcttgctcgcggcagcaaagggttttttccagatgccgtcacgaaaaggggcgcaaaacatgtacgggaattgactgctttgaatttgttgcccgagtatgagagcgcgattctgtttgtctctcaacatagcaacattagcacagtggaaatggaaagcagcatagaccccgattttgccaaagcgatta

SEQ ID NO: 5297 - DNA, 717 bp, Bacillus clausii
  misc_feature (1)...(717): n = A,T,C or G
tgaaagcagcacagttatacgagctcatctctactgaaatggacgatgcttataacgaacaattgaagacgattttgcttcagcctgaaatggacaagaattatggcgatgagttggctattgtgtttacaccgctccatggcacagcgaatattgcggttaggcgcgccctaaaggagagcgggtttacaaacgttacagtggtcgctgaacaagagcaacctgatcctgatttttcaactgtttcttcaccaaacccagaggaacatgcagcctttacattggcgatggagtatggggagcgccaaggggcagaccttttgcttgctacagacccggatgcagaccgtgtagggcttgcagtgaaagatgacgaggggaactacattgtcttgactggaaatcaaacgggcgcgcttttgcttgactatcttctcgaaacacgccagcaaaaggggactcttccgcaaaatggcgtagtcctcaagacgattgtcacgtctgaactaggccgagcagttgctgacgcttacgggctgacaacgattgatacattaacaggcttcaagtttatcggcgaaaagatgggcgaatatgaacgttccggtgaacatacatttttgntcgctatgaagaaagctatgctattaataggtgattcgtccgcgataaagatgctattcagcttgctgtttgctgctnnttggactccttata

SEQ ID NO: 5298 - DNA, 429 bp, Bacillus clausii
gcggttatgtgctaacgaaagaggcggcgcaacctaaggtgttgattggccgggatacgcgtatttctggagaaatgcttgaggcttccctagtggctggtttgctttcaattggcgctgaagttatgcgccttggagtcatttcaacccctggcgttgcgttcctgaccaaacaactgagcgcaactgcgggaattatgatttccgcttctcataatccggttgaagacaatggcattaaatttttcgggtctgacggatttaagctgcttgattcacaagaagaggaaatagaagcactcattgacggcgaagatacgatgcctcgtccggttggtggcgatgtcggtcagttaaatgactattttgagggcgcccagaaatacatgcagtttttaaaacaaacggttgagggcggttttgaaggaa

SEQ ID NO: 5299 - DNA, 334 bp, Bacillus clausii
  misc_feature (1)...(334): n = A,T,C or G
atgtgtatttagtccgccacgcccattcaacgtacacagcagatgagcttggaaggccactgtcagaaaaagggatggccgctagcgagaacgtaagaaggctttttgcaaggaaaaaaattgacgttgtcctttccagtccatataagcgtgcgattcaaactgtagaatgtgtggctgaaggaatcgggaaagaagtaatcataaaagacggctttaaggaacggcgtttgtctgaaaagccgatggnggactttcaagcagcgattgcaaaagtttgggaagaccctacgtttttttgggaagggggagaatcgaacgtagccgctcaaaa

SEQ ID NO: 5300 - DNA, 873 bp, Bacillus clausii
ttaccgcagccggacataccgcattttttctgtatttaatattgtctttttgcttgtgcttagcgcgatttgcatcatgccgcttatccatatactcgccgtttcatttagttctcctgctcccgccaatgccaatcttgtccgtttttggccagttgactttacggtgtctgcttgggagcagacgtttggcaaccaaaactttttgcgtgcgttatggaatggcgtctttcgtacattcctcggcaccgtaatcagtcttgtcacgattacacttgccgcttatgcactttcaaaagaagaccgggagtttaaaggcagaaaaatgtacatgtatgcacttgtgtttgtcatgctttttaatggcggccttattcccacgtatatcctcgtccaaaatcttggcttgatcaatacgatttgggcacttgtcctacctggagctgtaaatgtatttaatctgattttgttgttaaatttttttcgaacaggcgtgccgaaatcactggaagaggctgcttttattgatggggcgggccacttccaaatattatttaaaatttatttgcctatctctttgccagcattggcgacagttgggctgtttaccatggtaggccaatggaattcatggtttgacgggctcatttatttgactgactccaccaagtatccgttatcgacatttttgcaaacaattattgttcaaaatgatttttcacagcttaatgtgaatcctgatgaagtgaaagcattgtctgagaggacagtccgttctgctcagattttcattggcgcactgccgattatcattgtatacccatttttgcaaaagtactttgtcaaagggattgtgcttggctcggttaaaga

SEQ ID NO: 5301 - DNA, 677 bp, Bacillus clausii
acgcttgtcatttctagttttaaaattgtctttcaactagtgattccgatcatgtttgccttgctgttaaatgaagtaagggttatggcgttaaaacgatcgatccaaacactcgtgtatttgcctcattttctttcttgggtgattttagggggcattttgctagatttgttgtcagtcgacggcggtttagtgaaccaagtacttgctagcatcggcatcaatccaatcttctttctaggcgatggcgactggtttcgcgtaaccgtcattgccagtgatgtctggaaagacttcggtttttcggcgattgtctttttagctgcgcttgcagggattaacccgagtctgtatgaagcagcagtcgttgacggggccaatcgttttcagcaagtgctttatattacgttgcctgcgcttttgccaattacgattgtagtagcgactttggcgctcggcaatattttaaatgcaggatttgaccaaatctttaacttatataatccgcttgtgtatgacaaaggcgatattattgatacgtatgtgtatcggcaagggttaattggcggcaattttagctatgcaactgccgttggcttgtttaaatcagtcattgcattcatcttgattgtgattgggtatcgccttgcctacaaatacgcaaactaccggatttt

SEQ ID NO: 5302 - DNA, 456 bp, Bacillus clausii; identical to SEQ ID NO: 5208

SEQ ID NO: 5303 - DNA, 486 bp, Bacillus clausii
ttccagccgcagcgctagcaatgtaccatacggcgaaaacgaaacgcaaaaaacaaacagcgtcgttgctactcgctgcaggatttgcttcgtttttcacaggtgtgaccgagccatttgaattcgcgtttatgtttgtagcacctgttctttatgtaatacacgcggtgcttaccggcttatcgttggccattgccgcctattttcagtggacagctggatttggctttagcgccggactaattgactttattttaagctcaaggctgccgctagcgaaccagccatggatgctgcttgtgcaagggcttggctttgctgtcgtttattacgcgctattccgctttacgattgtcaaatttaatttgatgacgcctgggcgtgaagaggagaacgatgaagaaaaagtgccagaggatactgaaaacgctcaagacaagagcaagtatacagcgatggcggccatgatctatgatggactaggcc

SEQ ID NO: 5304 - DNA, 375 bp, Bacillus clausii
gaaggcgggcacaacaactactttgccggctccagcacaccaaacaccgctgctcgtcaaagcaggagcaattatacctgtaaacgaagcaaaacgaacatttgccaaaaaagacaaggacaaacgcggctttttgctgtttcctagccgcggcgctgggcacacatcaaactacacaatatacgaagacgacggcattacgaaaaattggcagtctgcacacgcgcttgtctccatcgaaatgaccacaacagcggatgccattcatgtgaccacaaacgttgtttcaaaaggctactccctgccttataaagaagcacgttttaccgtcatgactgacgatagcagacctttatttgtaaacgggaaagaagt

SEQ ID NO: 5305 - DNA, 579 bp, Bacillus clausii
tggcacttgttctcttcagccctgtcatcggtaaaagattgttaaatgttatctactttcttccctatttaatgtctacggtggcgatagggcttctctggatttttatgtatgacccgataaacggtccgattaaccaattgttgcaagtatttggttttgatgcgatcccctggttggcggacgccaatgtggcgatgattgccattttaattgtcgttatttggcaattctctcctttttatatgattttatttaaagcagcaatggtagggattccaaatgaattgtatgaagcggctagcattgatggcgcaaatggaaggcaacagtttttttacatcacgttgccagccctcgttcctactattgtcagttcttccgttctcgccgttgttggttcactaaaagcatttgacattttttacattatgactggcggcggccctggaggggcaacagaaatattaggaacctatatgtacaagcaaggctttatccagtttagcatgggctatgcgagcacagtcgcggctgccatgtttattattgcctttatttgtgtagccatcatccaat

SEQ ID NO: 5306 - DNA, 242 bp, Bacillus clausii
atgaaaattgttggtgttgcggcttgtacggcagggattgcccatacatttttagcgaaagaaaagcttgtaaaagcggcacaagaagcagggcacgaagtaaagattgaaacacaagggacgatcggcacggaagatgagttgacagcaaacgagatcaaggaagcggacgtcgtcatcattgcagcagacattagcatatcggggcgcgatcgtttcaaagagaaaaaagttatccgcat

SEQ ID NO: 5307 - DNA, 322 bp, Bacillus clausii
atgaatattattcacgtaaaaaattatgaagaaatgagccaaaaagcagcagcactcttgtttgagcgaattcagcagtctccaaaaataacgctcggacttgcgacagggggcacaccggaaaacacgtataccgctttgattgcaaaagcaaaggaaaacggccaatcattttcacatgtgcaaacgttcaatttagatgaatatgtcggcttgcctgcagaggataaaaatagttaccgccactatatgaagcaacggttgtttgatcatgtcgatattccaaaggaaaaaacgcatttgccaaatggaatgggctccg

SEQ ID NO: 5308 - DNA, 143 bp, Bacillus clausii
  misc_feature (1)...(143): n = A,T,C or G
aagaagaatgccgtgcttatgaaaacatgattgccgaggcgggcggaattgacattcaacttctcggtatcggcagcaatggccatatcggttttaatgagccanggacgccattttcgagcagaacccatgttgtcgagttg

SEQ ID NO: 5309 - DNA, 398 bp, Bacillus clausii
atgaatacaacacagcttaaacaatggttaacagaactggcggctgttattgctgacaacagagacgaattgtcgaaattagaccaagcattaggggatggagatcatggcattaacatgcatcgtggctttcaagcagtgcttgccgagctgccaaacataaaagaggaggatgaaccggcggcattgctgcaaaaagtcgcaaccattctcatttcaaaagtaggaggagcgtcaggacctttatacggtaccgcgtttttacgtatgtccgctgcatgcaaaggaaaacagacacttgatgatgagacgatggtggttgctctcaaacaagcagctgaaggcattgcccagcggggaaaggcagccccgggagaagggacacttcttgatgtttg

SEQ ID NO: 5310 - DNA, 435 bp, Bacillus clausii
atggccgatcattttaacagaggaggaaccggtatgaatacaacacagcttaaacaatggttaacagaactggcggctgttattgctgacaacagagacgaattgtcgaaattagaccaagcattaggggatggagatcatggcattaacatgcatcgtggctttcaagcagtgcttgccgagctgccaaacataaaagaggaggatgaaccggcggcattgctgcaaaaagtcgcaaccattctcatttcaaaagtaggaggagcgtcaggacctttatacggtaccgcgtttttacgtatgtccgctgcatgcaaaggaaaacagacacttgatgatgagacgatggtggttgctctcaaacaagcagctgaaggcattgcccagcggggaaaggcagccccgggagaagggacacttcttgatgtttggtcc

SEQ ID NO: 5311 - DNA, 576 bp, Bacillus clausii
  misc_feature (1)...(576): n = A,T,C or G
atcggaagaagcaaatggaaggggggaccaaagtgaagaaaacgcaatcatttggaaagatcatgttgtatgtcacgttaatcattgcttcgttgctggcggtttttccgttttattggatgtttgtcatggcgaccaacccaagccatttaattaaccaaacaccgccagtagttattccaggaacggagctagtccgcaattttcaaaatgtcatggccaatgttgatttttttggcgcatttaaaaattcgtttattgtctcgatttccgttacgattggaacgctgtttctatgctctctcgctggctttgcatttgccaagctcgattttccatggaaaaagttttggtttgctgcgatcctcgtgacgatgatggttccaccacaacttgggttaattccccagtattttattattacagagctaggctggctaagcgatttgcgggcagtcatcgtgcctgggcttatcaacgcgttcgggattttttggatgangcaatacattaaggattcgattcctgatgcattaatagaagcagggaagatcgatggctgctctacatttcagg

SEQ ID NO: 5312 - DNA, 520 bp, Bacillus clausii
  misc_feature (1)...(520): n = A,T,C or G
atggacagccgaattaaatggatcgatgcggcgaaagggcttggcattgttcttgttgtcatgagccatgcgcctatcgacgaaacgcttaaagcctttttgtttgcctttcatatgcctttatttttttactngtctggagctgtatttcnncctcattctatgagtattggggcctttattaagaaaaaancacgaancctattatggccatacttngttttttcagcggctncctatctcatttggtacagtatgacaagacattttcctttcactgccggtgaagacgtcaatccgattaatccatttgttggcatctttttgtcaacacctgggaattaccaacttacgtacaatccggccatttggtttctcacttgcctatttgttgtcgaattgctcttttttctttactatcgcctgtcaaaagggagattcattgcgacgtttctcgtantcgctgctatcgccggttacgggtcgaccatgctttcgtttgcattgccttggaatgttt

SEQ ID NO: 5313 - DNA, 348 bp, Bacillus clausii
  misc_feature (1)...(348): n = A,T,C or G
ttatttgcctgttcntcataggattttcggccgcaaaaaggttcggaggaaattcgtttttaggtgctgccttagggatgntcatggttcatcccgatttattaaatgggaatgantatgctgtagcaaagctagaaggcactgtgcctgtttggaatatccttggctttaacattgagatggtaggctatcaaagtaccgtattaccagtattagttgcctcctatattttggctcaactggagaaatttttgcgaaagatagtccctaccgttttagataatttgctaacgccattattaagtctatttataactggtattttaacgtttacattcgttggaccac

SEQ ID NO: 5314 - DNA, 255 bp, Bacillus clausii
atcggctggccgttgatatcggcgcctcaagcggcagggtgatggctggcaaaataagcgagaccggcatcgatttacaagaggtctatcggtttgataatcaagctcagttgatgggcggccattattgttgggacgttgactacttgttttgtgaaatcaagcaaggcattcgagtggcagttcaatctggcttgcagccggttagcattggcatgaatacatgggcggtagattttgtccttctcgatgaaa

SEQ ID NO: 5315 - DNA, 423 bp, Bacillus clausii
  misc_feature (1)...(423): n = A,T,C or G
catgctcgaagtctgtccgacgatcagtgcccaaaaaccagagatngtggntgccccgctgtcaatggggaataaggaggacccagcgcggcttgtattcaaaggcaaagcaggccgtgcattgaatgcggctcttattgntatgggctctcgctttcgcttagtcgccaacgaggtcgaagcagttgaaaacccacatgagatgccgaagctgccggtagcaagcgtgctgtggaagccccttccttctttttcggaagcgacagaagcatggatttatgctggtggtgctcatcataccgtgttttcttatgagatttcaaaagaacaattggctgactgggctggccttatggggattgaatgtatcgtcattgatgaccattcaaatgttggccaggtgagaaaggaacttttttggaa

SEQ ID NO: 5316 - DNA, 591 bp, Bacillus clausii
actccaggggatcgtctcgattttgaaagacttggtccacattccgagtccttcagggtacaccgctgaagcgatcgcctatattaggcgatttttggaggatgtcggagtccagacgcaattgttaaataaaggtgcgctccttgctacgatcgaagggaaaaacaatgataagcagcggatgctcactgcccatgttgatacgttaggggcgatcgtgaaagacattaaagaaaacgggcgattggcaattgacaaaatcggcggatacgcgtttcactccattgaaggggaatactgcctcatccataaagccgaccaaagtacggtgtcaggaacgattgtcatgcatcaatcttctgtccatgtatacaaagacgcagacactgcaaaacggaatgaagaaaatattgaagtgcgaattgatgccgctgtccataatgaaaaagacacgaaagcattaggaattgccgtaggagatttcattagttttgctcctcgtttcgagcaaacgccatccggttttattaaatcgcgtcatttggatgataaagcgagtgtagccttgcttttgcagttaatgaaacaact

SEQ ID NO: 5317 - DNA, 222 bp, Bacillus clausii
ggagcatcgtgagcgttggttttgaaaaagtatttttaatgcaaaatcagctaaacatggaagcatctgacgtgatcgctacccatatttaccgaacgggaatcgctggtgcccaatacagttattcggcagcgatcggcctatttgaatcagcgattaacttttttattctgatttttgtcaattacacagcaaagaaaacaagccagacgagtttgtggt

SEQ ID NO: 5318 - DNA, 440 bp, Bacillus clausii; identical to SEQ ID NO: 5144
  misc_feature (1)...(440): n = A,T,C or G

SEQ ID NO: 5319 - DNA, 579 bp, Bacillus clausii
gagctgccttaaacggaatggcgctccacggcggattgaaagtatttggaggaaccttttttgtcttctccgattacctgcgtccggctattcgcttatctgcgcttatgggcgtgccagtcacgtatgtgcttactcatgatagcgttgctgttggcgaagacggtccaacccacgaaccggtagagcatcttgcggcattgcgggcaatgcctggcttgtccgttgtccgtccaggtgacggaaacgaaacagctgcggcttggaaaatcgcactagagtcgacagaccgcccaacggcgctcgttcttagccgccaaaacgtcgatacgttaaaaggtactgacaaaaaggcttatgaaggggtcaaaaaaggggcatacattgtatcggagccaaaagataaaccggaagttgtgctgttggcaactggttcagaagtgccgttagctgtaaaagcacaagctgcacttgctgatgagggcatcgatgcttcagtagttagcatgccgtcttgggatcgttttgaggagcagccacaggaatacaaagatgcggtcattccgagagacgtaaaaa

SEQ ID NO: 5320 - DNA, 678 bp, Bacillus clausii
attggctatggggaaattttattgaaatttttgaagtggttgaattcggcttgtatttgaaaaatacactgtttatcctgattcctgtcctaatcgggacagtgttgacaagttgcatgtgcggttttggttttgcacgccttcaatttccagggaaaaatatctggtttacactcattattgccacgatgatgcttccacctgccgtcacattaatcccaacctttatgctttggacggagcttggcgctattaatacgtattggcctcttgtgtttccaagcttttttggcggtggtggcttcttcatctttttaatgaggcaattttttatgagtattccccgggaattagacgaagcggcattaatcgatggcgccaattatgtgcaaatttttgtttttgtgctcctgccccttgtcaagcctgcgctactagttgttgcctttttcactttcacgaatgtgtggaatgactttttcggcccattgatttacttaaatgacgaatcattgtttacactggcactcggtcttttgcagctccaaggcacgtatacatcggactggaatttaattatggctgcggcgactgtcatgacgttgccggcgattcttgtcttctttcttgggcaaaaatattttgttgaaggtgttacgctaactggcatcaaaggat

SEQ ID NO: 5321 - DNA, 1122 bp, Bacillus clausii
agctctttcctttttcggagagcatgaagttgactatatgggagaggcagtccgcgctgcacataaagcgcttcatgaaaagacaggccaaggaaatgactttttaggatggatcgacttgcctgtcgattacgataaagaagaatttgcccgcattcaaaaagcggcagaaaaaattcgtcatgactccgatgtgctgctcgttgtcggcatcggtggttcgtacttaggagcacgcgctgcgattgaagcgttgaaccattctttttttaaccaactgccgaaagaaaagcgcaacgcaccgcaagtcatttttgtcggccagaacattagctcaacgtatttgagcgatgtgcttgatcttcttgatggcaaggatgtatcggtcaatgtgatctctaaatcaggaacgacaaccgagccggcgattgctttccgtgtgttccgcgactaccttgaaaagaaatacggaaaggaagaggcgcgcaaacgcatttacgcaacaactgacaaagagcgtggagctctgaaaacattggcgaacgaagagggatacgaatctttcgtgattccagacgatgttggcggtcgcttttctgtattgacagctgtaggcctcttgccaatcgctgtaagcggcttagcgattgaagacatgatgaagggagcggctgatgcaagggaagctttttcaacaggtgaattaagcgaaaatgcagcttatcaatatgcagctattcgcaacatcctttacaataaaggcaaaacaattgaattgttggtgaactatgaaccgcacctccattatgtgtctgaatggtggaaacaattatttggcgaaagcgaagggaaagaccaaaaagggatttacccagcatcagtcgacttttcaaccgatcttcattcaatgggccaatatgtacaagatggacgccgtgatttgtttgaaacggtacttcatgtcgaagcggtcgacaaacatattacgattgaagaagcagaaagcgatctggatgggttaaactatttagcgggaaaaacaatggattttgtcaataaacaagcgtttaaagggacaatgcttgctcatactgacgggaatgtgccaaacctagtcgtttc

SEQ ID NO: 5322 - DNA, 213 bp, Bacillus clausii
tccgcgtcacggataaagatgcagttaaaaacaatgccctcgtccaacaagaaatccaacgtgtggaggaggcaatggctggcgaaggccggatcctcgtacgcccgtctggcaccgaaccacttgtgcgggtgatggtcgaagccaaaaccgatgagttgtgccaacaatacgccaaccaaattgtcgatgtcgtaaaagaacagcttggag

SEQ ID NO: 5323 - DNA, 198 bp, Bacillus clausii
taaaaattatgacagtatgtgggtttggtcttggttcttccatggtcctaaaaatgaatttggaaagtgttttaaaagagttaggcatagaagccgatgtgtttactggagatgtcgcttctgcgcaaagtacgcctgcggactatattttcacgagcaaggagttaggggaaaagttgcaggagtcagctgggaaac

SEQ ID NO: 5324 - DNA, 555 bp, Bacillus clausii
ccccttggctcgtcggctttttactttttattggcgggcctattcttgcatcgctgtactttagttttaccgattatgccatcatggacacagccacttttgtcggcttgcaaaactttatcaaccttttttccgacccgctcttttaccgatcgctgtttgtgacattcgcttacgcagcgctcgccattccatttacgatgatcgtcggactgggactggcgatgcttctaaacatgaaaataaaggggcaagcatttttccgcacatttttttatgccccttcgattatttctggcgtctccgtcgcttttttatggatgtggattttaaacccgcaatttggcatcgtcaattccattctctatgaactattcggcattcaagggcctggctggtttaccgacccttataccgtcattccttccttcgtgctcatgcagctgacagcagtcggcagtaccatgattatttttctagcgagccttcaacaactgccaaaagaattgtacgaagcggcggccattgacggggccggagcatggcggcggttcc

SEQ ID NO: 5325 - DNA, 512 bp, Bacillus clausii
  misc_feature (1)...(512): n = A,T,C or G
caatcaaaaccgagtcacaagcaatctcgtatccgccgactttatggccagcgccatttgatnttgccaactaccgagaagtgtttgaattggtgcctttngtgcagttttactggaacacgatcgtggtgacggggctgacggtcatcggcactgtcgcttccagtgccattgtcgcttacgcgtttgcgcgaattaaaggaaagggcaggaacttctggtttattttattgctgtgcacgatgatgctgccgccccaggtgacgatgatccccgtgtatttgatttttacagagcttggctgggtgaacacattcttgccattggtcgttcctgcttttttaggaaacgctttctttatctttttattgcgccaattttttcgagctattcctaaagaattggaggaatcagctatcattgatggctgcagcttgtttggcatcttttggcggatcgtcntccccttatcgaaaccggcgctcataacggtcgcaattctttcatttatg

SEQ ID NO: 5326 - DNA, 672 bp, Bacillus clausii
atgccgaagaaacaggcagctcagctattgctattcaatgctggtcttacattacaagacatcattggaattatgccttgtttggcaaatgcaatcttaactgatgaacaaatcccagttacttgcgaaacagatattcatggtgcaatcacatccattatggttcaagcagcaactttgaacacgttaccaactttttttgcagatattacaattagacaccctgaaaatccaaatggagagttgctattccattgtggaaattttccggtttccctaagtgtggaagagaagcctaagttaaataaacactttttatttgaagatcattcacctggtacgcatgaaggggagataaaaggcggggagatgacaatcgcgcgctttgatggtgaccatggagagtattccatttttttagggaaagctaaaggaattgaagggccatattcaagagggtcgtatgtatgggtagaagtgaatgattggccgctatgggaagaaaaattagttaaaggtccatatattcaccattcaactggaattcatgccaatgtcatacccgttatatatgaagcgtgtcaatatatacctggtttaacaccagaccctgtggatcctacaacagaagagattcaagcttggttgcgtggcagtgacattaatgaataa

SEQ ID NO: 5327 - DNA, 414 bp, Bacillus clausii
acgggaaaaatggtggggctatgcattcatcgctccccagctgctgggcatgattgtgttttcattgcttccactcatattcgcgtttgccctcagtttcatgagttgggacggttttggggagcggacgtttgtcggcttagataattatattcaacaatttcaagaccctgtttttaggacagctttacgaaatacgacgctttattcgttgctcgtcatccctggaggcattattgcagccttaggcgctgcgcttgcattaaataaagtcaaaggcaaagatttttaccgaatgttgttttttatgccggttgtaaccagttctgtttcaatcggagttatttggatgtggcttttaaatggggatattggcttgatcaaccagctccttgcgatgatcggcattgatgg

SEQ ID NO: 5328 - DNA, 375 bp, Bacillus clausii
atggctggtaagttatcaatgacaacagcgctgtctgccaatatcgccgcaggtataagggcgacagcgctgtttttagcgccgctgatcgacaccgtgccttctaatgtatggccgccttcaatcaaaagcttttgcattgcaatcccttccttttttactggatcaaacgcacacatctttatccagtatagccagagtccgctaaaaaagtacgagtttccttatttttcgacattctgtttgttccaatctgctagaaatttttcaatccctttgtctgtaaggggatgccctgtcaactgtttaatgacgttcaatggaatagtcgcaatatgggccccacgttttgcagcttcgctcacatggacaggg

SEQ ID NO: 5329 - DNA, 622 bp, Bacillus clausii
atgaaacaggtggaattaatcaatgtaacaaagtcatatgacagagagacaaatgtcctaaatgaaattgatcttgaaattgagcaaggggagttttttgttttagttggcccttctggttgtggcaagagcacattgctcagaatgatagcgggcctagaagaaatgacgggaggaatcttaaaaataaatggcagggaagcaaataggcttgccccgaaagaccgcaacctatcgatggttttccaaaattatgcgttatacccccacttatccgtagaacaaaatattctatttggcttacatgcaaaaaaagtaaataaagaggaaagcaaacggcgtttgcaagaggcagctgagatgatgggacttacgacgctgttaaagcgaaagccgagggaactttcaggcggtcaacggcaacgggtagcgctagcgcgcgctgttgtcagtgaagctccattgtgcttgatggatgagccgctctcaaatctagacgcaaaactaagggcccatatgcgcattgaaatccgaagattgcagcgaaagctcggactaacgatgatttatgtaacccatgaccagattgaaccgatgaccatgggcgatcgtattatggtgc

SEQ ID NO: 5330 - DNA, 609 bp, Bacillus clausii
tctgtctgttgcacttgcgactggtttgctcattggctgtagtgggaatacttcaggcgggggaggcgctgatggaaaagtagaactgacattttcggcatggggcaatccggctgagttaaaagtgtacaatcgtgcagtcgatgcctttaatgacatgcaagacgagatcgaagtcacgctcactggtattccgaatgacaattactttcaaacattgacaacacgcctccaaggagggcaagcgcctgatattttctacgttggagcagaggatatctcaacgttaattgagaacggaacgattgaaccgctgtccgactttttggagacagaagattcttatgtgaaagcagatgagtttaccgatgacatttggggagcgtcacggaaagacgaaacgatatacggactgcctgttgattgtaatccgtatttaatgtactacaataaaacattgcttgaagaagctggcgcaaagtcgccgcaagaatattacgaagaaggcaattggaactgggaagcgtttgaagaagtcactgcaaaattgcgtgaccatggcaaatacggatttgtccaagagggtgggacatccacacttgctaaact

SEQ ID NO: 5331 - DNA, 948 bp, Bacillus clausii
caacaagaggttgtcgccttatgacggaaccgtatgtctatgtacctgaacagacaagcaccgcgaaaaaaggaaaacgcagtactaggcattttgccaaaggcatgctgtttttatttccttctttgtttttgtttactgtgtttctgttttacccaatgatacggacgttgtatttaagtttctttctgacagataaccgcggaatggcaacggtctttgtcggtttcgagaatttcatgcgtatttttacatcagatctttttttaaaatcactcacatcgacctttttatttgtgctttacacggtgccaggaacgattctcatcagtttgtttttggctattatcgccaatgagcggctaaggggaatcggtatatttcggatggtgttttcttcgacgatgggcatatcagtagcggcagcatctgtattttggctgtttttgttccatcctagcatcggttttttgaaccagctgcttggctggctgaacgtcggctcaatcggatggctaacagatccgaaatgggcgttattttctgtttctgtctcaacgatttggatgaatataggctttacattcctcattttgttaggcggtttgcagtccattgaccgctacttgtatgaaagtgccgatattgacggcgccagctatttttacaaattaaggcggattaccattccaatgttatcgccgacgctgttttttgttgtcactgtcaccatgattaatgcgttccagacatttgggcaaattgacatgctcactagaggtggaccgcaaaatgaaacgaacttgatcgtttattccatttatcgggaagcttttgtcaattaccaatatggaaccgccagtgcgcaagcagttgtgttgtttgcgatcatcttgcttatgacgatcgtgcaatttaagcttggcgaaaagaaggtgcattaccaat

SEQ ID NO: 5332 - DNA, 216 bp, Bacillus clausii
ttttttatttgcttctcaccgtttctgcttttgtgctatttgcaccagcgattttagcatttttgatgagttttatgacaagcgcagacacactgacaggtaaagtgatcccatcggtgtggacgttcgacaattatattcaagcgtttcaacggtttccgctgttgaattacttgttgaacagtttgattgtttcgctcgtcattatggtcggcc

SEQ ID NO: 5333 - DNA, 589 bp, Bacillus clausii
atgaacccgaaaatgacattaacgggcgtatcgaagaaatatacgctctatcggaataacaccgagaagttaaaggcgatgttctttccgaaaactcgtgagcagcaccgtgacttctatgccctcaaagatattaaccttgaagtctatgaaggcgaaacaatcggcgtcatcggcataaatgggtcaggaaaatcgacgatatccaacattttagctagcgtcatcccgccaacggaaggcgaaatgacggtgaatggcgaaacatcattgatcgccattaatgtcggcttaaacaaaaatttgaacggttacgaaaacattgagcaaaaatgtttaatgcatggtttcagcaaaaaagagattgaagagctgatgccagcaatcgaagaatttgccgacattggcgattttattgaccagcctgttaaaaattattcatcagggatgaaatcccgtttagggtttgctatttctgcccatacaaaccccgacatattaattgtcgatgaagcattgtcagttggcgacaaaacgttttaccaaaaatgcaaagacaaaattgatgagtttaaagcgcaaaataaaa

SEQ ID NO: 5334 - DNA, 339 bp, Bacillus clausii
aaatgcgcaaacaaacgcaaagcgaaatgaaaaaacggattgcctatgtcctcgatgtcgttaatttaacggggtttgaaaatcgttttccaaaagaactttctggcgggcaacggcagcgtgtcgctatcgcccgggcattagtaattgaacctgacctgttgttgtttgatgaaccgttaagcaacttggacgcaaacttgcgtgaaacaatgcgcgtggagattcgccgcattcaacaagagctcggcatcacagctgtatacgtctctcatgaccaggaggaatgcttttccatttccgacaatgtcgcgattatgaataaaggggtcattgaac

SEQ ID NO: 5335 - DNA, 304 bp, Bacillus clausii
  misc_feature (1)...(304): n = A,T,C or G
ttgtctaacgctttttttcaagttcacccgacagacaatgtcatcgtcagtttaaaagacttgcaaaaagatcaacgtatccagtttaaagaagagcatattcctttatccagagacgttccttctgggcacaaaattgcaatcagagacatcgctgtaggagaagacatcgtaaaatacggattccctattggcaaagcaagcaagccaattcaaaaaggcnattgggtncacaccgataatgttgtaacgaagctatcaggaacgctcgaatatcagtatcaacataaatcacagccgtttc

SEQ ID NO: 5336 - DNA, 669 bp, Bacillus clausii
  misc_feature (1)...(669): n = A,T,C or G
acaatgctggttttagtgattatgaccttgtccgctatggccgtgatggcgccattatccctcttgaaggcttaattgaagaatatgcgccgaacttacaaaagattttagatgaacgccctgagctgttggctgttttaacagctccagatggacatatttattcattgccacgagtagaagaaatggggcttgttccctatgccaattttacagcgattaaccaagcttggcttgatgaagtggggcttgaaaaaccagaaacgttggatgaacttcgtgaggcattaagggctttccgcgagcatgatgtgaatggaagcggcaaagccgatgaaggattgagctttacgccaaatgacggatttcaaggctatttaggcgacttttttgcggcctttggcctgcctgataacccgaacaaaatagttgtaaaggacggggaagtcatttttacagccgttcaaaatgagtataaagaagcgatcgcgtatttccatgaatggtttgcagaagggctgatcgaccaagaagtgtttacccatgacacaggacagtttttggctaaaggcaaacaagatcctaaccctttangcgcctttattttttgggagattgagtctgttgtcggcttagagcgagctgaggattatgtcttgcttggtcccc

SEQ ID NO: 5337 - DNA, 723 bp, Bacillus clausii
tagagaaaaactttgggcagacaaatgtcattccgccaatggatttaatgattaacagcggtgaacgccttgtgcttcttggtccttctggatgcggtaagtcgacattgttgcgactgatcgcggggctggaacaacctacgtcaggcacgattttaatgggcggacaagtgatggcaggggttgatgttgccgatcgcaatgtggcaatggttttccaaaactatgccctttatccccatatgaccgtgtttgataacatcgctttttcgctcacgattcgcaaaaagaaaaagcaagacatacgcgaagcagttgaatatgccgccggactggtcgaattaaagccgtatttagggcgcaaacctgccgaactgtcaggtggccaacgccaacgggtcgcccttgcccgagcggtcgtcaaacaagcaccgtttttcctgttggatgaaccgttgtccaatcttgatgcgctcttgcgtgtgtccgcacgcaatgacttaattgaacttcataaccgcttaaaacaaacgatggtctatgtcacacacgaccaattagaggcaatgacaattggacagcggatcgccgtcatgaatggtggcgttatcgaacaaattgggacgcctgaagacatttacgaaaaacctaaaacacgatttgtcgccacttttatcggcacgccgccaatgaatatgctgccagccgatgcatttgctgaca

SEQ ID NO: 5338 - DNA, 129 bp, Bacillus clausii
ggaattctctaaacgttatggattcatatatgttgataaacacgatgatggcagtggtacgatgaagcgattgaagaaaaaatcattctattggtataaaaatgttattgaaagtaatggcgaggtttt

SEQ ID NO: 5339 - DNA, 588 bp, Bacillus clausii
ctgactttgtgcacgttgacggcattacacggattaacgtgtttatgaatgcagacaaggaatacaaaatagtcaatcaagggccgtccattagtaaagaaaagcaacgcttgctaatagaaaaaattggccaaatggaagcaggcagtacgttgattgtttcaggaagtttgcctgtaggcgtgtcagaaggcattctcgccgagattggcgccatttgtcaaatgaacggcgtccattatgtccttgatacaagcatttcttctttagacgccgtgttggcgactcaaccttatttattgaagccaaatgaagaagagttagcaggtttctttcaagtgcaacatccattgagtgaaaaagagcttgtctactacggctatgaattgataaagcgtggagcaaagcaagtactcatttctcgcggaaaagacggcagcatttatttgaataaggacacttgcttgtttgcgacgtctcctaaaggcaaagtattgaacacggcttgtgctggcgatgctttgttggccacgttcattggccatatccagcaaggcacacctgtggaagacgcactaagcgaaagca

SEQ ID NO: 5340 - DNA, 486 bp, Bacillus clausii
  misc_feature (1)...(486): n = A,T,C or G
aattgataaagaaaagtattatccaaatcatgaaggaatagacttctatcatcgctacaaagaggatattgccttatttgctgaaatgggcttcaaagtttatcgtatgtcaattgcctggtcgcgcatttttcctaatgggaatgaattagaacccaatgaagtaggacttgcgttttatgaccgtgtatttgatgaattgcacaaatacggaattaagccggtcgtaaccatttctcactatgaaatgccattaaatcttgtaaaagagtatggcggttggagaagtcgtgaagtcattgcgttttttgaacgttatgtcaatgctattttcaatcgctataaagacaaagngaaatattggatgacgtttaatgagattaatagtgccttacattttccaatcatgagcatgggtttttcgatcgaaaagggagaagacaaatatcaatcgattttccaggcttttcaccaccaatttgtggc

SEQ ID NO: 5341 - DNA, 393 bp, Bacillus clausii
gtccagcttcaggcacgattaaattaattgatcaagtgaaggatgagacattttcccaaagaatgatgggggatggatttgcaattgaacccacttcttcgcacatctatgctcccattaatgcaaaagtcgattttgtttttcaaaccaaccatgctgttgggttaaggacagatgacgggaaggagattttaatacatgtgggcgtagacacagttcgcctagagggcaaagggtttactgctcatattaaagaagggcaaagggtaaaagcaggcgatctgttattaaccgttgattttgattcgattcaagcacaggtcccatcaacagatatcattttgatttttacaagtggtgaagcttgtaccgtgaacaatcctgacagtaaag

SEQ ID NO: 5342 - DNA, 334 bp, Bacillus clausii
atggaatcattaagcgcaaaacagcagattatcattgaacgtttaaaaaatggtcttatcgtgtcttgccaagcaaaaaaagaggatccaatctatttgccaggtatcattacgaaaatggctgaatcggcaatatggggaggggcggccggactgcgaataaatacgcctgaacatattaaagaagtgcgtaaaataacggatctgccgattattgggttatggaagcagcatacgaagggtaatcctgtctttattacacctactatcgaagcagtagaagaggtcatagaggcaggagcagatattgtggcaatagacgccactgatcggg

SEQ ID NO: 5343 - DNA, 615 bp, Bacillus clausii
tttgaatagcttgtttgtctcatctgtgttaacagtaaccaatgtgctgttttgctcgttggcaggctatgcgtttgcgaagttgcggtttccagggcggaacacgatcttttggctgctactcggaacgatgatgatcccggcacaagtaacattgatccctgtttatattattgttgtcaacacgttgcagctaggcaatacatataccgcgatcatgctgccgatgtttgctacagttgggaacatctttttgatgaagcaatacatgtcgactttgccgtcatcgctcattcaagcggcgcggattgatggttgcagcgagtggcgtattttttacaaaatcattttgccgatttcaaaaccaggcttagccgtgttggctatttttacgttcgtggcgacatggaatgaatttttttggccatttctagttacacaaacaagttcgatgcggacgattcaaattggcttggctagttttaaatttgccgatgctactgatttcggggcaatgatggccggttctgtagtcgcagcgctgccgatgtttctgttgtttttctcgctgcaaaagtattttttgcaaggcattaccattggtgccgtgaaagg

SEQ ID NO: 5344 - DNA, 369 bp, Bacillus clausii
atggctacgacgattcagtcgccttcgaaatggcgtttgttttttcgtgattacggctggtgctatttgtttattactgtgccgattctcgtatttttgctgtttacgctcattcccgtcatttacgcatttattatgagctttcaacaataccatgtaatgggttctacctttatcggcttggacaattataaaacgatgatcaatgatgacgtattttggaagtcaatgcgcaatacatttatttttacagttgcgactgtgcctgtcagtgtcgcgatcacattagtgctagctgttttgattttcccacgtggcaaaaaaatgcaaactttttttaaagcgtctctttacttgccaacagtcgct

SEQ ID NO: 5345 - DNA, 306 bp, Bacillus clausii
aactggtacaacgggcactcggatcatggaggcgactgagttggttgttacccgttttaagtctggcccattagggggcgatcagcaaatcggggcgctcgttgctgagaatcaattcgatttaattttgtttatgcgcgatccattaacggcgcagccccatgaaccggatgtcactgctttaattcggttatgtgatgtgcaaagtgtgccgctggcgacaaatatgggaaccgctgaaattttaatcaaagggcttgagagaggcgattttgctttccgtgatattatccatgaacaagaaaa

SEQ ID NO: 5346 - DNA, 573 bp, Bacillus clausii
aaaagcaaacttgcccatcaatggagcggatacatttatgggccatcaagaactaatggggtcgaagccaggaaaaccagctaagcgcctcatgaaagaagttgggcagcaaatcgccgacggtttaacggcaaatgggtaccatgtagaagaactaatcgaaggcaagccgattttgctagttgacggcgctgtcgtcgtaggagacaatttggagtcggcactcggcaatatcattaatatgactgctgatttaacccaaatttccttcgaagcggcaacaaagatggccgctgtagtcagaaagcatgttgatacaagccgtgtgattgtatttggaaacgagtctgtgccgctaacagacattgtagctgcggcggaagaagggaaaccaggccagtggggcattaatgcgcctaaaacaggtgtatacggcgaagggtatcaagtgctccatttaggctatggcgtgacatttgaaaagcaatttgcctatttggccgaacaagcaggaaagccagtttatcgaattggcaaaacagctgatgtcattcaggcacaaggctttgcaaa

SEQ ID NO: 5347 - DNA, 582 bp, Bacillus clausii
tcggattgatctatcaaaatatgtagcgtatctatttctactcattgcttgctttttatgggtggtcccgttaatttttggcgtatccacttcgtttcggtcgcaaacggaagtcgtaaatgtagggtttcggctgttgcctgtcaattgggtcgtcgagaactatatgggcgtcctaaacaacacgtcaactgcccccattttaaaatggctatggaattccgtttttattgcgacttcacatgcattgctcgttgtggcaatggtcgcgattacagcctatggctatacacgcttaacatttaaaggaagagacacgctgttttttgtcttactagcgatttcgctttttcctggcgttgtcaacttgattccttcttacaaaattattgatactttagggtgggtaaacacaccttgggctatgattttcccagggttagcaggaatgggcaacttatttttagtaaggcagttcatgctaggcattccgaaagaattagatgagtgtgcgaagatcgatggggcgaatgattttcgaattttctattcaattatattgccgtgagtccgtcctgtttt

SEQ ID NO: 5348 - DNA, 489 bp, Bacillus clausii
tgtcacttgcaaaggcggcaggtacaaaagttgtgtttgaactcgattatcgtccgtacacgtggtcatcgagggaagaaacgtccgtctactacacacttctggcaggcatggctcatatcgtgatcggcacgcgggaagagtatgacattatggaaggggcaagtgccagcggcaatgagcaaacagccaaaatgctatttgccaaagagccggaattggttgttattaaacatggtgttgatgggtcttacgcttatttgccatcaggagaaacctttcgagcaggcgtgtacaaaacaaacgtgttaaaaacgtttggtgctggagattcgtatgcatctgcgtttctatatggacttttgcgtggttatgacattgatcaagcattgcgttttgggagcgcttccgcatcgattgttgtcagtaagcacagttcatcggaagcaatgccaactttatctgaaatcaaggcgcttgtcgaagaac

SEQ ID NO: 5349 - DNA, 714 bp, Bacillus clausii
atgaaagaaacaacaggtgtccatatgtttgaatcgattacaaaaccttatttgcaagtgattgagcagcaatcagacaaatactttgctgaagacggcacttatatcggcgatggggaagcgattcaatatgcttggaatacagcagtccgcatccacgaagaaggcctgtctgcacgtctgacagaagggcaagaagtcaatgccgctttaaacgggggcgatgtcgcttcacgggtaggagctgtttgggaatcgcaaatcttacaagatgctgctcctgatacagcagggaaatggcgtgttacaagagctcctggtggagatggcaataacggcggttcttttattggcgttcttgatagctccgcccacaaagacgaggcagtggctattacaaaatggcttgtatcaccagatgcccagctcgaccattttttagacgtcaatctttttccttctgcgattgagacgcttgagtcagagcttttgcgtgaacctgatcctttttatggcgaccaagtagtagcggatgtttttgttgagtcggcgaaaaacgtccctcctactttctatggagaacattacggcaagtttcgcacgatttttaatgatgagatggtgctgatcgatcgagccaataagaatccagagaaggcttgggaggatgcacagaagaaagcgcaacgggaactgtcaagaatcgatcaataa

SEQ ID NO: 5350 - DNA, 1127 bp, Bacillus clausii
gaacatgaggggttgctttatcttttctatacagggaatacacgcgatgccgattgggttcgacgtccttatcaatgtatggcgacgatggataaaacgtataagatcagcaaatttccagcgccggttattgatcatgtgccagagggctatacggatcattttcgcgatccaatgctgttcaaaaaacaaggccaattttatgcgttaatcggtgctcaacgggaagacaaaacaggaagcttggtcatttataagtcgattgaccttcagtcatggaattttcacggtgaattgaaaacgaaactccatacatttggttttatgtgggaatgtccaggttatttggaaatgaacggaaaaggaatattgatcttctctccacaaggcttaaagccacaaggaaatcattttcaaaatctttatcaagctggctatttaataggagagccgcttgatttcgaagagaaacaatttcaccatggcaagtttcaggaactggatcgtggctttgatttctatgcacctcaagtaatgaaagatccaagtggaaggaacttgtgtgtcggttggatggggctcccagagatcgaatacccaacagataaacatggctgggcccattgtttaacaatcccgcgggagctcatcctaaaagggaatcaattgctacaaaaacctgtacccgaattaaaaaaacgaagaaaagaaaaagtcgaaaaaacgtttaagctggtgaacgaaacacagacattcccagatttcaaaggggatatctatgaattactttgcgagtttgatgcaggtagcgcacaagtggtaggcattaacattagagagaacggaactgagaaaacggtaattaaatacgataaagccaagcagatgatcgttttagatcggacgagtgctggccaaccatttgcacaggaatacggtacggtgcgaaaatgctcctttcaaggagaattcgtgaagttccatatttttgttgatcaatcttcggtagaagtcttcattaatgacggagaggaagtgtttacggcaagaatatttccagataaagcaagcacgggaattcgttttttttcagagggggaagctagcgtaagcgctcgtaaatggga

SEQ ID NO: 5351 - DNA, 194 bp, Bacillus clausii
acatctcatcgttcacaagacggttctgttcatattgccgatgtcgttaaggcctaccacgaaaatggctatactggctacgcgcgccctgaccacggccgccatatttgggatgaaaaatgccgtcctggctatggcctctacgaccgtgctcttggcatcatgcatttgtggggactttgggatgcatatga

SEQ ID NO: 5352 - DNA, 612 bp, Bacillus clausii
agattggcgattatgctgtttatagccatggggcaatcgatttgcttggcgaccgattaagcgcaaggggcttggataaccggagcggtgcctttatggttgccgaaatattacggcgcctccaacaaaaacgccctcaggttggcgtgtatgctgtcagcacagttaacgaggaaaccaatttgggcggtgcttacttcgccgcagcagggattaagcctaatatcgccatcgcccttgacgtcacttttgcgacggactatccaacagtgaatgccaaaaaatacggcgatgtgaaagttggcggcgggccagtgttggcaaaaggagcacccattaatcgcaacatcaatgccctgcttgaacgtacagccaaagaggtaggcattgatgtccaatacgagctgacccctagaaacacaggtaccgatgctgaccgcatgcgcttaacaggcaagggcgtgccgattgcgctcgtatcattgccactccgctatatgcacgctccccgtgaagtcgtttcgaaacaagatatggaacaagaaattgagttgttggctcagtttatcgcaaacttaacaggccaagaagagctgcgtccggtcgtttggc

SEQ ID NO: 5353 - DNA, 575 bp, Bacillus clausii
  misc_feature (1)...(575): n = A,T,C or G
aatattgagttattngcaggttctccagatgacaacaatgcgacgttcttttttaaaggggcgatgtccgttcttcagccttatatcgatcaaggcaagctagtggttccaagtggtcagacggatttcaaccagattgccattttaggctgggacggcgccaaagcgcaaagcaggatggacaatttgctcagctctaattatggagggggtgaagagcttcatgcagttttagcgccagctgacttgttaagcatcggcattatcgcctctttaaaaaattcaggctacaccgtcgatactatgccgattataacgggacaagatgcagatctcccagcagtcaatgctgtcatcaaaggggaacaggccatgactgtctttaaagatacgcggctgcttgctaaaaaggccgtagagatgacggaagctgtgctccaaggggaagaaccggaagtcaatgacacaaacacgtacgacaataatgcgaaagtcgttcctgcattcttggaagagcccgtcgttgtagatcaagacaactacgaggaagtgctgattgacagcggctactatga

SEQ ID NO: 5354 - DNA, 371 bp, Bacillus clausii
ttaaaagagattgtgcaaacaatagcgagagactggaatttgccgattgaatttctgcaatggctagaggaagcaaatgtcttttgcaacacgctcgtcgatcgaattgtaacaggctttccacatggcgaggaagaaacgtgggcaaacaggctcggctacgaagaccggctgttgacagtcgctgaaccgtaccatttgttcgtgatcgaaccagagcgcccgctagaggagcgtttgccgttcgagcaagcagggcttaacgttaaatgggaacctgtggcgttgcatcgggagctaaaagtaaggctcttaaacgggttgcacacgctgatgttcgcaatcagttttctagcaggagaagacacggt

SEQ ID NO: 5355 - DNA, 602 bp, Bacillus clausii
atgaaaaaattgttgaacgatccgaatcagttagtgtccgattttctagatgggtttactgctgttcatacgagtcaattgaaacgccttccaaatagcaatgtggttgtccgtaagcagccaaaaacggataaagtcggcgttattagcggagggggcagtggccatgagcctgcccatgcaggttatgttggttacgggatgctcgatgctgccgtatgcggtgaagtctttacttcgccaggggctgatcaatttttagcggcgattgaagcagccaaccaaggaaaaggtgtgcttcttgtcataaaaaattacaacggcgatcgaatgaatgcagagatggcgatggaaatggctgaggcacaaggtattcagacagaaatggttgtcgttaacgatgatgtagctgtggctgatccagcacaacggcgtggcatcgctggcacggttcttgtccataaaattgcaggagcttgtgcagaaacgggcgctagtttaccgaaagtaaaggaagtcgttgaaaaagcaataagccgtatccgcagcatgagtctggctttaacgccttgttcattgcctggcgttgaccaacctagctt

SEQ ID NO: 5356 - DNA, 789 bp, Bacillus clausii
tcacagcggtggctacgtttttaatggcgctccttttgcttgttgcttggccgccgatccaacacggcttaaacagcttttctgagtttttgctaggatcgagcttgtatgtagctgtgtttttatttggctttataaaacggcttttgattccttttggcttgcaccatattttccatgctccgttctggtatgaattcggttcctataccaatgcggcaggggaaattgtccgtggcgatatgctcattttcttcgcgcaactccgcgatggtgtggaattgacggcaggccacttcatggcaggcgaatttccgattatgatgtttggcctgccagctgcggcactggcgatgtatcattgtgccaagcctgagaagaaaaaactggtggccggtttgtttggttctgcggcactgacatcgtttttgacaggaatcacagaaccgcttgaatttacgttcttgtttatcgcgccagtactgtttttgctacatgcgatcctcgatggcctatcgtttgtattgatgacgttgtttgacgttcatgtagggtacaccttttcaggcggagcgattgactttttcttattcgggatcttgccgaatgaagaacaatggtggattaccattcttcttggactcgtctttgctgcgatctattacgtcgttttccgctttgcgattcaaaaattcaatttaatgacgccaggacgggaagacgacacagccgatgataacaaaggcataggaaaaacaggcgagttagcaggacaagtgttgcaagcga

SEQ ID NO: 5357 - DNA, 231 bp, Bacillus clausii
  misc_feature (1)...(231): n = A,T,C or G
aaaagtattactaatctgtggtgcaggtgcgtctagtggattcatggcaaacgccattcgtaaagcaggcaagaaaagaggaatggaaatgtctgtccaagcacgaagcgagtcgcaattgtcagagtatctaaatgaaatcgatgttttgctagttggccctcacttaaaatatatggaagatgaattaagagaaaaagnaagcggttattcgattaaagtctcggtaat

SEQ ID NO: 5358 - DNA, 387 bp, Bacillus clausii
atggcaaagcagaatattggcgtcgtcggcgtcggtgtcatgggacgcagcctagctttgaactttgaaagcaaagggttttctgtctctctttatgacgtttcagaagaacgaatcaaagaaattcttgaccacaacaaagacaagcgtttagtcggtactttttcattagaagagtttgttcattctttggaaaagccgcgcaaaattatgcttatggttcaagctggccaagtcacagatcaagtcattgattccttgatcccgctattagataaaaaagatattctcattgatggcggcaacacttattataccgatacaatacgccgttcccaaacagcagcggagcatgggattcattttatcggcacaggcgtttccgga

SEQ ID NO: 5359 - DNA, 444 bp, Bacillus clausii
atggcgcccacaccatgatgtttgcggcggcgtatctatctggcctggataccgttaaggaagcaatggaggatgaggaactccagcaatttatccgaacaggggtttacgaagaaattttgcctttgcttcatatcaatgaagaggaaaagatccgctttgcagacgctacattggaaaggtttagcaatccatttaatcagcatcatctattagacatttcactgaactccatctttaaatggaagactaggatactgccttcttttctcgaagcagtgagagaaaagaaggcccttccagcagctttaaccttttcactagccgctttatacgtcttttatcgtcctgatcatgtgaaggaccatgtatggtttggcaaacgtggggatactgtgtatccgattagagagaatgaaaaaacgcttcgttccattcaaattc

SEQ ID NO: 5360 - DNA, 117 bp, Bacillus clausii
acaagcgtattctttcccgaaagatttctggtggggatcggctgtttcggcaacgcaaatggaaggagctgccaatgaaggtgggaaaggaaaaaacatctgggactactggtatga

SEQ ID NO: 5361 - DNA, 288 bp, Bacillus clausii
ggatataacagaggtttccttcagtatcattttgcacgctggaaatgggaaaggaagcgcgatggaagcaattcaagcggcaaaagcaggcgcatttgaacaagcggatgagttaatagaagaggcaggaagagagctggctaaagcccatgaatttcagacaaatttaatccagcaagaagcaaatggagtgcggacagagttaaacgtgctgctgatccattcacaagaccacttgatgacgtcgatgaccgtacgcgatttagcaatcgaaatcattgaaatata

SEQ ID NO: 5362 - DNA, 330 bp, Bacillus clausii
aatcggtggccctcctggtttgtttaatgtcaatgaaccgattatttttggcttgccgatcattatgaacccactcgtccttatcccgtggctgtttgcgccagtcgtggtgacgattttcacgtacttcacgatggcggccgggcttgtgccagccccgtatggagcaatcgtaccatggacaatgccacctattattagcggagcgctggcgacgaattcatggcaaggagcggtcttgcaagttgtaaacatggcgatcgtatttgtcatttggtggccatttttgaaagtgatggataagcaatactatgaaaatgaacaaaacga

SEQ ID NO: 5363 - DNA, 306 bp, Bacillus clausii
atgaacgtgttgttggcgtgttcagcaggaatgtctacgagcttgcttgtagcaaaaatgaaggaagccgcagccgaattaggggtagaagcggaaatttgggcggttgcccaagataaggcattgatagaaatcgaaaaagcggacgtgctgttagtaggaccgcaaatgcgctttatgaaaaagaaatacgaggcaaaaggcaaggaaattggcgttcctgtcgagattattgatgcggttgcgtatgggcgtgtcgacggcatggctgtgataaagcgggcactagaactagctgagaagtaa

SEQ ID NO: 5364 - DNA, 1251 bp, Bacillus clausii
tcgagaatgtattaatgccgcttgcagacaagttaaacaacaatcgttatttaacagcattgcgtgatggctttatggttgcgctgccgctcattatcttcggttcgatttttgtcgttatcgccaatcttccgtttattgaccgcttgatgagtgaagccacttacgcccaatatcaggaactgatcgccagtgcttcgtcggcaacgttggcgattatggcgacgtttgtcatcgtcggcattggctataaactgacggaaagctacggaggcgaggcgatttttggcggcgtgactgctcttgctgcttttctgattttaatcccgcaacacgtcgatgagacgaccggtgttattccagttggcgttttaggcgcacaaggaatgtttgtcgggattattacagcatttgtgtctgcggaactgtaccgctcttttgtaaacaaaaattggcagattaagatgccaagcggtgtgccagatgcggtgtcccgttcgtttagttctttgattccaattacgatgacactttcgtttttcttgttggtgcgtatcgccttttcgtttacaccttttgagaccgtgcaaaattttgtgtacacatcggttcaagcgccgttaacagcacttggaagcggcttgactgcaacgatcatcgccgtgctgttgatacaagttttctggtttttcggtttgcatggccaaattattatcaactctgtccttgacccgatttggttcacattggcgggagaaaacttggatgcatacaacgcaggcaatgagctgcctcatattgtaagcaagccgtttatggaatcgtttattgtcggtattggcgggtctggtatgacgctagccgttattattgcgattttcttgattggccgcagccgccaactaaaacaacttggaaaaatcggtggccctcctggtttgtttaatgtcaatgaaccgattatttttggcttgccgatcattatgaacccactcgtccttatcccgtggctgtttgcgccagtcgtggtgacgattttcacgtacttcacgatggcggccgggcttgtgccagccccgtatggagcaatcgtaccatggacaatgccacctattattagcggagcgctggcgacgaattcatggcaaggagcggtcttgcaagttgtaaacatggcgatcgtatttgtcatttggtggccatttttgaaagtgatggataagcaatactatgaaaatgaacaaaacgaag

SEQ ID NO: 5365 - DNA, 288 bp, Bacillus clausii
atataacagaggtttccttccgtatcattttgcacgctggaaatgggaaaggaagcgcgatggaagcaattcaagcggcaaaagcaggcgcatttgaacaagcggatgagttaatagaagaggcaggaagagagctggctaaagcccatgaatttcagacaaatttaatccagcaagaagcaaatggagtgcggacagagttaaacgtgctgctgatccattcacaagaccacttgatgacgtcgatgaccgtacgcgatttagcaatcgaaatcattgaaatatacc

SEQ ID NO: 5366 - DNA, 117 bp, Bacillus clausii
aagcgtattctttcccgaaagatttctggtggggatcggctgtttcggcaacgcaaatggaaggagctgccaatgaaggtgggaaaggaaaaaacatctgggactactggtatgaaa

SEQ ID NO: 5367 - DNA, 543 bp, Bacillus clausii
cttgtgcttggccttggctgcgaaaacaactacattgacgtgtttaaagaggccgttggcccttatgacagcgaaacgcgtcaagtttctcgccgtgcaagaagtagaagacgaactggaggaagcgcttcagcttgtttctgaaattgccgctgtcgcgaaaaacgatgtgcggacagaagtgcccgcgtcaacattaaaagttggcttaaaatgtggaggctctgacggcttttcagggattacagccaatccacttgtcggcgcattttccgatcggctcattgcccaaggcgggtcaacggtgctgacagaagtgcctgaaatgttcggcgcagaaacgattttgatggaacgggccgcagatgaaacggtttttaatggcattgtcgatatggtcaatggcttcaaagactattttatccgccatggccagcctgtttatgaaaacccttccccaggcaacaaaaaaggcggcattaccacgttggaagaaaagtcactcgggtgtgtgcaaaaaggcggttttgcgccagtagccga

SEQ ID NO: 5368 - DNA, 477 bp, Bacillus clausii
tacaaaattgcataagcgcttacaaacgacgacgatttatgtaacccatgaccaaacagaagcgatgacgatggcgacacggattgtcattatgaaagatggctttatccaacaaatcggcacaccgaaagatgtgtacgacaatccggaaaatattttcgtcggcggttttatcggctctccatctatgaactttatttcaggccatttagatggaagcgatttcgttgttaaagagcagcgcatacgcgtcccagaagggaaaatgtctatcttacgggaacagggctttcaagataaagaactgattctcggcatacgccctgaagatattcatgatgagcccgtattcatttcttcatcgccagatacaaaaatcaatgcgttgatcgatgtagcagaattgactggtgctgaaatggtgctttactcatcgattgacggccaagaattcgtcgctcgtgttgattcacggac

SEQ ID NO: 5369 - DNA, 1217 bp, Bacillus clausii
atgtcacttaaagtcgttatcatcggtggtgggtcgagttatacccctgaaattattgaaggatttattgatcggtatgaacgagtgcccgttagcgaaatcgttcttgtcgatattgatgccggcgctagaaaattagcgattgtcgaagcgttatcaaaacgaatgatcgagaaatcaggctatcccatccacgtgcgcagctcatttaaccggcagcacgctttagaaaatgctgactttgttacgacgcaaatacgagtaggcgggttggaagcaagagaaaaggacgagcgaattccattagagcatgggctagtcggccaggaaacgaatggagcaggcggcgtatttaaagcgtttcgcaccattcccgttttgcttgagattgccaatgacattcataagatttgcccgcaagcgtggatgattaattttaccaacccagcaggcatcgtgacggaggcgttgctccaccatagcctccataaaaaagtaattggcgtatgcaacattccattcaatatgaaaacaggaattgcggaaatgttctcctgccctgtggaacaagtggagatcgagtttatcgggatgaatcattttgtctttggaaagcgtgtttttattcgtggcgaagaccgcaccaatgaagcattagcaaaactcacagcggacaatgtccattactctcctgccaacattgtctctcttggatggtctaaggcgtttgttacggcaatacagctgcttccaaacccgtatcacatgtattatttccaaaaggaggaggtgctgaaaagggatcttgctgcctttagggaacatgggacgagggcgcaaatcgtcaaacaagttgaaaagtcgcttttccacacgtatgaaaatccagcattgtcagaaaagccaaaagaactggaacagcgcggcggggcttattacagcgaagcagcgtgcaacttagtagaaagtcttcataccaataaacaagatattcaaacagtgaacacacgtaataatggaagtatccgagatttgcctgatgatgcagtcgttgaaatcaatgctgtcattacgaaagaaggccctaggcctcttgctgttggaaacatccctctacaagtcaaaggaatcatttcgcaaatgaaagcgttcgaacagcttgtcgttaaagctgcattgtccggcgattattacgatgcgtacaatgcgcttgttat

SEQ ID NO: 5370 - DNA, 795 bp, Bacillus clausii
ccaaccataaatacgatacgattgattatttaaaagtagatccccagtttggagatgaaacgacacttaaacggcttgttgatgaatgccataagcgcggaattcgagtcatgcttgatgccgtcttcaaccatgctggcctgtactttccaccttttcaagatgtactcaaacaccagcaggaatcagaatatagcgattggtttcatatccgccaatttcccgttcgggcagaggaaccacctaattacgatacgtttgcctttacccctttaatgccaaaactaaatacagcaaatgaaaaagtaagagactatttattgaacgtagctacgtattggattaaggagtttgacattgacggttggcgtttagatgtcgccaatgaagtcgaccatgccttctggcgtgagtttcgcaaaagagtcaaagcattaaaaccagatttgtatattctcggtgaaatatggcataacgcttatccttggctgcaaggcgaccaattcgatggggtcatgaactatccgctcactgacgcgatttttgactttgtccaacacggcaaaagcgcaaccacttttcaacacgcggttacaaaacatttgtacagttacccaaaattggtgaacgaagtccagttcaatttgctcggcagccatgacacaccaagaattttaactgtaagtgggggcaacaaaaaattagtcaaactttcctacttattgctgttttcctttcctggctcaccttgtatttattacggggatgaaatcggcatggccggagaaaatgaca

SEQ ID NO: 5371 - DNA, 243 bp, Bacillus clausii
ttaccgcagccggacataccgcattttttctgtatttaatattgtctttttgcttgtgcttagcgcgatttgcatcatgccgcttatccatatactcgccgtttcatttagttctcctgctcccgccaatgccaatcttgtccgtttttggccagttgactttacggtgtctgcttgggagcagacgtttggcaaccaaaactttttgcgtgcgttatggaatggcgtctttcgtacattcct

SEQ ID NO: 5372 - DNA, 677 bp, Bacillus clausii; identical to SEQ ID NO: 5301

SEQ ID NO: 5373 - DNA, 529 bp, Bacillus clausii
  misc_feature (1)...(529): n = A,T,C or G
atgctagcagacacggaagcagtgctccttgatttagatggaaccgtttttcagggcgaccgcctaatccgaggcgctaaagagacgattgcttccttgcaagaagctggcaagcgaattgcctatttaagcaaccgcggcaatgtatctaggaaggaaggtcttgagaaactagagcgccatgggattatggcggcccctgaatcattgatcctgtcttcaactgtaactgcctcctttttaaagcaacattatccgaaagctgccgtctggccacttgggaatcgtgggcttgcccaagagttgctgtataccggtgttaaaatcgcacaggcgccagaggaggctgactttgtcgttgtgacgcttcacgataagattacgtacgaagagttgaatgctgcttttaaagcaaggttccgcgggcgcccgaatgatcgccaccaatgccgacaaaacctatccagacgaagcaggccaagctattngacgttgcccggatttatcggcgccattgaagcggcgacag

SEQ ID NO: 5374 - DNA, 618 bp, Bacillus clausii
ctgcgacaatccattttcagcaagggacgccgtatgtgtatcagggtgaagagttcggcatgacaaacccgaattttacaagcatcgacgattaccgcgacgtagagtcattgaatgtctacgatcgcttaaaagaagagggcgtgcctgaagaacatattctcgcgatccttaaacagaaatcacgggataactcgcggacgccggtccaatgggattcaagcgagcaagccggttttacaacgggaacgccatggataaaggtgagcagcaattacaaggagatcaatgccgaaaaagcgctcagtgacccgaattcgattttttatttttatcaaaagctcattgcgctgcgcaaaaagctgccaatcgtgacaacaggtgattaccgcttgcttgtgcctgaagatgaccatgtatttgcatacgtgcgcacggatggcacggagaaactccttgttgtttcaaatttttaccctgtaaattgcgattttgaatgcccagaagatctggtatcattaaaagcgacgcagttaataggcaactacaaccaaaaacgaaaactggaaaaaacattttcgctcaagccttatgaaacggtggcattccagttgaagg

SEQ ID NO: 5375 - DNA, 255 bp, Bacillus clausii
atggcgcaaaaagaagtaaccatccaacttaaatcaggtttgcaggctcggcctgcggcgatgtttgtccaagaagccaatcgattttcgtctgaagtgtttattgtaaaagacaatgccaaagtcaacgcgaaaagcatcatggggttaatgggcttggcgctcggcaaaggcacgacgatcacgattgtcacagaagggcacgatgaaaaagaagcactggatgccttggttgcttacgttgaaaacgattaa

SEQ ID NO: 5376 - DNA, 402 bp, Bacillus clausii
atgccaaaaaggcggtgcccgaggaatgtagacggtttgttgagttgacaggcgtaccaacgcttgcaccggcgatcggaacagcccacggcatttacaaaggcaaaccaaatattgattttaaccggattgcccgtattgctgaactagttgacgtaccactagtgctccacggaggttccgctgtccctgatgaggatgttcgccgctgcgtttcattaggaatggcgaaagtcaacgtatcaaccgaattaaaaaatgcttactctgctgcgatccgtgaacattttgcctctcatccaaatagccttgacccccgcgcctatttgcaaaaagcaagagaggctgctatcgaaatggcaaaagcaaaaatcaaattggtaggaagcgaagatacggttg

SEQ ID NO: 5377 - DNA, 843 bp, Bacillus clausii
gggagggggcaaatgtggacattgaaccgctgaaaccgtcgatgggggctaggaaaaaaacgactcggtttgcgagaaaagagcatcttgctggctatctgtttacgctgccggcgattttaggcttgctcgtttggacaattggcccgattgttgccagcttggttttgagctttaccgattaccaagtgatcgcggacacaatcaattggattgggttcgacaattatataaccattttcacagaagatctttattttaagcaagcacttgtcgttacgttgtattttgcgtttgccagcactgccgccacactcgtcgctgccttgttgatcgctctgcttatgaacatgaagataaaagggcaagggctgtggcggacgctcttttatttgcctgtacttgtgccagcagtggcagcaaacattttatggatgtggttgtttaatccagaatttggcctgctcaatggcattctccgcttctttgggctccctgcctctatgtggatctatgacgaggcatcggttatcccgtcgctgattttgttaagcatatggggctgtggcggcgctgcgctcatttttctagccggtttgcaagaaatcccgaaagaccaattggaagcagtcgagttggatggcggaaatgcttggcaccagttccgctttgtgacaatccctactatttcgccaatcattttcttcaatttgattatgggactaatcggcgcatttcaaacgtttaaccaagcctatattatgacagagggagggcccaataacgcaagtttgttttatgtgtatttaatttatcgagaagcatttgtccacagtaatatgg

SEQ ID NO: 5378 - DNA, 846 bp, Bacillus clausii
cacattcccgaagaattttttatggggaggcgcgattgcggcaaaccaagcggaaggcgcttatttagaaggcggaaaaggactttgtgtagcagacattaacaagtttacggatcgcgtggatattaagaaaaaagccaatttggaactaacaacagaagacatacagtcggccatcgaagacaaagaaggccactatccaaaacggacagccattgatttctaccatcgctataaagaagatttacgcatgcttgcagaaacggggatgaattcgttccgtacatcgattaactgggcacgtatctttccgaatggcgatgaagccgaaccgaatgaagaagggctaaaattctacgataatctcattgatgagattattataaacggaatggaaccattgatcactgtttcccattatgaaatgccgttgcatttagcgactgaatacaatggatggtatagccgaaaaacaattgatttttttgttcgttactgtgaagtgttgtttaatcgttataaagacaaagtaaagtattggattctcgtcaaccaaattaacctaattacgtttgaatcctttaatcatctcggcattccagcagatcgtgtcgaaaacttattggaagccaaataccagggagcacacaatgagctcgttgcttgtgcaagagcaacgaaaatagccaaagaaataaatcccgacatgcaaatcggcatgatgctttttgacgccatttctcaccctgccacttgcaaaccggaagatgtactggcaacggtcaaacgcaatcaaatggaatactatttctctgatattctcatgcgtggcaagtatccaaatta

SEQ ID NO: 5379 - DNA, 843 bp, Bacillus clausii
aatcttttcattctgttgcgatttgcaaagccaagtagagaacatggaagaagcgaggtatcaagctgttcacaaccaaatggttgcgtcggctctgattgttaaaaaagcgcgagaaataagtgctgattttcagatgggaacaatgttagcggattgcaccgcctatccagagagttgccatcctgatgatatcgtgttggctatgaaacgaaatcgcctccagtatttttttacagacgttcaatttaggggcgagtaccctcgttatatgagacgtttctttcaagaaaacaagattgaactaaatgaacaagtgggagatgcgcctattttaaaagcgaatacaatggattttctcgccatttcctactattactcttccatggtttcagcaaaaaagaatgggatgagtccgatcgacgtaagcaaaaacccacatcttaaagccaatccatggggctgggccgttgatccaaaaggcttgtatcacgcattatgtcaatactatgatcgttaccaagtgccgatcatgattgcagaaaatggttttggcatgtatgacaagctcgaggatggcaaggtacatgatgattatcgtatctcctatcttgcagagcatattgcacaaataaaagaagcgattaaagacggcgttgaaatatttgcttattgcgcatggggaccaattgatattgttagttgctcttcagctgaaatggaaaaacgttatggctttatctatgtcgatatcgacaacgaaggaaacggctcacggaaaagaataaaaaaagacagtttttattggtatcaaaccgtgattgaaacagacgaagagacgct

SEQ ID NO: 5380 - DNA, 333 bp, Bacillus clausii
agaagcattgaatttaatctcaatgcaaatgattttgcatgcaggcgatgcccgtaatgatgtgatggaagcattaaaatgttgcgaagaagaagagtatgaccgcgctgagaagctattagaaaaagccaataaagatatcgtagcatctcataagctgcaaacagaaaccgtccaaaaggaagcacgtggagaggaatcgattttttcgctattgtttgctcatgcccaagacacactcatgaccgtgaaaagcgaatatgaactagccaaacggttgattcgggtctttagaagattggatgaaaaaatagacggaaagagaggtcaatc

SEQ ID NO: 5381 - DNA, 552 bp, Bacillus clausii
atgatgccggtcatttatcctgtttatttatcaggccttgcagaaaatgcacaagtagcagcggccggaggaaatccatccaatatcgccattatggaaaccctttatgcctttacaagtatgggcggagtcggaacaacgttgcctctcgtcattatgatgtgcttccttgcaaagtcgatgcgtatgaaagcaattggtcgggcgacgatcatcccatcggtcttcaatattaatgaaccgttgatgtttggcgcgccaattgtctttaacccatttttaatgattccgatgtggcttaccgcgattgtgatcccaagtatcacatactgggtactgcatttaggctgggtaagcattccgacgaagacatttttactttggtatatgccaatgccgatttcttcctatttagcaactcaagattggcgggctattattttagctattgtattatttgtcgtcgcatttatcatcttcttcccattttttaaagggtacgatgttcaagagaaaaagaaagaatcagagttaagtgaaacggaagagtaa

SEQ ID NO: 5382 - DNA, 465 bp, Bacillus clausii
agcaggaattaatcgaacgaattcgccaagcactgtatttcagcaaagtgctttcctacgcccaagggttttcgcagctgaaatcgatgtccttagaaatgaattggaaccttcaatatggagagatcgcgaaaattttccgcggcggctgtattatccgcgctgcctttttgcaaaacattacggatgcatttgcgcgggacgccaacttagacaacttgctgcttgatccgtacttcgaaaacatttccagaaagtatcaacaagcactgcgtgaagtggtcgctctagcagttgaatacggcatcccagtaccagggttttcgagtgccatttcttactatgacagttaccggagtgaacgtctgccagcgaacttgctccaagcacagcgtgattactttggcgcccatacgtatcaacgcattgacaaagaaggcgttttccatacaaattggcttgact

SEQ ID NO: 5383 - DNA, 294 bp, Bacillus clausii
caaaaagattggctccgcagatacaacgcctgtccatttgcaatacaggcatgatagcgaagaccggtttaacacgcctgaggcatatgagcggctcctctttgattgcatgatgggcgatgccacaaactttgcccattgggatgaagttagtttgtcatggtcccttgttgatgcgatctccaaagcgtggtcagaaagcggtgaaaaactgccaacttatagagcaggttcaatggggccgaaagaagcggataagcttcttgaagcagacggcttttcatggtggcctgt

SEQ ID NO: 5384 - DNA, 1035 bp, Bacillus clausii
ccttctatatcaatttatacagaaaaggcaatttgaacgagcattttgctgtagtaggtttagggcgtcgcgaatggggtgatgaaaaactaagaccagtcgttatggaatcgatccaagaagaactcggtgggcaaagtcctgaagtgactgaatcgtttttaaaacatttttcctatctatcatttgacgtcaccaacaaggattcctatagcgagctgaatgacaagttgcatattttggatgagacattccaaatccctgggaaccgtattttttatatggcaatggcacctgaattttttgggcaaattgcgcagtcaatacataacgaagggttaaaggacacgcaaggatggactcgacttgtaattgagaaaccgtttggcacagacttgcaatcggctatccgtttaaatgatgaaatacgccaggcattttcagaagatgagatttaccggatcgaccactatttaggcaaagaaatggtgcaaaacattcaagtgattcgttttgctaatgctatatttggttcattgtggaacaaccggcatatcgctaatatccaagtgacttccagtgagcagctcggtgtcgaaggacggggcggctattatgaaaaatcaggagcccttcgtgatatggtacaaaaccatatgctgcaaatggtgtctctcttggcaatggatgtacctcttcgcttgtccaccgatgatatacgtagcgaaaaaattaaagtgctacgcgcattgcgcccgattgtcggcgagagcattaaggaaaatgttgtgcgggggcaatatggccgaggagagatcaatgggcaagaagtgattggctatttagaagaagaaaatgtgagtgattcgtcaaaaacagagacttacgttgcggcaaagttaatgattgacaatcatgtttgggcaggcgtccctttttatatccgcactggaaagcggatggcggtgaagtcaacgaaaatcgttgttgaatttaaggaactacctttaaatctgtatagcaaggaaaacaaac

SEQ ID NO: 5385 - DNA, 924 bp, Bacillus clausii
atgaaagtaggattgagttcatacagcctgttgcaagcgttaaaagacggacgcaccacgatagtagacgcccttcagtgggtagccgacaatggcggcgcccatatggagctcgtcccttatggcttttcggttgtagatgactacgaactggcgacgaagttaagagacaaagcagcggaaacagggattgagctgtcagcctactgtatgccggccaatttcatccagccgacggaacgagcttttcaggaagaagttgaacgcatccataaacatgtcgatgtcgtccaacatatgggcattaagctattgcgccacgacgtaacagcgttttccctaccaccggaacagcgaacagttcattattttgatgaccactttgaggagatggtacgcgggtgtcggctgattgccgattatgccaaacaatacggaatgccaacgacgattgaaaatcatggttttaatgtccagtcaagcgatcgtgtccagcgcctgcttcgtgctgtagaccgggaaaactttaaaacgacgctagatatcggcaactttctttgtgcagacgaagatccgcttgttggcatccgtaaaaatttgcctcatgcagcgacagtccattttaaagatttttatgtgcgcccatactatgagaatcccggggaagggccatggtttcgatcagtaaacggcaattatttgcgcggtgccattgtcggccacggtgaattgccgattcgagaaattatccgcctactaaaagtccatcattatgatggctacatcgctattgaatttgaagggatggaagattgctttaccggctcgagaatcgctatgaataacgtcaagcgtttgtggaatgaggttgcacgagatggctggaaagtaacggcagaggaggtgagcactgaatgcgtgtag

SEQ ID NO: 5386 - DNA, 696 bp, Bacillus clausii
ttgagaatgacaaattaacggttgaaattgcaaataaaggtgcggaaattcggagcatttggcataaagaacaaagcagggaagtaatgtggagcggagacccaacgtactgggggcggatcgcgcctatattgtttccaattgttggccgtttaaaagagggcgcgtatacatacaacgggaagtcttatcaactgagccaacatggatttttacgcgaccaaatgtttgttactgacgatttgcaaagcgacaaagccgtattccggtttgagtcatctggtcagtttgccgatgtgtacccttttgaatttacggtttatctatcgtaccagttaaacggacatacgctcaccgtaggctgggaagtcgtcaatgacaatgaggaggagatgtatttttcaatcggtgggcatcctgcttttaagattccctttcgctcagaagaaacattcacagagtatgagctttcctttaaagcggcagaaggcaagcaaatcgaacgttatgcgctttctaatggtttggtccaaaaaccggaaattgtgccagagctgaaaaatatcgggcttactgactcgctctttcaacatgacgcactcgtctacagccatcttgacgaagtcgctctttatccaaaacaacgccctgaagaaaaagttgttgtctcttttcctcgttttccttatgtgggaa

SEQ ID NO: 5387 - DNA, 681 bp, Bacillus clausii
  misc_feature (1)...(681): n = A,T,C or G
gattatcattgaacgtttaaaaaatggtcttatcgtgtcttgccaagcaaaaaaagaggatccaatctatttgccaggtatcattacgaaaatggctgaatcggcaatatggggaggggcggccggactgcgaataaatacgcctgaacatattaaagaagtgcgtaaaataacggatctgccgattattgggttatggaagcagcatacgaagggtaatcctgtctttattacacctactatcgaagcagtagaagaggtcatagaggcaggagcagatattgtggcaatagacgccactgatcgggccaatgcacaangagaaaaagcgtatcttcttattgataaaattaaacagaagtaccccaatacgatcattttagctgatattcgcaatgaaaaagaagctgttttggcattagagcaaggcgcccatatggtagcgccgactttatatcgatttaacgatcatccaaaatcaattgacagtccagatttcgagatgaaggctaaaatcgttcgcgtaacacaagggaatggcgtcgtattaatggaaggcaaaattaatacccctgaagaggcaatcgaaagtctttatttaggtgcgtatgcggtagtagttggaagtgccataactcgcccccatctaacgacattaagatttaccaacaaaataaacaa

SEQ ID NO: 5388 - DNA, 456 bp, Bacillus clausii
taataaaaaaagcaatacatttgtcagtccagcttcaggcacgattaaattaattgatcaagtgaaggatgagacattttcccaaagaatgatgggggatggatttgcaattgaacccacttcttcgcacatctatgctcccattaatgcaaaagtcgattttgtttttcaaaccaaccatgctgttgggttaaggacagatgacgggaaggagattttaatacatgtgggcgtagacacagttcgcctagagggcaaagggtttactgctcatattaaagaagggcaaagggtaaaagcaggcgatctgttattaaccgttgattttgattcgattcaagcacaggtcccatcaacagatatcattttgatttttacaagtggtgaagcttgtaccgtgaacaatcctgacagtaaagttgacgcttggcaggaaaatattatccaactttcaaa

SEQ ID NO: 5389 - DNA, 230 bp, Bacillus clausii
atgaagttgcagcttgcgcttgaccgcctgaattgggaaacgtgttttgcgctagtagaagatacaagtgacgctattgatataattgaaataggcactggcgttatcaaagaatatggcatggaaatcgtaaggcaaatgcgcaaagcattcccccgccacacgttgcttgcagacatgaaaatttgcgatgccgggaaacacgaggcacgacaagcgtttgcagcagg

SEQ ID NO: 5390 - DNA, 780 bp, Bacillus clausii
cggcttaaaaacaggctggattagccggcttgggaaagatgaatttggccagcatattcaaacatttgcccgtggcgaaggggtagacgtcagcgaaacgaaattagtcgacggctatgctacatcacttaactttaaagaaatcatggcaaacggagcgggacgtactctttattatcgcaatccgtcgccaacagagacattaaagcctgaggatttacagccgagttatttccaacaagcaaaaattttccatttaacagggatttacccagctgtctcccctggcaatatggcagtgacaaagcaagcaatcaagcttgccaaagaaaatggcgtaaaagttgcttttgacccgaatatccgcctgcgcctttggagcaaagaggaagcgcgacttgctctgtacccgcttttgcaagaagtcgacattctcctcacaggcgatgaagagatggagattattctcggaacaagcaatccagctgagattatcgccgaaacgacgaagcttgggatagacttagtagcaatcaaacgaggagagcatggctcggtcggcagttatcaaggtaaagtcgtcgaggcagcaccggtgccagcggcaaaagtcgtcgacacagttggcgctggagacggctttgatgctggactgttgtatggttatctccaaggttggcctcttgagcggatgctgacatttgccaacacaataggttcgatggtcgtcagcattgtcggggacaacgaaggcttgccttatttagaagaagtgcaagc

SEQ ID NO: 5391 - DNA, 168 bp, Bacillus clausii
ctatccttactatagctcagatgcatctgctgctattaaggcaggccatgatttagtccacggcttaattgggccaggcattgaaggttcccattcgatggaacggacacatcagtcttcactggaagccacataccgccttctatgtgcctacacttattcggagat

SEQ ID NO: 5392 - DNA, 733 bp, Bacillus clausii
atgtgtgcagcatttagcgttggcgttagtttagtagcaatcgcaggatgcggtgccgaaaatgaaagcgcttcctctgaaggagaaaagccttctgctgaagaaggcccgtttaaatttacaattatggctaatttgcatacagcagaagtgccagaaaaagaagtccaacatttattggaagaggcgacaaacacagagctcgacattcaatgggtgccagacagcaattatgaagaacggttaaataccgcgtttgcgacagggacgttgccccaagctgtttatatgaaaaaccaaacaacctatgaccagtttaaagatgcgatccgcgatggacaattttgggaaattggcccttatttagatgaatacgagaacttgaaaaaactaaagccggaagtcgtggaaaatacaatggttgatggaaaagtatatgcgctctaccaaggccgtccgttagcgcgttcaggcatcatctatcgcaaagactgggctgacaaccttgggctagaggcgccaacaacgattgaagagttcgcagaaatggcgcgcgcttttacagaagacgaccctgatggaaacggccgcgacgacacgattggcttaacagaccggaacgacctcgtttatggggcctttaaaacagtcgcgtcgtggcatgggacgcccaaatgggatggggccgaaaaaagacgcgagcttttgccagaatttatggttgatgagtatt

SEQ ID NO: 5393 - DNA, 474 bp, Bacillus clausii
cgctgtaggcgttaactggaacttagccccagttgctgatgtgaacaataattcgaacaacccagtgatcggcgtccgttcatttggcgaggacccaggcaaagtcggcgaatacgcggaggaaatgatgaatggcttgcaggcagagggcgtcatcgctacactgaagcattttccaggccacggtgatacggtcgttgactctcaccatgcaatgccgaccattccccatggcttaaaacgccttcgacaagtggaacttatgccttttaaagcgtgtataaaagcaggtgcagaagcgatcatgagcgctcatatccatttccccgcactggagacggagccagtgcctgcgacgatgtcatataaagtaatgacggaacttttacggcacgaactaggctattcaggcgtattgatgacagactgcttagaaatggaggcgattgccgggacaattggcaccgcccgagg

SEQ ID NO: 5394 - DNA, 419 bp, Bacillus clausii
atgaatccagtgatgcagtggatggagaaacattttattccgattgcgggacggatcggttcacaacgtcacttagttgcgattcgcgacggttttgtcgcgatcatgccgttaatcattattggctcattcgctgtcttgattaacaatttgcctatcgcgtttttccaaaactttatggccgacctattcggcgaaagctggacaacgcttggcggcaacatctgggatgggtcgtttgcgatcctttcattgcttgtcgtggcaggaattagttacaatttagctaagtcttatgatgtggatgctctgtctgctgcacttcttgctgttggctgctatatcattttgacgccaacgacggatgattggggactatcattcgcttggacgggagcgcaaggtctgtttgtcggtgt

SEQ ID NO: 5395 - DNA, 926 bp, Bacillus clausii
ggaaataacattgcaaaccggaaagtcatcagtgatactctgctacatttggcaaaaaaaaataaagacattttagtattaacaagtgattccagaggttcagcatccatggcgtcaatcgcagatgcgctgccagaccaactggtagaagtaggaatagcagagcaaaacttagtagggattgcagccggcttggcggcgtctggaaaaaagccgtttgtagcttctccggcctgttttctaagcatgcgaagcatagagcagattaaagttgatattgcttactcaagaacgaatgttaagttaattggaattagcggcggtgtgagttatggagcgcttggtatgtcacatcactccctacaagatttggccgtgaccagagccataccggatttacacgtcatgatgcctgctgatcgtcatgaagccaaaaaaatgaccgaagccttagtggattatcatacacctgtttatatgagaattggcagaaaccctgtggaggattcttatataaatgagaattacgattttgaaattggcaaggcagttacgatgcatgaaggaaacgatctaaccatcattgcatcgggagaaactgtacgcattgcacttgatgcagcttatttacttaaatcagaagggattgcttgcagagtattaaatatgcatacgatcaagccgctagatgagaaagctgttataaaagcagctaaagaaacggcacgaatcattacgatagaggaacatagtatttatggcggacttggttctgccgtttcagaagtgatttcacaaaattaccctgttcctatcaaaatcattggcattccggatgaaccagcgataacaggcaatacaaaagaagtgtttgaacattatggcttgagtgctccaaatgtttctactatcgctaaagaaatgat

SEQ ID NO: 5396 - DNA, 1629 bp, Bacillus clausii
tgaataaggacacttgcttgtttgcgacgtctcctaaaggcaaagtattgaacacggcttgtgctggcgatgctttgttggccacgttcattggccatatccagcaaggcacacctgtggaagacgcactaagcgaaagcaacagcaacaggggcttctactgccctttcaaaagggttaagcgatttaaaagatgttccaatgcttctcgatcaagtacaaatcacgcggaggggattcacatggcaaaagtaaagattgtcgctgcaacgggctgtccgacaggcattgctcatacttttatggcagcggaagcgctgaaaaaagcagcgaaaaacatggacgtggagatcaaagttgaaacgcatggccaagcgggaatcgaaaatgcgttaacaaaagaagaaattgaagcggcagacggtgtcattgtcgctgccgacaaagatgtcaatacggaacgctttcatggcaagcggcttgttgatgtcccagtagcgaaggcattgcgaggcgccgaagaactaatccaacaaattattgataaaagcgcgccggtttatcgagccaaaggtggagtgctgccagaagaagcgactggcgaagacaatcagccaactggcaaaaagaacattggtcgttcactttataagtcactgatgaatggtgtttcccacatgctgccatttgtagttggcggcggcgtgttgatcgcaatttcctttttgttcggcatttattctgctgatccgaaccatgaatcttacaatgcatttgcggcatttctgaataaggttggcggcttgagttttagtgttatggtaccaatattagccgcatttattgccgaagcgatcggcaaacgttctggtatggttgccggttttatcggcggtttgctcgcggtcgaatcgggggcaggttttcttggcggcatcattgctggttttgccgctggctatttaattgtcctgttgcaatacctattcaaaaaattacctcgttcattagacggacttaaaacaatcttcctttttccggtgcttggcatctttctaattggcgcggtcatgtatccattgatgtcacctgtctcctctctaaacgaagcaatgattgcgcctttagcttccgtccaatcatcaagtccgctgctgctcggcttaatcgtaggcgctatgtgcgcatttgacatgggcgggcctgtcaacaaagccgcatacgtaacagggacattgttgctatctgaaggaaatttgtacttcatggctggcgtgtccgctgcgtgtatagcgccaccgcttatcactgcatttgcggtcttgttctttggaaagtacttcaataaagaagagcgaaactcaggaatggtgaactttattttaggatccacccatattacagaaggggcgattccgtttgctgccaaaaacccgattgtcgtcttgccgattttgatggttggttcagcgattgcagcaatcatgacatatatgtttggcgtgcaagtgccagcaccccatggaggctttcttgtactgccagttgtgactggagcggttaagtgggtgatagcaattttaacagggtcggttattggcggggtcttgttcgggctataccgtaaaa

SEQ ID NO: 5397 - DNA, 2064 bp, Bacillus clausii
atgaatgcagacaaggaatacaaaatagtcaatcaagggccgtccattagtaaagaaaagcaacgcttgctaatagaaaaaattggccaaatggaagcaggcagtacgttgattgtttcaggaagtttgcctgtaggcgtgtcagaaggcattctcgccgagattggcgccatttgtcaaatgaacggcgtccattatgtccttgatacaagcatttcttctttagacgccgtgttggcgactcaaccttatttattgaagccaaatgaagaagagttagcaggtttctttcaagtgcaacatccattgagtgaaaaagagcttgtctactacggctatgaattgataaagcgtggagcaaagcaagtactcatttctcgcggaaaagacggcagcatttatttgaataaggacacttgcttgtttgcgacgtctcctaaaggcaaagtattgaacacggcttgtgctggcgatgctttgttggccacgttcattggccatatccagcaaggcacacctgtggaagacgcactaagcgaaagcaacagcaacaggggcttctactgccctttcaaaagggttaagcgatttaaaagatgttccaatgcttctcgatcaagtacaaatcacgcggaggggattcacatggcaaaagtaaagattgtcgctgcaacgggctgtccgacaggcattgctcatacttttatggcagcggaagcgctgaaaaaagcagcgaaaaacatggacgtggagatcaaagttgaaacgcatggccaagcgggaatcgaaaatgcgttaacaaaagaagaaattgaagcggcagacggtgtcattgtcgctgccgacaaagatgtcaatacggaacgctttcatggcaagcggcttgttgatgtcccagtagcgaaggcattgcgaggcgccgaagaactaatccaacaaattattgataaaagcgcgccggtttatcgagccaaaggtggagtgctgccagaagaagcgactggcgaagacaatcagccaactggcaaaaagaacattggtcgttcactttataagtcactgatgaatggtgtttcccacatgctgccatttgtagttggcggcggcgtgttgatcgcaatttcctttttgttcggcatttattctgctgatccgaaccatgaatcttacaatgcatttgcggcatttctgaataaggttggcggcttgagttttagtgttatggtaccaatattagccgcatttattgccgaagcgatcggcaaacgttctggtatggttgccggttttatcggcggtttgctcgcggtcgaatcgggggcaggttttcttggcggcatcattgctggttttgccgctggctatttaattgtcctgttgcaatacctattcaaaaaattacctcgttcattagacggacttaaaacaatcttcctttttccggtgcttggcatctttctaattggcgcggtcatgtatccattgatgtcacctgtctcctctctaaacgaagcaatgattgcgcctttagcttccgtccaatcatcaagtccgctgctgctcggcttaatcgtaggcgctatgtgcgcatttgacatgggcgggcctgtcaacaaagccgcatacgtaacagggacattgttgctatctgaaggaaatttgtacttcatggctggcgtgtccgctgcgtgtatagcgccaccgcttatcactgcatttgcggtcttgttctttggaaagtacttcaataaagaagagcgaaactcaggaatggtgaactttattttaggatccacccatattacagaaggggcgattccgtttgctgccaaaaacccgattgtcgtcttgccgattttgatggttggttcagcgattgcagcaatcatgacatatatgtttggcgtgcaagtgccagcaccccatggaggctttcttgtactgccagttgtgactggagcggttaagtgggtgatagcaattttaacagggtcggttattggcggggtcttgttcgggctataccgtaaaaaaatagctaatggaaaaccaatcgaagggtaa

SEQ ID NO: 5398 - DNA, 648 bp, Bacillus clausii
ggaaaagcatggttatgactttattgaaattcgtacagaagataagctgcctgaatatttaaaaacccatacattagctgatttaaaccaattttttgcggagagccgtcttaaaccactggcgcttaatgcccttgttttttttaacaatttaggcgaagcagcctataaggaaatgatgaagcagtttcaagaaatgctccatgtcgccgagcagctcaacatcccttatatcgtagcggttccacttataacaaagcagccgcttttaagagaggaaatccgtaaaagctgtgtcgagacattgtctactttggctgaggaggcgcagcagtcgaaagtgaagattgcccttgagtttgttggccatcctgattgcactgtcaatacgtttgccgacgcttaccgcatcattgaagatgttaatcgggaaaatgtcggacttgtgtttgattgtttccattttcatgcaatgggttcgaaccttgaagatttacaacaggccgatggcgaaaaaatctttattgtccatattgacgacacagatgattttcccgttggcgcacttcgggatgaacaccgtgtctggccaggcgagggagccattgacctcgctggtcagtttaccgcattaacagcgatcggtta

SEQ ID NO: 5399 - DNA, 486 bp, Bacillus clausii
  misc_feature (1)...(486): n = A,T,C or G
aatgtggtggcactttggtggaattgggtcatgcagagcggcgagcaaactttaatgaaacagatgaaatgatcaaccagaaggcacgcttggtgcttgaactcggaatgacacccgttntatgtattggagaatcaatcgagcaaaaagaaagcgtcagagatcatttacgacaacaattagtatccaacttaacggcaatcgattcagcaaagcttgaaaatgtcattatagcttatgaaccaatttggtcgattggtcaggcggaagcagcagctccagaatatgttcataagattcataaaatgattcgacaattgctttatgaattgtatggacaaaaggtttcagagaaagttcgcatcatctatggtggttccgtgagtaaagttaatgcgggtgctattatagccgatgaaaatgtcgatggtgtatttgttggtcgatttggacatgaaccagacaatttcaaggaaattattgaag

SEQ ID NO: 5400 - DNA, 745 bp, Bacillus clausii
atgaaagcctataaaagttacttatttgatttagatgggactgtgtatcatggcagtgagccaatcgtaaacgcagtcaattttatcaatcaattagccaaatgccatattccttatggctttgttacgaacaattcaacgagaagccccaaacaagttgccaaacgattaaatggaatgggcatctcagccgagccttggcaaattatgacttctagcgtagcgacagcctcttatttacaagcaaaaatgccccattccgcgctttatattattggcgaagaagggctgtttgaagcattggcagcatttgcgcagacagaagacaagcctgatgctgttgtcattgggctagatcgggcgattacccatgaaaaactgagcaaggcagcccgctttgtggcaaatggagcggacttgattgcgacaaatccagatgcgatgattacaaccgagtcagggcttgttgtcggaaacggcgcccttgtagcagcggtggcgtacgcaacaaaaacagaaccgattgtcattggcaagccaggagctgcgattgttgaagctgccatcaaacagttaaagcttgacccgcgtcacactgtttttgtcggcgacaattatgatacagacttgctcgctggtattcatgctggcattgacacgatccatgtacaaacggggatcacaaccgatttatctgcgtataaaattcaaccgacatatagcatcccttctttagcagattggc

SEQ ID NO: 5401 - DNA, 504 bp, Bacillus clausii
gaaatgaggagacgagtgtacgccaagcagtgccgctgccggttttgcaaactcaatttccaggagtggtgtttgttaaaggagatccggcaagcaaccaagtagcattaacgtttgatgatgggcctgatcctcggtttactgaacaagtattgacgaagctcgatcaacatcatgtacctgctacgttcttcgttttaggaaaacgggttgaagcgaatcctgaattgttggtgaggttaaatcaagcgggccatgaagtaggaaaccatacgttttcacacccgaatttatctgaaggtagccttgagcagcttgaagcagaagtgacgaaaacggaggaatttatagaagcgacgattggctaccgacctcgtttgtttcggccgccctatggttttttgacggcagaacaagttggacgtcttcaagcgttaaatcacattgttgttggttgggatgtcgacacgctcgattggcaaggaattccggcccaagaagtaa

SEQ ID NO: 5402 - DNA, 612 bp, Bacillus clausii
  misc_feature (1)...(612): n = A,T,C or G
atgaaaggtctgttaaagnacgcctgtcatgttgtcacgcttctagccgcctttagttgttccggctgcctgtttgcttctgtcggcaccaatgacccagtagagctgcgttttacctactggggtgggccgctagagcgagaagcagttgaaacattaattgccacatttaataacgagcatccagggattcaagtgagggcaccgcttgtcccgattaatagctatgtggagaaaatgaatgtgatggctgcatcgaaaacacttcccgacgtaggctattttccagagggcagcttgtacccgtgggtggaaaacggcatgcttcgcgatttgacgccattgttgacaggagacgaagcaaacgaaaagctcgattatacgctatatcagtttcatgatgggccgattgctaggggcagcgtcgcgaatgaagtgataaacatttattacaacaaacaattgtttgcagaagcgggagtagaactgccgccgacaaaagcagaagaggcatggagctgggatgaatttgtcgaagtcgccaaaatgcttactgtagatcggaacggacngagggcgaatgagcctggctttgatgaagaaccggattga

SEQ ID NO: 5403 - DNA, 222 bp, Bacillus clausii
atgaagcgcctgcaatcctgccagcaactctgcctattaacgccccaaaatagggactgttgtccgtatactcattcatatccttgtagccgagggcaacgtttgctaattgtccgctgcggtcaaaagcatctattctcgttacgatgccgccgtaatctaggcagtcaaggcgcatgccatgtttgttttgcaaacgtatttgcttccagccatttctga

SEQ ID NO: 5404 - DNA, 552 bp, Bacillus clausii
atgagttcaaatgaagggacttttccgaaacactttctctggggaggggcggttgccgctaaccaatccgaaggagctttcgccgttggcggcaaaggatttagcctagcggacacccaccgctatcgttccaatcaggatattacaaaagtaagccatgattcggacaggacgcttgcacaaataaaagaagcaattgaagacaaagtcggttattacccaaaaaggcatgggattgacttttaccacacgtataaagaagatttgaaacttcttgctgaaatgggctttaaaacgtttcgaacgtcgattgattggtcgcgaatttttccaaatggcgatgagacagagccaaacgaagaagggctaaaattctacgaccagttaatcgatgaaatcagaagtcttgggatggaaccaattattacaatgcttcactatgaaacgccgttgaacattacgcttcaatatggcggtggcataatcgccaagtcattgacttattcgtccgttatggcgaagtgttgctcaatcgctataaaggcaaagtaa

SEQ ID NO: 5405 - DNA, 228 bp, Bacillus clausii
atattccgcagcctattcgagctgatggcgctggaggcgttgatcgtggtccgcggaatttgatgcgtgatcttcaaaaccctaatatacttgttccaccggaaaccgatagtgggttgattcctaatttgcgtttttctttttccgatgcccatatgcaattaaatcatggcggttggtcaagagaaattacgcaaagggatttgccgattgcgacaacacttgccg

SEQ ID NO: 5406 - DNA, 819 bp, Bacillus clausii
tgcccggatcacggctgttgaccaaaatggcaggaactttatagctgatgtcggccccagagacttatggtattttccccctgggattccccactcgattcaaggtttggatgacggttgtgaatttttgcttgtttttgatgatgggatgttctctgatttaagtacattgtcgttgtccgattggatggcccacacgccgaaagacgttctttcggcaaattttggtgtacctgaatctgtatttgcaaccattccaactgaacaagtgtatatttaccaggatgaagttccaggaccgttgcagtcgcaacaaataaactccccttatggcgctgtgccacaaacgtttaagcatgaattattaaaacagcccccattggtcacacctggaggcagtgtacgtattgtcgattcaaggaattttcctgtttccaaaacaattgctgctgctttggttgaagttgaaccaggagctatgagggaaatgcactggcacccgaataatgatgaatggcagtattacttaactggccaggcaagaatgactgtgtttactgggaatggcgtagcgcgtacatttgattatcgggctggcgatgttgggtatgttccttttgccacagggcactatattcaaaatacaggcaacgaatcagtgtggtttcttgaaatgttcaaaagtgatcggtttgaagatgtatctttaaatcaatggttggctcttactccaacggaacttgtccaacataatataaatgtcgattccaagtttactgatcagttaaggaaagaaaaatggcctgttgtgaagtatcc

SEQ ID NO: 5407 - DNA, 846 bp, Bacillus clausii
  misc_feature (1)...(846): n = A,T,C or G
aatggtccaanatgttactngcccatgcccggatcacggctgttgaccaaaatggcaggaactttatagctgatgtcggccccagagacttatggtattttccccctgggattccccactcgattcaaggtttggatgacggttgtgaatttttgcttgtttttgatgatgggatgttctctgatttaagtacattgtcgttgtccgattggatggcccacacgccgaaagacgttctttcggcaaattttggtgcacctgaatctgtatttgcaaccattccacctgaacaagtgtatatttaccaggatgaagttccaggaccgttgcagtcgcaacaaataaactccccttatggcgctgtgccacaaacgtttaagcatgaattattaaaacagcccccattggtcacacctggaggcagtgtacgtattgtcgattcaaggaattttcctgtttccaaaacaattgctgctgctttggttgaagttgaaccaggagctatgagggaaatgcactggcacccgaataatgatgaatggcagtattacttaactggccaggcaagaatgactgtgtttactgggaatggcgtagcgcgtacatttgattatcgggctggcgatgttgggtatgttccttttgccacagggcactatattcaaaatacaggcaacgaatcagtgtggtttcttgaaatgttcaaaagtgatcggtttgaagatgtatctttaaatcaatggttggctcttactccaacggaacttgtccaacataatataaatgtcgattccaagtttactgatcagttaaggaaagaaaaatggcctgttgtgaagtatccta

SEQ ID NO: 5408 - DNA, 330 bp, Bacillus clausii
atgatgaaggggattaaaaaaatgaaacggggagataacgtgaagccgctaaaagggaatccaaatattccgcagcctattcgagctgatggcgctggaggcgttgatcgtggtccgcggaatttgatgcgtgatcttcaaaaccctaatatacttgttccaccggaaaccgatagtgggttgattcctaatttgcgtttttctttttccgatgcccatatgcaattaaatcatggcggttggtcaagagaaattacgcaaagggatttgccgattgcgacaacacttgccggaagtgaatatgagtttaacaccaggaggcgtacgtga

SEQ ID NO: 5409 - DNA, 474 bp, Bacillus clausii
catgctagtcgatgagagcacaattttgatcaatgtgcatgcgaaacataaagaagaggttctacagctcatgtcggacaacctcgtcgcccacggatttgtaaacaaaagtttcactggcgcggtgatagcgagggagcatgagtttcccacaggtttgccgatggatgggatggcagtagccattccccatacggatattgaacatgtgcgcaaaaagacgatcagcattgcccagttaaacgaaccagtagaatttggcgtaatgggcggaacggattcagaaagagtaaccgtcaaacttgtctttatgttggcgatggaagaagcccattcccagttaacgattttgcaacaactgatgaagttatttcaaaacaaagaagcaatgacacaattagcctatgcaacatcgaaacaagaaatcaaaacggtcgttttaaatcatttaggaacagaaactaaaggaggaaa

SEQ ID NO: 5410 - DNA, 360 bp, Bacillus clausii
tcgctcgtaagcaagagggcgttctccgatttctggataaacaattacaagaaagagggttggtgagcgaaggcttttatgaagcattaattaaacgagaaaaacttgcctcaacagcatacggaaatttagtcgcgatcccacacccgattacaccacaaacagaaaaaacattcctagcctttgtcaccttaaaagaaccggttagctggaatggaaaaccggtccagttggtatgcttattgtgtgtcaaacaaggcagcaccgaagatttagaacgtgtctataaccaattgctttatgtacttgaccatcgtgacattgtccaagagtgcataaagtccgaggaggtaacccgat

SEQ ID NO: 5411 - DNA, 427 bp, Bacillus clausii
atgagcattttaaaagcagagaacattaaaattggcgcgagtgtggcctcgaaagaagaagcgatcaaacttgccgggcaagtgctggctgaccaaggctatgtgaatgaacagtacattgacaaaatgtttgcccgtgaagaattgacgtctacttatatggggaatttgcttgccattcctcatgggacagagcatgcccgtgaggacgttacacagtctggcttatcgattttattgcttgatcaagaaattgactggaatggcaaccctgtgcagctcgtcatcggcattgctggcaaaggagatgagcatttggagatactctccaaaatagcgatcgcgtgctcggaagaggacaatgtcagagcgcttctccaagtgaaaacagctgacgatgtacttgactttttttcagggagtaacg

SEQ ID NO: 5412 - DNA, 218 bp, Bacillus clausii
gtgaaattggtcgatattttaacgcgtgacaatataattttgaaccttcaagggaatagccagacagctgttattgatgagttagtcgataaattggcacaaaacggccttactgataacccggaagcattcaaaaaagcgatttataaaagagagcaagaaatttcgacagcagtcggctatggcgttgcgattccacacgcaaaatctagcactgt

SEQ ID NO: 5413 - DNA, 427 bp, Bacillus clausii; identical to SEQ ID NO: 5411

SEQ ID NO: 5414 - DNA, 405 bp, Bacillus clausii
ttcgaaagaagacgcgattaaagaattaatcgaattgcttgatgagaatggggccatcgaatcaaaagaaggctttgaaaaagatgtatatgagcgggaagctcaaggcatgacggggattggcggcggggtcgccattccccatggcaagtcggatgctgttcgccacacagcgattgccatcggccggacgaaacagccaattggttgggaaacgttagacggaaaaccggtgcaggcgattatcttgtttgcggtgcgcaaagaagatgagggcaatcttcatttaaagcttctggccaaagtagctggtgcgcttgcccgcgatgaagtgtgtgccgcattgcttgaatcgaactcaaaagacgacattatacaggcatttgatgaacaggagggagaatc

SEQ ID NO: 5415 - DNA, 433 bp, Bacillus clausii
atgacagaagaactaataaaaaaagaacatgttgcggttggcgttcaagcaaaagactgggagagagccattgaagcatcaggttccttgctagtcaagtcaggagcggtaacttcagagtatgtcaagcaaatgattgattccgtcaaagaaaacgggccttacattgtcattggccctgggatggcgattgcccatgccagacctagtgaggcggtgcatacggacgccgtttcgttagcaatcttaaaagaggctgtgccgtttggcaatgaagagaatgacccagttgaccttgtcttttcattttcagccacgggagcagaatcccatttgcatttaattgagcggctatcgcgtcttttgcttgatgaagaaaaagtcggtcagctacgtgaagcaaaatcagccgaggacgtttatcaaattattt

SEQ ID NO: 5416 - DNA, 410 bp, Bacillus clausii
  misc_feature (1)...(410): n = A,T,C or G
atgattacagaaaagcaaattcatttgcactcaagcgcatcaacacaggaaggcgtttttcaggcgattgcagatttggctgtggaaaatggcattgcggtagacaacgctagtgttgttgctggattaaaagaacgggagtccttaagtacaacgggcttccaagatggttttgcgattccacatacacagtctgactcgattacaagaccagcaattataatcgtccgcacggaaacaggaattgagtgggaatcatttgatgggaagccagcattcttttttatttcattgctcgtgccacatggagaagcaggaacaacgcatttgcaggcgttagcggctctgtctcgggctttaatggatgatgagtcgcgccnngcgttccttactgcgcaatctagtaagca

SEQ ID NO: 5417 - DNA, 250 bp, Bacillus clausii
atgagaaaaaaacaagggcgattaacgatcgtcaaacaaactgagattgctcgcgacagctatgagcttgtgctggaaggcgaattggttaagcacatgagtcaaccgggccagtttttgcatgtacgtgttgatgaatcagaagacctgctcttgcgccggccgattagcattgccaatatcgatcctgaaaaagagcaagtgacgatgatttaccgtgcaggcggggcaggcacaaaacgccttgctg

SEQ ID NO: 5418 - DNA, 781 bp, Bacillus clausii
  misc_feature (1)...(781): n = A,T,C or G
atgagaaaaaaacaagggcgattaacgatcgtcaaacaaactgagattgctcgcgacagctatgagcttgtgctggaaggcgaattggttaagcacatgagtcaaccgggccagtttttgcatgtacgtgttgatgaatcagaagacctgctcttgcgccggccgattagcattgccaatatcgatcctgaaaaagagcaagtgacgatgatttaccgtgcaggcggggcaggcacaaaacgccttgctgtccaaggcgtnnggaccnaattcnncgtgcttggaccacttggggcagggcttnccacttgaggaaacaaaaacaaggagaaaaagtgactgttagttgncggnggnatagncgttccaccnctttattatttagnaanacgtnaagtagaaaatggngtccgtgtcacttctgtgctngnattcgcctcacaagcggatgttttttacgagcaaccgtttaaacagttggncgatgtctttatcgcaacagcggacggcagttacggcgctcgtggctttgtcactgacgtcattagccaacaaagcatcgattttgatgttctctactcatgcgggccaacgccaatgttaaaggcgttaacagaccgttaccgggaacggcgtgcctttatttcccttgaagagcggatgggctgcggcgtgggcgcttgctttgcttgcgtttgccatgtagaaaatggccaagctcatgagtaccgcaaaatttgtacagacgggcccgtctttccagtaggggaggttgttctgt

SEQ ID NO: 5419 - DNA, 769 bp, Bacillus clausii
ttgaacgatgtgcataactttaacgcaggccctgcagctcttccaaaacaagctttagaaagagcgcaaaaagaactggtcaattttgacgggacaggcatgtcggtcatggaactgagccaccgcagcgacacatatgaccgcatccatactcatgcgattaagaaaataaggaaattgttggaagttcctgatgactaccacatcctgtttttgcaagggggcgccagcttacaattcccaatggtgcccatgaattttcttgatcagcaagcaacttatatactgacaggagcatggtcagaaaaagcgctcgcagaagccaaacatttcggcaaaacggtgattggtgcatcgggaaaagacggtaattataaacaaattcctgctttaaaccagattagcgaacatgcgcaagactcgtatatccacatgacatcaaacaatacgatatatggaacccagtggcatgcctttcccaatacgaaagcgccactcgtgtgtgatatgtcaagcgacatcttctcgcgccgcatccccgtaaaccaatttggcctaatttatgccggagcccaaaaaaacttaggcccttcaggggtgacgcttgtattgatccaagattcgtttttgcagcgagctaaaagcggccttccggcaatgttgtcgtataatacgtttgttaaatcaaattccctttacaatacgccgcctgtgttttcgatttatatgctcggtctagtcctcgattggctagaagaatctggtggtt

SEQ ID NO: 5420 - DNA, 624 bp, Bacillus clausii
catccatactcatgcgattaagaaaataaggaaattgttggaagttcctgatgactaccacatcctgtttttgcaagggggcgccagcttacaattcccaatggtgccgatgaattttcttgatcagcaagcaacttatatactgacaggagcatggtcagaaaaagcgctcgcagaagccaaacatttcggcaaaacggtgattggtgcatcgggaaaagacggtaattataaacaaattcctgctttaaaccagattagcgaacatgcgcaagactcgtatatccacatgacatcaaacaatacgatatatggaacccagtggcatgcctttcccaatacgaaagcgccactcgtgtgtgatatgtcaagcgacatcttctcgcgccgcatccccgtaaaccaatttggcctaatttatgccggagcccaaaaaaacttaggcccttcaggggtgacgcttgtattgatccaagattcgtttttgcagcgagctaaaagcggccttccggcaatgttgtcgtataatacgtttgttaaatcaaattccctttacaatacgccgcctgtgttttcgatttatatgctcggtgtagtcctcgattggctagaagaatctggtgg

SEQ ID NO: 5421 - DNA, 186 bp, Bacillus clausii
gaagcatactcatgggactggttgtacgtttgcttcagcgatagcagcagactcgcaaaggggcaaagccaatcgaagcagctaaaaagcgaaagcatatgtgactgccgcgatttcggaaggaattccattaggagccggaatcggcccgacggaccatgctgcttatcgccgccttggccaaga

SEQ ID NO: 5422 - DNA, 818 bp, Bacillus clausii
gtgaaaacagcagaggaagcagtacaatgggtgcattcgctattgccgtttggcataaagccaggattaaagcggatggaatggatgcttgaagcattaggccacccagaacaaaagctaacggccgtccatgtcgctggcaccaacggaaaaggttcgactgtcagttttttacgtcacatccttacagcggacggcttttcagtcggcacgtttacatcgccttacattgaacagttttcagagcgcatttcggtaaacggtgtgcccatttccgatcatgacttgcttcaagctgccaagcgcctaaagccgattgtcgaggaagtggcacagtctgacctcgggtcgccaacagagtttgaagtgctaacggcgatgatgttttaccactttgccgaagtcgctaaaccggacatttgtttaattgaagtcggcctaggtggcagactcgattccaccaatgtggtgatgcctgttttatcgattatcaccatgattggtcacgaccatatgcacattctcggcgatacacttgcggaaattgcctatgaaaaagcgggcattattaagccaggcgttccggttatttcaggggtagaaggggaagaagcgtatacagttatttccgaggcagctcgccaaataggaagtcccttgcaccagttaaatgaaacgttttttgtcgagagcctccaaggacgaacgtttacatacaaagaggaaaggggcgaggaagccgttcgttatcaagccgggctctacggggcacaccaacataaaaataccgcgcttgctcttaaagcagtttcgttgct

SEQ ID NO: 5423 - DNA, 483 bp, Bacillus clausii
atggtgcttgctctgccaatgatttttatgtggctcaagccgattcctggctggaatccaggcgtgtatggaacgattgggattttgtttattgcctatatcactcggtttatggtgttgcaagtccggggcagctatacagcgatggttcaagtcgatccgtcgatggaagaggcggctagcttattcggagcacggccaatggcgaagtggcgccgcgtgttagtgcctttgctactgccaggtgttttaagtggcgcgttccttgtatttctgacggcgttgacggaactgactgtctcctcattgctatggtcgagcgggtcagaaacgattgggcttatgatctttaactttgagcaagccgggtactcgactcattctaccgctttttcgatgctcattgtcacggccattttgcttgtaatggtcagtatgtatatgcttcagcatgttcgagacaggaggataaaggacatatga

SEQ ID NO: 5424 - DNA, 459 bp, Bacillus clausii
tgcactaccaggaatggtgcttgctctgccaatgatttttatgtggctcaagccgattcctggctggaatccaggcgtgtatggaacgattgggattttgtttattgcctatatcactcggtttatggtgttgcaagtccggggcagctatacagcgatggttcaagtcgatccgtcgatggaagaggcggctagcttattcggagcacggccaatggcgaagtggcgccgcgtgttagtgcctttgctactgccaggtgttttaagtggcgcgttccttgtatttctgacggcgttgacggaactgactgtctcctcattgctatggtcgagcgggtcagaaacgattgggcttatgatctttaactttgagcaagccgggtactcgactcattctaccgctttttcgatgctcattgtcacggccattttgcttgtaatggtcagtatgtatatgct

SEQ ID NO: 5425 - DNA, 176 bp, Bacillus clausii
atgaatcgcaaaacatcagaatccctttaccaggaagctcaacatgtaattgtaggtggtgtaaatagcccttctagagcctacaaaggagtgggcggcggcacgcctgttttcacggaaaggggagaaggtgcctatttttatgatgttgacggcaaccgctatattgattattt

SEQ ID NO: 5426 - DNA, 1047 bp, Bacillus clausii
atgttaaaaaacaagacgattgtagtaggcgtgagcggaggcatcgccgctttcaagacagcagcgcttgtcagcaagttaacacaggcgggggcgaacgtttatgtggtcatgacagaagccgccacgaagtttgtaacgccgttgacgtttcaagcactatctcgtaatcctgtttatacagatacatttacagaaccagacgcaacaaaaattgcccatattgacattgctgaccaggcggatcttgttttgattgctcctgcaagcgccaatacaattgcgaaattagcggcaggcattgctgacaacatgctgacaacgcttgtgttggcaacgaaagcgccagtggcattagcaccagcaatgaatgtcaacatgtacgaacacccgtctgtacaggaaaacatggaaaaactacggtcttatcattatcaattaattgaacctggcgcgggttatcttgcttgcggttgggtcggcaaaggccgtatggccgagccagagcaactgctcgaactggtggatacgcttttggaagaggcgacagctttgcgaggcaaacaggtaatcgtaacggcagggccgacaagggaacctcttgacccagttcgttttttcagcaattactcttctggaaaaatggggtatgcgctggcgcaagaagcacggcgacgcggcgcttatgtcacgttaataacaggtccggcggcgcttgaagctcctgttggcgttgagacggtcgccgtacaaacagcggaggaaatgtacaatgcggtaaataagcgctatcaacaagcagatatcgtcataaaagcagcagcagttgccgattaccaacctgttgacgtttttgcccataaacagaaaaagaacgcagacaaatggtcggttgcactagagcggacaaaagatatcttgcgttttcttggcgaacataaacaggaacaaattcttgtcggctttgcagccgagtctgagcaactgcacacatacgccaaaagcaagcttgaacgaaaaaaccttgacttaatcgtcgcgaacaac

SEQ ID NO: 5427 - DNA, 594 bp, Bacillus clausii
gacagctaccagatgatctcaagctatgtgagcaggcagtgcgcaacatgctcgaagaagtcgatattgttattacaactggaggagcttctgtcggtgattttgatcttgtgcctcaactaattaagaaattaggcgccaagcaaatttttaacaaagtagcaatgaggccaggaagcgtcacaactgcggcccatgttggcggcaagccgtttttcggtttgtcaggcaatcctggggcttgttttgttggctgcgagttgtttgtccgcccccttatccggcgtagccttcaagctcaaaacattcatttgaaaaagagtaaagcaattttagcggttgattttccaaaaccgaatccatttacaagattggtgcgcggcattctttcagaagaagatggcgttcataaagtggcgccctctggcctcgacaagtcagggtcggtcatttctcttgccgaagcagatgtgttgatgatgttgtctggagggacgcgtggctatcaatctggcatggaagtggatatattgcttttaggtgaacaacaaggaagtgaatggccgtggggaagcgttgccgtatcttccaagt

SEQ ID NO: 5428 - DNA, 552 bp, Bacillus clausii
atgctcgaagaagtcgatattgttattacaactggaggagcttctgtcggtgattttgatcttgtgcctcaactaattaagaaattaggcgccaagcaaatttttaacaaagtagcaatgaggccaggaagcgtcacaactgcggcccatgttggcggcaagccgtttttcggtttgtcaggcaatcctggggcttgttttgttggctgcgagttgtttgtccgcccccttatccggcgtagccttcaagctcaaaacattcatttgaaaaagagtaaagcaattttagcggttgattttccaaaaccgaatccatttacaagattggtgcgcggcattctttcagaagaagatggcgttcataaagtggcgccctctggcctcgacaagtcagggtcggtcatttctcttgccgaagcagatgtgttgatgatgttgtctggagggacgcgtggctatcaatctggcatggaagtggatatattgcttttaggtgaacaacaaggaagtgaatggccgtggggaagcgttgccgtatcttccaagtcgtag

SEQ ID NO: 5429 - DNA, 201 bp, Bacillus clausii
ttcagttaaccaataaaccgattgatgtccaacaggtaatcaaccaagtgaccgatagaaactgcggagcgattgccacttttatcggcactgtccgtgagtttaccaatggcaaaaaaacagtgcgtctggaatacatcgcttatgaatcaatggctgaaaaaatgctgaaacggattggcgctgaaataaacgaaaggg

SEQ ID NO: 5430 - DNA, 823 bp, Bacillus clausii
atgatagaaaaaatacgaatggtcccatttgctttattggtctttagtgctgttagtttggcaggatgcggagcagaaaatgtccaagagcaagtgaattccgcggcagaaacatctgaaacaaatgaaacggaacaggcgaaaggaacgaatgcaattgctggaacgctttcgttttatacatcccagccagatgccgatgctgaggcgctcgtcgctggctttcgcgaacagtatcctgatgtcgacgtcacgattttccgttctgggacagaagaagttgtcagccgcttgttggcggaagaggaggcgggttcggtacaagcggacgtgcttttgctggcggatgcagtgacgttcgaaaacttaaaagagaaggacttgctgttgccatacgagtccccggagcttgcccacatccctgctgattttgttgatcaagactatatgtatatcggcacaaagctaatggcgactgtgctcgcttataacaccgatttagtagaggaggcgccaccatcttggttcaagttacccgcagaccatgccaaaggggaactgacaatgccaagccccctttattcaggcgcggctgcatacaacgcaggtgtatttagccgaaacgacgattttggctggtcgttttatgagaagctttatgaaaatgaaacaacagtcgttcaaggaaatggcggtgtggtccaagcagtagcgggcggcgaggcttcttatggaatggtcgttgattttgtcgtagccaatgcgaaagaacaagggtctccgattgattttgtttatccagaagaaggcgtgccagtcatta

SEQ ID NO: 5431 - DNA, 407 bp, Bacillus clausii
  misc_feature (1)...(407): n = A,T,C or G
aaaaacgttcattttttacgaaagtgctggatggaattgaacgtatcggaaacaaactcccgcatccgttcatgttgtttatttacttggccgtgtttttaatggtcatttcagcggttttacatgcgttcgacttaacggtgctagatccaggcaccaatgaaacagtagctgtaaggagtttgctatctcaagaaggctttctctacattctctcgtcgatgcttagcaattttacaggattcgccccttttgggcttgttattacgatgatgcttggtatcggcttggcccaaaaagcggggctatttgaaacattcatgaagacaacgattttaaaagcgccaaaatcacttgttacatacgcggntgtttttgcaggaatacttggcaacattgcttctgac

SEQ ID NO: 5432 - DNA, 201 bp, Bacillus clausii
aggccccagcgccaacagctatggctcttggctattttgacggcgttcataaagggcacaaggcggtcatcgaaaccgctaaagcagaagcggaaaaacggggcattcagtctgcggtgatgacgttttacccccatccgaaagaagtgcttggtaaaccggatcagccaattgattatttgacgcctctgcaagcaaaag

SEQ ID NO: 5433 - DNA, 300 bp, Bacillus clausii
ttgtagatgatgaagaccgggagaatgaaggggattttttggctcttgctgaaacggcgtcccctgaaacaatcaattttatggcaacacacggacgcggtcttatttgtgtccctttgacagaagagcaggctgaacgcctgcagcttgggcagatggtgtctcacagcacagatccacatggaacagcatttactgtgagcgtcgaccattcacgtacgacaactggcatctccgcttttgagcgggcagaaacggtccgcgctctagcagatgccaatgcgctgccaaagtgatttt

SEQ ID NO: 5434 - DNA, 369 bp, Bacillus clausii
cccatgctggcggcattactgaatgcaagaaaattctatcaatggctgaggcatttgatgtggctgccgctccccattgcccacttggaccaattgcactcgcggcatgcctgcaagtggatgcaacttgccacaatgcgtttatccaagaacaaagccttggtatccattacaatgaaggatctgatcttctcgattatctcgtcgatggcagcgttttccactataaagatggttatgtggacataccgaacaaacctgggcttggcattgaaattaatgaggaccatgtccgcaagatgagcgaaacaggccacaattggcaaaaccctgtctggagacatcaagacaacagcgttgcagagtggt

SEQ ID NO: 5435 - DNA, 266 bp, Bacillus clausii
atggcccaatcgaaagaacaacgcgttcatgacgtatttcagtcgatttataaaaaatacgacgtgatgaactctgttatcagtttgcagcaacacaaaagctggcgtaaagatacaatgaagcaaatggatgtccaagcaggaacgagtgctctcgatgtatgttgcggcacaggtgattggacgttggcgctgtcggaagctgtaggcgagcatgggtccgtgattggccttgattttagcgaaaatatgctcgcagtcggacg

SEQ ID NO: 5436 - DNA, 576 bp, Bacillus clausii
accggcgacgttgtcaattggttattttcagcgtgtcgccaaagaaattcgaatggaagctgttagagaaaaacagctcggctttgtgcgccgccctacgggagggcgtggcgtgttgcatgaacatgagttaacgtatagcgtgattgtgtcagaagcccatccagctatgccaaagacggttacagaagcataccgcgtcatttccacagggttgcttgaaggatttaaagcattgggcctcaatgcttactttgctgttcctgacagcgaaaaagagcgtgaggcattaaagaagccaaggtctgcggtttgttttgacgccccgtcctattatgaattagtcgtggaggggaaaaaaatagccgggagtgcgcaaacgcggcaaaaaggcgtgattttgcagcatggctcaattcttctagatatagacgaagagaaattgtttgatttattccagtatcgaagcgaccggttgagagagcggatgcagcgcgctttttcgcaaaaggccgttgcgattaacgcccttagaaaggagcctgtcacattagacgaggcaagccgagcgtttaa

SEQ ID NO: 5437 - DNA, 432 bp, Bacillus clausii
tatctacaatgaggatgactggattccgcttattaaaatatcagagagcatcgaaaaaattctcaatccaggccgcaaaaaagtgtatcgtttattcggcccagacgggatggcaaaaggggactacatttgcttagcccatgaaagcctggatggtcaatcagaaattgtcttaaaacatccgaccaatccgttgaaagcgaagaaaatccgtgattttgaggcagtcgaactccataagcaaatttttaagcaaggcaaatgcgtgtacgctgtcccaacattagaagaagtgcgggcctaccatcaacgccaaaaaaacacgttttgggaagaatatttgcgcttagaagttccggaagtgtatccggtttccctttctgacgaactaagaaacatgaaagaacgactgattgaagaaaaacggcaaca

SEQ ID NO: 5438 - DNA, 498 bp, Bacillus clausii
  misc_feature (1)...(498): n = A,T,C or G
tgacgctcccctaacggcagaaacaaaagtatcgatcattgccgccctctcgaaagcggctggcgctancggcatggttggcgggcagcttgcagacatgtttgcggaaggaaancagcttaccgttnaacagcttgccaacgttcacaagcgcaaaacgggcgaattgttggctttttcaatcgaagcaggagccctgattgctggggtatcaaacgaggaacggagcaaattaaacgaattcggacaggagattgggctattattccaaatcaaagacgacattcttgatgtagaaggcgatgcaatcgccatcggtaagcctgtcggcagtgacgctgtcaataataaaagcacttatccagggcttcttggccttgagggagcgaaaacgatgcttcacactcattatgatcgggctttacaagtgctcgatgagcttcatttgcgagggacgttgctcgaggacttggcaaattacatcgttacgcgtgacca

SEQ ID NO: 5439 - DNA, 210 bp, Bacillus clausii
  misc_feature (1)...(210): n = A,T,C or G
ctttgaaaaagcgcngacgtccgacttggatttgtttgctggctatttccgnggaatgttggcagagggcatatctcttgccccatcgcagtttgaagggttgtttttatcgacggcccactcaaacgaagatattgaggcgaccattgcagcagcagagcgagtctttcaagcaatcgccgcgaaataaacaagcattcatttgcaaaa

SEQ ID NO: 5440 - DNA, 303 bp, Bacillus clausii
gctcgcttcaatccggtacaggcctcgcagacaacctggttacacgggccgctgatgtcatgttaaaagagcgtaaaccgctattattaatgacacgggaaacgccacttaatgatatacatttagaaaacatgctggctttgtcgcgaatgggggctcatatcgtcccgccaatgcccgctttttataaccagccgcaaacgattgatgatcttgttgaccatatcgtttaccgcacccttgaccaattcggcattcacttgcctgatgcaaaacgctggcaaggattaaaagcagagcgcc

SEQ ID NO: 5441 - DNA, 501 bp, Bacillus clausii
aggccaggattctacgctggcagcaaaacttgcgcaaatggcagtagatgagctcaatcaggaagctccagggacataccaatttcatgccgttcgtttgccttatggcgttcagcacgatgaagaagatgcgcaagtggcgctgtcgtttattagccccgataagatccatacggtgaacattaagccagctgttgatgctgccgttgcctcttttgtagaagcgacaggagaagagctgtctgggtttataaaaggcaatacgaaagcgcgggaacggatgaaagtccaatttgatttggcagcccactaccaatgccttgtacttggtaccgaccacgctgccgaagcggtaactgggttttttacgaaatttggcgatggagcttgtgatgtcattccgttatatgggctgacaaagcgacaaggcaaagcgctgctccaagaacttggggcgccagaggcactgtaccaaaaagtcccgacagccgatcttgaaga

SEQ ID NO: 5442 - DNA, 546 bp, Bacillus clausii
tgggtttagcgcaaacttgctattatcggcgaccgacccaatgctcggtgaattaacgatgcaagcagctgcaacaatagacccagcgtacgctgaacaaatgaataacgcaatgaattactggtttattattgtatcaacgattttgattacgattgtcggtacgatcgtttctgaaaaaattgtggagcctcggttaggcacttataaaggggactatacaggcgatttggaacgtttaaaaccaatcgagaaaaaaggcatgctttatgctggcatcgctctcgccatttctgctgccttaatcagtttacttattgttccagaatgggggccgatgcggggcacgggcgaccaaccgattgtcgtttcgccgtttatggactctctcgtcgttattattttgttgcttttcctcataccggggctcgtttacggaattgtaacgaaaaacattaaaagcgataaagatgtagcaaagcaaatgacggacacgatggcatcgatgggcatgtttatcgtccttgcttttacagcgggccaatt

SEQ ID NO: 5443 - DNA, 513 bp, Bacillus clausii
actgcttcagtcaggtgcttacatttctggcgaggaaatgagccgtaagctcggcgtttcccgtacagccgtgtggaagcagctatctgcgctgagagaacaaggttacgagcttgaatcagcaccgaaaaaaggctatcgattgctctcttctccagacactttgcttgcccatgatatcgaagcacatttacaaacaaaaacgcttgggcgaaacatccacagttatgattcggttgcctctacccaacctcttgcccatgaagaggcagcccgggaagcccgagaaggaacgctcattgtcgcaaatgaacaacaaggggcaagaggcaggcttggccgccaatggcaatctacgaaggggacaagcctatcgatgagcttgcttttacggccagacattagcgttaaccaagcgccgcaattaacgcttttggctgctgtagctgtcacaagggcaattgaggcagtaagtgggttggtttgtgacatcaagtggccaaatgatatttt

SEQ ID NO: 5444 - DNA, 513 bp, Bacillus clausii
ccagtataattgggatcaaggtttacgcatttacttgaggaggattaagcgcaaaacggcattgttgattgccgttagctgccagttgggtgccattgtttctggtgcgacggctgaactccaaaaaaatctttactactttgcttattttcttgggatgtcttatcaaattatggacgacatactcgattttgtaggcaccaatgaacagctaggcaagccggctgggggcgatttgcgccaaggcaatgtcacgttgcctgcgctgtatgcaattgagcacacgcctggatttaaacaacggctagagaagtcgttaacgaaagagtcgtctttagaaatggacatggagccgctattaaatgaagtccgcacatcaggcgggattgaatatgcacaggcaatgagtgaccgctatttgcacaaggcgaacacgcttttaatggaatttccagacattgatgccaaaaggcatttaattgaagtagccagttacataggacggagaaaata

SEQ ID NO: 5445 - DNA, 474 bp, Bacillus clausii
ctgcacgagggtggcgttgatgaagttagcagatatttataaagcatttcaaggagatatagaatttattgaagcagaattggagcgaaccctttcggctaaacaccctgttttaaaagaagcatcaacggggttgttaaaagccggcgggaaacgaatccgtcctgtgcttgtgcttttggcggggaagtttggcgattatcaattagacaggttaaagcacattgccgttacgcttgaactcattcatatgggttcccttgtccatgatgatgtcattgataatgcaccgctaaggcgtggacgggaaacagtgatgtctcgttgggataaccgtgtagcgatgtatacaggcgactacattttcgggcacgcgattgaaacgacaaaagcctttagcgataaacaagtccatacgattatttccgacgtcatgaaccaaatatgccgaggcgaaatcgaacaaatccgaga

SEQ ID NO: 5446 - DNA, 464 bp, Bacillus clausii
cgttttacgtgggcatgccacttgattttagggataacgatcgggattgcgcctctaggcggatgggttgctgtaacaggccaactgccattggctagcttttgtttgtttttggctgttatgttttggcttgctggttttgacaccgtgtatgcaacacaggatgctgaatacgatcaaacacacgggctccattcgattccaagccgtttcggcatcaaaaaagcgttatggatcgcccgttgttttcatgtcgtcagttttgcgttttttgtcggtctctactttttaacgcctttgacatggatttacttagtgggcgtcgccctttcaggaatgattatgatttaccagcatttaattgtttctgagaaagatttatcaaaagtgcaattggcgttttttccgatgaatgggacgcttagtgtcgtcatgtttttgtttgctttcgctgatatgcttgt

SEQ ID NO: 5447 - DNA, 465 bp, Bacillus clausii
gttttacgtgggcatgccacttgattttagggataacgatcgggattgcgcctctaggcggatgggttgctgtaacaggccaactgccattggctagcttttgtttgtttttggctgttatgttttggcttgctggttttgacaccgtgtatgcaacacaggatgctgaatacgatcaaacacacgggctccattcgattccaagccgtttcggcatcaaaaaagcgttatggatcgcccgttgttttcatgtcgtcagttttgcgttttttgtcggtctctactttttaacgcctttgacatggatttacttagtgggcgtcgccctttcaggaatgattatgatttaccagcatttaattgtttctgagaaagatttatcaaaagtgcaattggcgttttttccgatgaatgggacgcttagtgtcgtcatgtttttgtttgctttcgctgatatgcttgtta

SEQ ID NO: 5448 - DNA, 444 bp, Bacillus clausii
tgacccagttcgttttttcagcaattactcttctggaaaaatggggtatgcgctggcgcaagaagcacggcgacgcggcgcttatgtcacgttaataacaggtccggcggcgcttgaagctcctgttggcgttgagacggtcgccgtacaaacagcggaggaaatgtacaatgcggtaaataagcgctatcaacaagcagatatcgtcataaaagcagcagcagttgccgattaccaacctgttgacgtttttgcccataaacagaaaaagaacgcagacaaatggtcggttgcactagagcggacaaaagatatcttgcgttttcttggcgaacataaacaggaacaaattcttgtcggctttgcagccgagtctgagcaactgcacacatacgccaaaagcaagcttgaacgaaaaaaccttgacttaatcgtcgcgaacaa

SEQ ID NO: 5449 - DNA, 489 bp, Bacillus clausii
  misc_feature (1)...(489): n = A,T,C or G
atgattgtgtttgtttatgcacgagacgcccactatggcatcggccaagacaacgggttgccttggcatttgcctgctgatttgcgccattttaagcggacaacgacaggtaaaacgattgtcatgggccgaaaaacatttgactctatgggtgggccattgccgaatcgcaaaaacnttgttctcacgagaagcagctcctttcaagcagaaggagcggaagtaatccattcactcgacgatgtcctgcaacttagcaaacaggaagcgatttacgtcataggtggagcggagatttttgcgctgttatgggacatatgtgacaaacacattgtcacggttattgacgaaaaatttgaagcggatacgtttgtcccccctctatctgancaagaatgggagcttgtggaaacagtgcctggaccaatagatgaaaaaaaccgctatccccacgaatatcggacttacgtgcgtaaacaagcaaaataa

SEQ ID NO: 5450 - DNA, 749 bp, Bacillus clausii
atgaatcgcaaaacatcagaatccctttaccaggaagctcaacatgtaattgtaggtggtgtaaatagcccttctagagcctacaaaggagtgggcggcggcacgcctgttttcatggaaaggggagaaggtgcctatttttatgatgttgacggcaaccgctatattgattatttagcggcatacggccccattatcaccggtcacgcccatccagtcattacaaaagctatacaagaccaggccgccaaaggcgttcttttcggcacgccaactcggcttgaaaatgaatttgcacaggaactaacaaatgccattccatcccttgaaaaagtacgctttgtaaattcgggaactgaagcggtcatgacgacgattcgcgtcgcaagagcgtatacaggcaaagaaaaaatcattaagtttgctggatgctaccatggccattctgatctcgttctcgtagctgctggatcaggcccttctacactcggcactccagactcagctggcgttacagctgcaacggcaagtgaagtcattaccgttccctttaatgacatcgcggcatttaaagaagcgctagcccattggggaagcgaaacagccgctgtccttgttgaaccaatcggtggcaatttggcattgtcgaacctgagccaggctttttagaagctgttcatgaccttgctcatagcgccgggcgctctcgtgatctatgatgaagtcattacggctttccgctttatgta

SEQ ID NO: 5451 - DNA, 407 bp, Bacillus clausii
ggtggggaaatgctgacttccttgaatttagacggcattccagtcgttattggctttattataatcactgccttcattaatttgtttgtcggcagcgcatcggcaaaatgggcgatgatggcacctgtgtttgtaccgattatgatgcaaattggctactcgcctgagttggcgcaagcgacttatcgcgtcgcagactcggccaccaatatcattacgccactgatgacctatttcgccattgtcattgcttttgcccagaaatatgataaaaatatggggattggtacactaatttcagttatgctgcccttttcgatttggttcttaatttcatggtcattgctgttaatcgtctggatttttactggccttccattagggccaaatgcgcctatttatatgcc

SEQ ID NO: 5452 - DNA, 1074 bp, Bacillus clausii
atgtccacagtggaaaggaaaaagggaatcttccaacgttttcttgatgggattgaaaaagcaggcaataagttgccacatccagtgacgctatttgcgattcttgctgttcctgtcgtgatcatatctagcgttgtagcaagctttggcattttagtcgaggatccagctaatcctgaagaaacgattgctgtaaaaaacttgctgagcggtgaagggatttcctatatattcacgagtatggttgacaactttattggcttcgccccattaggcgtcgtactcgcaacgatgctcggtattggaatttgtgaacgcagcggtttgattagtgccggattaagaggctttgtgctctcgattccaaaccgcctcatcacggcagggctcgtttttgcggcagtgatgtcaagcgttgcctcagatgcgggttacgtggtactgcctcctttaggcgctgtcatttacgcagcactcggcagacatccactagcagggcttgccactgcatttgccggtgtctccggtgggtttagcgcaaacttgctattatcggcgaccgacccaatgctcggtgaattaacgatgcaagcagctgcaacaatagacccagcgtacgctgaacaaatgaataacgcaatgaattactggtttattattgtatcaacgattttgattacgattgtcggtacgatcgtttctgaaaaaattgtggagcctcggttaggcacttataaaggggactatacaggcgatttggaacgtttaaaaccaatcgagaaaaaaggcatgctttatgctggcatcgctctcgccatttctgctgccttaatcagtttacttattgttccagaatgggggccgatgcggggcacgggcgaccaaccgattgtcgtttcgccgtttatggactctctcgtcgttattattttgttgcttttcctcataccggggctcgtttacggaattgtaacgaaaaacattaaaagcgataaagatgtagcaaagcaaatgacggacacgatggcatcgatgggcatgtttatcgtccttgcttttacagcgggccaattt

SEQ ID NO: 5453 - DNA, 498 bp, Bacillus clausii
tgacgctcccctaacggcagaaacaaaagtatcgatcattgccgccctctcgaaagcggctggcgctagcggcatggttggcgggcagcttgcagacatgtttgcggaaggaaaacagcttaccgttgaacagcttgccaacgttcacaagcgcaaaacgggcgaattgttggctttttcaatcgaagcaggagccctgattgctggggtatcaaacgaggaacggagcaaattaaacgaattcggacaggagattgggctattattccaaatcaaagacgacattcttgatgtagaaggcgatgcaatcgccatcggtaagcctgtcggcagtgacgctgtcaataataaaagcacttatccagggcttcttggccttgagggagcgaaaacgatgcttcacactcattatgatcgggctttacaagtgctcgatgagcttcatttgcgagggacgttgctcgaggacttggcaaattacatcgttacgcgtgacca

SEQ ID NO: 5454 - DNA, 249 bp, Bacillus clausii
ccagtagaagaacgatccacgttagactagaggaaatcattttagacgttaaaaaggagttatacatgtccatacaaggaaaagtgtacctcgtcggcgcaggacctggagacgccgaactgttgactgttaaagcacgcaagatattacagcaagcagacgttgtgatttttgacaggcttgccaatccggcgctaatcatggaagttagcgatcatgccaagttggtgtatgcaggcaagcagcccg

SEQ ID NO: 5455 - DNA, 306 bp, Bacillus clausii
atttatgcgccaccgccgtttacgccaaagtgacgcgattcgccgcatggttcgggaaacgacattacaagctgatgatttgatttatccgctttttgtaacagaagagaaaaacaaaaagacggaagtgccgtcgatgccaggggtctatcagttttcacttgatcgcctaaatgaagaagtgggggaagtggaaaggctagggatcccggttattattctatttggtgtcccatcagaaaaagatgcttgtggttcacaagcgtatgcggaagaaggcatcgtccagcgtgcgattcggcaagt

SEQ ID NO: 5456 - DNA, 572 bp, Bacillus clausii
  misc_feature (1)...(572): n = A,T,C or G
atgcgaaagattgtgattggcacacgccgaagcaaattggcgttaacgcaaacacattgggtcattgagcagcttaaacagcttggcgttccctatgagtttgaagtgaaagaaattgtgacgaagggcgaccgtattctcgacgtgacgttatcaaaagtaggcgggaaagggttgtttgttaaagaaattgaagcagcgctccgctctggggaaattgatgttgccgtccactcaatgaaagatgtgccgtccgaactgttggaagaattcactcttgctgcgattacagagcgagaagatccacgggatgtgcttgtgagcgaagatggccacacactggacgagcttccagctggtgcaattgtcggtacaagcagcttacggcgttctgcgcaaattttacataggcgcccagatgtgcaagtaaaatggataccgggcaatgtggagacccgtttgcgcaaaattaaaagaggaaagatttttcggcgatcgtcttggcttgcagctgggtttnagcggcttggcttattgaccaggaccatcatttacccgaatacnttagaccc

SEQ ID NO: 5457 - DNA, 189 bp, Bacillus clausii
ttcgttctggcgttggccatattcgcattgtcgatcgtgattacgtagaaatgagcaatttgcaaaggcaaatgctgtctactgaaagcgatgtagaacaagcactgccaaaggcggtcgctgcaaaacaaatgttagaaaaagtgaacggatcggtgcacattgcaagcatttgtagaagatgtaacg

SEQ ID NO: 5458 - DNA, 228 bp, Bacillus clausii
agggaatcgatctcgtattagatgggacggataattttaaaacacgttttttgcttaatgatgcctgttttaaaaaaaggcattccttttgggtatggcgggagctgtaagcgccaggggcatgagtgctttcctagttcctgaaaaaaacgccatgcttgcgctgttttatcacaagcggtgcatccccgggggagacgtgtgacacagtcggcgtcatttccccct

SEQ ID NO: 5459 - DNA, 582 bp, Bacillus clausii
tgcttttagcagcaggcacaatggcgatttgcctattcgtcggcactggactcgcctatatgcgtgcccgtcaaccaaatgcacttaatcgggcgcttgaagtatttgttggcttcccatatgcactaccaggaatggtgcttgctctgccaatgatttttatgtggctcaagccgattcctggctggaatccaggcgtgtatggaacgattgggattttgtttattgcctatatcactcggtttatggtgttgcaagtccggggcagctatacagcgatggttcaagtcgatccgtcgatggaagaggcggctagcttattcggagcacggccaatggcgaagtggcgccgcgtgttagtgcctttgctactgccaggtgttttaagtggcgcgttccttgtatttctgacggcgttgacggaactgactgtctcctcattgctatggtcgagcgggtcagaaacgattgggcttatgatctttaactttgagcaagccgggtactcgactcattctaccgctttttcgatgctcattgtcacggccattttgcttgtaatggtcagtatgtatatgcttc

SEQ ID NO: 5460 - DNA, 384 bp, Bacillus clausii
atgtatcggacaatgatgaaagcaaaattgcatcgtgcacgggttactgaatcaaatttaaactacgtaggcagcatcaccatagatgaagacctcatggatgcagtcgatttgcttgaaaatgaaaaagtacaaattgtgaacaacaacaacggcgaacggtttgaaacgtatgtgattaaagggacgagaggagaagggggcatctgtttaaatggtgccgccgcgcgaaaagtccaacctggagacgtcgtcatcattttgtcttatgcgatgatggaaaacgcggaagcccttgcccatcagccgaaagtggcgattttggatgagaacaaccgaattgtggaaatgttaggcacagagccagcttctaccgtccgttag

SEQ ID NO: 5461 - DNA, 501 bp, Bacillus clausii
  misc_feature (1)...(501): n = A,T,C or G
gttggtgcgtgcctgtgcgcaaacatgcgacttggtcgttgtgagcatttacgtgaacccactgcaattnggccctcacgaggactatcatgaatatccaagacaattggaaaaagaccgcgtgttagcagaagaagcagggtgcgatgtgctgttttgcccaactgatgaagaaatgtatcctgatgggtatacgcaaacggttcatgtgaagcaaggtgcgaacgtgttatgcggcaaaagccgccctggccattttgacggagtggctaccgttgtgttgaaattgtttatgcttgttcagcctgatttcgccttttttggtgaaaaagacgcgcagcaagtcgccattattaaacaacttgttaaggagttcttcctgcctgtgacaattgttgcttgtccaactgttcgcgaagacgacggcttggcgaagagctcccgcaacgccaatttgacgccggcagaacgccaagccgcaccgaagttatatgctgccct

SEQ ID NO: 5462 - DNA, 680 bp, Bacillus clausii
atgaaaattgtagatgttgtagagagagcagtgccaattagcagtaatatcgcaaatgcttttattgactttagtaaaatgaatgcctcaattgtagcggtaaagacagatgttattcgaaacggtaaaccagtagtaggctacggtttcaattccaatggtcgttatgcgccgagcggcattttaagagagcgatttattcctcgtttattagaagcaaaatcagaagatatcttaaatgaatcagggaccaacttctcgcccgaaaagatttttgacattctaatggcaaacgaaaaaccaggagggcatggtgaaagaacggttgcggttggaacactagatatggctatttgggatgcagtagcaaaaattgaggaagtgccactttataaactattggctgatcaatatggagacggcacgattgacgagaaggtctttgtctacgccgctggcggttattacttcccaggtaaagggttgccagaacttcaagatgaaatgaaagcctatttagatatgggttactcaaaagtcaaaatgaaagttggcggtgtacctttaaaggaagacctaaaacggattgaggcagttattgatgtcgtaggtacgggacagaacctaatggttgacgtgaacggccgattcaatctagaagaagcgattgaatttgggaa

SEQ ID NO: 5463 - DNA, 285 bp, Bacillus clausii
gcggcgggtttattcgtccgtctgttgtcttatttggagaaccgctcgattcaaacgtacttgccttagcggagcagcattcgatagaggcagatgttttcatcgtgctaggttcgtcgctagttgtatcaccagctaatctttttccaagaatggcgaaagaacacggggcaaagctcatcattgtaaaccgcgatcctaccccgttggacacaatcgccgattatgtggtaaacgaaaagccgattggttcctttttagtagaaaccaaccaagctttgcaaa

SEQ ID NO: 5464 - DNA, 152 bp, Bacillus clausii
atgattgtgtttgtttatgcacgagacgcccactatggcatcggccaagacaacgggttgccttggcatttgcctgctgatttgcgccattttaagcggacaacgacaggtaaaacgattgtcatgggccgaaaaacatttgactctatggg

SEQ ID NO: 5465 - DNA, 231 bp, Bacillus clausii
gaccaatcattggcatcaccatgggagacgcagccggcgtcggccctgaaatcatcgcaaaagcattggccgatgaatcaacctttaaaattgggcgtcctgtcgtgatcggcgatgcggctatcatggaacgggctgtcgacataaccgaaacagaattaaatgttgtatctgtatcaacggttgacgaatgtgtctttgaaccaggaacgattgaagtcattgacatgc

SEQ ID NO: 5466 - DNA, 519 bp, Bacillus clausii
tgggagacgcgatgaaagacatggccggttatatagggcttgtgtttgctgccgcccagtttattgcttactttaattggacgaatattgcgacgttgattgctgtaggcattgctgattttttacaacaagtcgaattcacagggttaggattgttcgttgtctttattttgctcgtaaccgtgctaaacttgtttataacaagtggttccgcgcaatgggcgcttatggcccccgtgtttgtgccgctgttcatgttgcttgactacaatccagcatttattcagcttgcataccggatcggcgattcggcgaccaatgtcattacgccgatgaatccatatgtcgtgatggtgcttggctttatgaaacgttatgacagcagggccggttttggcacgctaatgtcgacgatgctcccatatagtttgatcttccttggcgcttggattgtcctctttatcatttggaacgtagttggtttgccgatcggtccaggcagtggcatgttattaacga

SEQ ID NO: 5467 - DNA, 312 bp, Bacillus clausii
tggtccctgcgattgaaaaggcgcgtggagaagggatcgatgtagaaggaccatacccagcagacacactgtttttccgggctgctcgcggcgactttgacattgttgtcgcttgctaccacgaccaaggccatgtgccaataaaggtaatgggcttagaagcaggcgtaaacatcacggttggcctaaaaggcggcattgtccgcacgtctgttgaccacggtactgcctttgacatcgccggcaaaaacatagccgatgaacgaagccttctggccgcttatcgtgacgcggttgagcttgctcctaaat

SEQ ID NO: 5468 - DNA, 456 bp, Bacillus clausii
  misc_feature (1)...(456): n = A,T,C or G
gattgaatttggaaatgcgataaaggactatcatttattttggtatgaagaagcaggagacccgttggattacaaattgcaggaggaattatcgaaagtttacccacacgcaattgcgactggtgaaaatttgttctcccttcaagatgccactaacttaatccgttacgcaggtatgaatccaaagacggatttcctgcaatttgattgcgcgcttagctacggactagtggaatacatgaaaatattaaacatgctagaagaaaacggatggtcttctcgtaattgcattccacacggtggccaccaaatgtcattgaatattgcagcaggattgaaactgtacggcaacgaatcataccctggtattttccaaccatttggcgggtttgctgacgggcatgcagtggaagacggcttcgttacattnccagatgcgcctggtgttgggttcga

SEQ ID NO: 5469 - DNA, 510 bp, Bacillus clausii
ccaaaacatttaatgacacgttcttgaaagcgtgcaaaggggaaaaacatggccatgtgcctgtgtggtatatgaggcaggcaggaaggtcgcaacctgaataccggaaaattaaagaaacgcattcgttattcgatattacccatgatccggagctttgcgcgtatgtgacaaagctgccagttgaccaatacaacaatgatgcggctattttgtacaaagacataatgacaccgcttccttttatcggcgttgaagtggacataaagtctggaattggaccagtgattgacaatccaatccacggcctcagtgatgttgagcgcttaggggaaattgatcctgaacatgatgtgaaacatgtccttgatacgattaagctgttgcgcacacagcttgacgtgccattgattagctttgccggtgcaccgtttacgcttgctagctatatgattgaaggcgggccttctcggaattaccataaaacaaaagcatttatgcatgcagaac

SEQ ID NO: 5470 - DNA, 624 bp, Bacillus clausii
  misc_feature (1)...(624): n = A,T,C or G
agattttcaattttcngacatccctttttgtccatttcatggccagacggatggcggcgcatttgttacacttccccaagtgtacagcgaggacccagataagcccgggttgatgaacgccaatttaggaatgtaccgtgtgcaattaaatggaaacgactatgagccaaataaagaagttgggctccattatcaaatccagcgaggcattggcgtccatcaagcgaaggcggcaaagcggggcgaaccgctaaaagtcagcatttttattggcggtccaccggcacacacattgtcagcagtgatgccactcccagaaggtttaagtgaaatgctgtttgctggattgttggctggacgccgtttccgttacggctatgtggatggctatgccgttagccacgatgccgactttgtcattacaggagacatttatccagatgagacgaagccagaaggcccgtttggcgaccatttagggtattatagtttgacgcacccatttccagtaatgaaagtccataaagtctatgcccgcaaaaacgcgatctatccgtttacggtagtggggcgcccgccacaggaagatacgacatttggcgcgtctatccattaccttacagg

SEQ ID NO: 5471 - DNA, 423 bp, Bacillus clausii
tgtatgttaaaaatgcttcttctaagcggcagaacctaattgatttgacaagtttgttgccaaatattgtgccaggcattgtctttgttgttggcttgattttattttggaatgcaagttggctgccagccactgtctacaatacgaaatggatgccgattctcacgtacattgttttgtttttgccttactcgttccagtacacaaaggcagcattatcacagctcgaccaatcgattgaccatgccaattccatttatggcccgacggcagcgagtattcttgtgcgagtatggctcccccttctcgcacaaggtgttttggccggatggatcatgacgtttattatttcgatgcgcgagttagttggttcgcttttaattcttccaccatctgttcaaacaggcgctacgtttatttaca

SEQ ID NO: 5472 - DNA, 240 bp, Bacillus clausii
  misc_feature (1)...(240): n = A,T,C or G
tgaaactgattataggaatgacaggggctacaggggccatttttggcatccgtttgctccagcaactacgaaaaacagaagtggagtcccatttggtgatgtcgccatgggctgctgctacgatccaagctganactccttttaccgtaaaagatttgaacggtttgccgattatacgtattcgcctaaagatttaggcgcancgatttcaagcggctcttttcaaatccgatggcattg

SEQ ID NO: 5473 - DNA, 981 bp, Bacillus clausii
tgtacgtacagcacaaccatcccgtcctagtggaactagcggaagaggggctggcgtttacgtcatttgatgctgtttatgaacaacatagcgaatttgaagatgtttataaagagattgcgacgcgcttgctggaagaggcaaaacaaggtgacgtcctttatgctgtgcctgggcatccatttgtggcggagcggacggtccaacttttgcaaaaacaagcgcaaggaacaggcgtaacgatcgatgtacttggcggtgcctcgtttttggacaacatgtatacggctttggcaatcgatccaattgaaggctgccaaattgttgacggcacggcactacgagcggaggagttgcaaattcgccatcacctcatcatcgtgcaagtatacgatacactgatcgcctcagaagtaaaactaacgttaatggaaaaattgccagacgattatgaagtgtcgattgtgaccgcagccggcacgccagagcaatcaattttgcgagtgcctttgtttgaattggaccattatgtaaaaacaaacaatttaaccgctgtatatgtgccgcctgtaatagaggatcaattattgcatcgcgacttctcctatttgcgaggcgtgattgcaacgttgcgggggccaaaaggctgtccttgggaccagaagcaaacacaccagtcattaaaacggtacttgcttgaggaagcatttgaagtgtttgaggcgattgatgaagaagacgacagccatttggcagaagagttgggcgatgtcttgctccaagtgctcctgcatgcgcaaattggcgaagaacaagggtattttaacgtggatgatgtgattggggcgcttacggaaaaaatgattcgccgccacccccatgtgtttggcggggcaaaggcggaaacagctggcgaagcgttcagacgtggcagcaaataaaagcgcaagaacaagaagaacagcccaagcccaagtctgc

SEQ ID NO: 5474 - DNA, 453 bp, Bacillus clausii
tgaaaatttaaagctatgaactgttcaaagtccagccacggtggctgtttttgaaaatagagacggacgaaggaatgactggttggggcgaacctgtagttgaggggcgtgctgctactgtagaggccgctgtgcatgagctgatggaatacttgattggcaaagatccttttcaaattgaagaccattggaatgttctgtaccgcggcggtttttatcgtggtgggccaatattaatgagcgccatttccggtattgaccaagcattgtgggatattttagggaagtaccacaatgtgcctgttcaccagttgcttggcggcaaagcacgagacaagataagagtatactcatggattggcggagatcgccctaatgaagttggcgctgcagcgaaacaagtagttgacaaaggctttacagctgtgaaaatgaatgcaaccgatgaaatgc

SEQ ID NO: 5475 - DNA, 598 bp, Bacillus clausii
atgaagccttttggactttacgcgatcacaggagaggaattccatcctggacgcgatgtcgtagaagtgatggaagaagccatccaaggtggggtagacattattcagcttcgtgataaaacgagcagcaaaaaggctgtgttggaaaaagcccgtaggctaaaaaagcttgcggccaattatggaattccgtttattgtcaatgaccatatcgatgtcgcccttgccgtcgacgcaagcggcgtccatgttgggcaagatgatttgccccttccagaagtaagaaaattgctggggccagacaaaatcattggcgtttctacccacaagctagaagaggcacttgaagctgaaaagaacggagccgattatattggcgtcggtccgatttttccaacaaacagcaaagcggatgtagtagacccagttacaactgcatatattcgcgaagttaaggaacatgtgacgattccgtttgtggcaataggcggtatcaagcgccataatgtccgtgaagtgatcgaggctggggctgaagccgtttgcgttataaccgaaattgttgctgcccgtgacgtgaaagcgagctagtgcaagc

SEQ ID NO: 5476 - DNA, 384 bp, Bacillus clausii
  misc_feature (1)...(384): n = A,T,C or G
ttaaaatatcagagagcatcgaaaaaattctcaatccaggccgcaaaaaagtgtatcgtttattcggcccagacgggatggcaaaaggggactacatttgcttagcccatgaaagcctggatggtcaatcagaaattgtcttaaaacatccgaccaatccgttgaaagcgaagaaaatccgtgattttgaggcagtcgaactccataagcaaatttttaagcaaggcaaatgcgtgtacgctgtcccaacattagaagaagtgcgggcctaccatcaacgccaaaaaaacacgttttgggaagaatatttgcgcttagaagttccggaagtgtatccggtttccctttctgacgaactaagaaaccatgaaanaacactgattt

SEQ ID NO: 5477 - DNA, 222 bp, Bacillus clausii
aagacctaacacgggaactatatgcaaaaaaaggctacaaaacctttatgtactgtccagtcggctttgtggcagagcacttggaggtgctttacgacaatgattatgaatgcaagttggttacagacgaactaggcgttcgctatttgcgcccgccgatgccaaatgcagacactcgtttcttaaaggcgctcgccgatgtagtgccaaaacgcctggccg

SEQ ID NO: 5478 - DNA, 693 bp, Bacillus clausii
gtgttgccatcgttgaagctggagcgacagggctgtcagctgcactctggctccatgatcatagcgacttacaatacgatgtatatgaagcttcaaatcaagttggcggcaaaattgttacgtacaaagaccgtggttttgtaatagagggaggcgctgactcttatttagagcgaaaagcgagcatgactcatttcattcagcgagtaggccttggcgattcccttgttcgcaatgaagtggggcaatcctatattttaaagagcggtacgctttttccgactccaaaaaatacggtgttaggcattccgacagacatagatgcgtttttggaaacgaaactgatttcggatgaagggaaacgcaatttattaaaagaatatgagaagccgcgatttgcaaaaccaggagaagacgtctcagcaggtgctttttttgaataccgcttaggaaaagaaatggtcgattcgctcattgagcctttgctcggcggcatctacggcggcaatatttatgaactaagcatgaaagcgatatttcctcatttccttcaatacgaagcagaatacggcagccttttaaaaggggtagccgcaacgaaatcaacaagtaagcaggcgaaaaagcaaggaatgtttttaacagtcaaatccgggttggcgtcggtgctggaggctgctgccgaacagcttc

SEQ ID NO: 5479 - DNA, 990 bp, Bacillus clausii
  misc_feature (1)...(990): n = A,T,C or G
atgcaagttggttacagacgaactaggcgttcgctatttgcgcccgccgatgccaaatgcagacactcgtttcttaaaggcgctcgccgatgtagtgccaaaacgcctggccgctgtggtgaccaaatgaagcaaaagcgtgttgccatcgttgaagctggagcgacagggctgtcagctgcactctggctccatgatcatagcgacttacaatacgatgtatatgaagcttcaaatcaagttggcggcaaaattgttacgtacaaagaccgtggttttgtaatagagggaggcgctgactcttatttagagcgaaaagcgagcatgactcatttcattcagcgagtaggccttggcgattcccttgttcgcaatgaagtggggcaatcctatattttaaagagcggtacgctttttccgactccaaaaaatacggtgttaggcattccgacagacatagatgcgtttttggaaacgaaactgatttcggatgaagggaaacgcaatttattaaaagaatatgagaagccgcgatttgcaaaaccaggagaagacgtctcagcaggtgctttttttgaataccgcttaggaaaagaaatggtcgattcgctcattgagcctttgctcggcggcatctacggcggcaatatttatgaactaagcatgaaagcgatatttcctcatttccttcaatacgaagcagaatacggcagccttttaaaaggggtagccgcaacgaaatcaacaagtaagcaggcgaaaaagcaaggaatgtttttaacagtcaaatccgggttggcgtcggtgctggaggctgctgccgaacagcttcgccctgggtctgttcatttaaatgcagcggtagaacggattgatgtgctcgacgacggggcttttaccgtgtttgttaacggtacccaaangcggtatgantgctgtggttgttacgattccgccacnacaagcggcaaaattgtttgtagagattaa

SEQ ID NO: 5480 - DNA, 402 bp, Bacillus clausii
caagccggaccgcgacagcagaatgccgtgtccggatttcgccccacctttacgaggcgatccatgaacaatcattaaagaaaggcaatcctttgccagttgcccaagtagcaggaatcatggccgccaagaagacggctgagtggattccaatgtgtcaccctatccttatccaagggacagacctttcttttaagtatgaaccagtcaaagacggctacatgctcgtgattggcgcaactgttaccgttgatggcaacacaggcgttgaaatggaagcattaacagctgttacagctgctgcgctgactttttacgatatgtgtaaagcggtcgataaaagcatggtgattgaagaaacattgctcgtcaaaaaaacaggcggcaaaaacggcgactttt

SEQ ID NO: 5481 - DNA, 753 bp, Bacillus clausii
  misc_feature (1)...(753): n = A,T,C or G
ttaaccaaacgattttatgggaagttcctgaaacattcgccgcattttttaatggaaccgattattttccggcggcggcgtcatttccccttcaatcaaacgattattacaaacgtgtccgcgacatttgcgatcgctatcaagtcttgctcattttagatgaagtcgtctctggtttcggccggaccggtaaactgtttggctttatgcatggcgatgacgatttcaaacctgacatcatcacactggcaaaagggcttacgagcggctatctcccactaggcgctacgtgcgttgccgaaaatgtgtatcaagcattcgacggaaaaggcgagaccagccatttccgccacatctccacctacggcggacacccggcgtcttgcgcggtcgcgttaaaaacgattgatattattgaacgtgaacaaattgtcaatcgagtcgaagcgctatgccgcactattctcagcaagctaaaacaacttgaacaactttcgattgtcggcgaagtgcgcggaattggcttcctttacggcatagaacttgttcaagataaacagatcaaggagccagctgatgacgatacaatgaaagcgattgtaaacgcttgccaaaaacaagggctgatcatcggcaaaaacagcgacacgattccacgaagaagcaatgttttaattatcgccccnccactcacttcttaccaaagaagattagcttttctcgttgataccgtgtccagcgttctgcgtacat

SEQ ID NO: 5482 - DNA, 624 bp, Bacillus clausii
atgagtactcatcagaaaaaaaacaacagaaaggataggacaatggagaagaaaaaaattggattgcttgtcatggcttatggcacgccgcgcaagaaagaagaaatcgaaccgtattacacacatattcgccacggacgcaagccttcagaagaggcacttgctgatttgcaggaacgctatgaagcaattgggggcacaagccctttggctcgcattacggatgagcaagcaaacgggcttgctgctgttttaaatgagcagcaagaagacatcgtttttgtgccttatttaggccttaaacacattgatccgtttattgaagatgcggttcaaaaaatgaagaacgatggcatagaaacggctatttcgattgtccttgcgcctcatttttctacgtttagcgtgcagtcttacaataagcgcgctcaggaagaagcggaccgaattggcggacctacaatttatacaatcgaaagctggtataaagagccgggatttttgcagttttggaaagagcaaattgaaaatgaaatgaagaaggccgattctattgatgacctttgtgtcattttttccgcgcatagcttaccggagaaaatcaggggatcctctagatgtaaa

SEQ ID NO: 5483 - DNA, 562 bp, Bacillus clausii
atggagaagaaaaaaattggattgcttgtcatggcttatggcacgccgcgcaagaaagaagaaatcgaaccgtattacacacatattcgccacggacgcaagccttcagaagaggcacttgctgatttgcaggaacgctatgaagcaattgggggcacaagccctttggctcgcattacggatgagcaagcaaacgggcttgctgctgttttaaatgagcagcaagaagacatcgtttttgtgccttatttaggccttaaacacattgatccgtttattgaagatgcggttcaaaaaatgaagaacgatggcatagaaacggctatttcgattgtccttgcgcctcatttttctacgtttagcgtgcagtcttacaataagcgcgctcaggaagaagcggaccgaattggcggacctacaatttatacaatcgaaagctggtataaagagccgggatttttgcagttttggaaagagcaaattgaaaatgaaatgaagaaggccgattctattgatgacctttgtgtcattttttccgcgcatagcttaccggagaaaatca

SEQ ID NO: 5484 - DNA, 203 bp, Bacillus clausii
ttggataaaatctttttaaatcaagtgtctttttacggataccatggcgtctactcagaagaaacaaagttgggccaacactttatcgtcgatttagtgcttgagctcgatttaaggcatgctgcacgccatgatgatttgcaggcatccattgattacggagacgtacatgagcgtgtaaaagcgataggtgaagggaaacc

SEQ ID NO: 5485 - DNA, 144 bp, Bacillus clausii
aggtgtacaaaaagagcaaatttggcttgatccaggggtcggctttgcgaaaacgtatgaacaaaatttggaagttattcgtgaactagaccaaattgtcgaaatgggctatccagtgttgcttggtacttcaagaaaatcctt

SEQ ID NO: 5486 - DNA, 342 bp, Bacillus clausii
  misc_feature (1)...(342): n = A,T,C or G
tttgggcgggagattcaaacgaggccaagggtacaacgcttgtgccagcagaggaagaaatggagcggttattcccgtcattgaagcgatatcagcgcggatggacgtaccgatttccattgacacgtataaagccaaaacggcaaaagcggcagnacatgccggcgcagccattattaacgatgtttggggagcaaaagcggacccggaaatggcgacagttgctgccaaccttgctgttccaatcattttgatgcacaaccgcgagaatatgaattaccaatcgttcatggaagatgtgaaagctgatttgtcaagaaagcatagatatctgcgtcagag

SEQ ID NO: 5487 - DNA, 627 bp, Bacillus clausii
cagaccgggtgaaacaaggaatggcgcaaatgcaaaaaggcggcgttattatggatgtcattaatgccgaacaagccaaaattgctgaagaagcgggtgctgtcgcggtcatggcgttggaacgggtgccttctgatattcgtgcagctggcggtgtggcgagaatggcagacccaactgtgacagaagaagtgttaaacgctgtttcgattccagtcatggcaaaagcacgcattggccatatcgttgaagcgaaagtactggaagcgatgggcgtcgattacattgatgaaagcgaagtgctgacaccggctgatgaagtctatcatttaaacaaacgtgattttacagtgccgtttgtctgcggagcccgtgacctcggcgaagcggcacgccggattggcgaaggcgcttcaatgattcgcacaaaaggcgagccaggaacgggcaatattgttgaagcagtccgccatatgcggaaaatgcaggcgcaaatcaaacaagtagcccatatgtcgacagatgagttgatgacgggaagccaagcagttaggcgccccttatgaattattgttgcacattaaggaaacgggccaattgcctgtcgtcaattttgccgcagggggc

SEQ ID NO: 5488 - DNA, 568 bp, Bacillus clausii
atgaaaatcggagtactagccttacaaggcgcggtcagtgaacatatccgtttattaacgaacagtggcgcagaagcaatcgaaataaagcgtgcagaccagctagcagaagtggatgggcttattttgccaggtggtgagtcgacggcaatgcgtaggttgattgacaagtatcaactttttaagccgttgcaagaatttggcgaatcaggaaagccgatattaggcacatgtgctggattgatattgatggcaaagactctttctggtgagcaagatgggcacttaggtttttatcgacatggtccgtcgagcgcaatggcgtttgggcggcaacgggatagtttttgaagcacacttgatgtgaaaagggggtagcccgaaaaagcttgactggcttggtttttattcgcgcgccgcttgttaaagaagtcggcccagatgtagacattttgagcgaatacaacggagaattcgtttcccgttcaagccaagcccctttccttggcatgttcgttccatcctgaattgacggatgacgcccgcttgcatcaagcgtttataaaag

SEQ ID NO: 5489 - DNA, 267 bp, Bacillus clausii
atggaagtgaaaacagcagaggaagcagtacaatgggtgcattcgctattgccgtttggcataaagccaggattaaagcggatggaatggatgcttgaagcattaggccacccagaacaaaagctaacggccgtccatgtacgctggcaccaacgggaaaaggttcgactgtcagttttttacgtcacatccttacagcggacggcttttcagtcggcacgtttacatcgccttacattgaacagttttcagagcgcatttcggtaa

SEQ ID NO: 5490 - DNA, 501 bp, Bacillus clausii
  misc_feature (1)...(501): n = A,T,C or G
tggtgcgtgcctgtgcgcaaacatgcgacttggtcgttgtgagcatttacgtgaacccactgcaattnggccctcacgaggactatcatgaatatccaagacaattggaaaaagaccgcgtgttagcagaagaagcagggtgcgatgtgctgttttgcccaactgatgaagaaatgtatcctgatgggtatacgcaaacggttcatgtgaagcaaggtgcgaacgtgttatgcggcaaaagccgccctggccattttgacggagtggctaccgttgtgttgaaattgtttatgcttgttcagcctgatttcgccttttttggtgaaaaagacgcgcagcaagtcgccattattaaacaacttgttaaggagttcttcctgcctgtgacaattgttgcttgtccaactgttcgcgaagacgacggcttggcgaagagctcccgcaacgccaatttgacgccggcagaacgccaagccgcaccgaagttatatgctgccctgc

SEQ ID NO: 5491 - DNA, 647 bp, Bacillus clausii
agccgagagcagcatgtgatcctgcctgatcttgctgctggctgttcgatggccgatatggcttcgatcgcccaaacggagcgcgcttgggaagcgctgacggaacgattcggaaacacgattttgccgctgacatatgttaacagcaccgctgaaattaaagcgttttgcggtcgccatggcggtgcttgcgtaacatcatcaaacgctaaaaacatggtgaagtgggcgttttctcaaaagccaaggttattgtttttgcctgaccaacacctggggagaaacacagcttttgcacttggcattcctttagaaaaaatggcggtctggaatcctcttacacatgaactcgagctcctccccggtgcgaacatagaagaaatcatcgtcattttatggaaaggacactgctctgttcatgaaaaatttacagttgagcaaattaaaaaagtgcgcgcccgttctccgcatacacaagttattgttcatccagagtgcacccacgaagtggtgcaagctgcagataaagccggaagcacacactacattattgaaacattaaagcaagcggagccgggaacatcctgggcaattgggacggaaatgaacttggtcaatcggttagcgaaacagcatccggatagcaa

SEQ ID NO: 5492 - DNA, 597 bp, Bacillus clausii
tttttcggaggctgatctcgactatttgcgccagcaaccagaaggatttgaagaagcgtttcttgaagatttgcgcaaattgcgctttagcggtgatatgtatgcagtcgaagaaggcaacctcgtgttcccgaatactcccctaatccgcttagaagcgccggtatgggagtgcatttggattgaggcgatgctgttaaacattatcaacgctgagtcccttgtgttgacgaagggatcgcgtattaaaaccattgccggaaaagacggcctgcttgaaatgggaaaacgccgagcgcaagggcgggatgccagtgtatatggcgccaaaatggcatacatcgcaggcttcgatgcgacaagcaacgtgaaggcgggcaaacaattttcgatgccaattacaggaacacaagcccatgtatatattatgtttcatccatcagagttagaggcgtttctcgcttatgccaacgtcttcccacaaaagacgattcctctgctcgacacgaccgatacgttaaacagcggtttgcctcatgcgattacgactgcacgcaagctgcaagaaaaaggctttgagatgacggctgtccgctt

SEQ ID NO: 5493 - DNA, 617 bp, Bacillus clausii
atgggaaattggacaaagtcgattgaagcatttaaagaagcacagccgctcatgccaggcggagtgaacagcccggtgcgggcatttaaatcagtaggcatgaacccggtttacatgaaagaggggaaaggcgcaaagataaaagacattgacgggaatgaatacattgattatgtcctgtcttgggggccgctcattttaggacatgccaatgacgttgtcgtcgaagagttaaaaaaagcaacagaactggggacaagttttggtgctccccatgaatatgaaacgaggcttgccaaacttgtcatcgagcgtgttccttcaattgacgttgtccggatggtcaattcggggacggaggcgacaatgagcgcattgcgtctagcacggggctatacagggcgtaacaaaattttaaaatttgtcggctgttaccatggacatggcgactcactgttaattaaagcaggttctggtgtggcaacactgggcctccctgatagtccaggtgttccagaaagtgtagcccaaaatacattgacggtgcattacaatgatttggagagcgtccgctatgtatttgagacgtttggagatgatttggcagccgtcattgt

SEQ ID NO: 5494 - DNA, 288 bp, Bacillus clausii
tcattaagggtggaagcaagcttaaccacccgcaagcagttgatgtttggtatgatggccagtctttcacattgcttgaaaatccagaaatcgatacgacctatacccacggagcaggctgcacgtttgccgcagccatcactgctatgcttgcaaaaggcaaatcggttgaggaagcgatccacacagcgaaagactttgtcactgccgcgatcaagcacggcagcagactcaacgaatacgtcggttccgttgcccacggcgcctaccgccacgaaaaacaaaact

SEQ ID NO: 5495 - DNA, 555 bp, Bacillus clausii
cagcaattcttgtatggctcaaggggggattgcggcggcagtaggcgaaaccgaccatccgacactccatgcgagagatacgtttgtcgcaggcagcggttttaatgcgtttaagcgtgcgtctgagctcgctcggcaggctccagcaatgattaaagagctcgatgctttaggggtgccgtttgaaaaagcagctggccaatatgtccttggccatgaaggagcccatagcaagcggcgcattttgcatgcttatcaagatcaaacaggcttagcagttgtcgaaacattatggcggacactcagtgaaaacgtgcatgtgtacgaaaaccaatatgtgctggagttgattgtgaaaaatcaaacaatccaaggcgttcgcaccgttaatcacgctttttacggcgactgtgtggttatagcaactggcggctctggccaattgtatgaaaatagttccaatgagcagagagcaacgggagacgggttaatgttagcttatcggactggcgctgtccttaaagatcttgagttcatgcaattccatccgacgat

SEQ ID NO: 5496 - DNA, 354 bp, Bacillus clausii
cttagacggagctcataatgaagaaggctttttagccctaacaactgctttacaagaacgttttagcgacaagaacatctatgtattgcttgcatcgacaaaagaaaaagacatgaatgtgttgctaaagtcgtttacaacaagcggccttgaaatgacattttcgttcacaaactttgatttccaccgtgctgccaatgctgaagacctattcaaacaagcacctgtcaagcgaaagcaagtagcagctgattggcaaaaagcgctcaaaacgatgatggaaaaccttggcgagcaagatgtccttgttgtgacaggctccctttactttatttcagccgtacggcaatcgtt

SEQ ID NO: 5497 - DNA, 531 bp, Bacillus clausii
  misc_feature (1)...(531): n = A,T,C or G
tcgcttcgccccgcgcagcattgtttggttttctcggcctctttttatatgttgtgccttacacaatgtggtcgaaacggcgtacgatttataataccgaaattggcagtgttggcggcgcagtcccaccgcttatcggctgggccgcgatttctggagacttggttcacccagcgattattggtttgtttgtcgttatggtcctttggcaaatgccccatttttatgcgatcgccattcgccgctatgacgaatacaaagcggctaaagtgccgatgttgccggttgtcaaagggttcaagcggacgtttatccaaacgaatgtctatttgtttgtgctagctgcatccagctttntctttgtttcgttaagttggttcatcaccagtgtagcgcttgtgttgtcattgatttggctgacgttgagcatagctggctataaacgaatggagcctaaaaaatgggcnacccttatgtttgntttttcacttaactatcttacnattctttctacggtgatcatcggttttt

SEQ ID NO: 5498 - DNA, 392 bp, Bacillus clausii
atggggaaaaattatgaaggccatttggtggcatctggattaaagatcggaattgttgtgggtcgtttcaacgaatttattacaagcaaacttctcggcggcgcgcaagatgggttaatccgccatggagcagatgaaggcgatatcgatgtagcttgggttccaggagcgttcgagatcccgtttgcagccaaaaaaatggctgaaagcggccgatacgatgctgtcatcactttagggaccgtcatacgagggtcgacgcctcattttgactacgtttgtaatgaagtggcgaaaggcgtctcttcattggctttaacaactgggattccagtcatttttggtgtcttaacaacggatacaatcgaacaagctgttgaacgagcaggcac

SEQ ID NO: 5499 - DNA, 406 bp, Bacillus clausii
  misc_feature (1)...(406): n = A,T,C or G
ttgcangtaatcggagctggggctgtaggcttatttttagcagttagttttaagcgcccaggacaagatgttgttttagtaacaaaacgggcagaacaagctgctttattagcagtccgcggcatttcgttaaccgggaaaataaaagccgaaaaaaaagtgctcacacaagtaggcatgggcacaaaaccgtttgacctgattgtgtgcgctgtcaaatcttatgatgtaccaagtacagtagcgatgggcgaatcattggcacacgataaaacaaggtggttgtttgtacaaaatggcatgggccatttagaggagattgcccatctaacggtaaaggtagcagtcggtgtattggaatacgggctgtttaaagaaggcgacgctgtagttgaggtaagaggct

SEQ ID NO: 5500 - DNA, 521 bp, Bacillus clausii
atgcgaaagattgtgattggcacacgccgaagcaaattggcgttaacgcaaacacattgggtcattgagcagcttaaacagcttggcgttccctatgagtttgaagtgaaagaaattgtgacgaagggcgaccgtattctcgacgtgacgttatcaaaagtaggcgggaaagggttgtttgttaaagaaattgaagcagcgctccgctctggggaaattgatgttgccgtccactcaatgaaagatgtgccgtccgaactgttggaagaattcactcttgctgcgattacagagcgagaagatccacgggatgtgcttgtgagcgaagatggccacacactggacgagcttccagctggtgcaattgtcggtacaagcagcttacggcgttctgcgcaaattttacataggcgcccagatgtgcaagtaaaatggataccgggcaatgtggagacccgtttgcgcaaaattaaaagaggaaagatttttcggcgatcgtctggcttgcagctgggtttaag

SEQ ID NO: 5501 - DNA, 1131 bp, Bacillus clausii
attttgcaaaagcatttttggcagagtggtttctgtcgatatggaagacgtaacgccgtatttggttatccgtgaaaatgaccatgccattgaacaccttttccgcgttgcttgtggtttagactctatggtgatcggcgaaacgcaaattcttggacaagtgaagcaggcatttttgcttgcccaagaagagaaagtcacaggcactgtgtttaaccagctatttaaacaagcggttacgctcggcaaacgtgtgcactcgtcaacggaaatttcttcacaagccgtttctgttagctatgcaggcgtagaactgggaaagaaaattttcggcacgttttcaggaaaacatgtgcttattttaggcgctggaaaaatgagcgaactgacggccaaacatctttattcgaatggggctgcttccattagtgtcatgaaccggacaaaagaaaaagcggtggaactggcaagccagttttctggaacggctcggtcttttgctgaattgaatgatgctttaaaagaagcagatgttgtgattagctccacgggggcccgcgactttgttgtcaaaaaggaaaatgccgcagctgcccttaaaaaacggaaaggcaggccgctgtttgcgattgatatcgcagtgccacgggatattgacccggaaattgcaacaattagcgacgtttacttatacgacattgatgacttacagaacattgttgaagccaataaaaaagagcgcaaaaaagaggctgaaaaaatcggtgttatgattgaggcagagatcgatgactttaaagcatggctaaacacactaggggtggtgcctcttattacagccttgcgtgagaaagcattgcaaatccaaggcgatacaatggaaagcattgagcgaaagcttcctcacttatcagaacgtgacataaaagtgttgaacaaacatacgaaaagcattgtcaatcaattgctccgcgatccgttgacgagagtgaaagagcttgcagctgagccggatgccaagcattcccttgagtagtttaagacgattttcgcccttgaagcacaaatagagcttgccgaaaaggcagaagctgatcatgcggaacaatcttggaaagaagggcagcgccc

SEQ ID NO: 5502 - DNA, 173 bp, Bacillus clausii
atgcatacgatcgcaataggattaaattataaaacagccccagtagaaatacgggaaaaactagtatttagcgaacacgagcttccagatgcactcaagaagcttcgctcatctaaaagcatgatggaatgcgttatcctttctacttgcaaccggactgaactgtatgtagt

SEQ ID NO: 5503 - DNA, 261 bp, Bacillus clausii
tgttccgatttcaattaaccggttaaaaggagcgctaaccgtttatttcacagatgagcccgtcattgattatgaaggagccaaacgttctaacggcgatcaatttagcgtctttttcaaagcgatgttaaatgaaggaattcacttggcaccttccaaatacgaagcttggtttttaacgattgcccatacaaaaaatgacattgatgaaacaattgaagctgcgtaccgttcatttaaaacagtcgctgcgcatttcta

SEQ ID NO: 5504 - DNA, 546 bp, Bacillus clausii
ggaaagttagcgccgaatgtggtgcacaagcatttgcttatattgaacatgcggttgagctttgcaaaaccaaccaagtgcaagcaatggcaacagcaccgattaataaagaatcccttaaagcagcaaatgtaccatacattgggcatacggaaatgcttgctggcctagctgatgtcgctgatccgctcacgatgtttgaagtccgcaacatgcgcattttctttttgacacgccacttgtcgctaaaagatgcaattgggcaaatgacaaaggaacgtgtccacgactatttgcttcgctgtgatgcagcactcgcaaagcttggtgttgaaaagcgcaaatttgctgtagctggcttaaatccccatagtggagaaaatggattgtttggttatgaagaagtggatgaaatcaagccaggaattgagcttgccaaagcagacgggatagacgctgtcggtccagttcctgccgactcggtctttttccaagcattaaatggacgttacgatgccgtgctttccctttaccatgaccaaggca

SEQ ID NO: 5505 - DNA, 609 bp, Bacillus clausii
cgatacgattgttctttcaacacagcatgctcctgaagtgacgctcgagcaaattcaagcagacttaaaaaagcatgtgattgaagctgtcgtgccaagcgtgttaatcgatgaagaaacaaaatactttattaatccgactggccgtcgtgtcacaggcggacctcagggagatgccggcttaacagggcgcaaaatcattgttgatacgtatggcgggtatgctcgacatggcggtggcgctttttctggcaaggatgcaacgaaagtagaccgttctggcgcttatgccgcacgttatgtagccaaaaatattgtcgcagcaggccttgctgataaatgcgaagtacagctcgcttatgcaattggcgttgcccagcctgtttcaatcgctgttaatacatttgggactggcaaagcagcggaagatgtcctcgtcgagttggttcgcaagcattttgatctccgtccagctggcattattcgcatgctcgatttgcgccgcccgatttataagcaaactgctgcttacggccatttcggtcgcaccgatgtcccacttccatgggaagcgacagacaaggcagccgctttaaaagaagatgtttt

SEQ ID NO: 5506 - DNA, 345 bp, Bacillus clausii
aagaaagcatagatatctgcgtcagagcaggtgtacaaaaagagcaaatttggcttgatccagggttcggctttgcgaaaacgtatgaacaaaatttggaagttattcgtgaactagaccaaattgtcgaaatgggctatccagtgttgcttggtacttcaagaaaatctttaattgccaaaaccttgaatttgccggttgaggaccgtatagagggtactggcgcgacaatttgcttaggaattgcgaaaggctgtcaaatcattcgtgtccatgatgtgaaggaaatggcacgcatggccattatgatggacgccatgctgaaacggagtgatgatgttggat

SEQ ID NO: 5507 - DNA, 186 bp, Bacillus clausii
taaatcaactgtctttttacggataccatggcgtctactcagaagaaacaaagttgggccaacactttatcgtcgatttagtgcttgagctcgatttaaggcatgctgcacgccatgatgatttgcaggcatccattgattacggagacgtacatgagcgtgtaaaagcgataggtgaagggaaac

SEQ ID NO: 5508 - DNA, 216 bp, Bacillus clausii
atgatgcatctaggcgctgacggcgtttttgtcggatcgggcatctttaaatcagacaatcctgaaaaatttgctcgggcaattgtggaagcgacaacccattacacagattatgaacggattgccgagctttcgaaaaaccttggctccgccatgaaaggaattgacgtggcgacattggcgccagcagaacggatgcaggaccgtgggtggtaa

SEQ ID NO: 5509 - DNA, 387 bp, Bacillus clausii
  misc_feature (1)...(387): n = A,T,C or G
atgattggaacagcaaggttggcagcaactgtcgccatttccgggtccgcttttgctccccaaacatcgttaataatggctgcgccggcatgtnctgccgcttttgccgttttggctttatacgtgtcaatggaaatcggtacgtccatccgcgctgatatcgcttcaatgacgggaataaccgctccatttcttcctctgctggcacaggcgtgtaccctggcctcgttgattctccgccaatatcaattaagtcagcgccagctttcacaagcttatgggcacggtcaattgccgcgtcaaggcgattgtagcgccctccatctgaaaaagagtcaggcgttacgtttaagatgcccatcacttttgttcgtgctcccctattga

SEQ ID NO: 5510 - DNA, 843 bp, Bacillus clausii
gaaaatgtcaattgcaccctaatgtcggcgctttgcacagcaattcttggccgcttgcgtaccggctgggaaaataccaaaaagcaaaagaggacctggaaacgattattcgcaaaatcccagctttgcggaaacttgcagatacggccgaacgattaaaggacagcttaaagtacttaaatggatcgggcatgttttttgaagaatggggttcacttatttaggacctgtagacggacatgacttagatgacttaaaacaccagctaagttatgcgaaaaaaacatcaggaccagtattggtgcacgtgctaacgaaaaaaggcaaaggctataaaccagcagaagaagatgcgacaggagcttggcacgggacagggccgtacaagattgaaagcggtgaaatggtgaaaaaaccagggccgccaagctacccgagtgtttttgcaaacacgttaaaacgaattgcccgcgaagatgaacgggttgtagcgattacgccagccatgccaggaggctcaaagctcgacttgtttgctgaggagtttcctgatcgcatgtttgatgtcggcattgctgaacaacatgcggccacaatgtcagctggtcttgcgacacaaggaatgaagcctgtttatgctgtctactcaacctttttgcaacgtggctatgaccaagtcgtccatgatatatgccggcaaaacttaaatgtgcttattgcgattgaccgcgctggcctagttggcgctgacggggaaacgcaccaaggtgtattcgatattgcgtttttacggtcattgccaaatataacgattttaaatccaaaagatgaaaacgagttcca

SEQ ID NO: 5511 - DNA, 384 bp, Bacillus clausii
ccttgaagaaatccaagacccgagctttttaaagaactattcgaataaacaattggaagagcttgctgcggacatacgtcgttttttgatcgaaaagctttcggcgacaggtggccatattggcccgaacttaggggtggtcgagttgacacttgcgctccaccagctttttgacagtccgaaagataagctgttatgggacgtaggccaccaagcatatgtgcataaaattttgactgggcgcgcaccccaatttgacacacttcgccaatacaaaggcttatgcgggtttccaaagcgtacggaaagcgagcatgatgtttgggagacgggacatagctccacttctttgtcaggggcaatgggaatggcgacagcccggga

SEQ ID NO: 5512 - DNA, 315 bp, Bacillus clausii
  misc_feature (1)...(315): n = A,T,C or G
atgtnaaggcaggcttaaaccgccgtacgtctgcatacgatgatatgcgtacgattgcggtcagccgccttatgctcgacaatttccagcatataaaagcgtactggattaacattggcgttcaattgacgcaaatggcgttgacttttggctccagcgacatccatggcacattaatagaagaacggatttcccattctgttggcgcattaacgtctgcaggcatcacgagaaaagaactgattcatatgatcaaaacagctggcaaaacaccaattgaacgcgacactttctacaatgaaataaaacgctatt

SEQ ID NO: 5513 - DNA, 570 bp, Bacillus clausii
  misc_feature (1)...(570): n = A,T,C or G
tattaatgcagggcggaaccaaccctaacttaaagcttgattactatacaaacttgctaaaaggcattaaagaacgtnttccagatattgggatgcattccttttcccctgcggaaatctggaaaatcgctgaagtgatggacatgtcgattgaagacgtgcttcgggaactccacaaagcggggcttgacagtatgccaggcggaggcgctgaaattttgactgaagagacacggatgcgtgtcagccgttnaaaagtgacggccgatcagtggcttgatgcgatgaagacagcgaaaaaagtcggcatgtntggaacggcaacaatggtcattggctttggtgaatcgntngaagaacgggccttgcatttgcagcgcgtncgtgatgcccaagacgaaacagaatgntncacggctntcatnncttggctgctacaaccggaaaatacagggttgagaaggctgaaaaaattgacgccagaagattatttgaaaaacgtagcgatttcaaggattttcctcgataatatcgccaatttccaatcttcctgggtgactatggggcctg

SEQ ID NO: 5514 - DNA, 146 bp, Bacillus clausii
atgagcatagatgccatattagaacgggcagtaaacggcgagcgcatttcgatggccgatgccgttaagctttacgagagcgacgatctcgataaacttggcaaagcagctgatacgattttgaaaaaatggcaccctgagccaat

SEQ ID NO: 5515 - DNA, 1035 bp, Bacillus clausii
gggcgagcgcctttcggtagaagatggccttgttttatatgaaacgcctgatttgctcggagttgcacaattggctaatatcgtcaacgagcgaaaaaacgggcaaaacgtttatttcatcgagaacctttatatcaacccaacgaatgtgtgtgaagccaactgcggattttgcggctttaagcgcaaaccaggcgaagaaggcgcttatacaatggatgaagaagcgctattaaaatatgtagaagatcgttggaacgacaacatccgcgaatttcatatcgttggcggtcacaacaatgaagtcggttttgagtattatgtgaataccgtaaaaacgttgaaaaagcactacccgcaagtgacgattaaagcgtatacaggggcagagattgaatttttctcacgccttgctggcatttctatgaaagaagtaatccaaacgctcatggatgcggggctggccactttaactggaggcggtgcagaaattttgaccgagcgctatcgtgctattatgagcccggataaagcatcaacagaccaatggctcgaagcacacgaaaccgctcacaaccttggcttgcgcactcattcaacgatgctttacggctcagttgaaacgaaagaagagcgcttgattcatatgcaacgcgtccgcgacttgcaagaccgtacaaatggttttatggttttcatccctctagcgatgcagccgcgcaatgtaaaggcaggcttaaaccgccgtacgtctgcatacgatgatatgcgtacgattgcggtcagccgccttatgctcgacaatttccagcatataaaagcgtactggattaacattggcgttcaattgacgcaaatggcgttgacttttggctccagcgacatccatggcacattaatagaagaacggatttcccattctgttggcgcattaacgtctgcaggcatcacgagaaaagaactgattcatatgatcaaaacagctggcaaaacaccaattgaacgcgacactttctacaatgaaataaaacgcta

SEQ ID NO: 5516 - DNA, 989 bp, Bacillus clausii
cgtttatcatcaaagcttccttaggcggaggcggtcgcggcatgcgtattgtccgcgaagaaaaggatgtaaaagaatcgtatgaacgggcgaagtctgaagcgaaatcagcgttcggcaacgatgaagtgtatgtagaaaaatttgtcgaacgccctaaacatatcgaagtgcaaattttagctgataagcacggaaatattgtccacttgtatgaacgggactgttcggtgcaacggcgccatcagaaagtagtcgaaatcgcgccaagcgtatccctgtccgatgaagtgcgaaccaatatttgcgatgcagccgtcaacttgatgaaaaatgtcggctacgtaaacgccggtacggttgagtttctcgtcaccgatgacggaacattctattttattgaagtcaatcctcgtgtccaagtggaacacacgattacggaaatgattactggcatcgacatcgtccagtcgcagttgaaaattgccgacggttacaaactccatgaaaaagaactcgacattcctaaacaagaagatatcgcttgttttggctacgcgatccagtcacgggtaacgacagaagaccctgcaaatggatttatgccggatacgggaagaatcaatgcctatcgttcaagtggcggctttggtgtgcgccttgatgctggaaacgggtttcaaggcgctgtcattagcccccactacgattcgttactcgtaaaagtatcaacgtgggcattaacgtttgaggctgctgccttgaagatggtacgcaatctacgggaatttcggattcgcggcattaaaacaaatattgcattcttggaaaatgtcgtcacccacccgcaatttttaaatggcgaatacaatactcattttatagacgaaacacctgagctatttgtctttcctaaacgaaaagaccgggggacaaaaatgttgtcctttatcggagagacggtcgtgaacggttatccaggcttggaa

SEQ ID NO: 5517 - DNA, 447 bp, Bacillus clausii
attagcgttggaagcattagaagatcgaggggttacgattgaagaaattatggatcttgtttatgaattgcaaagcacgtatgttccagacttgacgaaggaaatgtgccggccgcatgtaatgaaagtgctggctaagcgagaagtgcaaaatgcgttattaacaggaatcgagcttgaccgcctcgccgaacaaggcaagcttagctcccctcttcaagaaattgtgcaatcagatgaaggcctttatggcattgatgaaattgttgccctttcgatcgttaacatttatggctcaattgggctgacgaactttggctatgtcgataaaatcaaacctggcattcttggtaagttaaacaaacataaaggcgggaaatgccatacattccttgatgatattgtcggcgcgatcgctgccgctgcttccagccggctcgcccattc

SEQ ID NO: 5518 - DNA, 425 bp, Bacillus clausii
  misc_feature (1)...(425): n = A,T,C or G
ctatatttgattgangccggaaacttanaggatgactttgacaaactaaaagaagctgactggatcattgaggccattattgagaacttggaagcaaaaacacagctattggctaaaattgacgaagtccgcgctactggggcaattgtaacatccaatacttctggcatatcggtggaagcaatgtcgaaagaaaggagccaagattttaaagcccattttctcggcacgcacttttttaatccaccgcgttatttaaaattgcttgaggtaatcccaacgaaagaaacgaaaaccgaggttacagagtttatcggtaattttgctgaaacggcgcttggcaaaggggtcgttgaagcgaaggatacgcctaattttatcgccaccgcattggcacgtatggattgcttgtcacggttcatgaa

SEQ ID NO: 5519 - DNA, 1108 bp, Bacillus clausii
ttgtcaattttggatgaacaatcagcagtgggccgggaacaagcattgcgccacattttaaaaggtttttctgaaattggcgccctccacgaccagcaacaaacggtgccaattgaaaatattgccgcccttaaggaatctggctatacagcgttgccggtagaaacgaaatatggaggaagacagatttcccttagcgaaatgctataccttcaacaattgattgccgaagaggacggtccgaccgccttgtgcatcggctggcatatggggacgatgcaccagttggccgaggagaaaaattggcctaagcattggcacgaacagatcagttgtgaagttgtcgaaaaaggggttctcctcaacacagctgcaacagaaaaagcgacagggagtccgacacgagggggagcttttcaaacgacagccaagtatgaacgaggcgagtgggtcctaaatggtacaaaaacctttacgacacttgccgaacaattagattattatttaattctcgctactgtcgaaccagaaaaacaggtaggcttgtttatcgtaccgcaaaacacgccaggagtgaccgtcgaacatccatgggacatgatggcaatgggttctactggaagcgaagatttgcacttaaaaaatgtcaagctgccaagtgaccattttattaaaaagcaagaaaaggatggcctgccaacagcatggctgctccacattcctgcctgctatttgggaatagcccgtgctgccatccgagaagcagcgaagtttgccaattcatattctcctaatagcattcaaggaacgattgctcaattgccacacgtcaaacaaaagcttggtgaagccgcgattttatatgaacaaagccgccacttcctgtacagtgtggccaataaatgggacgatagcgacaaagaaacccgtatgcagttaaacacagaattaaaaatggtcaaatacgcagtagtcaacaacgcaaacagaatcgtcgacttcgtaatgagagctgttggcgcccatagcctatccaatcagtcgccattatcgcggtattataaaaatgtccgcgctggtcttcacaacccggccatggacgacatgg

SEQ ID NO: 5520 - DNA, 537 bp, Bacillus clausii
tagatgcacctgtcagcggtggtgagccgaaagcaattgacggaacgctggcaattatggttggcggcgacgagacggtatttgaatcaattaaaccggttcttgctgcgatggggacagacgttgtccttgtaggcgaatcaggctgtggagcgactgcgaaactagccaaccaaattattgttaatttgaacattgccgccgtttcagaagcgttggcactggcagccaaagcgggcattaacattgaaaaaatgtacgaagcaatccgtggcgggcttgctggaagcacggtgcttgatgccaaagtgccaatgatcctcaaccgtgactttaaagctggcggacgggttgatattaatttaaaagacttgactaatgtaatggatacagcgcatgcattgtctgtaccgttgccgttatcaagccaactgctggagattttccatgcattaaaagccgatgggaaagaagcgctcgaccatgcaagcattgtccaacattatgaaaaattggccaatgtcatagtggagaggg

SEQ ID NO: 5521 - DNA, 237 bp, Bacillus clausii
ttgatttgtcgaaccgtacatacgtagtgatgggtgtcgcgaataaacgcagtattgcttgggcgattgctcaagcgctagcaggagcaggagcaaacttggtgtttacttacgctggagaaagactagaaaaaaatgtccgttctcttgctgaaacgctcgaaggggagcatcttgttttgccatgcgatattacgaacgatgaagagattgacaaagcatttaacgaaattaaat

SEQ ID NO: 5522 - DNA, 767 bp, Bacillus clausii
atgaaagcgcttcctgctattgaaggaaaccataacctgaaaaattatgaagaagccgtacacaactttgcctgggaggatgtcagaaaaacgttttcttggcataaaacaggcaaagtcaaccttgcctatgaagcgatcgattatcatgccgagaacggcaaaggcgaacaggtagctctttattatagcgatgcgcgccgtgatgaatcctacacatttgcggaaatgaagacgttctcgaacaaagcagcgaatgtgctaaaagaagccaacgtccaaaaaggggaccgtgtctttatctttatgccacgcacacctgagctgtattttacgcttcttggcgccataaaaataggggcaattgttggcccgttgtttgaagcttttatggaaggggctgtgcgtgaccgccttgaagacagtggcgcaaaagtgcttgtcacaacaccgacattgcttgaacgggtgccatttgacgatttgcccgatttggaaacggtgctagtcgctgatgaaacgtatgaagacaatggctcttttttacagttaaacaagcggcttcaagcagcaccaagtgattttgcaattgaatgggttgatcgggaagacgggctcattcttcattatacgtctggctcaacgggcaagccaaaaggtgttcttcatgttcacgaggcaatggtccaacattatcacacagccaaggtcgtccttgacttgcagcaagatgacatttactggtgcacggccgaccctggctgggt

SEQ ID NO: 5523 - DNA, 624 bp, Bacillus clausii
  misc_feature (1)...(624): n = A,T,C or G
atggcaacagtgttaatgataaatgcaagcgaccgtcttgagcaaggcgttagcgtgaaaatgtataatcaatttttgaattcgtataaggaagnccatcctaatgatacagtggaagagcttaacttgttcgctgaaaaacttccttattacggaaatacagcgattaccggccaatataaaaaagcgcaaggcatggaattgactggcgaggaaaaagaaatcgttgagacgattgaacgctatcaagaacagttcctgaatgctgataaagtcgtctttgcctttccattgtggaacttcacggtgcctgcgccgcttattangtatttgtcctatcttgcgcaagcaggcaagacgttccgctatacggaaacaggcccagttggactcgttggttctaaagaagtcgctttgttaaatgcccgtggcggcgtttattcgaacgaagcgatggcagcttcagaaatggcggcaaacctcgttcggacgacaatggcattctggggcatcactcaaccagtagaagtcattattgaaggccataacgccgtccctgaccaagcagaggcgattatttctgaaggcttggaaaacgttaaaaaagttgccgttgccttttaa

SEQ ID NO: 5524 - DNA, 341 bp, Bacillus clausii
atgaaaacagttggtcttattggctgtggcgcaatgggaaaaggaatggctacgtcccttttaagcgccggctattccgtttatatttatgacgacatgtccaaatggcgggaaccattggaaaaacaaggagctcgctttgtcgaaaacggtgctgctgtagcaaagaaggcaaagtatgtcttgctatctcttccttcaccgaacattgttgccgaaacagttgcaggcaaagaaggcttgctttgtcatatacaaacgggtggctttttattggatcttagcacgacggatgtgcaaacgacattagcaatggagaaagcagctgctgctaaaggaat

SEQ ID NO: 5525 - DNA, 612 bp, Bacillus clausii
ttgaaatgaaaatgaatacaaattcgcttgtgattagcatcgtttgcatagcctgttttttagtcgtagcttttagtttaaacacggtttttttagagaaagtcgaccagctggcgttaacatgggctgagtcgattcgtgctgaaccgattacggctctcatgcatggctttgcctttttaggggcgaccaaaacggttttcgttttgacagtagcggtgcttatcattttgcttgttgcccgtgcctcgcacaaagaattagcatttactgctgttacgatggccgcgacaggtcttgttaatctgttcgtaaaagaatgggtagaacgagaacggccagcacagtatatgctagttgaattgtcctcgtacagctttccaagcggccattcaatgggagcgatgtcgttttacacggtgcttacctttctgatttggaagcgcgtgaacaaacaaagtcaccgtgtagcgtttgttgtatttgcaagcctcatgatactcattatgggattttctagactatatctgggtgttcattatttgagtgatgtcattggcggatatctcctaagtggcagccttgtgtttttcttgttttggctattccaac

SEQ ID NO: 5526 - DNA, 450 bp, Bacillus clausii
cgacattcgcgcaagcagatacaagagctggtcttctgcaactttgtaacacggtatttccactagcatttctatgggtggctgcttatcaaagcctgtctctgtctatttggctgtcgctgcttttctcggtaataggcggtggatttgttgttaggttgtttattattttccacgactgtacacatggttctttttttaaacacgccaaggccaatcgggtgctagggacatttttgggcatcattactcatttcccttttgaaaagtggaagcggagccatgcgatgcaccatgcgactagcggaaatctcgataagagaggcacaggcgatatttggttgttaacgattgaggagtatgaacaagcctccatctggaaaaaaacagcgtacaggttataccgtaacccgcttatcatgtttgggcttgggccactctatttgtttt

SEQ ID NO: 5527 - DNA, 480 bp, Bacillus clausii
ttgaataaaagaggggcgaacgtaaggagcgtctcaatacgcatgtcaccaatgttgcaatatttgcgctatacgcagtcggcatttggttgcttggttgggaagcgtttcttttagtgcaagggccgcttatgtttattgcgggtgcagccggcatttggcttttctatgttcagcatcagtttgaagattcctattttgaaaatgaagccgaatgggattttgtaaaggcggctgtggagggcagctcttattacaagttgccaaagccattacagtggataacgggtaacattggcttccaccatgtccatcatttaagccctaaagtgccaaattacaatctggaaaagacacaccaacaagttgtaccattacaaaaagcaacaacgatcacccttgcgacaagtttagcgtcactaaagtttcgcttgtttgatgagaagaataagacgttcgttagttttggagactttaaaa

SEQ ID NO: 5528 - DNA, 375 bp, Bacillus clausii
tggagcgaaacaaacggttagccgctgaacgagcaaggcttgcgtctggcggtgggacaaaaaaacagcaagctcagaaacaagctggaaaacaaactgcgagagaacggattggcatgttacttgaccgcgagagctttactgagcatcttgcttttgccagcgggtctgggggccaggcaggcgatggcgttattgtcggttatgggacaatctccggtcgccttgtatgtgtctatgcacaggatttcacggtcagcggcgggtcacttggagcgatgcatgccaaaaaaatctgtgcgattatggacttggcctacgacatgaaagcaccgatcattgccctgatcgattcatgaggggccagaatccaaa

SEQ ID NO: 5529 - DNA, 738 bp, Bacillus clausii
ttgcaataccaacatatttacttgtcgccctcatgatcgtcaatatcttgcttgccgccattttaatttttattgaacggaaagatgcacaggcgacttgggcatggctgcttattctattttttattccactaggcggctttattatttacattttcctcgggcaaacattaacacggaggaaaatgtttgaatgggaaggaataaaaaaagtaggactcgagcatttcattgaagaacaaaagcgtgatcttttagacacttcgttccgcttttatagccctactgttgataaaaatcgcgaattgatctatatgcatctaatgagcaacgacgcgctgctaacaaaagagaaccgtgtcgatattttcagcgacggcaaagaaaaatttgcgcaattgttaaaggacatcaaacaagccgagacgttcatccacatccagtattatattttccgttacgatgagatcggaaaaacgatcgtggatgcgctgacagaaaaagcgcgccaaggcgtaaaagtccgcttgctctatgatgacctcggttcccggtctttgcgcaaaaagtatttaaaagcgtttcgtgaagcaggcggagaaatcgggatttttttcccatctaggtttacgattgttaacttgcgtttgaatttccgcaaccaccgtaaactcgttaacatagatggcaaatgcggttatgtcggcggctttaacgttggagatgagtatttaggaa

SEQ ID NO: 5530 - DNA, 810 bp, Bacillus clausii
atacttgcctggcttggccagtggcgagacatttgccgcttatgccttaacggagcctggctcaggttcagatgcgcttagcgccaagacgacagcagttctaaacgaagcaggtacacattatgttttgaatggtgaaaagcagtggataaccaactctgcttttgcggatgtgttcattgtttacgctaaggtagacggcgaaaagtttactgcttttatcgtagaacgaacgtttgctggcgtcagcactgggccagaagaaaagaaaatgggcattaaaggatcatctacgcgtacgctaatattggaagatgtttcagtgccggtggacaatgtccttggcgagatcggccgtggccatgtcattgcctttaatattttaaatattggccgttataaacttggagtcggctgtattggcggtgctaagcgggcgttggaactggcagcgacatatgcgacagagcgaaagcaatttaaaacaacaatcgcgtcattcgctttgattcaagaaaaactcgcttccatggcaaccgaaatttacgcgtcagaaagcgccatttaccgaacaggtggactgattgaaagccgctttgccagcttaagcgaggaagaaaaaaacgacggccgtgccgttgctagtgcaattgcggaatacgccattgaatgttcattgaacaaattcgcaggttcggaaacgttggattttgtagcagacgaagccgtgcaaatccatggcggttatggctttatggctgaatacgaagtagagcgtatttatcgtgattctcggattaaccggatttt

SEQ ID NO: 5531 - DNA, 654 bp, Bacillus clausii
  misc_feature (1)...(654): n = A,T,C or G
agagagcgaattgactccatcattgacgatggcacatttaaagaagcattcgcctctgtcaaaggaggcaatccactccagtttccaagttatgaggaaaagcttgagagcgaccgtaaaaaaaccggtttgaatgaagcggtggtcactggtgaaggaaagataaatggatatcccgttgtcattgcagtttatggactccaattttcggatggcgagcatgggctcggcggttggcgaaaagctaacgagggcaattgaattggccactgagacgagcgttccgttgcttnatttttggctgcctcagggggagcgcgcatgcaagaaggcatgctcagccttatgcaaatggcgaaaacgagcgccgccnttgaagcgtctgaaccgagcaggagggctttacatttcggttatgaccaacccgacgacgggcggcgtgtccgctagtttcgcgtctcttggcgattacaattttgccgagccaaaagcactgattggcttcgctgggaggcgcattattgaacagaccattcgtcaggaacttcctgaagactttcagacagcagaatttctcttggagcatggccagcttgatcgtgtcattccaaggctagaaatgaaagaaacgctgactaagctgttggcgatgca

SEQ ID NO: 5532 - DNA, 1248 bp, Bacillus clausii
ctcgaacggttgaaaaaatcatccgtattcaagaaacggcagaaaaattgtccgtgccgctgttgtatttggttgactcagctggggcaagaattactgaccaagtttagatgtttccagggcggagaggggcagaccgtatttttagcaatcaagtaaagctgtcaggaagaattccgcaaatttgcattcttttcggtccttcagcggcgggcggcgcgtacattcctgcattttgcgatgttgtcattatggtggacggaaatgcttccatgtatttaggttcgccgcggatggcacagatggttattggcgaggatgtcacacttgaagaaatgggcggcgccagtatgcactgcagtgtgtcaggctgtggcgatattctagccaaaaacgaggaagacgcgatttcccaggcgcgtgcttatttaagttatttgccgccaagctataaagagaagccgcctagtaaagaggcgcgcccgccgaaagatgtgccaaaaacgatcgaggacttgattccgcaaaatcaaaatgcgccttttaacatgtatgacttgctcgagcgcctcgtcgacaacgacagtttttttgaaatcaagcgaaacttcgctccagaactcatcactggctttgcccggttaaacggacaggcgatcggcattgtcgccaatcaaccaaaggcaaaagggggagtattgtttccagattcagctgacaaagccgctcgcttcattactctttgtgatgcttttcatctgccgcttttgtttttagcggacattccaggctttatgatcggcaccaaagtcgagcgtgctggcattattcgccatggcgcaaaaatgattgccgctatggcggaagcgactgtaccaaaaatttctgtcatcgtccgaaaagcgtacggggccggactgtatgcaatggccgggcctgcttttgacccagactgttgcctcgcccttccgcaagcacaaattgccgtgatggggccagaaactgcggtaaacgccgtatatgcaaacaaaattgctgaacttggggaacaggagcggaaagcgtttatagaggaaaaacgtgaagcatataaacgggatatcgacgtttatcgccttgcttcagagctagtcatcgacgggattgtcaacggcaatgacttacgacaagaattggtgcagcgctttgctttttatgatagcaagcggatggtgtttagcgaacgaaagcatcccgtttatcccgttt

SEQ ID NO: 5533 - DNA, 549 bp, Bacillus clausii
atggttgatcaagcattgcaggaaagcgccaataagcccgtgtttgtgattggacatagtatgggtggctatgcgtcagcagcatttggcactaaatacccgggcaaagtaaaaggaatcgtgttgtcgggagcacttacccgctataatacccaagttgcaggggaactcccgcttgctcttcccgcgggcacttatcttccgaatgaacttggcagcggagtgtgcagcgaccctgaagttgtagcggcctatgcgaatgacccgcttgtagaaaagcaaatttccgtggatctgtttaatcgtttaggtgagggtgtagcgtggctaaagcagtatgctgaaaatttcgttgatccggtctttgtcatgcatggtgcgaatgacggccttgtcagcgagcaggattcccgtgatttttatggagatatcgcatccgctgataaatctttaaaaatttatgctcatttgatgcatgaaatcttcaacgagccgagccgcgacgaagtcattgcagaagccattgcgtggctagaaaaacgcatctaa

SEQ ID NO: 5534 - DNA, 549 bp, Bacillus clausii
caggcaaagtcaaccttgcctatgaagcgatcgattatcatgccgagaacggcaaaggcgaacaggtagctctttattatagcgatgcgcgccgtgatgaatcctacacatttgcggaaatgaagacgttctcgaacaaagcagcgaatgtgctaaaagaagccaacgtccaaaaaggggaccgtgtctttatctttatgccacgcacacctgagctgtattttacgcttcttggcgccataaaaataggggcaattgttggcccgttgtttgaagcttttatggaaggggctgtgcgtgaccgccttgaagacagtggcgcaaaagtgcttgtcacaacaccgacattgcttgaacgggtgccatttgacgatttgcccgatttggaaacggtgctagtcgctgatgaaacgtatgaagacaatggctcttttttacagttaaacaagcggcttcaagcagcaccaagtgattttgcaattgaatgggttgatcgggaagacgggctcattcttcattatacgtctggctcaacgggcaaagccaaaa

SEQ ID NO: 5535 - DNA, 252 bp, Bacillus clausii
aaagaattgttcaagcttaccgattagctcatccgcaggatgaggtagttcatctcgatttgtataaaatgaatatcccgcaactagacgctgatgttttggacgggtgggacaagctcagaagtggtacatctttcgaacaattaacgcttgaggagcaaacgaaaatccgacgtatcaatgaacttgttgatcaatttgtggctgcagataaatatatttttgccactccctcaataaagtttaattttc

SEQ ID NO: 5536 - DNA, 363 bp, Bacillus clausii
gcttcggcaaatttctcgatcctttggccgataagctccttgtgaccgctgccttaattgggttagtggaagcgcagctcgtgccagcttggattgccattgtcattattagtcgtgagtttgcggtaacgggcattcgcttagttgctgcagcagaaggcgatgttatagcggcgagcaaactgggcaaatggaaaacgctcacccagattatcgctattattgctagtcttttacataatatccctttttcagctctttcatttccatttgcttccataatgctatggatcgcggctctgttaacgatctggtctggaatcgaatattttgtgaaaaacaaacacgtcattctaaaatcga

SEQ ID NO: 5537 - DNA, 396 bp, Bacillus clausii
tgtctttcatattagtgaaagttatgacagcggcaccaatgccaagttgatcaataatttgttgattggcttttacacggccggtgtagcagaagcattggcgcttgccgaaaagagcggcttaaacttggattttttgtttaatgtcctaaatgttagttatggccagagccgcatttatgagcgaaactataagtcgtttatggcaactggcaattatgaacctggattcgccttaaagttgcttaataaagatttgcgttttgcgatggatctagcgaaagagcgtggcgtgaaattgccgattagtgaagctttagttgaactgtatgcagacgctgagcaagcagggcttggagaaaaggacatggccgtgttgtttgaacggattgggga

SEQ ID NO: 5538 - DNA, 561 bp, Bacillus clausii
atgtcgaggcaaacggagaagtatgcgagcgtttgcctatcatttgagagcctacttggcaggctcttaagcttacgtaatgtcgacaacattaccagagggggagatgtcgtgaaagtcgggttcatcggtttaggcaatatgggcatgccaatgtcaaaaaatttgcttgagtctggatatgaagtagttggttatgacatcaatgaaacttcggttttagcgtttgaacaggctgggggaaaacgggcccgtgatttggcagacatcgtgctggccagcgagcttatctttacaagcctcccctcttctgaagcggttgaaaatgtgtatttaggagaaaagggtgtattcgcttcggccccttcgagcattttatttgtcgacacgagcacagttgccccagagcttgaaatgcggattgggcaagcggcagaagaaaaagggttatcgtttttggcagctcctgttaatggcggcgtcgttggtgcggaaaaccgaaccttgacgttcatggttggcggtccaaaaaaattgcttgagcggtatccgaccacctaa

SEQ ID NO: 5539 - DNA, 1094 bp, Bacillus clausii
gcaaaacggacagctgttggcaaaattggcggcattctagccacgcagcgtccagaagtgttagccgcctctgtcataaaagaaatcgtcgctggccttccttttcctgagattgatggagtggtgctcgggaacgtagttggcgaagggggaaatatagcacgcctttcgctgttggaaagcggtctgcctgttgacgtgccaggggtaacggtcgatgtccaatgtggttctggattagaggcaatcatcgttgcagcaaggcacatacaagcaggagatggcgatgtctatttggccggcggcgtagaaagcacaagtcttgagccgaaacggattgccgctaacatggacggaaatagacgagagtggcaccagacaatcgaacgtgcccgcttctcgccggaatcgctaggagaccccgatatggctgaagcggcagagaatgtggctgaacaaaggaaaattggccgggatgcacaggacgagtacaccgctgagagttacaggcgcgcatgggcagcagaacaaaagggcctttttcgtgacgaaaaaattgcagcacaccgtgatcttgctgacgaaggcattcggcaaatgcccgatcggcttttaaaacgagttccaccgctctacagtggtggaactgtaacagcagccaactcatgcgcaaaatcggatggagcggctctcgtattgctcatgtcaaagcaagcgtgcgtgcgttaccgtatgaaaccgatgcttgcatttgtcgatgctgcaagagcaggctacgatccccactttgcaagtattagcccagtgcctgcgatccgcaaactgttggcaaaacaaaaacaggatctatcagacattgatttgattgagctgaacgaggcgtatgcggttcagatggttgcgctccaacaagagcttggcctagacaaagaaaaactaaatgtcagtggtggcgctttagcaataggccatccgtacggggcatccggggcgataaacgtatgccgtctagcagccgaaatgaaacgtcgtgatgccaagtttggcttgagcgccattggtgcagcaggagggttaggaatagcggcgttgtt

SEQ ID NO: 5540 - DNA, 549 bp, Bacillus clausii
  misc_feature (1)...(549): n = A,T,C or G
ttatcggcttgccccgacttatgcttttcctacagcggtaaacgatagctatgatgcccttacctgggtttatgagaatgcagacgttttagatggcgatggggataggcttgcagtggctggcgatagcgctggaggaaaccttgctgcggctgttgctatcatgtctggagaagaagatggtcctgccttgtcagggcaagcgctcctttacccattggctacttttgaagatgcgaagtttccgtcacgtgacatgtatgcaagcggcttttattttttgtcccgtgcggttatggaaatggcgcaacaatcgtatgcgccaaacgaagcggattgggcatcgccttacacttcgcctcttaatgccgaagacgtgtcgatgatgccgagtacgcttattataacaggcgagtttgatccgttacgcgatgaaggggaagctttggcaaaacgtttgtataatgaagggatctatgtacaagcacagcgttttaatggagtgatgcacggctttatctctttctatgaagtgatggancgaggcga

SEQ ID NO: 5541 - DNA, 578 bp, Bacillus clausii
atggatttatttcaaatgaatgttgatttgtttagactaattaatgattttggtaaagaacatacatatctaaacgatacttttatatttatagctgaatatatggtttttgttcttgctttaattgttttaatgttctggtttactaggataagggaaaataggatgatgataatttcggctattatagcctttattgttgccgaggttatcgggaaaattgctgggaagttacatgcaaataatcaaccatttgcggaattgtctaatgtaaatcaattaatagagaaagcagtagataattcctttccgagcgaccataccattttattctttgcgttttgtacaactttctgcatatatcgaaaaagatggagttacatatggatgacggttgctttttttgttggcctttctcgtatttgggtgggtgtgcactatcctgcagatgtcttagtcggggcgctaattagtatcgtttcagctttaatggtttcttttatggtccctcgtcttaaattcgtaaggaaattactatggttttatgaaaaacaggaacaacagtttttacctactag

SEQ ID NO: 5542 - DNA, 465 bp, Bacillus clausii
  misc_feature (1)...(465): n = A,T,C or G
ttttcccagagttacaagcaggcaaccanccattgcagtttataagcacacaagggacggagtttgaacaaacactgcttatgcttattcgtagcgctaaaaacagcttaatcatcggcagcccttattttatcccgacacgggccgtaatggatgccatcattgaagtggcgcaaagaggcgtcctcgtttccttaatcctccctgaaaaagcagatcatccccttgttcaacacggggctactccttatgtgattgaagccctgcaggcaggcgtgctcgtttaccattattatcgaggattttaccatgttaaagccgtagtagctgatcaatctgcatgtttagtggggacgccgaatatcgataaacgcatttttcatctttaacgatgaaaatgtcatgctttaacccatgaccanacatttttattgaaaacagtcctcgctgtgctccacgctgaat

SEQ ID NO: 5543 - DNA, 170 bp, Bacillus clausii
  misc_feature (1)...(170): n = A,T,C or G
cataaagatatcggcttggccttaaagttggcagacgacattggtatgccactggacgtcgttaaattaggtgctgaaaaagtcgcaaaggcaaaagaaaagtncggagaccaagatgttagcgctattattcgaccgctagaagaagcnacagggatgattgtgaaacg

SEQ ID NO: 5544 - DNA, 426 bp, Bacillus clausii
gcagcttgacggttggtatgtgtctggcgattctgcttatatggatgacgatggctacttttggttccaaggtcgcattgatgatgtcattatgaccgcaggtgagcgcgttggtccatttgaggtggaaagcaaactggttgaacacccagctgttgccgaagcaggtgtcattggcaaacctgaccctgtccgtggggagattattaaagcatttattgcactgcgccaaggctatgaagttactgacgaattaaaagaagagattcgccaatttgtaaagacaggacttgcagcccatgcagcaccgcgggaaatggaattccgcaagtcattgccaaaaacgcgcagcggaaaaattatgcgccgcgtattaaaagcctgggaattggatttgccgacaggcgacttatcgacaatggaaga

SEQ ID NO: 5545 - DNA, 441 bp, Bacillus clausii
agagggtacaattacggcaggcaatgcaccaggcgtcaatgacggtgcctgtgcattgctgttaatggaagctgttcaagcagagaaacaaggcaagccagttttggcaacgattgaagcccatcaccgtcttgccgtcgaaccatgggactttccgaaaacaccaggcctggttataagcgaattattggagaaaacaaagttaactgttgctgatataagccgattcgagatcaatgaggcgtttgcgggagaggcagtggcaagcaaccaaatagctggattagataaaaaaaaattcaatgtcaacggaggcgcttttgcttatgggcacccaattggcgccagcggcgctcgaatcttgctaacgcttgcttatgaattgaaccgcaccggtggtggttatgggatcgctgcaatttgcagcggcggcggccaagg

SEQ ID NO: 5546 - DNA, 1056 bp, Bacillus clausii
tcgaagaaatggaagaatcacaattgtttccacgggatgtactcaagcaaatgggggagcttgggctaatgggtgttcctgtgcctgaggagtttggcggcacggggatggactttgtttcttatattatagccgtacatgaagtatctaaagttagtgcagcaattggcttaattatgagcgtccatacatctgtaggaacgatgccgatcgtagcgtacgggacagaaacacaaaaaaaggcatatgttccgaagctggctacagcagaagcgattggtgctttttgtttgactgaaccaaatgcaggtagtgatgcgagggcgctgcaaacacgtgcagtcaaaaaaggcgaaggatatgtgcttaatggttcgaaagtatttattacaaatggcggtgaagcagacacataccttgtctttgctgtcaccgatgctgacaagggggctaaaggcatttcttgttttatcgttgaggccggcactccaggcttaattgtcggcaaaaaagaacggaaactcggcttggcaggttcgacaacgactgaaatcatttttgaagattgcgaagttccacaaacgcaaatgcttggcgaagaggggcaagggctaaaaattgccttgagcaacttaaatgcagggcgaatcggcattgcagcccaagcgcttggcatcgctgaggcggcccttgaggcggcttgcacgtatgccaatgaacggaaacagtttggcaaaaagctccttaaccatcaaggcttagcgtttaaattggcagatatggctacagaaacagaggcggcaaaacaattaacctatgcagcggctcgacttaaagaggcaggaaccccatgcgcgaaagaagcgtcaatggcaaagctatttgcttcgcggacagctatggatgtagcgacaaaggctgttcaagtctttggcggctacgggtatatgaaggagtatcctgtagaacgttattttcgtgatgcaaaggcgtgtgaaatttacgaaggaacaagtgaaatccagcaaatggttatagctaggcaattcgaaaagt

SEQ ID NO: 5547 - DNA, 600 bp, Bacillus clausii
  misc_feature (1)...(600): n = A,T,C or G
atggaacacaaattggaaaaagctactttttcaaaagatattaaagatcgagtgagagccctccaggaacgagataactggcggaatttgttcacaattgcttttgactggcttgtcattattggagcgattgcgttagttcgaacatttcctatgtggtgggtgtatttaatatctatagccatcataggaagtagaatgagggcatttgacaatcttatgcatgaggctagccattttcaattatttaagaatagaataatgaataaatggattgcctgtttttttgtagcttttccggtgtttacttcgtttactgcctactgtcaatcccattatttgcatcatcgtcatttatggcatgagcaaaaagatccagatacgaaacgatatgcgttaatggggttagataaaccacaagacgacattcggacatttggccttagacatgttttaaaaccgttaacgttaatccacntccctaaatacatttacgggaccattaaagttaatattttgacaaaagaaganccactctcggaaaaagtctcgaagtttttattttggcccagttatcgtgctattaagtgtggtatttga

SEQ ID NO: 5548 - DNA, 285 bp, Bacillus clausii
  misc_feature (1)...(285): n = A,T,C or G
cgctgaaggaaaagaagacaaaacgtttgacggcaagcgcatatattatggaacggggcattgttggcgacgttgctttagtaaaggcgtggaaagcagacccatttggcaatctcgtttaccggaagacgtcacgcaacttcaatccgctcgtaacagctgctggcacagtaacaattgtcgaggtagaggaactcgtcgaattgggcgaacttgatccagacnagatccataccccaggcatctatgtgcagcatatctttgtcggtgattcctttgaaaaaa

SEQ ID NO: 5549 - DNA, 387 bp, Bacillus clausii
tggttggatatgtagaccgcagcgtcattgcccagttaggcactcccgatatgcgcgtcccgatccagtatgccttaacgtatccagagcgctttgcccgcccgaaacatgaacgtttagatttagcggagcttggcaaactccacttcgaaaaaatggatatggagcgtttccggtgcatgaaactcgcctacgaagcagggcgtgttggtggcacaatgacaacggtgcttaacgcagccaatgaagtagctgtattccgctttttgcaaggcgagatcactttcttggaaatcgagcgcatcattgaagaggcactaagtgcccattcgccgattgcgcatccatcgctcgaagagatccaagctgtcgatgcttcaatccgca

SEQ ID NO: 5550 - DNA, 675 bp, Bacillus clausii
  misc_feature (1)...(675): n = A,T,C or G
aagcagatgntgattcattaaacgtccaacttgcagaccaagcattttgcattgggccaacagagtctgccaaaagctacttgaatttcaccaacttaatgagcgtagcgacattaacggaaacggacgcgattcatcctggctatggctttttagcggaaaacgccgatttcgcggaaatttgcgcagactgtaacattacctttattggcccaagcccaacagcgataagccggatggggacaaaagatgttgccagggaaacaatggcgaaagccggcgtgccaatcgtacctgggtcaaatggaattgtggaaacaattgaagatgcaaaacaaattgcccgcgatattggataccctgttattattaaagcaacggccggtggaagcggtaaaaggatccgcgtcgcccgcaatgagaaagaattagaatcgggcattaaagtgacacagcaagaagcagagacggcctttggcaatcctggcgtttatttggaaaagtatattgaagatttcaggcatgttgaaatccaagtgctggccgataaccacggcaacgttatccatttaggcgagcgcgattgttcgattcagcgccgtttgcaaaaattgcttgaagaaagcccttcccctgcaattacagaggaaaagcgtcaagaaatggggcgcgcgg

SEQ ID NO: 5551 - DNA, 684 bp, Bacillus clausii
  misc_feature (1)...(684): n = A,T,C or G
ttgcttacaaaggatttacagccgaaatcgacaaaatttctgatggcagcaccgacggcctaatngcaaagtgggtgtttggcgaagcatcgagcggctgggaaaatgtggatgatcgaatgaaaaatgaaaacgcttcctttgaacgagaaatggataaagaggaaatcgcgtttttgccctatacgtctggcacgactggaaacccaaaagccgttgtccatacacaagcttgggcctttgcccatttgcaaaccgctgcaaccgaatggctcggtgtggaaacaggagaccttgtttgggctactgcggccccaggctggcaaaagtgggtatggagtccttttctatcgatagtcggcaagcaggcgaccgcctttgtttacgatggcccttttcaggcaaaaacgtatctgcaattaatcgatgaatatggcattaatgttttttgcgcgacgccgactgaataccggatgttggcgaaagaagaggcgctttcttcttttaaacttcacagcatcaagcatgcggtttcagcaggggaaccccttaatcgagcagtgattgccacatttcaagaacaatttgatattacggtgcgcgatggctacnggcaaaccgaaaacacgttgttaattggcacgatgattggcatggaagcgcggcctgggttcaatgggcaaa

SEQ ID NO: 5552 - DNA, 592 bp, Bacillus clausii
gtggggaaagttgcctttttatttcctggacaaggctcacaaaaagttggcatgggagcaacgctttttgctgaagatttgatggcaaaggaagtgcttgagcgggctgaccaagcgcttggttttcctctttcagagatcatcgaacatggaccagaagacaagctgaaacaaacggcttatgcccaacctgctttagtgacgatgagcactgcagtcctccaattgttccgcgacgctgacattcaagcagattttgttgcaggccatagcctaggggagtattccgctttagtggcatgtaagtcccttacatttgaagatgcggtcacacttgttcatcaacgggggacactcatggaggaagctgtgccacaaggacaaggggcgatggcagcggtactcggcttaaataaagaggagcttgaggaagtggcttccgaaattgcagcggacggcgaagttgctgaacttgccaatttgaattgtccagggcaaattgtcctgtcagggactgcgaaaggaattgaacaagcagcagtattagcaaaacaaaaaggggccaagcgtgtcttgccacttgccgtcagcg

SEQ ID NO: 5553 - DNA, 473 bp, Bacillus clausii
ttgctatgcgcaaaccatattagcaacaatgatccgcctttgctaggtgcctatatcaaacggccagtacgttacatggctaaaaaagagctgtttaaagtacctgttttgaaaacgctgctgagaaagctaggcgctttcccagtcaatcgcgccggcggcgataaacaatcgctccgcacttctttagatattttaaaatctggggatatggtaggcatctttccagaaggaacgcgctctaaaaccggtgagatcggaaaggggctgtcgggcgctggtttttttgctttaaaaagcaccgcccacgttgtcccgtgtgccattattggcccttacaaaatgaggggccgtgttaccctcgtttatggaaagccaatctctatggaagagcaccgggcgaaccgcacttcagcaaaggaagtcactgaaatcatcatggatgaaattcaaaagctgaaggatcaatatca

SEQ ID NO: 5554 - DNA, 573 bp, Bacillus clausii
  misc_feature (1)...(573): n = A,T,C or G
tgtggttgttgctcattcctgacacgctttttcatagcgccattcccntcaatgtgacaaaagtagagctgttcctatttttaatcttaggtttattattgctgacagtattgacaaaaaacaaatttacatttgatgaagttggttttgtgatcgtatcaagcgtctatattggttttggcttccattacttaattttaacgagagcgattccagatgtaggcgtatggcttgtcctatttgtcattgtattgatttggacaaccgattcaggggcttactttgtcggaaaagcgatcggcaagaacaaattgtggccagatattagcccaaataaaacgattgaaggttcggtcggtgggattgtccttgctgttgtcgtcggtacgattttttatatgatccatccattttttagctcatacataattgcgctttgcatcatgctagttacggccgtgtttggtcaaatgggcgatcttgttgagtcagccttaaaacggcattatgctgtaaaagattcaggcaatgtcctgccagggcatggcggcatccttgaccggttcgacagct

SEQ ID NO: 5555 - DNA, 244 bp, Bacillus clausii
atgcttgagagattttcaaaatggaggcaagcctttacggatacagaagatgaggagcctacatcaatagacccgcaaaatataccgaggcatgtcgccattattatggatggaaatggccgttgggccaaagagaaagggctgccgcgcattgctgggcatagggaaggcatgaagacggttaataagattgttcgtgctgccaataccctcaatattgaaatattgacgctttatgcttttc

SEQ ID NO: 5556 - DNA, 405 bp, Bacillus clausii
  misc_feature (1)...(405): n = A,T,C or G
gcattatgcttcaatttccgttttatgccgggattatggggatnatggtaggctcaggactatntgaacagctttccctttggttngtctcgatttcatcagcagagacgttcccgctatggacgtttcttagcgcagggttactaaacatgtttatcccttctggaggcgnacaatgggctgttcaagggccgattatggtgccggcagcattggaacttggtgcggatatggcgaaaacagctatgnctgtcgcttggggagacgcatggacgaacatgatccaaccattttgggcgctgccattattagcgatcgcaggcttgaaagtccgtgacatcatgggcttttgtgtcatattgcttttttgggcatttgtgccaattgccattggcctgatgtttt

SEQ ID NO: 5557 - DNA, 418 bp, Bacillus clausii
atgaataaaatcattccgacgacagaggaagcaatggcgtttatcaaagacggttctacattagtagtaggcggtttcgggttatgcggcatccccgagcatttaatcgctgccgtgaaaaacagtggcgcctctaatttaacagttgttagcaacaattgcggcgtcgatgattttggcctcgggcagctgcttgaaaacaaacaaattagcaaaatggtcgcctcttatgtaggggaaaacaaacggtttgaacagcaatttttaaacggcgaactagaagttgaactcgtgccccaagggacgctcgctgagcggcttcgagcaggtggcgctggcattcccgccttttatacagcaaccggcgtcgataccccattcgctgaaggaaaagaagacaaaacgtttgacggcaagc

SEQ ID NO: 5558 - DNA, 597 bp, Bacillus clausii
atgaataaaatcattccgacgacagaggaagcaatggcgtttatcaaagacggttctacattagtagtaggcggtttcgggttatgcggcatccccgagcatttaatcgctgccgtgaaaaacagtggcgcctctaatttaacagttgttagcaacaattgcggcgtcgatgattttggcctcgggcagctgcttgaaaacaaacaaattagcaaaatggtcgcctcttatgtaggggaaaacaaacggtttgaacagcaatttttaaacggcgaactagaagttgaactcgtgccccaagggacgctcgctgagcggcttcgagcaggtggcgctggcattcccgccttttatacagcaaccggcgtcgataccccattcgctgaaggaaaagaagacaaaacgtttgacggcaagcgcatatattatggaacggggcattgttggcgacgttgctttagtaaaggcgtggaaagcagacccatttggcaatctcgtttaccggaagacgtcacgcaacttcaatccgctcgtaacagctgctggcacagtaacaattgtcgaggtagaggaactcgtcgaattgggcgaacttga

SEQ ID NO: 5559 - DNA, 366 bp, Bacillus clausii
  misc_feature (1)...(366): n = A,T,C or G
acttgatgattccaaccaanccggaccatatgttcgtttactgggcaaccacttcccatattggcgaaatgctaagagctggcgcaacggtctatcagtatgaaaatggctttattcataataaagtgttgatcgtcgatgaaacggtttgttctgtcggtaccgctaacattgatcaacggagctttaagctcaattttgaagtaaatgcctttatttatgacagtcaaatcgctggccagctaatagcggactttgagaatgatgtaaaacactctactcaaattacgccagaaatgtatgaaaacaggccaataagcgtccgctttaaagagtcaatttcacggctgttgtcgccgattttat

SEQ ID NO: 5560 - DNA, 468 bp, Bacillus clausii
  misc_feature (1)...(468): n = A,T,C or G
tggcgaggtcggcgatattgccgtccataaagacgcgcctgcattgttccgcgaatactacaaagatccagaaagaacgaaagccgcttatcgcggttcatattatttaacaggcgaccgtgcttatcgggacgaagaaggctatttttggtttgaaggacgaagcgacgatattattatttcctcagggtacacaattgggccattcgaagtcgaagatgcattaacgaaacatccagccgtgaaagaatgtgccgttgtcgccagcccanacgaaattcgcggccatattgtcaaagcgtttgtcgtactcaatcggccaacggacgatcanagcaagctgacnaaagagctgcntgaatntgtcaaacgtgaaacggccccatacaaatacccacgggcaattgaatatgtagccggactgccaaaaacgatttctggaaagataagaaggatcgagctccggca

SEQ ID NO: 5561 - DNA, 1041 bp, Bacillus clausii
  misc_feature (1)...(1041): n = A,T,C or G
ggagtttatacagatgggacaggtgttgcaagcgccgcaaagttataacgtagcagctatgcttgaacgggaagcgatcaggacgcaaaaagcaattatttggcaaaacgaggccggtgacaaactagaatggacgtatggggacttaattcaaaagatgaaccagctcgcaaatgccttaagccgaagcggtcttaaaaaaggcgacccggtgttgttgctttttccccgcgtgccagaggcgtatgcagcttaccttgcttgtttgaaaggcggctttgtcatcattccgtgttcagggatgttgcgagcgaaagatctggcttaccggcttagccattcgcaggcgaaaggcgtccttgcttacaaaggatttacagccgaaatcgacaaaatttctgatggcagcaccgacggcctaattgcaaagtgggtgtttggcgaagcatcgagcggctgggaaaatgtggatgatcgaatgaaaaatgaaaacgcttcctttgaacgagaaatggataaagaggaaatcgcgtttttgccctatacgtctggcacgactggaaacccaaaagccgttgtccatacacaagcttgggcctttgcccatttgcaaaccgctgcaaccgaatggctcggtgtggaaacaggagaccttgtttgggctactgcggccccaggctggcaaaagtgggtatggagtccttttctatcgatagtcggcaagcaggcgaccgcctttgtttacgatggcccttttcaggcaaaaacgtatctgcaattaatcgatgaatatggcattaatgttttttgcgcgacgccgactgaataccggatgttggcgaaagaagaggcgctttcttcttttaaacttcacagcatcaagcatgcggtttcagcaggggaaccccttaatcgagcagtgattgccacatttcaagaacaatttgatattacggtgcgcgatggctacnggcaaaccgaaaacacgttgttaattggcacgatgattggcatggaagcgcggcctgggttcaatgggca

SEQ ID NO: 5562 - DNA, 393 bp, Bacillus clausii
  misc_feature (1)...(393): n = A,T,C or G
tgggctgaccaacgtctggaaacggtgttgtcatattgaatgaagctggagaggaggcaggcattggcgaggtcggcgatattgccgtccataaagacgcgcctgcattgttccgcgaatactacaaagatccagaaagaacgaaagccgcttatcgcggttcatattatttaacaggcgaccgtgcttatcgggacgaagaaggctatttttggtttgaaggacgaagcgacgatattattatttcctcagggtacacaattgggccattcgaagtcgaagatgcattaacgaaacatccagccgtgaaagaatgtgccgttgtcgccagcccanacgaaattcgcggccatattgtcaaagcgtttgtcgtactcaatcggccaacggacg

SEQ ID NO: 5563 - DNA, 574 bp, Bacillus clausii
ttgaatttagcaaataaaatcaccgtagcgcggatttgtttaattccggcatttatgctgtttttgcttgtcgattggccacttggcgaaacggagtggtttcaacagccgattacatacagcatgcttgtggccacagcgatttttgtcgttgcctctgccacggattggctcgacggctactatgcacggaagcttgaccttgtcactagcttcggcaaatttctcgatcctttggccgataagctccttgtgaccgctgccttaattgggttagtggaagcgcagctcgtgccagcttggattgccattgtcattattagtcgtgagtttgcggtaacgggcattcgcttagttgctgcagcagaaggcgatgttatagcggcgagcaaactgggcaaatggaaaacgctcacccagattatcgctattattgctagtcttttacataatatccctttttcagctctttcatttccatttgcttccataatgctatggatcgcggctctgttaacgatctggtctggaatcgaatattttgtgaaaaacaaacacgtcattctaaaatcga

SEQ ID NO: 5564 - DNA, 639 bp, Bacillus clausii
cctcagcagcagaagcaaagacgaaagcaagggaaattggctttccggttatggtcaaagccgcttcaggtggcgacggcatcggcattgatgtgtgccggaatgaagaggaaatcgaagcagcttttgcccgaaacgaaaagaaagcacgtatgttttttggcgacagctctctttatttggagaagttgcttgagcggccgcgtcacattgaaattcaagtgctcgctgacagcgatggccatatcctcgcatttggggagcgggaatgttccattcaaaggagacatcaaaaagttgttgaagaagcgccatctccttttttagaccaaacgactcgtgaggcgatggaggaaatggcgaaaaaagcagctgccgccattggttatgaaaatgctggcacaattgaatgtttgctagacagcgacggaaattattaccttttggaaatgaatacacggctgcaagtcgaacatccagtgacagaggaagtctttggcattgatcttgtggaatggcaattgcggatagcaaatggcgatgtgctgccgtggcagcagcatgagctcagaggcagcggccatgcgatcgaagtccgcatttatgcagaagacccaatacgctttttcccttcgcctg

SEQ ID NO: 5565 - DNA, 195 bp, Bacillus clausii
  misc_feature (1)...(195): n = A,T,C or G
gagatacggtctcttatgcacttgctgtcgaagaaatcggctacgcatgcggcggtaccggcttgagttatgctgcagcggtatctcttggtgcaagtccgattttctactacggcacanaagaacaaaagcaaacctatttagttccacttgcaaaaggcgaatcccttggtgcattcgggttaacagaaccaa

SEQ ID NO: 5566 - DNA, 595 bp, Bacillus clausii
atggatttatttcaaatgaatgttgatttgtttagactaattaatgattttggtaaagaccatacatatctaaccgatacttttatatttatagctgaatatatggtttttgttcttgctttaattgttttaatgttctggtttactaggataagggaaaataggatgatgataatttcggctattatagcctttattgttgccgaggttatcgggaaaattgctgggaagttacatgcaaataatcaaccatttgcggaattgtctaatgtaaatcaattaatagaccaagcagtagataattcctttccgagcgaccataccattttattctttgcgttttgtacaactttctgcatatatcgaaaaagatggagttacatatggatgacggttgctttttttgttggcctttctcgtatttgggtgggtgtgcactatcctgcagatgtcttagtcggggcgctaattagtatcgtttcagctttaatggtttcttttatggtccctcgtcttaaattcgtaaggaaattactatggttttatgaaaaacaggaacaacagtttttacctactagggaaaaatctaaagaat

SEQ ID NO: 5567 - DNA, 174 bp, Bacillus clausii
taagttacgtgcggttgtatgggcagatgatcccgcaggcaagctgctctggtcaattttaaaaccggtattgctatatacagccgagaaaacagcagaaatagcccatgatttgttagcggtcgatgaagcgatgcgctggggctttggctgggaaatgggcccatatgagct

SEQ ID NO: 5568 - DNA, 204 bp, Bacillus clausii
attttatcggcaatgtcgaagcaagggatttgtttgcaggcgtctgcgatatcgtcgtttgcgacggcttttcgggaaatgtcgttttaaaaagcgtggaagggacagcgaaaatggtcttctcactgctcaaagagcaattgacaagctcattgcctgctaagcttgcagcgggtatgctcaagccccaattccgcaatcttt

SEQ ID NO: 5569 - DNA, 477 bp, Bacillus clausii
accgcatcgtgcaacgctatttgccagatgcctttttgtttgcagtattgttaacgattcttgtttttatattgggcgtgtttgttacagatgcttcgcctgtacaaatggttgattattggggctctggcttttgggatttgctttcctttacgatgcaaatggcgcttattgttgtaaccggttacattttggcgaatacaccgctgtttaaacgcctattatcaacgttggccgtattggcaaaaacgccaggccaggcaattgtgcttgtaacgtttgtggccagcattgcttgtctgatcaattatggttttggccttgttgtcggcgcgcttttttccaggcacgttgttcgccaagtaccaagcgtcgactatcgtatactggtggcggctgcctacagcggttttcttgtatggcatgggggattatcggcttctatccctcttacaattgcaacagaggaccactttt

SEQ ID NO: 5570 - DNA, 429 bp, Bacillus clausii
gattgccaccgccaacgtatccacatgagcggcaggcgcgagggaaaaaggctttttgtcagaacgggacggcattacaatgaacgactttttcgttaataacgatgccaagcagcgtgtcctgtctttagcagatggttaccggccgcctgcaaaaacaaagatccctgtgacaggaagagcaggttatgcgacgttgatgcttggcgccaaaatgatggaatggggcggttatgcatcagagcatgatttaaaaatcgccaaaaagctagcgttcgtcctttctggaggacaggtgtcagaaggcacgctagttgatgaatcttatttgcttgatttggaaagggaagcgttcttaagtttgatcgcagaaccgaaaacgcagcagcggatgcagcatatgcttacgaaaggaaaaccgttgcgcaa

SEQ ID NO: 5571 - DNA, 474 bp, Bacillus clausii
aaagcaatttgcttggcgatcctggaaaaggcttcagtcaatttctttacacgttggatggtgggcgaatttcaattgcagcccttgcagtcggcattgcccaagctgcctttgaccgggcgttagcctatgcgaaagaacgaaaacaattttcgaagccgatcggctcattccaagcgattcaatttaagctagccgatatggcgatggaaattgaacttgctcgtaatatggtgcacaaggcagctgctttaaaggatgcaggagcaccgtttggcaaagaagcggcctatgccaaactgttcgcttctgaaatggcaacacgcacatgcaaccaggccttgcaaattcatggcggctatggctatatgcgcgaatatgaagtagaacggatgctccgtgatgccaagctattggaaattggcgaaggcacttcggaaatccaacgccttgtcattgctaggcatttagggt

SEQ ID NO: 5572 - DNA, 293 bp, Bacillus clausii
  misc_feature (1)...(293): n = A,T,C or G
tagcagctttacagcaaaaggaggcgaaacggtgatcaatacagtattaattgccaaccgtggcgaaattgcctcgcgcattatccgtacatgcaaaaagcttggcgtaaagacgatcgctgtttattcagaagctgattgcaatgcagaacacgtcacgcttgccgacgaggcctactgcattggcggttcacgtgtccaggagagctatttaaaccaagaacagattttggctgttgccaaacaagcaaaagctgatgccattcatnccggttacggcttgttgtccgaca

SEQ ID NO: 5573 - DNA, 479 bp, Bacillus clausii
ttggtttcgatgatacataaaatcacaattgaattagcgttggaagcattagaagatcgaggggttacgattgaagaaattatggatcttgtttatgaattgcaaagcacgtatgttccagacttgacgaaggaaatgtgccggccgcatgtaatgaaagtgctggctaagcgagaagtgcaaaatgcgttattaacaggaatcgagcttgaccgcctcgccgaacaaggcaagcttagctcccctcttcaagaaattgtgcaatcagatgaaggcctttatggcattgatgaaattgttgccctttcgatcgttaacatttatggctcaattgggctgacgaactttggctatgtcgataaaatcaaacctggcattcttggtaagttaaacaaacataaaggcgggaaatgccatacattccttgatgatattgtcggcgcgatcgctgccgctgcttccagccggctcgcccattc

SEQ ID NO: 5574 - DNA, 903 bp, Bacillus clausii
  misc_feature (1)...(903): n = A,T,C or G
tgagggcggtaacccttggcgacttgtctattngcgcaggcgaagcgagcactgttctcgccggtggaatggagtcnatgtcgaatgctccttattatatgaagaaagcacgctttggggcacgaatgggcgatacgacgttgcttgatggaatgatttatgatgggctgacctgttcgtttaacgatgtgcacatgggcgtgtatggaaataggacggcaaacgaactaggcattagccgcgaggaacaggatcgctgggctgctaagagccaagagcgtgctattggagctattgaaagcggtatcattgatgaagagattgtttcggtttcggtaaaaggcagaaaaggggaaaccgttctcgttagtcaagacgaggcgccacgcaaaggaacgaccgttgacagccttgctcaattaaagccggtttttgggaaagagggaacaattacggcaggcaatgcaccaggcgtcaatgacggtgcctgtgcattgctgttaatggaagctgttcaagcagagaaacaaggcaagccagttttggcaacgattgaagcccatcaccgtcttgccgtcgaaccatgggactttccgaaaacaccaggcctggttataagcgaattattggagaaaacaaagttaactgttgctgatataagccgattcgagatcaatgaggcgtttgcagcagtagctttggcaagcaaccaaatagctggattagatgaagagaaattcaatgtcaacggaggcgctgttgcgtatgggcacccaattggcgccagcggcgctcgaatcttgctaacgcttgcttatgaattgaagcgcagcggtggtggttatgggatcgctgcgatttgcagcggcggcggccaaggcgatgccgtattgctgcatgtga

SEQ ID NO: 5575 - DNA, 385 bp, Bacillus clausii
atgaaaacgatgatggtcattggcgctgggcaaatgggagcgggcattgccgaagtgtttgctgcaaaagggtttaacgtgctcctgcacgaccgggagcttgagctggctgaaaaagggaaagctggcatcgagcaaaggctcgaacgtttggtggcaaagggatataccgaagaacaagatgtacaacagacactggcgcgaatcaaaccaatggccgatattgctgcatgtgctgatgccgagatggtcattgaagcagcaactgaaaacatggaaacgaaaaaacacctatttaaaagtgcagacgcacatgcccgagagggggcgattcttgccagcaatacttcttcattatcgatcactgaattggcaagcgttacga

SEQ ID NO: 5576 - DNA, 251 bp, Bacillus clausii
  misc_feature (1)...(251): n = A,T,C or G
cctttgcaagaaattttagcacgggatgaagggctttatggcgtagatgaaattattgcattgtcaatcgtcaacgtnnncggntccatcgggctcacaaattatggttatattgataaacaaaagccagggatattaaagaaactaaacgataaatcgacaggcgcttgccatacatttctcgatgatattgtcggcgcgattgctgccgccgcctcgagcaggctcgcccacagaaaagcgaatacaga

SEQ ID NO: 5577 - DNA, 270 bp, Bacillus clausii
  misc_feature (1)...(270): n = A,T,C or G
ncaatatactggagggacancagggcttgccaaaggcgtgatgctcacacancggaatntggnngtcaatgcagngcaatgtgaagcntggcttnacnaaacagaagagggaagtgaacgggtgnttggngtcatgccgttttnccatgtgtangggatgacgacagtgatgaanntcgccgttaaaacggcagcancaatggtgctattgccgaaattcaagccagaagaagttttaagnncgattgaaaagcaaagnattacactttt

SEQ ID NO: 5578 - DNA, 437 bp, Bacillus clausii
  misc_feature (1)...(437): n = A,T,C or G
tggccagacacagatgnaatggtgtattcacttgaaaaagacggggaagcagaaatcggcgaggttggcgaactgtttgtccgcgncccgcaagtgatgaaaggatagtggatgcagcctgaagaaacggcgcaaacgtttcatggcgagtggctaaaaacaggggatatggctcgaatggatgaagagggttatgtatatatcgttgatcggaagaaagaaatcattattgcaggtggatttaacatttatccccgtgaaagtagaagaagtgttgtttgaacatgaagcggttgtccaaagcagccgtaattggtnttcctgacgagtatcggggcgaaacgcgtgaaagcgtttattgtgttgaaagcaggcgaaacgatctctgaaaaagagatggaggcgtactgtcgccaaaaattggccgnttataaaat

SEQ ID NO: 5579 - DNA, 612 bp, Bacillus clausii
tgatcgaaaaagaacgggttacctttaccggtggtgtgccaactgtctggctcggcctcttgcaagtgcttgaacatcgtcattatgatttgagcagcttgcgtgctgtcatttgtggcggctctgcggcaccgcaaagcatgatcgagcgctttgaacgtaagttgaacgtcccgttttaccatgcctatggcttaacggaaacggccccgctcgtatcgttttcccgtttgaaaagccaccagaaaaagtggagcaaaggtgagcaatatcaagcgaaggcaaaacaaggaatggccgttccgttaatcgatatcaaaggcgtgaacgccaatggggagatcccttggaatggagaagaaatgggcgagttgctcatccgaggcccttgggttgccgaccgttattttcacgatgaacggagtacagaagcattcaaagacggttggttccatactggagatgtagtcacgattgacgaggagggagcaattaagattgttgatcgtacgaaggatttaatcaaaagtggcggggaatggatttcttcggttgatttggaaaatgcgattatgtctcacgaagccgtactagaagcagctgtggtggctt

SEQ ID NO: 5580 - DNA, 216 bp, Bacillus clausii
caatcggaagtttattagaaagaatggctgaggagtccccttcgaccgaagcgctagtttatcctgaccgtcatttacgcctttcctacaaagactttaatcactcgtgcagacagttagcaaaagggtttatgcaattaggcataaaacgtggcgagcatatggccgtttgggcgacaaattgtcctgaatgggtgaccactcagtttgctacag

SEQ ID NO: 5581 - DNA, 135 bp, Bacillus clausii
gcagcgaaatccaagactattgtaaggggcagattgcccattttaaaattccacaagtcgttgaatttgttgaccattttccaatgacggcttcagggaaagtacagaaatttaagctgcgtgaacaaaaagaaa

SEQ ID NO: 5582 - DNA, 699 bp, Bacillus clausii
ttccctatcttaagcatattatttacttaggattagaacgcaagcctggcatgtggctttatgacgacattgtcaaaatgggcgaccaagtaaccgatgccgcccttgaccgcttaatgagtgagctggatgtcgatgatgccattaatatgcagtacacttcaggcacaacaggctttcctaaaggcgtcatgctgacacatcgcaatttaatccataacgcaagcaatatcgctgcttgcatggaactttctcagcaagaccgactctgtatacctgttccatttttccactgttttggctgcgtccttgggacactggcctgcgttagcgttgcagcgacaatggtgcctgtagaagaattccatccagagaaagttttgcatacagtccaagctgaaaagtgcacagcgcttcatggcgtaccaacaatgtttattgccgagctgaacttgccgacattcgatacgtatgacctttcttcattgcgtactggcataatggcaggttcaaactgccctgttgaagtgatgaaagatgtgattgagaaaatgggcattaccgagattaccattgcctatggccaaacggaatcttctcctgtcataacgcaaacacgcgtcgatgattcgctagaacggcggacagacacggttgggcgaactttgccaaatgttgaggtgaagattgtcgaccctg

SEQ ID NO: 5583 - DNA, 192 bp, Bacillus clausii
cacgcaaacgggcgcatcctgtatttattccccacatcaccattgcccaggggctgccccaatcagagcatgctgatattgttggtcaattgaaaatgatcgatgtttcccatcaagaaacaattgatcgctttcaattgctcaaacaacttgacaacggttcatgggccgtctatgaaacatttttgttag

SEQ ID NO: 5584 - DNA, 1133 bp, Bacillus clausii
tggtgtatttcgagacagctatggtggggtcaccaaattccagcctggtaccataacgaaacaaacgaaatttatgttggcaaagagcctcctcgtgacagcgaaaactggcgtcaagatgaagacgtccttgatacttggtttagctctgcactctggcctttttcaacaatgggctggcctgacgaggaagcgcctgactataagcgttactacccgactaatgtattagtgacaggctatgacattattgcattctgggtatcgcgcatgattttccaaggcaaagcctttactggccaacggccatttaaagacgtgcttattcacggtctgattcgtgatgctgaaggaaggaagatgagcaaatctcttggcaatggtgtcgatccgcaagaggtgattgacaagtatggcgccgattctttgcgtttcttcttggcaacagggagcacacctggaaacgatttgcgcttttactgggaaaaagtcgagtcgacttggaattttggcaataaaatttggaatgcttcccggtttgccttaatgaacatggacgggttctcttatagcgacatcgatatgaaccaggaaaagtcaattgcggacaagtggattttaacgcgtttgcaagaaacggtagaatcggttactcgattaatcgatgcttatgaattcggcgaagctggaagagtactctatgcttacatatgggacgatgtatgtgattggtacattgaaatggctaagctcgccctttatggggaaaatgagcaagcaaaacaggcaactcgttctgtgctagcctatgcccttgaccacacgatgcgtatgctccatccgtttatgccgtttattacggaagaaatatggcagcaccttcctcatgagggcgaatcgattacagttgccaactggccagtgtatgatcaatctcttgtttttgaggaagctgtagaagacatggaggcactcaaatcgcttattcacgccatccggacaacacgctcggaactaaatgtgccaatgagcaaacaaattgagctaaagatccgtccgcaagacgaacaaatggcggcacggctccaaagaggggtcgcttatattgaaaagtttgccaacccaagttcact

SEQ ID NO: 5585 - DNA, 437 bp, Bacillus clausii
atgcgagttctagtccagcgagcgaaacggggcagtgttcgagtcgaccaaaaaacagttggcgacattgggccaggcctcgtcctcttagttggaatttctcaagaagatacggaagcggacgtacgtttttgcgcagaaaaagtagcccatttgcgcatttttgaagacagctctgccaaaatgaacgaatcggtactcgatcaaggcggttccgtctaatcgatttcgcaatttacgctttatggagactgtaaaaaaggacgtcgtcctaatttcatgcgtgctgctaagcctgaaaaggcaaagcagctttatgaactttttaacagctatttgcgagaactcggccttgttgtggaaacaggcgagtttggggctatgatggaagtagagttaattaatgatggtccggtaacgatattagttgaaagtga

SEQ ID NO: 5586 - DNA, 291 bp, Bacillus clausii
gatttgaacgcgcgctagaactgaacggtgtcggttaccgtgcttccaaatctggcaacaagcttgtgcttaacgttggttactctcacccagttgaaatcactcctgaagaaggccttgaaatcgaagttccttccaatacgaaagtggttgtaaaaggaatcaacaaagaacgagttggggcgcttgcatcaaacattcgcgctgtgcgtctgcctgaaccttacaaaggcaaagggattcgttatgaaggcgaatatgtgcgtcgcaaagaaggcaaaactggtaaat

SEQ ID NO: 5587 - DNA, 363 bp, Bacillus clausii
atgattacgaagcctaacaaaaatgcaggccgtaagaaaagacacgctcacgtacgccgcacactaagcggtacgccgcagcgtccacgtttgaacgtattccgttcttctaagcacatttacgctcagctaattgatgatgtgaatggcgtaactcttgcacaagcttctacgcttgacaaagagttggggcttgagaaccgcggcaacaaagaagctgcgcgtaaagtcggcgaacttgtaggaaaacgtgcggttgatgcgggattcgaatcagtggtctttgatcgtggaggctacttatatcacggccgtatagctgagctcgctgatggcgctcgcgaagctggccttaaattctaa

SEQ ID NO: 5588 - DNA, 277 bp, Bacillus clausii
atgcgttctatcgatccaaacacattggaacttgaagaaaaagttgtcacaatcaaccgtgttgcaaaagtggttaaaggtggacgccgttttcgttttgccgcgctcgttgtcgtaggtgacaaaaacggacacgtcggttttggaatggggaaagcacaagaagtgcctgaagccattcgtaaagctgtagaagatgcaaagaaaaacttaattgaagtgccgatcgttaatacaacgattccacaccaaattgttgggcgttttggtgccggtc

SEQ ID NO: 5589 - DNA, 357 bp, Bacillus clausii
  misc_feature (1)...(357): n = A,T,C or G
aagaagaaattttagcaaggcgcacctttgcgattatctcccaccccgatgccggaaaaacaacattaactgaaaaattgcttntttttggcggtgccatacgtgaagcagggacagtgaaagggcgcaaaaatagcaaacatgcaatgagtgattggatggaaattgaaaagcagcgtggcatctcggttacaagctctgtgcttgaattccagtacaacggctttcatgtcaatattttggatacgcctggccacgaagatttttcggaagatacgtaccgcacattgaccgcagctgattctgccgcgatgttaattgacgctgncaaaggagttgaagcacagacaaaaaagc

SEQ ID NO: 5590 - DNA, 610 bp, Bacillus clausii
  misc_feature (1)...(610): n = A,T,C or G
ctgttgaaaattgtttttatgggaacgccggcattttcagtgccggttttaaaacggctgatngatactcatacggtattggcagtcgtcacacagcctgaccgtccagttggccgcaaacgcctgctaacgccaagcccggtaaaagaagaagcgcaaaaacatgggattccagtactgcaaccggaaaaaattcgcgagcagcatgaagacattcttgcgtttgcgccggagttaatcgtaaccgctgcttacgggcagattgtcccaaaagctgtccttgatgctcctccatacgggtgcatcaatgtgcatgcttcactgttgccaaaataccgcggaggggccccgattcatcaagcgattatcgacggcgagaaacagacaggcatttcgattatgtatatggcggaaaagcttgatgctggagctgttctttcccagcaagcggtagcgataacagatgaagacgacgtgcagacgatgcatgacaagctaagcgcgattggcgccgatttgcttgaaaaaacgattgttgctttagaacagggtacaattgaggccgttgcgcaagatgaggacaaggcaacgtttgctcctaatattaaac

SEQ ID NO: 5591 - DNA, 371 bp, Bacillus clausii
  misc_feature (1)...(371): n = A,T,C or G
aacatccaacagttatctttggatanncttcgtgcattangcattgatcctttaaaacatgacattcggttcgtagaagacaactgggaaaacccaacgctcgggtgtgcgggcctcggttgggaagtntggctagatgggatggaaattacccaatttacgtatttccagcaagtnngcggcntggaggctaatcccgtgtctgcagagattacttatggattggaacgattggccacatatatccaagataaagaaaatgtatttgacttggagtgggtcnaanggttcacctatggcgatatctttttacagcccaagtatgaacattctacgtatacattcgaagtttctgatgtagacatgttgtt

SEQ ID NO: 5592 - DNA, 648 bp, Bacillus clausii
tgcagggcgattaatgacaaaacgcggcaaaggaaaggcgggatttgcccacattcaagatataggagggcagattcaaatatacgttcgtcaagacgccgtaggggaagaagcgtatggtttattcaaatcattagatattggcgacatggttggtgtcggcgggcgtccatttaagacgaaggtaggagaaatgtctgtgaaagtgacggagctggtgatactagggaaatcattgcgtccgttgccagacaaatatcacggtttaaaagacgttgagcaacgttaccgccagcgttatcttgatctaattacgagtcctgaatcaagaaccgcgtttataacaagaagtaaaatcattcaagtcatgcgccgttatttagatgaaaaaggctttcttgaagtggaaacgccgatgatgcatagcatccctggtggagcttctgctaggccatttgtcactcaccataatacgctcgatatggaattatacatgcgtattgcgatcgagcttcatttaaagcgtttgatcgttggcggcttggaaaaagtatacgaaataggccgtgtgttccgaaatgaagggatatcaactcgccataacccagaatttacaatgattgaactttatgaagcgtatgctgatta

SEQ ID NO: 5593 - DNA, 332 bp, Bacillus clausii
  misc_feature (1)...(332): n = A,T,C or G
ctgagcttttgactaaacggttattccttaggctgccactgcctggggacgggtttgctttgtatcaagcactccaggcttccanaaaagaattggtgccatggattccatgggtggagagaatgtcatcgccagagcaagctgaacaaggtgtacagcaagcacatgttgattttttgcaaaaaaaagcatttcatttccacttattcgagcagcgctccggtacttttgtcggctcctgcggactccaccatattaactgggatgtcccgcgtatggaaatggggtattggatcgatagccgttttgctggaaaaggctatatgactgaa

SEQ ID NO: 5594 - DNA, 582 bp, Bacillus clausii
  misc_feature (1)...(582): n = A,T,C or G
ctacttcggttgcaatcaatggggttgctcngtataaaggggtactgagccatggctttgttatggacggtgaaggcaaaaaaatgagcaagtcccttggcaacattgtggtgccaaataccgttatgaaacagcttggcgctgacattttgcggctttgggtggcgtccgtcgattatcaagccgacagccgtgtgtctgattcgatcttaaaacaagttgcagaaacataccggaagatccgcaatacattccgctttctccttggcaatttgcatgattttgacccgaaaaccaacgctgtcccacgggaccaactaacaggcgtgcatgcgtttttgcttgtacgtttaaatgagctaacgaaacgtatgcatgaaggctacaatgagtaccagttcttaaatgtctataatcacttccgcaatttttgcacggttgaattgagttccttttatatggacatttcaaaggataccctttatatcgagcacgctgaccatcctgagcgccgcgctttccagacagtgatgtatgaagtagtgacggcactgactaaactgattgccccgattttgccac

SEQ ID NO: 5595 - DNA, 883 bp, Bacillus clausii
gtgagtaatctgactttttcatggcgcgtcgatgaaggcgcgcccctgctattacggacgtttttgcgtgaaaaaaaacaagtgtcgaagcggcttttggcagctgtgaaatttaaaggcgggcttttgcgggtgaacgagatagaagcaacggtgcgccacgttgtgaaaacaggggatttagtgacaatggtgctaccgcctgaatcgcctagcccaagtttacaacctgaacagcttttattcggcatcccttatgaagatgagcatatgctcgttgccgataaaccaggacatatggcgacgattccttctcgagatagaccaggaggttcccttgccaatggagtgctccactattacaaacagcagcaactgcaggcaacgtttcatgctgtcaaccgccttgaccgtggcacaagtgggctgctgattgtcgccaagcatcgttacgcccatgatttgctatctcggctgcagcaaaaagggggcgttaagcgttgttataaagcgcttgtaacaggggtactttcagaaaaagtgggcattattgatgctccaattgacagaaagcctggaagcattattgaacgagaagtggggccaggtggcaaatcagccataacccactacaaagtggaagcagaatcaaacacacacagcttagtgtctttgcagcttgaaacgggcaggacacaccaaatccgcgtccattttgcttacataggccacccacttgtcggcgatgggctatatggagatcatgacgaggggttgtcccaccaagcactgcattgcgatcatgtggcatttacgcatccgtttacagacgaagtactttatgtcgaaaaaagcttgccgaaggaatggcgtccattcgttg

SEQ ID NO: 5596 - DNA, 211 bp, Bacillus clausii
  misc_feature (1)...(211): n = A,T,C or G
gtgaaaacnacnatcgcccaagtgggacgttatgtcnatgaacaagtaacgatcggcgcatggattgccaacaaacggtcaagtggaaaaattgcatttttgcaactgcnagatgggacaggctttattcnaggagtcgtcgtcnaagcggaaaagcctgaggacgtatnngcattagcgaaatcgatcacgcaagaaagttctctttatg

SEQ ID NO: 5597 - DNA, 294 bp, Bacillus clausii
  misc_feature (1)...(294): n = A,T,C or G
agtggttgatcctaaaacaggcatgcgtggtcgccgtgaaacgaacacgatgccccaatgggcaggtagctgctggtattatttgcgctatattgatccgacgaacgacgaagcgttggccgatcctgaaaaactagacaattggctgcctgtcgatacgtatattggcggtncggagcatgcagtcttgcatttgctatatgctcgtttttggcataagtttttgtatgatattggcgttgtgccaacaaaagaaccattccaaaaagtgtttaaccaaggcatgatccttgg

SEQ ID NO: 5598 - DNA, 342 bp, Bacillus clausii
gtttattacacgttacccaaggccattaaagccgttttacatgcagcctgcccctgaccgtgacgatgtcgtcctttgtgcagacttaatcgctccagaaggatatggagagattattggcgggtctgaacggattcacgattatggtttgcttaagcaagaactggaaaagcacaacttgccgttagatgcctatggatggtatttggatttgcgcaaatacgggtctgttccccattcaggctttggcttaggactcgaacgtacggtagcgtggctgtccggcacggaacatgtcagggagacgattccgtttccacggttattgaaccgcctgtaccc

SEQ ID NO: 5599 - DNA, 417 bp, Bacillus clausii
gttgtttttcgtttgccttttctgttacgtgtacaaaaggcacttacattcgtacacttgctgttgacatagggaaaaaggcaggctaccctgcccatatgtcaaagctgacacggacagcatctggcccgtttacacaagcagatgccattcctttatctgcatttgcggaaatgagtttcgatgagcgcctgaataagttgcgaccccttgatacggctcttcagcattttccacgggtcactgccgataaggagctggaaaaacgaatacgcaatggtgctgtcctgaagaaaagcgcttcttttggagacaggcgttttttgttttataatgaacaaggagattgcttggcattgtatcaagcacatccaacaaaggctgggcttattaaaccagaaacgttattttgtcatg

SEQ ID NO: 5600 - DNA, 940 bp, Bacillus clausii
ctgttgaaaattgtttttatgggaacgccggcattttcagtgccggttttaaaacggctgattgatactcatacggtattggcagtcgtcacacagcctgaccgtccagttggccgcaaacgcctgctaacgccaagcccggtaaaagaagaagcgcaaaaacatgggattccagtactgcaaccggaaaaaattcgcgagcagcatgaagacattcttgcgtttgcgccggagttaatcgtaaccgctgcttacgggcagattgtcccaaaagctgtccttgatgctcctccatacgggtgcatcaatgtgcatgcttcactgttgccaaaataccgcggaggggccccgattcatcaagcgattatcgacggcgagaaacagacaggcatttcgattatgtatatggcggaaaagcttgatgctggagctgttctttcccagcaagcggtagcgataacagatgaagacgacgtgcagacgatgcatgacaagctaagcgcgattggcgccgatttgcttgaaaaaacgattgttgctttagaacagggtacaattgaggccgttgcgcaagatgaggacaaggcaacgtttgctcctaatattaaacgggagcaagaagtgctcgattggcaaaagccagcaagggcgctattcaaccaagtgcgcggaatgcggccatggccagttgcctatacgcttgtaaacggcaaccgtttgaaagtgtgggaggcaaaagaaatagcaggggagcatgagtgcgagcctggtgaaatcctagccacgacaaaacaaggaattgacgttgcttgcgggaatgggacgattttgcgattgacggttgtccagccagcaggaaaaaaagcggtgctagcaaaccaactgctgcaaggagcccatccgttccaagtaggaaagcgtctcggtgaagggcatgaat

SEQ ID NO: 5601 - DNA, 317 bp, Bacillus clausii
gcgttcgcgaagtggcgcttgatgcgctgctcaaggtcgagaaaaaccaagcgtatagccatctgttgcttcattcgactttaaaggccgccgggttggacaagcgcgacagcgggctgctgacggaactcgtttacggtacgattgccaggaagcaaacgcttgattactatttggcgccttttataaaatcaggtaaaaaacgtgctttatggatagatgtactcttgcgcctttctgtctatcaaatggtatttttggatcgcattcctgaccgtgcagttgtccatgaggctgttacgattgccaacaaacga

SEQ ID NO: 5602 - DNA, 657 bp, Bacillus clausii
tggcactgattatgtgtttgccaaaacacataaaaagggtgaaaaaacaagcgtgctattgccggaacttaaagaattgattacgggcttaacatttccaaaaagcatgcgatggaacacctactcccttcgctatgctcggccgatccagtggcttgtcgctctctatggcgaggacgtcattcctttctcaattaacggtatcgaaacagggcgaaacacgacgggacaccgttttttagggactaactttccattagagaatccaatcgagtatgccgacgccctgaaacgtcactatgtcattgccgatgctgacgaacgaaaagcagcgattgtaagtcagttaaagcaaatggaggaagagcatagttggattgtgccaatagatgaagcgcttcttgaagaagtgacacaattagtcgagtatccaactgcgctatcaggctcatttgacgattcgtttttagctttgccgaaagaagtattgattacgacgatgcgtgaacatcagcgttattttccagtagaagcgaaagatggccgtttgcttccgtactttattacagtgcgaaacggaaatgaagaatttattgaaaatgtcgccaagggcaatgaaaaagtgttacctgctccttggctgaagctgcctttttt

SEQ ID NO: 5603 - DNA, 476 bp, Bacillus clausii
atgataacacttaaatcgaagcgtgaaattgcgctaatgcatgaagcggggaaattgctagccgactgccataaagaaattgcgaaacggatcaaacctggagtgacaacagaagaaattgaccacttcgttgaatcctacttaaaaaaacacggcgcaaccccggaacaaaaaggctataacggttataaatacgccacgtgcgcatcaatcaatgatgaaatgtgccatgggttcccacgaaaacagcctttaaatgaaggggatattgtcacgattgactctgtttttaaccttaatggcgcccttgccgattcagcttggacttacgcggtggggaatgtatccaaacaagcttcagatttgatgaaaattacccatgaagccctttacaaagggattgaacaagcacacgtaggcaaccgcctaggcgacatcggttacgcgatccaatctcatgtggagcaagcaggcta

SEQ ID NO: 5604 - DNA, 555 bp, Bacillus clausii
atgcattttaatattcgtggggaaaacattgaagtcacacctgccatccgggagtatgtcgaaaaaaaggtgggaaaattggagcgttattttgataccactccaaccgccgatgtaaacgtaaaattgcaagttctcggaagtggcgagtcaagcatcgaagtcacgattccaatgccaaagcttttgcttcgtggggaagaaatcaacgcggatatgtatgcagccatcgacatcgtcgtggaaaagctagaacgccaaatccggaaatataaaacgaaagtcaatcgcaagtttcgccaagaaggcagtttgaaatatatgtttaaaaatgaattggaacctttacgagatgaagtcgctgaagacgatgaacttgaagttgtacgcactaaacgctttaatttgaagccgatggatgcggaagaggcgattttgcaaatggatttactcgggcataatttctttgttttttcagatgcagagagcggcagcacaaatgttgtttaccgccgcaaagacgggaaatacggcttaattgaacctgaagcgtaa

SEQ ID NO: 5605 - DNA, 399 bp, Bacillus clausii
cgatgtgtatacgatgttcgccaaggcaaggctgttaactgaacgtgcggaagaccgggagtttaaagaagtgaccgaaagcttgagtcgtgtcacaaatttggctaaaaaagcgccaaaaggtggtctcatttccgaagatctgtttgaaaatgagacggagtcacggttgcttgctgctacgctagaggtcgagttcggcttggctgaggcttggaagaccaaagatgcgtttgctgcttatcaagcgttggctcagtgtcgtgacacgatcaacacgttctttgaccatacgatggtgatggccgacaatgaagccattcgcaataatcgccttgcgctgcttgaccgattggcgaaatcaatccagtcctatgctgattttcaaaagatcgtctt

SEQ ID NO: 5606 - DNA, 512 bp, Bacillus clausii
atgaaacggatagaatcagtcaaaaatgaacgtgttaaagcatggaaaaaattacatagcaaaaaaggacgtgaccagacaggacggtttttaatagaaggggaacatttaattgaagaagcgtggaaatcagattggaaagtggaaacggtactaacgactgcagacgatgaaaacttatttcccggggaatgcataggcgtttctgaagccgtcatgaaggagttatcggaaacaaaaagccctcaaggcattgtagctgtatgccaaaaaaaacagtggcatacccctgaacagttgaaagggcgttttgttcttcttgaccgggttcaagacccaggcaatgtcggcacgattatccgcacggcattggctgctgatgcagcaggagttgttttaggcagtggttgtgctgatttattcaatgcaaaagtgatccgagcaacacaaggggcattgtttcatttacctgtttatatgggcgatttggctacctggataaagatgctcaa

SEQ ID NO: 5607 - DNA, 684 bp, Bacillus clausii
aaaccgttttttctggaattcaaccgagcggcacgttgacgcttggcaactacttaggggcattgaaacactttgccgacatgcaaaatgactatgattgctacttttgtattgtggaccagcatgcgataacggtaccacaagagcgtttgaaactgcgcgaaaacatccgcagcctcgccgccctttacattgcatcagggatcgatccaaataagtcgacgttgtttatccagtcggaagttccagcacatgcccagctaggctggatgatgcagtgtgtttcctatattggcgaattggaacgcatgacccaatttaaagacaaatcaagcgggaaagaagccgtttcagctgcgctgttaacgtatccaccgcttatggccgcagacattcttctttatcaaaccgacattgtgcccgttggcgaagaccaaaagcagcatttggaattaacccgcaatttggcggagcgctttaacgccaaatacaatgatatttttactgttcctgaagtgcgcatcccgaaagtcggtgcaagaattatgtctttaaatgacccttcataaaaaaatgagcaaatcgaatccaaatgcgaaaagctatatttccatgcttgacgaagccaaagacgattgcaaagaaaaattaaaagcgccgtcaccgattcagaaggtacgattc

SEQ ID NO: 5608 - DNA, 624 bp, Bacillus clausii
gagtggacgaagtcgacggtgccgttgtgaaagacgggaagctccacgtgcaaccagagcgacaatctgtttgatatgccggcacccctgtccgttacaaagccgaactttatttaatgctcaacaaaccagcgggcgttgtgacggcgacagaagacgcgaggcagaaaacggttcttgaattagtgaaaaatgaatggggacatatgaagccttttccagtcggaaggttagataaagacacaaccggattgttgttgttaacgacagacgggggcttttcccatgagctgatggcgccgaaaaaacatgttgctaaagagtaccgcgctctagttgaaggaaaagtgacacaagccgacgttgaagcattcaaaaacggtgttgttcttgatgacggctactgtacaaagccagcgcaactagaaattgaagaatctggtcctttgtctgcgatatcgctagaactgacagaaggaaaattccaccaagtgaaacgcatgtttgcagcagttggcaaaaaagtcatcaaactggaacgagtacggattggcagtttgatgcttgactcaagcttgccaaaaggcggttatcgtgagctaacgccagcagaaatacagctgg

SEQ ID NO: 5609 - DNA, 213 bp, Bacillus clausii
ttttgtacagggtgattacaatgaatcaactgagaggccggttcgcgcccaccccgtcaggcgagctccatctcggcaacctttacgttgccttgctctcttggctgcaagtgcggcaaggaggcggacagttcattttacgtattgaagacatcgatcgtccacggtcaaggaacgagctcgttgggccaatgatggaccatttgcactggc

SEQ ID NO: 5610 - DNA, 234 bp, Bacillus clausii
tacttacgggtatatgacttttggcaaaatcggcggcacgttgcttgttgaaaacgaagttgaggtcgtcgtgcaaatgaatggcaaagttaaaacgaagctcgttgttaacaaaggagcctcaaaagaagaaatggaagcagcagcactcgctgatgaaaaagtgcaagcagctatcggcgagaaaacgattcgcaaagtcatcgctgttcctggaaagcttgtcaacattgt

SEQ ID NO: 5611 - DNA, 168 bp, Bacillus clausii
tgtgttggtgcaaacggctcctaagcgcaagcttgaccaacttgtcggccatagcaaccaccaaggcgtcgtcgcctccgttgctgcgtacgaatatgcagacatggatacgttatttgccaaagctgctgccgctaatgaagccccatttttcctcgtgcttgacga

SEQ ID NO: 5612 - DNA, 566 bp, Bacillus clausii
atgaacgaactacactattttttagctttgcccctttctgccgatattcaatcggccatttgttcacatactcgccgctttgtccaagaagagcgatttaaaaagtgggtccatccggctgattatcatttaacctatcatttttttggttccttacaagcaaaaaagtgggcagaaacggaaaaagagcttgcccgattaactgcaacgttcacgccgtttgtgttgcagtttggcgaatacggaacattcggcaaggaaaacagtccgagaattttttacatgaagcctaacccaatagaagatacgctaatggaacaacacgcccaagttgtggcgttattggcgcaacttggttatccagtcgacagccgtccgttttctccacatgtcacgatcgcccgcaaatgggttgatataaagccctacgtacagccgccatctcgttttcgttactcagaaaaagtggggcgcttgtgtttgtataaaaccgttactggacaaactccgaaatatgaagaagtctgttcgtttccgtttttaggtagggaagagcagtgaagtgg

SEQ ID NO: 5613 - DNA, 783 bp, Bacillus clausii
ttggtcttcgtcttttttgcaggaaaacggagttgaacctacagcaggggaatggctgttgcggcaccatgggaaaatggaacgggccaagctattggcaagcttaagagacccccttccagaatcagtttggcaagcatttaaacaagatgtggccgtcattgcttcaggggttcctgtccagcacgtaatcggctacgaacaattttatgggcggacgtttctcgttaatggcaacgtccttattccccgcccagaaacagaagaacttgtcgcgctcgtacttaataaattaaagcctggcccccaagccatccttgatgtcggcacgggcagtggggcgattgcactcacgttaaagctagagcgacccgattgccatgtaaccgcgactgatatttccgagaaagcgctagacgttgcccgggaaaatgccgagcaattcggtgccgacataacgtttgccaaaggcgatttactagcgccagtagcaggagcggtgtttgatgtcattgtgtccaatccggcctacattccttatcgtgatcgggacagccttgcggtccatgtgcgtgagttcgaaccggaaatggcactgtttgccgaagaagatgggctattgttttatcgacggctggcggaagaagtacccacttgcatccatccgcgctcattaatcgcagtcgaaattggcgctggccaaggcgaagccgttcaagcgttgtttgctgccgcgtttccctttgctgacataaacattgtctatgacataaacgggaaaga

SEQ ID NO: 5614 - DNA, 749 bp, Bacillus clausii
gaatagaagtggatgagcgtaaggaagacccactcgatttcgtattatggaaagcagcaaaaccaaatgaaatttcgtggagcagcccgtggggcgaaggtcgtcctggttggcatattgagtgctcggccatgattaagaagagtttaggggacacaattgacatccacgccggcggcaaggatttgacgtttccccatcatgaaaatgaaattgcccagtcagaagcgttaacaggcaaaaaattggccaattattggatgcacaacggatttgttaacataaataacgaaaaaatgtcgaaatcactcggaaactttgtgcttgcacatgacatcatccaacaatattcgccagaagtcgttcgatttttcatgctcactgcccattatcgtacaccaattaactttagtgatgagcttcttcaaggggctgaagcaggactagagcgcctgaaaaatacaatcgccaatttgcagcaccgcttggcggaaacagctgatatgggggcagaagaagagtggctcgaaaaaatcgctggcgcaaacaacgttttatcgaagaaatggatgacgatttcaatagcgccaatggaataagtgtcttgtttgaccttgctaaagaagccaatatttatatgagcgaagcacaaacgtccaaaaaagtgctcaatgcttttttggagtttgtttaccgagtttggcgaagtgcttggtgtacgctttacacaccaaggcggagagcttctt

SEQ ID NO: 5615 - DNA, 626 bp, Bacillus clausii
gggttgttccctattgcccccattgtgagacgtcgcttagctctcatgaagtcgctcaagggtataaacaagtaatggacttatcggcaacagtcaagtttccaataaagggcagagaaaatcactatttgcttggttggacaacaacgccgtggacactaccaggaaatgtcgcaattgccgttcatccagaacgagagtatgtgcaagcaagacaagggaacgacgtgtatatcgttgccgcagcacgtgcaaagaccgtacttggcaatcattttgatgtacagagacgcttattaggagaagaacttgttggaactgcctatgaagcgccctttgctgaaacggaaattgagaaaggccatcaagtcattgccgcaagttttgtgacagaagagagcggaacaggcttagtccatattgcccctggttacggcgaggaagattacaatgccgttttggaaaatggccttgacttttttcatgtcgtcgatgaaaaaggacgatgtaaacaagaatttgggccgctggcaggccagttcgtaaaagacgcagacgtagacatcattaaaatgctggccgccaatggactgttgcatgcaaaagaaaaatatgagcacagttat

SEQ ID NO: 5616 - DNA, 372 bp, Bacillus clausii
atgaaagtcgtgcataccaatgaagcgccggctgcaatcggcccttattcacaaggaattattgtaggaaatctattcttctcatctgggcaaattccacttacgcctgctggtgaactagttacaggcggagtagaagagcaaacccatcaagtgtttgcaaacgtaaaagcggtattggaagaagccggttcatcacttgaaaaagtggtaaaggcgaccgttttcatcaaagatatgaacgatttcccccgtattaatgaagtgtacggcagctatttccgtgaacataagccggctaggtcatgtgtggaagtagcgcggctgcctaaagatgtactaattgaagtcgaagtcattgcaaccatttaa

SEQ ID NO: 5617 - DNA, 336 bp, Bacillus clausii
gcaatcgattgtcattacgaaagggatcaataaacgcgaagccgtccttttggaaaacactgaggtggttgaatggttttttgaaagcaatgaccgcccccaaatggttggcagcgtctttttaggtaaagtcgaaagagtccttcctggcatggaggctgcttttgttgatattggcacaggcaagaacgggtttttgcaccgtgatgaacttctcgctttccatctggacccgagcgacttaacggaaaagcaaacaaaaagcatttcccagtttgtatcgccaggcgatacaattgccgtgcaagtgacaaaagaagggacgaacgagaaagg

SEQ ID NO: 5618 - DNA, 588 bp, Bacillus clausii
gcacgcaggattatttgcctgaggatgaaagcgtccgtgtttggctgcgcagtgtgctggaagacgtgtttcagcagtatggctgcaagccaatggaaacgccaatgattaattacacagacttgcttgcgtcaaaatacggcggcggggcagaaatcaaaaaagaaatgtatacgttgacagaccgcggcaagcgagcattggcactccgctatgatttaacgattccgtttgcaaaagttatggcgatgaatccggaaattcgcaagccgtttaaacgctatgagatcggcaaagtgtttcgcgatggcccgattaaagcagggcgtttccgtgagtttacccaatgcgatgttgacgtagccggcgtcgattctgcattggcagaagcagaactattagagatggcgaccgaagtgttccggcggatcgggctgaatattaacatccagtacaataatcgcaagctgttgacgggcttgttggacatttgcggagttagcaaagatcaacacagtgccgttatattgatactcgataaacgagaaaaaatcggtgataaacaagtgttgaccgaactaaaggaaa

SEQ ID NO: 5619 - DNA, 609 bp, Bacillus clausii
atgagcccaattggaagcgtcgattttgccaccgaccggcccactacaccgataatggcggaagggatagcggagctacaagagttagaagaagcgcttcgctacttaaacattgatagccaatgtacgtttaatccctttttagctagagcccttgaaatttatacaggcactgtatatgaattgttcctgacagagggaccgatccaatcaagtgttggcagcggcggtcgttatgaccaagccatcagcggtttaattggcgaagaacagcctatgccgacagttgggatctcgtttggcattgatgtcatttatacagctttaaagatggagggtcgtatcaaccaaaagccactactcgattactacgttattcctttgcaaaaacaaaaagaagcgcttgctgtcgcttcttcgttgcggaaacaaggctttcgtgtagacgtagaatttaaaaacaaaaaacttactaaagcgctggaaagagcaaacaaagaaaagattccatttgtgattcttattggagaagaggaagtggcttcgggccgttataaactcaaaaacatggagactggcaccgaacaatatgttcccttctctttttag

SEQ ID NO: 5620 - DNA, 966 bp, Bacillus clausii
  misc_feature (1)...(966): n = A,T,C or G
atgaggcacagtacagcccatgtgcttgcccaagcagtcaagcgattgtttccaggtgttaagttaggtgtcggagccgtcattgaggncggcttttactatgacatcgatgccgacgaatcgattacggcagaagacttgccacggatcgaaaaggaaatgaaaaaaatcattggcgaaaatttagagatcatacgcgaagaagtgagccgtgacgaagcgattgcccgttttaaagaaatcaatgatccttataaactagagttgattgaagcgattccagctggagaaacggtcacgatttacaaacaaggcgaattttttgatctgtgtcgtggcgtccatgtgccatcgacgaataaaatcaaggagtttaagttactgtccaccgcaggagcttactggcgcggcgacgcaaaaaacaaaatgttgcagcgtatttacggaacggcattttttaacaaagatgaactaaacgaacatttgcgtttgctcgaagaagcaaaagaacgggatcaccgcaaacttggcaaggaactcggcatttttgcgctttcacctaaagtaggacaaggcttgcctttatggctgccaaaaggagcaacaatccgccgtatcatcgagcgctacattgtcgataaagaggagcgccttggttatcagcatgtttatacgccgatccttgcttcctctgagctctacaaaacatctgggcactgggaccattatcaagacgatatgttcccgccgatggaaatggataatgaaacgcttgtgttacggccgatgaactgccctcatcatatgatggtatataagcaagacatgcgcagttaccggcaattgccgctaagaattgccgaacttggcatgatgcaccgttacgaaatgtcaggcgccggtatcaggactccagcgtgttcggggaatgacgttaaacgatgcccacattttctgccgccctga

SEQ ID NO: 5621 - DNA, 969 bp, Bacillus clausii
  misc_feature (1)...(969): n = A,T,C or G
aaaacggccactccctgaagatggaaatattgaaattgtcaccgcgggatcagacgaaggattagacatcatgaggcacagtacagcccatgtgcttgcccaagcagtcaagcgattgtttccaggtgttaagttaggtgtcggagccgtcattgaggncggcttttactatgacatcgatgccgacgaatcgattacggcagaagacttgccacggatcgaaaaggaaatgaaaaaaatcattggcgaaaatttagagatcatacgcgaagaagtgagccgtgacgaagcgattgcccgttttaaagaaatcaatgatccttataaactagagttgattgaagcgattccagctggagaaacggtcacgatttacaaacaaggcgaattttttgatctgtgtcgtggcgtccatgtgccatcgacgaataaaatcaaggagtttaagttactgtccaccgcaggagcttactggcgcggcgacgcaaaaaacaaaatgttgcagcgtatttacggaacggcattttttaacaaagatgaactaaacgaacatttgcgtttgctcgaagaagcaaaagaacgggatcaccgcaaacttggcaaggaactcggcatttttgcgctttcacctaaagtaggacaaggcttgcctttatggctgccaaaaggagcaacaatccgccgtatcatcgagcgctacattgtcgataaagaggagcgccttggttatcagcatgtttatacgccgatccttgcttcctctgagctctacaaaacatctgggcactgggaccattatcaagacgatatgttcccgccgatggaaatggataatgaaacgcttgtgttacggccgatgaactgccctcatcatatgatggtatataagcaagacatgcgcagttaccggcaattgccgctaagaattgccgaacttggcatgatgcaccgttacgaaatgtcaggcgc

SEQ ID NO: 5622 - DNA, 480 bp, Bacillus clausii
agaaaaaggcccaatcgaaataacgacatttaaaggcgagacacttgtagaagatttgcaaaaacgcgattttacgataaacgcactggcaatgacggaaacgagagaggtcattgacccttatggaggcagacaggatttacaaaaccgcctattacgttcgtatgatgcacagaagcgtttaagcgaagatcctttgcgaatgttgcgggcggcccggtttattagttcattaggctttgaggctgaccagcaattggtgaaggaaacaactgtccaaaaagcagcgttgcaacgctgcgctcttgaacgggtggcggctgaactggaaaaattgttaaaaggaatggagacagaggcggcgtttgcgtttttacaagagacaggcgccattcattgccttccaggcattcatattactgaaagacattagctgaactgaaacgactgccaaaacaacagtgggacagtggcgacaga

SEQ ID NO: 5623 - DNA, 543 bp, Bacillus clausii
atgtcgacgacgttgatgttgcgacgcaagcatcccctcatcaagttgccgacattttttctagaggtgtgcacattaaccgtgaacaccagacggtgcttgttccccggagaaaaaggcccaatcgaaataacgacatttaaaggcgagacacttgtagaagatttgcaaaaacgcgattttacgataaacgcactggcaatgacggaaacgagagaggtcattgacccttatggaggcagacaggatttacaaaaccgcctattacgttcgtatgatgcacagaagcgtttaagcgaagatcctttgcgaatgttgcgggcggcccggtttattagttcattaggctttgaggctgaccagcaattggtgaaggaaacaactgtccaaaaagcagcgttgcaacgctgcgctcttgaacgggtggcggctgaactggaaaaattgttaaaaggaatggagacagaggcggcgtttgcgtttttacaagagacaggcgccattcattgccttccaggcattcatattactgaaagacattag

SEQ ID NO: 5624 - DNA, 702 bp, Bacillus clausii
attttgtaagccttatggggcaaaagggttggcttggctcaaagttgatgacgaagggataaagggcccgattgccaaattctttaatgaagcacaaacggctgcattgcttgcggcaatggacgctgaagcaggcgatttgctctttttcggagcggataagaagcaagttgtgtttcatgcactgggcgcgctgcgcttaaagtttggaaaggactttcagctaattgacgaaaacgcgtttcacttcctctgggtaaccgattttccacttgtcgaatatgacgaacaagcaaaacggtttgttgcgctccatcatccgtttacacgcccgaaagcggaagacttggaccttatggaaacccatccagagcaagtgcgtgccgaagcatatgaccttgtcttaaacggctttgagcttggcggcggttcacagcgcatctatgaacgggaactgcaagaaaaaatgttcaagctccttggttttagttcagaagcggctaaagaagagtttggctttttacttgaagcatttgattatggaacgcctccacatggcggcattgccttaggtcttgaccgaatcgtcatgcttcttgcacgcaaaagcaatttacgtgaggtgattgcttttccaaaaacggcaagcgctagcgaccttctaaccgaagcgccaaacaaagtgagcgttgaacagctaat

SEQ ID NO: 5625 - DNA, 457 bp, Bacillus clausii
  misc_feature (1)...(457): n = A,T,C or G
gtgcgaatctatgaatacgcaaaggcaaataatgntcaaagcaaacaactaatcgaaagtttaaaatcaatgggtgtggaagtgtcgaatcatatgtcagcaattgatgaagaaacattaaacaaagcgaagcaagccgggaagcctgccgctgcaaaagggcatggatccactagtaaccaaaagcaaaatagccaaaataaaaaccaaaaccaacggccaaaccaagggcaaaagcaacgcccacaaaacaaccagcacaaccaagggcaaaagcagcgcccgcaaaacaatcagcaaaaccaatctcaaggccaaaccaaacgcccaagccaaggcagcaataaccaaagtggcgccgcaaaatcgcaagctgggaaaccaaaccaaaaccgtggcggcaatcgtcctggtggccaaggcccgtccaggcagcaacaaccgccgtccagggaat

SEQ ID NO: 5626 - DNA, 164 bp, Bacillus clausii
atgaaacgtacacatcattgtggccaacttgacaaaacactagcaggccaacaggtacaactaaaagggtgggtgcagcggcgccgtgatttaggccaggtggtttttttagatcttcgtgatcgctctggtatcgtccaagttgtgtgcagtccggaaagtca

SEQ ID NO: 5627 - DNA, 297 bp, Bacillus clausii
gcaaagcctcgatgcgtatttagttactctcggcgatgaagcgagccacctagggccggaactgttgcaacgtttgcgcgatggaggcattcgtgccgataaagactacttaggcaaaaaaatgaaagcacagcttaaagcggctgaccgttatcaagcgtcttatacaattattattggcgaagacgaaatggcgaagcaacaagcgctcgttaaacaaatggcaactggagaacaaacggtagtcgcctttaacgatttgacatcatttctacaagaacagatacgaggaggaaa

SEQ ID NO: 5628 - DNA, 321 bp, Bacillus clausii
atgtgcgacttgccagtaccgcaaagcctcgatgcgtatttagttactctcggcgatgaagcgagccacctagggccggaactgttgcaacgtttgcgcgatggaggcattcgtgccgataaagactacttaggcaaaaaaatgaaagcacagcttaaagcggctgaccgttatcaagcgtcttatacaattattattggcgaagacgaaatggcgaagcaacaagcgctcgttaaacaaatggcaactggagaacaaacggtagtcgcctttaacgatttgacatcatttctacaagaacagatacgaggaggaaactag

SEQ ID NO: 5629 - DNA, 2226 bp, Bacillus clausii
  misc_feature (1)...(2226): n = A,T,C or G
taaaatcaatgggtgtggaagtgtcgaatcatatgtcagcaattgatgaagaaacattaaacaaagcgaagcaagccgggaagcctgccgctgcaaaagggcatggatccactagtaaccaaaagcaaaatagccaaaataaaaaccaaaaccaacggccaaaccaagggcaaaagcaacgcccacaaaacaaccagcacaaccaagggcaaaagcagcgcccgcaaaacaatcagcaaaaccaatctcaaggccaaaccaaacgcccaagccaaggcagcaataaccaaagtggcgccgcaaaatcgcaagctgggaaaccaaaccaaaaccgtggcggcaatcgtcctggtggccaaggccgtccaggcagcaacaaccgccgtccagggaataaccaaaatcgccgcaaccacggcaaccgtggcggaaagcgtcgcccacagtcaaaagtcaatcatcagcaaatgccgctgcctgaaaaaattacaatttcaggttcgcttacggtcagcgaactcgccgctaagctccatcgtgaagcctctgaattgattaagaaattaattggtcttggtgtcatggctaccattaaccaggagctcgacaaagatacgattgaattgttggcagctgattatggtgtggaagttgaagaagaagtgattgtggatgagctcgatattgagttgtatgatcgtgaagataaagaggaagaattaaaagagcgcccgccagttgtgacaattatgggccatgtcgatcacggaaaaacaacgctgcttgattcaatccgtaacacgaaagtgactgcgggggaagcagggggcattactcagcatatcggcgcttaccaaattgaacactcaggtaaaaaaattacctttttagatacaccaggtcacgcagcctttacaacgatgcgggcccgtggcgcgcaagtgacggacattacgattcttgttgtggctgctgacgatggcgttatgccgcaaacgaaagaagcgatcagccacgcgaaagcggctgaagtgccgattattgtcgctgtcaataaaattgacaaggaaacagcaagtccagatcgagtgatgcaagagttaacggagtttgagcttgtcccagaagcttggggaggcgacacgatttttgtcaatgtttcagctttgacgggtgaaggcattgatgagttaattgaaatgattttactcgttgctgaagttgaggaatttaaagccaacccagacaaacttgcgacgggcacagttgttgaagcacagcttgataaagggcgcggcccagttgccacacttcttgtccaaagcggtacgttgaatgtcggggacgcagtcgttgtcggcagcacctatggccgcgtgcgggcgcttgttaatgatgtaggacgccgcgtcaaaacggcaggaccgtctgcaccagtagaaattacaggcttaaacgaagtgccacaagctggggaccgtttccaagcatttgaagacgagaaaaaagcccgccaattaggcgaagggctaatggcccgttatcgggagcaaaacttaacggcatcgtcaaaagtaagcttggatgacttgtttaaccaaattcagcaaggggatgtcaaagacattaacgtcatcatcaaagccgacgtccaaggatcagttgaagcgatgaaagggtcgttggaaaaaattgatgtggcaggcgtaaaagtcaatatcatccacactggcgctggtgcgatcacggaatcagacattattttggcgtctgcttccaacgcgattgtcatcgggttcaacgttcgccctgatgtgaacgccaaacgtgtggctgaagcggaaaacgtcgatattcgtctccaccgtgtcatttacaacgcgattgacgaaattgaacaggcaatgaaaggcgcccttgatcctgagtttgaagaaaaagtcatcggccaagtggaagtacggacgacatttaaagtttcgaaagtcggcacgattcgccggttcttatgtaacnagaaggaaaaaatcacccgcaattcttctgtccgtttgattcgtgacggcattgtcatttatgaaggcgaactgaacgctcttaaacgctacaaagacgatgccaaagaagtgcaagctggctatgaatgcgggattacgcttgataagttcaatgacattaaagaaggcgacatgattgaagcgtatgtcatggaagaagtgaaacgcg

SEQ ID NO: 5630 - DNA, 2301 bp, Bacillus clausii
  misc_feature (1)...(2301): n = A,T,C or G
atgccaaaagtgcgaatctatgaatacgcaaaggcaaataatgntcaaagcaaacaactaatcgaaagtttaaaatcaatgggtgtggaagtgtcgaatcatatgtcagcaattgatgaagaaacattaaacaaagcgaagcaagccgggaagcctgccgctgcaaaagggcatggatccactagtaaccaaaagcaaaatagccaaaataaaaaccaaaaccaacggccaaaccaagggcaaaagcaacgcccacaaaacaaccagcacaaccaagggcaaaagcagcgcccgcaaaacaatcagcaaaaccaatctcaaggccaaaccaaacgcccaagccaaggcagcaataaccaaagtggcgccgcaaaatcgcaagctgggaaaccaaaccaaaaccgtggcggcaatcgtcctggtggccaaggccgtccaggcagcaacaaccgccgtccagggaataaccaaaatcgccgcaaccacggcaaccgtggcggaaagcgtcgcccacagtcaaaagtcaatcatcagcaaatgccgctgcctgaaaaaattacaatttcaggttcgcttacggtcagcgaactcgccgctaagctccatcgtgaagcctctgaattgattaagaaattaattggtcttggtgtcatggctaccattaaccaggagctcgacaaagatacgattgaattgttggcagctgattatggtgtggaagttgaagaagaagtgattgtggatgagctcgatattgagttgtatgatcgtgaagataaagaggaagaattaaaagagcgcccgccagttgtgacaattatgggccatgtcgatcacggaaaaacaacgctgcttgattcaatccgtaacacgaaagtgactgcgggggaagcagggggcattactcagcatatcggcgcttaccaaattgaacactcaggtaaaaaaattacctttttagatacaccaggtcacgcagcctttacaacgatgcgggcccgtggcgcgcaagtgacggacattacgattcttgttgtggctgctgacgatggcgttatgccgcaaacgaaagaagcgatcagccacgcgaaagcggctgaagtgccgattattgtcgctgtcaataaaattgacaaggaaacagcaagtccagatcgagtgatgcaagagttaacggagtttgagcttgtcccagaagcttggggaggcgacacgatttttgtcaatgtttcagctttgacgggtgaaggcattgatgagttaattgaaatgattttactcgttgctgaagttgaggaatttaaagccaacccagacaaacttgcgacgggcacagttgttgaagcacagcttgataaagggcgcggcccagttgccacacttcttgtccaaagcggtacgttgaatgtcggggacgcagtcgttgtcggcagcacctatggccgcgtgcgggcgcttgttaatgatgtaggacgccgcgtcaaaacggcaggaccgtctgcaccagtagaaattacaggcttaaacgaagtgccacaagctggggaccgtttccaagcatttgaagacgagaaaaaagcccgccaattaggcgaagggctaatggcccgttatcgggagcaaaacttaacggcatcgtcaaaagtaagcttggatgacttgtttaaccaaattcagcaaggggatgtcaaagacattaacgtcatcatcaaagccgacgtccaaggatcagttgaagcgatgaaagggtcgttggaaaaaattgatgtggcaggcgtaaaagtcaatatcatccacactggcgctggtgcgatcacggaatcagacattattttggcgtctgcttccaacgcgattgtcatcgggttcaacgttcgccctgatgtgaacgccaaacgtgtggctgaagcggaaaacgtcgatattcgtctccaccgtgtcatttacaacgcgattgacgaaattgaacaggcaatgaaaggcgcccttgatcctgagtttgaagaaaaagtcatcggccaagtggaagtacggacgacatttaaagtttcgaaagtcggcacgattcgccggttcttatgtaacnagaaggaaaaaatcacccgcaattcttctgtccgtttgattcgtgacggcattgtcatttatgaaggcgaactgaacgctcttaaacgctacaaagacgatgccaaagaagtgcaagctggctatgaatgcgggattacgcttgataagttcaatgacattaaagaaggcgacatgattgaagcgtatgtcatggaagaagtgaaacgcgcctaa

SEQ ID NO: 5631 - DNA, 195 bp, Bacillus clausii
gtggcgaataaccgtgctgttcgcgtcggcgaacaaatgaaaaaagaattgagtgacatccttattcgcgacattaaagatccccgtgtccgttttgtcacggtgaccggggtagatgtcacaggggatttacaacaagcaacggcttttattacggtgctcggtgatgatgaagaacgcaaagcgacccttgct

SEQ ID NO: 5632 - DNA, 231 bp, Bacillus clausii
tcgtctgtgccggcgtatccgctgtttccatcggaacggtcaatgctgtccagtccttatgtggagttgatcttgttgttagctcaaaaggagagggtggctatcttgactgcgctgttcctgaagggcttgacgtacggacatatgaagatgtgcagctgttgttaaaagggatggaattgtcatttttgtcaatggctgacgcttatcaaacgtttattacggttgaaa

SEQ ID NO: 5633 - DNA, 274 bp, Bacillus clausii
atgttgaaaatggaccttcaatttttcgcatcgaaaaaaggggtaggtagcacaaagaacggccgtgactcccactcaaaacgccttggtgcaaaacgtgcagacgggcaagcggtaacgggcggttctatcctcgtgcgccaacgcggcacacgcgtatatcctggtgagaatgtcggcaaaggtggcgacgacacattgttcgctaaaattgacggcgttgtgaaatatgagcgtgtcggacgtgaccgcaaaaaagtaagtgtatacccag

SEQ ID NO: 5634 - DNA, 800 bp, Bacillus clausii
  misc_feature (1)...(800): n = A,T,C or G
ttgtcaactgttgcgtttcatacattaggttgtaaagtaaaccattacgagacggaagcgatttggcagctgtttaaacaagaaggctatgaaaaagtcgagtttgaacagactgcagacgtctatgtcattaatacatgtacggtcaccaatacaggtgacaaaaaaagcaggcaagtcattcgccgcgcgattcgcaaaaacccagacgctgttatttgcgtaactggctgttatgcgcaaacgtcccctgcggaagtgatggccattcctggggtcgatattgttgtcggtacgcaagaccgctcgaaaatgcttggttacatcgaccaatataaaaaagagcggcagccaatcaacgctgtcggcaatattatgaaatcaagggtatatgaagaattggatgtgccttcatttacagatcggacacgggcgtccttaaaaattcaagaaggctgcaacaatttctgcacattttgcattattccttgggcgcgagggttgatgcgttcccgtgatccgcaagaagtcgtgcgccaagcccagcaacttgttcatgctggctacaaagaaatcgtgttgactggcattcatactggcggctatggcgaagatttgaagggattatagccttgcccgtttgttatgaggnatttggaaaaggtagaggggctgaaacggcttcgtatttcgtcgattgaggcgaagccaattaaccgacgaggtcattgcggtgatcggcaaatcatagcaaagctggtccgccatatgcatattccgctccaatctggatcggatac

SEQ ID NO: 5635 - DNA, 228 bp, Bacillus clausii
cggtgttgctagcgaaagcgctgatgtgcttgttagcaacattctagcagaagtcattttgcagtttacggccgatgcttaccgtgttgtcaaacgaggcgggctctttttaacttctggaattatctctagcaaaagagaagctgtcgaaggggcattaaaggcagcaggttttacggttcaagaagtgaacgaattggacgactgggtagcgattgttgcgcaaaa

SEQ ID NO: 5636 - DNA, 272 bp, Bacillus clausii
atgttgaaaatggaccttcaatttttcgcatcgaaaaaaggggtaggtagcacaaagaacggccgtgactcccactcaaaacgccttggtgcaaaacgtgcagacgggcaagcggtaacgggcggttctatcctcgtgcgccaacgcggcacacgcgtatatcctggtgagaatgtcggcaaaggtggcgacgacacattgttcgctaaaattgacggcgttgtgaaatatgagcgtgtcggacgtgaccgcaaaaaagtaagtgtataccc

SEQ ID NO: 5637 - DNA, 231 bp, Bacillus clausii
catcgtctgtgccggcgtatccgctgtttccatcggaacggtcaatgctgtccagtccttatgtggagttgatcttgttgttagctcaaaaggagagggtggctatcttgactgcgctgttcctgaagggcttgacgtacggacatatgaagatgtgcagctgttgttaaaagggatggaattgtcatttttgtcaatggctgacgcttatcaaacgtttattacggttga

SEQ ID NO: 5638 - DNA, 253 bp, Bacillus clausii
atgaagtgggctgaatttcgcgtccatacgacgcaggaagcggtggagcctgtatcaaatattctccatgaattaggtgccgcaggcgtagcgattgaggatccccaggaccttgtgacagagtggagtgtaaagtatggggaggtgtatgagctctcccctgaggattacccatatgaaggtgtgatggttaaagcctattttccaatgggcgccacttttaaggaaacgattgctgaagtaagaagcgcgt

SEQ ID NO: 5639 - DNA, 278 bp, Bacillus clausii
atgtcgttttcacatcaggagattgaaaaaaaatggcaagcattttgggaagaaaacaaaacgtttaaaacagacgaacaagcagatgggccgcatttttatgcattagatatgttcccttacccatcgggggctggtcttcatgtcggccatccagagggatacacggcaactgatattttagcgcggatgaagcggatgcaaggctataacgttcttcatcctatgggttgggatgcttttggcttgccagctgagcagtacgctatagatacagg

SEQ ID NO: 5640 - DNA, 864 bp, Bacillus clausii
tgatttgctctttgcaagagctcggcgttgacaacaaactagtgcctaagggctatgttgacgggatttatgtattcccggaaacacaaagcgttgaacctggacaagatgcgttagcacttttcgagttaaacgatagtgtgctggaacttgatttaacaccgaatcgttctgattgcatgcatatgcttggcgttgcttatgagttggctgccctttatgatcggccaataaaaatgccgaaaactaaagtgaaggaagtcattgaatctgctgacggttatatcgatgtcagcgttgaaaatggcgaagacacaccgttttatcaagcccttgtaataaaagatgttaaaatcggaccatcgccttcatggctgcaaaaccggctaatggcagcaggtatccgtcctatcagcaacgttgttgatgtcaccaactacgtgcttctcgaatatgggcaaccattgcatgcgtttgactaccatgcccttggctcgaaatcaatccatgtgcgtcgtgcaaatgcagaagaggcgtttactacactagatggggagaagcggacactatcgcctgaacagttagtagtcacaaatgggcgcgaaccagtcgcgcttgccggtgtaatgggcggccttcattcagaggtgacagcggcaacaacgacgatcgtattagaggctgcggccttccatccgacagtggttagacgctcggctcgtcttgccggtttacgcagtgattctagcgctcgatttgaaaaaggcattaaccaggaacgggtgtcagaggcagcacgccgagctgcttacttaatccaagaaatagctggagggatcgtgttaagcggagctgccattgcgg

SEQ ID NO: 5641 - DNA, 555 bp, Bacillus clausii
  misc_feature (1)...(555): n = A,T,C or G
ataaagaagagcctgtctaccatttgttgtataaaccgactggcgtcgtgtcaacatcaaatgacgagaaaggacggaaagtcgtcacagattttattgaaagcgaacaaagaatttatccgattggccggttggattatgacacatctggtttgcttttgcttacgaatgatggagagtttgcccatctgctcatgcatccccgttataaaattgaaaaagagtacattgccaaagtgaaaggaatccctgaacgaaaacggatcaaagaacttgaaaccggcattgtattagaagatggcaagactgccccggcaaaagcaaaagtcctgtcgattgacaagaaaaagcaaacagcaggtgtgcngctcattatccatgaaggcaaaaaccgncaagtncgccggatgtttgaagcaataggccatcctgttgtaaagttaaagcgcgagcgctacgggttttttaacgcttggccatttacatncaggccgaatcaangccgttnaagccgattgaagtcaaacaattaaagggaactggctgtcaccgaaa

SEQ ID NO: 5642 - DNA, 369 bp, Bacillus clausii
tttgccgttgccgaaaaagcgaaaacagctagtggcagctggaataaaggcgtttgaatatcgacaaacacaacagcgctggagcgactggcaactgtacatttccggtttggcgatcgctatgcaaattgaggcaattcgtgctgggcgccaattgccgagcattcagaaagaagaattggctgaacagtggtctgccttgccgatcaaagcgaaaagcgatttggcgattacaggccgtgatttgcttcatgcaaaagctgtaccaggcccatggattaaggaggcgctacaagcggcagaaaaggccgttgtgacaaaaaagtgcccgaatgaaaaggctgcgattttggcatttttaacgacgag

SEQ ID NO: 5643 - DNA, 240 bp, Bacillus clausii
aaaaaggcccaatcgaaataacgacatttaaaggcgagacacttgtagaagatttgcaaaaacgcgattttacgataaacgcactggcaatgacggaaacgagagaggtcattgacccttatggaggcagacaggatttacaaaaccgcctattacgttcgtatgatgcacagaagcgtttaagcgaagatcctttgcgaatgttgcgggcggcccggtttattagttcattaggctttg

SEQ ID NO: 5644 - DNA, 948 bp, Bacillus clausii
  misc_feature (1)...(948): n = A,T,C or G
gtttgggttaattaataaaacgccatggttggtcctttgtaaaaaggcgccttgcccagggnaagaagttgtcgcntgaagtgacaaaggcagggcgctctttttcagaagcgaaaataaagaaaatccgcaagcgatcaaatgaccgtgttaaagcgccgtgccccatctatgaagagtgcggcggctgccatcttcaacatatgaattatgaggcgacattggaaggcaagaaggacatcgtgcgccaagcgtttgtccgctacacaaatgtgccagaatcaaagctgccgctaaaaaatacgataggcatggacaacccttggtattaccgcaataaaagccagctgcaaacgcgcaagcaaaaagacggcagagtggcagcagggctgtatcgggaaaatagccatgatttaattgatttgtccgcttgcatggtgcagcataagcagctgaaccgggtggcacaaattgttaagcagctgctcggagatttgcaaattcctatttataatgagaaaacgcatagcggtgacattcggacgattgtgactcgaattggctttgaaacaaagcaaatccaacttgtgtttattacaagaaccgaagcactcccgaaaaaagagctgcttattaaacaagtgcgggaaaaactgcctgaagtgacgtccgttatgcaaaacgtcaaccatgagaaaacatcgcttatattcggcgagaaaatcgttcatttgtacggtgaaaaaacgatccatgagcgtcttggagaatacagctttgacctatcggcacgcgcctttttccaattaaacccgagccaaacggttaaattgtacaatgaagcgaaaaaggcggcctatttaacgggaaaagaaaagctcgttgacgcctattgtggtgtcggtacaattggccaatggcttggcgatcaagctgaagaagtccgtg

SEQ ID NO: 5645 - DNA, 367 bp, Bacillus clausii
gtggattataaacaaacattactaatgccgaaaacggcgtttccgatgcgtggcaacttgccaaatagcgaaccgaaacgccaagaacaatgggaagagatggacatttataaacaagtgcaagaacgcacaaaaggccgtccttactatgttttgcatgatggccctccatatgcaaacggcgatattcatatggggcacgcacttaacaaaatcattaaagactttatcgtccggtacaaatccatgtctgggttccatgccccatatgttcctgggtgggatacccatggcttgccgattgaaacggccttaacgaaaaacaaaaaagtagaccgaaagtcaatgagcattgccgattttcgca

SEQ ID NO: 5646 - DNA, 342 bp, Bacillus clausii
  misc_feature (1)...(342): n = A,T,C or G
atcttagcatcttcctagaaaaaatgaacaataanagcagtactcatattggcttttgtggggaagatangggagaaatatacgatcatttaatgaatgatttttctgatttggaattgaaagattcatttttggttgcttataatcactctcgtatagttggtgcaatcggtttggatatggacttaaaaagaggatgtgcggacgtatgggggccgtttgttgagggggaagatatcgacatggctcaagaattgtgggaaacgattgcttcgaaaacacctcctatgataaagacattttctttctttttgaatgaggataaccactttgggaaaagag

SEQ ID NO: 5647 - DNA, 705 bp, Bacillus clausii
  misc_feature (1)...(705): n = A,T,C or G
gttgcgntaacttggatgcgcaatcagggcgttggaccngcaaacagaaacagtatggcgtcaaagcggacgacatacggggtgccgcgtattgtattcatcaacaaaatggacaaaaccggtgccgatttcatgtattctgtaagtactttgcgtgaccgtttgcaggccaatgcacatcccaatccagttgccgatcggcgctgaagacgattttgtcggctttgtcgatttgatcgaaatgcaagcgcatatttcgaaagacgacttaggacaagattgggaagttactgaagttcctgctgactataaagacgaagcggaaagccttcgtgaatcgttggttgaagctgtagcagaattagacgaagagctcatgatgaagtatctagaaggcgaagaattaacaaaagacgaactaaaagcggctatccgcaaaggaacttgtaatgttgagttctacccagtcgtttgtggtactgcctttaagaacaaaggggttcaagcgcttcttgacgcagtgcttgactacttgccatcaccgcttgacgtcgcagcaatccgcggccaagtccctggaacagatgaagaagtaacgcgtgagcctggcgacgaccaaccgtttgccgcattggcttttaaagtaatgacggatccgtttgtagggaaacttacattcttccgtgtttactcaggtacgcttaa

SEQ ID NO: 5648 - DNA, 258 bp, Bacillus clausii
atgagaatgatgtcttatgaaaaagtggagcaggcaaaagatccgattatcggtaagaaacagacacaaaaagctttacacgctcgtttagtcagtgaattgtacgtggcaaaagacgctgacccacgagttgtggcagacgtacttgaagccgcgaaagatacagatgcgacggtcgtgtatgtcgactcaatgaaacggctaggaaaagcttgcggaattgatgttggcgctgctgctgtagcgttaaggaagtaa

SEQ ID NO: 5649 - DNA, 420 bp, Bacillus clausii
atgcctactattaaccagttaatccgcaaaggccgtgtagacaaagtgaaaaagtctgactcgcctgcgttgaacaaagggtacaacagtttcaagaagtcacaaacggatgtgtcttctccgcaaaaacgcggtgtttgtactcgtgtcgacacaatgacgccgaagaaaccgaactcggctcttcgtaaatatgcgcgtgtgcgtttgacaaaccaaattgaggttactgcatacatcccaggcattggccataacttgcaagagcacagtgttgtgcttatccgcggtggccgtgtaaaagacttgccaggggtacgctaccacatcgtgcgtggcgctcttgacactgctggtgttcaaaaccgtatgcaaggccgttcaaaatacggtacaaaaaagccaaaagataagaaataa

SEQ ID NO: 5650 - DNA, 469 bp, Bacillus clausii
atgcctcgtaaaggtccagttgcacgtcgtgacgtattgcctgatccaatatacaattctaaacttgttacccgcctcattaaccgcatcatggttgacgggaagcgtggaacagcacaaacgattctttataatgcgtttgaactagtaaaagagcgtagcggtaacgatccaatggaagtatttgatcaagcgttgaaaaacattatgcctgtccttgaagtaaaagctcgccgtgtcggcggttctaactatcaagtgccaattgaagtaaaaccagagcgtcgtacgactctaggtttgcgttggttggtcaattatgcgcgtcttcgtggagaaaagacaatggaagagcgtctcgctaacgaaattcttgatgcagccaacaatgctggcgcagctgtcaagaagcgcgaagacacgcacaaaatggcagaagcgaacaaagcgtttgctcattatcgttggt

SEQ ID NO: 5651 - DNA, 136 bp, Bacillus clausii
atggcaagagaattctccttaaaagatacgcgtaatatcggcatcatggctcacatcgatgccggtaaaacgacgacaacagaacgtattttgttctacacaggtcgtgtgcacaagattggtgaaacacacgaaa

SEQ ID NO: 5652 - DNA, 705 bp, Bacillus clausii
  misc_feature (1)...(705): n = A,T,C or G
tgcgntaacttggatgcgcaatcagggcgttggaccngcaaacagaaacagtatggcgtcaaagcggacgacatacggggtgccgcgtattgtattcatcaacaaaatggacaaaaccggtgccgatttcatgtattctgtaagtactttgcgtgaccgtttgcaggccaatgcacatcccaatccagttgccgatcggcgctgaagacgattttgtcggctttgtcgatttgatcgaaatgcaagcgcatatttcgaaagacgacttaggacaagattgggaagttactgaagttcctgctgactataaagacgaagcggaaagccttcgtgaatcgttggttgaagctgtagcagaattagacgaagagctcatgatgaagtatctagaaggcgaagaattaacaaaagacgaactaaaagcggctatccgcaaaggaacttgtaatgttgagttctacccagtcgtttgtggtactgcctttaagaacaaaggggttcaagcgcttcttgacgcagtgcttgactacttgccatcaccgcttgacgtcgcagcaatccgcggccaagtccctggaacagatgaagaagtaacgcgtgagcctggcgacgaccaaccgtttgccgcattggcttttaaagtaatgacggatccgtttgtagggaaacttacattcttccgtgtttactcaggtacgcttaatc

SEQ ID NO: 5653 - DNA, 210 bp, Bacillus clausii
ccagctggattttcgaactcgccgctcaaacattcgctaccgaggatcgagacggcaagacacaattttgctacaccttaaacaacacggccatcgcttctccccgaatattgattccactgctggaaaatcaccagcaggaagatggttccattcggattcctcaagctttacagagatacatgcaagggctggaacgcctggagccct

SEQ ID NO: 5654 - DNA, 495 bp, Bacillus clausii
  misc_feature (1)...(495): n = A,T,C or G
ttatggaaaaggctggctacaaactgtcacgggagtattacattaatgacgcgggcaaccanatcgaaaacttggcngcctctttaaacgcccgctatttgcaagcgctcggagaagagaaaccaatgccagaagacggttaccacggccaagacattatcgatattgccaagcagcttgtcgacgaagttggcgatcantatcgccanatggatgaaaaagaccggtnggcatttatgcgtgaatacggcttgaaaaaagagcttgagaaanttanacnagacttaaacgcatnccgcgttgaattcgacaaatggttttctgagacgtctttgtatgaatcanggcaagtcnaacggggcttgcanntccttnaagatnaaaatnanacttaccaaaangaccgggcgacttggctacgctcnactgccttacgggcgatnactaaaaaccngggttgcttgttgaaaacaaggacggttccttattccttat

SEQ ID NO: 5655 - DNA, 871 bp, Bacillus clausii
atgaaaaaacaagcaccacctgtacaaaaaaacgaaacgctcaccgttacaatagaagatttgacccatgaaggagcaggcgtagcgaaagtaaacggctacgccctctttatccctcaggcacttcctggcgaaacagtcgacattaaagtggtgaaaacaaaagcgggctatggctatggacggttgctccaagtccaaacaaaaagcgagcatcgcgttgagccgccttgcccgattttctataaatgtggaggctgccaaatccaacatatggattacagcgcccaactagcttataagcaaaaacaagtaaaagatgtcatggaccgagtcgccaaacttcccaacgtacctgtccgccctgtcattggcatggacgatccatggcgctaccgcaataaatcgcaagtgccagtcgctttccaacaaggcgatctcgttgccggtttttatgcgaaacggagccactccatcgtagatatggatcaatgcatcatccaacataaagaaaatgacattgttgtgcagacagtcaaacagcttgccaaagagctgcgcatccccgcctaccaggaacaaagccatcaaggcgtattgcgccatattgtcgcccgttacggaaaaacgactgggcaagtcatggttgtactcgtcacaaaagaaaagaagctgcctcacaaagaagcgttcatttccggcattcgaaagcatgtgccaggcgtcgtatccatcgtccaaaacatcaacaacaaacggacaaatgtcatattcggccagcaaacagaagtgctctggggcgagcactatttgtatgatgaaataaacggtattcaatttgcaatctcagcccgctctttttaccaagtca

SEQ ID NO: 5656 - DNA, 1452 bp, Bacillus clausii
atgtcattatttgatcattcgttaacaaaactgcatgagttgcttgctgcaaaagaaatcaacgtctctgaccttgtcgatacttcttacaagcgtattgctgacgttgattcaaaagtaaaggcgtttttaacgcttgacgaagaacgggcgcgtggtctcgctaagaagcttgacgaagtagacgcaagcgaaaaaggcgtgttgtttggcatgccgattggcattaaagacaatattgtcacgaaaggcttgcggacaacgtgctcaagcaaaatcttagaaaacttcgatcccatttatgacgcgacggttgtgacgaaactccgtggagcagaaacagtcacgattgggaaaatcaacatggacgagtttgcgatgggctcttcgaatgaaaactcggcattccaagtgacgacaaacccgtggaataccgattatgtgccaggcggttcaagtggcggctccgctgcagcagtagccgcaggggaagtcccatttgctttaggatctgatacaggcggctcgattcgccaaccggctgcttattgcggcgttgtcggcttaaaacctacatatgggcgcgtgtcccgttatggccttgttgcttttgcctcttcccttgaccaaattgggccgattacacgcacggtcgaggacaacgcgtatttgcttgaggcgattgccggccactgcccgtctgattcgacatccgctgacttgccggttccgccatacagagagtcgcttacaggcgaaataaaagggcttcgcattgccgtaccgtcggagtacattggcgatggcgtatcggaagaaatgcgcaaagccgtgttcgatgcccttaacgtattggaaaaagaaggcgctgtttgggaagaagtttccctgccatactcgaaatacgctcttgcagcttattatgtcattgcgtcttcagaagcgtctgctaacttagcccgttttgatggcgttcgttatggctaccgcactgacaatgccgacaacttactcgatatgtacaagaatacacgggctgaaggcttcggtgatgaagtgaaacggcggatcatgctcgggacgtttgcccttagctcaggttattatgacgcctactataaaaaagcccagcaagtccgcacactgattaaaaaagactttgatgatgtctttgccaattatgacgtgatcattgggccaactgcgccaaccccagcgtttaaaattggcgccaaaaccgatgacccattaacgatgtacgccaatgacattttaacgataccagtcaatcttgccggtgtgccagcgctttcgctcccgtgcggtttcaaagacggcttgccgctcggcttgcaaatcatcggcaaacactttgacgaggcaacgatttaccgtgttgccgatgtctatgaaaaagcaacgaacttctctaaagagaaaccttcattgtaa

SEQ ID NO: 5657 - DNA, 147 bp, Bacillus clausii
  misc_feature (1)...(147): n = A,T,C or G
attttgaaacgattattggacttgaagtgcacgtggaactgaagacagactcaaaaatcttttcgtctagccccaaccattttggtgctgaaccgaatacaaacacgagtgtcattgatcttggctatcctggcgtattgccggtnn

SEQ ID NO: 5658 - DNA, 354 bp, Bacillus clausii
cgatgaaagcagcgatggccctcaattgccaaattgcgactgatacaaaatttgaccgcaaaaattacttttatccagacaatccaaaggcatatcaaatttcgcaatttgacaagccgatcggcgaacatggctggatcgaaattgaagtcggcggcaagaagaagcgcattggtattacgcgccttcatttagaagaagatgccggcaagctgacgcatggcacagacgggcattctcttgtcgattataaccgccaaggcacgccgctagtggaaattgtctctgagccggatatccgtacgcctgaagaggcctatgcgtatttagaaaaactaaaagcgattattcaat

SEQ ID NO: 5659 - DNA, 882 bp, Bacillus clausii
taaaaatggaagaaggctctttacgatgcgatgccaatatttcattgcgcccaatcggccaagaagcattcggcacaaaaacagagttgaaaaacttaaactcgtttaattttgtccgcaaagggctagagtacgaagaaaaacgccaagaacaagtgcttctttcaggcggcgtgatcgaacaagaaacgcgccgttatgatgaagctggcaataaaacaattttaatgcgtgttaaagaaggctcggacgactatcgctatttccctgaaccagatcttgtcaatctgtacatagatgacaattggaaagagcgtgtccggtcggaaattcctgaacttccagatgcccgcaaagaccgctatgtaaacgaactcggcttgcctgcttatgatgcccatgtgcttacgctcccaaaagaaatgtccgatttctttgaggagacgattcgcgaaggcgctgacgccaaactggcttccaactggctgatgggtgaagtgctcgcctacttgaacgccgagcagaaagagctgcaagattcagcccttacgccagcagggcttgccggcatgattaagctgattacaactggaacgatttcttcaaaaatcgctaaaaaagtgtttaaagagttgatcgaaaatggcggcgaccctgaacaaattgttaaagacaaagggctcgtgcaaatttccgatgaaggcgaactacgcaaaatcgttgctgaagtgcttgatgccaatgcacaatcgattgaagactacaaaaatggaaaagaccgcgcgcttggcttccttgtcggccaaatgatgaaagcgacaaaaggaaaagccaatccgcaattggttaacaaactcttgcttgaagaaatggacaagcgct

SEQ ID NO: 5660 - DNA, 588 bp, Bacillus clausii
caatcgcgcaagtatgattggcacagggcagttgcctaaatttgaggaagatgtttttaaaattagcgaagaagattattttttgatcccgactgcagaagtgccggtcacgaacttgcatcgcggggaagtgctgcaaggagagcagctcccgattgcttataacgcctacagcacgaatttccgctctgaagctggttatgctggtcgcgatacacgggggctcattcgccaacaccaatttaacaaagtagagcttgttcgtttttcattgccggaggattccaacaaccagctcgaaatcatgacaacacacgctgaaaacgtgttgaagcgcttaggattgccttaccgggtcgttacgttgtgtacaggagatttgacctttgcctctacgaaaacgtacgatttggaagtatggatgccgagcgccaatacgtatcgtgaaatttcttcgtgctccaatattggtgacttccaagcaaggcgtgccaatatcaaattcagtcgcgatccaaaaagcaagcctgagtatgtccatacgctcaatggttcaggggtagcggttggccgtacggtagcggccat

SEQ ID NO: 5661 - DNA, 283 bp, Bacillus clausii
  misc_feature (1)...(283): n = A,T,C or G
ttgaataaagacattgcgacaccagcgcggacaaatgcaattttaaaaaagcacggatttacattaaagaaaagtttagggcaaaattttctcattgatttaaacatccttgcccagattgtggaagcaagtggtttcgatgaacaagacggcattgtccaaattggtccaggcatnagtgccttaaccggtctcactggccgaaaaaaagcagacaaagtggtcgcttttgaaattgacggccgtttaatcccggtgttggaagacactctttcngcttacc

SEQ ID NO: 5662 - DNA, 595 bp, Bacillus clausii
  misc_feature (1)...(595): n = A,T,C or G
atgcgccaagacggccgaaaacaaaatcnactaagagaggttgagatcattcctcattttacaaagcatgccgaagggtctgtactgatttctgttggcgatacaaaagtgatatgcacagcaagcattgaaaaccgcgtccccccgtttttacgtgggcaaaataaagggtggctagcggcggaatattcgatgctgccacgagcgacaggccagcgaacgattcgcgaagccgcaaaaggcaaattgagcgggcgaacaatggaaatccaacgcctgatcggccgggcactccgggcagttgtcgatttataaaagctcggtgaaaagacgatctggatcgactgcgacgttatccaagcagatggcggtactcggaccgcatcgattacaggtgcatatgtggcgcttgtgctcgcggttcaaaaagcgtttgctgaaaaaccaattagcgcttggccgattactgattttttagcacctatatctgtcggccttttgcctgaagaaggggcngtgtgtgatctgtgtnacagcgaggattcacaggcaaaggtccatatgaatatcgtccnaacaggttcaggcgattttg

SEQ ID NO: 5663 - DNA, 252 bp, Bacillus clausii
atgcggttggataaatttttaaaagtctcgcgcctgattaaaaggagaacgttagcgaaagaagttagtgaccaaggcagagtcacggtcaatggccaagtagcaaaagcggggacaacagtaaaagcaggagatgaactggcgattcggtttgggcaaaaagttgtcacggtaaaaataaacgatgtacgtgagacaacgcgaaaagaagaagctgctgaaatgtatacgattgttaaagaggagtctgta

SEQ ID NO: 5664 - DNA, 205 bp, Bacillus clausii
  misc_feature (1)...(205): n = A,T,C or G
atgtcgattcagctgccgcgggggacgcaagatattttgccagaanacncancaatttggcagtacattgaacaagttgctaaggaaacatgcgaaacataccattatcaagaaatccgtacaccgatctttgaacataccgaaattttttcaangggtgtnngcgatacnacngatattgttcaaaaagaaatgtatacctttt

SEQ ID NO: 5665 - DNA, 540 bp, Bacillus clausii
gtatctctgtaaatgaggtagctgcccatggcatcccaggcccgcgggtgctgaacgaaggggatgtcgttaatattgatgtgtcggcggagctgggcggatattatgctgacaccggggcaacgacagtggtaggatctcgttcgccgcacaaggaaaagctatgtcagagctcgcttcgtgcgctgcagcagggccttaagaaggccagggcgggtacgaagatcagtggcatcggacgggcgattcacaacgaggctcgcaaagatggcttcactgtaatccgcaatttggccgggcacggcattggccgcaagttgcatgagatgccagacggcattttgaattactatgatccacgagacaacaggttgctcacgaacggactggtgctcgcagtggaaacttttgtatcggacggagcggaatttgtatatgagggtgctgacggttgggggctgctgctgccggacaatcactacgctgcacagtttgagcacacgattgtcattaccaaagataagccgctgattttaacag

SEQ ID NO: 5666 - DNA, 732 bp, Bacillus clausii
catcgaatcagaacacgatctcatcgctctacagaagattggccgtattgtggcaatggcccgtgaagagatgttgtcctctgtccgggctggaattacgacggcagagcttgaccgcatcggcgaaagggtgctggatgagcatggagctgtctccgcgccttatattacctatggttttccgggaacaacttgtatctctgtaaatgaggtagctgcccatggcatcccaggcccgcgggtgctgaaggaaggggatgtcgttaatattgatgtgtcggcggagctgggcggatattatgctgacaccggggcaacgacagtggtaggatctcgttcgccgcacaaggaaaagctatgtcagagctcgcttcgtgcgctgcagcagggccttaagaaggccagggcgggtacgaagatcagtggcatcggacgggcgattcacaacgaggctcgcaaagatggcttcactgtaatccgcaatttggccgggcacggcattggccgcaagttgcatgagatgccagacggcattttgaattactatgatccacgagacaacaggttgctcacgaacggactggtgctcgcagtggaaacttttgtatcggacggagcggaatttgtagatgagggtgctgacggttgggggctgctgctgccggacaatcactacgctgcacagtttgagcacacgattgtcattaccaaagataagccgctgattttaac

SEQ ID NO: 5667 - DNA, 708 bp, Bacillus clausii
gtgggctgaatttcgcgtccatacgacgcaggaagcggtggagcctgtatcaaatattctccatgaattaggtgccgcaggcgtagcgattgaggatccccaggaccttgtgacagagtggagtgtaaagtatggggaggtgtatgagctctcccctgaggattacccatatgaaggtgtgatggttaaagcctattttccaatgggcgccacttttaaggaaacgattgctgaagtaagaaggcgcgtgcataatctcgtttcctttcaaattgacattggccacgggacaatggattatacagaagtaaaagaagaagactgggcaacggcatggaagagcttttaccaccccgttcaagtaacggagcaagtcacaattgtgccgacatgggaagagtatagcgctcgtccaggggaaatcgtcatcgaattagatccagggatggcgtttggcactggaacacatccaacgacgattctgtcgcttcaagctcttgagcatgcggtcaagcaaggggatgcggtcatcgatgttggcacgggttctggcatacttgcgattgctgcatggaagttcggcgccgaggcgattacagcgttggacttggatgaggtagctgtgaatagcgcgaaggcgaatgtggccttaaacggcgctagtgactttgtcgatgtgcagcaaggcaatctcctaaacggtgttgc

SEQ ID NO: 5668 - DNA, 336 bp, Bacillus clausii
gggatgcttatttcaagcgagtgagtatattcaaatgttacaaataaaacataaagcagttgaaatgcataacaaagcttttgaacaagtagacgttattttgacgccaaccttaccaatggtaccaactaatattgatcagagaatgacagattcttatggattacaggaacatgtccgaattttcgcgcgtttaactggtccaagtaatacgactgggctgccagctatttctgttccaggagggatgtcacaatgtggattgccgattggcgtacaatttattggaaaagcctttgctgaaaaagagctttatcggtttgcttatgcgctaga

SEQ ID NO: 5669 - DNA, 147 bp, Bacillus clausii
ttggccgcccaatcgatcgccgcgtgacagtaaatacgcttggtttgcgtaaattgcaccaaacggtcgtacaagaagataatgcagcgatccgcggaatggtaaacaaagttaaacatttgattactgttaatgaaatcgatgcgt

SEQ ID NO: 5670 - DNA, 440 bp, Bacillus clausii
atgaaacttcacgaactacaaccagcagaaggttcacgcaaagtccgcaatcgtgtaggtcgcggtatcggttctggcaacggaaaaacggcaggcaaaggccacaaaggacaaaaagcccgttcaggcggcggcgttcgtcctggatttgaaggtgggcaaaacccactttatcgccgtttgccaaaacgtggatttacgaacattcaccgtaaagagtacacagttgtgaacctagacgtgctgaatcgttttgaagcgggcacagaagtgactccagaacttcttattgaaacaaaaacggtaaaaaacgttaagcacggcattaaagttcttggcaatggcaatctagacaaaaacttgactgtaaaagctcataagttctctgcatctgcagtaaaagcaattgaggctgctggcggaaaaaccgaggtggttta

SEQ ID NO: 5671 - DNA, 379 bp, Bacillus clausii
  misc_feature (1)...(379): n = A,T,C or G
atgaaacttcacgaactacaaccagcagaaggttcacgcaaagtccgcaatcgtgtaggtcgcggtatcggttctggcaacggaaaaacggcaggcaaaggccacaaaggacaaaaagcccgttcaggcggcggcgttcgtcctggatttgaaggtgggcaaaacccactttatcgccgtttgccaaaacgtggatttacgaacattcaccgtaaagagtacacagttgtgaacctagacgtgctgaatcgttttgaagcgggcacagaagtgactccagaacttcttattgaaacaaaaacggtaaaaaacgttaagcacggcattaaagttcttggcaatggcaatctagacaaaaacnttgactgtaaaagctcat

SEQ ID NO: 5672 - DNA, 558 bp, Bacillus clausii
aggattatttgcctgaggatgaaagcgtccgtgtttggctgcgcagtgtgctggaagacgtgtttcagcagtatggctgcaagccaatggaaacgccaatgattaattacacagacttgcttgcgtcaaaatacggcggcggggcagaaatcaaaaaagaaatgtatacgttgacagaccgcggcaagcgagcattggcactccgctatgatttaacgattccctttgcaaaagttatggcgatgaatccggaaattcgcaagccgtttaaacgctatgagatcggcaaagtgtttcgcgatggcccgattaaagcagggcgtttccgtgagtttacccaatgcgatgttgacgtagccggcgtcgattctgcattggcagaagcagaactattagagatggcgaccgaagtgttccggcggatcgggctgaatattaacatccagtacaataatcgcaagctgttgacgggcttgttggacatttgcggagttagcaaagatcaacacagtgccgttatattgatactcgataaacgagaaaaaatcggtgataaca

SEQ ID NO: 5673 - DNA, 276 bp, Bacillus clausii
atgggccgtagtttgaaaaaaggacctttcgttgatggtcatctcatgaaaaaagtagaagcattaaacgcaacgaatgacaagaaagtcgtgaagacttggtctcgtcgttcaacgattttccctgaatttatcggccacacgtttgctgtctatgatggccgcaagcatgtaccggtttacgtttctgaagatatggttggtcacaaacttggcgaatttgcccctactcgtacgtacaaagggcatgccgctgataagaaaacaagacgctaa

SEQ ID NO: 5674 - DNA, 336 bp, Bacillus clausii
  misc_feature (1)...(336): n = A,T,C or G
aagctaaagctgttgcgaagcaagtccgcataacgcctcgcaaagtccgtcttgtgatcgatcttattcgtggtaagcaagtcggtgaaaccatcgctattttaaaacacacgcctaaagctgcttctccagtagttgaaaagcttttaaattcggcaattgcgaacgctgagcacaactatgaaatggagccaaacaatctcgtaatatctgaagcgtacgtgaactaaggcgtnacgctgaaacgtttccgccctcgcgcacaaggccgcgctagccggatcaatnaacgcacaagccatattacattggttgtaacagaaaagaaggagggat

SEQ ID NO: 5675 - DNA, 141 bp, Bacillus clausii
aatactcaaagaaatttaaagcgcatgatgaacaaaacactgcaaaagtaggcgacattgtccgcattatggaaacacgcccgctttcaaaagataaacgtttccgtttagtagagatcgtcgaagaagcgatcatcattt

SEQ ID NO: 5676 - DNA, 286 bp, Bacillus clausii
  misc_feature (1)...(286): n = A,T,C or G
atgatccaacaagaaagccgcttaaaagtcgccgacaactctggggcccgtgaagtgctctgcattaaagtgctaggtggctctgggcgtaagatagcgaacattggcgatgtcattgtttgttcggtaaaagaagcaacaccagggggcgttgtccagaaaggcgacgttgtaaaagctgtaattgttcgttcaaaaagtggtgtacgccgcaatnatggttcttacatcaaatttgacgaaaacgcagcagtcattgtccgtgacgacaaaagcccgcgcggga

SEQ ID NO: 5677 - DNA, 294 bp, Bacillus clausii
  misc_feature (1)...(294): n = A,T,C or G
aaaaaggcgacaaagtcgttgtcattacaggcaaagacaaagggaagcaagggacggtactagaagcttacccgaaaaaaacccgtgtgctcgttgaaggtgtaaacatggtgaaaaaacacgccaagccgtcgcaagacaatccacaaggcggaattctaaaccaagaagcaccgatccactcttccaatgtcatgcttgttgatccaaagacaggtgnacgcanttgagtgggctacaaaggaggaaacggcnaaaaagtacgcgttgcnaaaaaatttggcgnaatcattc

SEQ ID NO: 5678 - DNA, 242 bp, Bacillus clausii
  misc_feature (1)...(242): n = A,T,C or G
aaacggaattgnttcttctcttaacagggaagtttaattacccatcagtaatggctgtgccaaagattgaaaaaatcgttgtcaacatgggcattggcgatgccgttcaaaatgcgaaagtgctcgacaaagcggttgaagaactgcaagcgatcactggtcaaaagcctgtcattacgaaagcaaaaaaatcgattgccggctttaaactccgtgaaggaatgccaatcgaggcaaaagta

SEQ ID NO: 5679 - DNA, 522 bp, Bacillus clausii
tgtttttttagatcttcgtgatcgttctggtatcgtccaagttgtgtgcagtccggaagtcagtgaagaagcgttgaaagcagctgaccgtgtccgcaatgagtaccttgtcgccgtttcaggcactgtggtggaacggaatgaacaggcagttaatgacaagctggcgactggcgctatcgaagttcacgttcgtgagctcgaaatcatgaatgtctcgaaatctttgccattccaaattgaagcagacacggatgcagctgaagacgtccgcttgaaataccgttatttggatttgcgtcgccctgatatgcaagaagcgttcgcgatgcgtcacaaaatcatgaaaagcgttcgtgattttcttgatgcagatggctatttggagattgagacgccgatgctcacaaaaagcacgccagaaggggcgcgcgattatttggtgccgagccgcgtccaccatggccagttttatgcgctgccacaatcaccgcaaattttcaagcaaggcttgatggtgtc

SEQ ID NO: 5680 - DNA, 282 bp, Bacillus clausii
gtatttcattccgtcgtgcagtgaaacaagcaattcaacgcactatgcgcgctggtgcaaaaggaattaaaacacaagtgtcaggccgccttggcggagcagacattgctcgtgctgagcactatagcgaaggaactgttccacttcacacgcttcgtgctgatattgactatggtacagctgaagctgatacaacatccggtaaaatcggcgtaaaaatctgggtttatcgtggtgaagttcttccaacgaaaggaacgaacaaagaggaaggaggcaact

SEQ ID NO: 5681 - DNA, 253 bp, Bacillus clausii
  misc_feature (1)...(253): n = A,T,C or G
atgttaatgcctaaacgtgtaaaataccgccgcgaacaccgcggaaaaatgggcggacgtgcaaaaggcggtacagaagtccacttgggcgagtttggcttgcaagntcttgaagcttcatggatnacaaaccgtcaaattgaggcagctngtattgngnngactcgttacatgaaangtggcggtaaagtatggantaaaattttccnttcaaagccatacacagcanagccgcttgaagttcgtatgggtt

SEQ ID NO: 5682 - DNA, 141 bp, Bacillus clausii
  misc_feature (1)...(141): n = A,T,C or G
gtnaaggggcacctgaaggatgggtcgccgttgtgaaaccaggtaagattatgttcgaaatttccggtgtatctgaagaagttgcccgcgaagcattacgtcttgcctctcacaaattaccgattaaatgtaagtttgtaa

SEQ ID NO: 5683 - DNA, 121 bp, Bacillus clausii
  misc_feature (1)...(121): n = A,T,C or G
atgaaagcaactgatctccgcgatttnaccactgctgaaattgaacaaaagacacaatctcttacagaagagttattcaatctacgctttcaactcgcaactggacaacttgacaacccat

SEQ ID NO: 5684 - DNA, 747 bp, Bacillus clausii
aaggagtgattacatgaacaaaaatataaaatattctcaaaactttttaacgagtgaaaaagtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaactgaatactcgtgtcactttaattcaccaagatattctacagtttcaattccctaacaaacagaggtataaaattgttgggagtattccttaccatttaagcacacaaattattaaaaaagtggtttttgaaagccatgcgtctgacatctatctgattgttgaagaaggattctacaagcgtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcagtttcatcaagcaatgaaacacgccaaagtaaacaatttaagtaccgttacttatgagcaagtattgtctatttttaatagttatctattatttaacgggaggaa

SEQ ID NO: 5685 - DNA, 756 bp, Bacillus clausii
  misc_feature (1)...(756): n = A,T,C or G
atgagtgcgcccatcacaacgtttcgggcaaacgattcaattgatcccgcttgtgcccacnttgcttataatcaggtcggcgtctcccctgttgttggcgacaacaacgaaccgattggcattgtgactcgaacagacatcgtccgtttgctttacccgaataagcatgccgttgcccnttctgagctcgcgtcttattttggtaagcaaacattttcctttttgcaaaagattggcgctttcgccgacgaactccaagtacctgtctatttagttggcggccttgtgcgcgactttttgttgaagcgcccacacaaagatattgacttggtcattgaaggggatggaattgcctttgctaagcagctggcaaccgcatttggggggagcgtgcgcagccatgagtcgtttggcactgctacgtgggtcaacgaacaagaaatggacattgtgatgtgtagaaaagagttttatttgcaaaaaggggcattgcttaccgtccgcccggattngattttacgaagacatagcaaggcgggatttctctataaatgcgatggcgatccaaatcaatcgatcctcgttcgggaacgtgctcgatgtgtttcagggaaaacaagcgcttatcgacaaacacattcgcattctccatccactcagtttcatagaagacccgaccaggcttttccgcgctgtccgttttggcctgcgcctaaacttcagcctctccttcgagacactgcaccaagcaactaa

SEQ ID NO: 5686 - DNA, 273 bp, Bacillus clausii
tagcgtgagtgaaaaaacgttttatattacgacaccaatttattacccaagcggcaagctccatattgggcacacatatacgaccgtggctggtgatgcaatggcacgctacaaacggttacgcggctatgatgtccgctatttgacagggacagatgaacatggccaaaaaattgagcagaaggcgaacgaaaaaggaatttctccactcgaatacacggatgaaatggtaaaaccgattaaagagttatggaagaaacttgacatttcaca

SEQ ID NO: 5687 - DNA, 141 bp, Bacillus clausii; identical to SEQ ID NO: 5675

SEQ ID NO: 5688 - DNA, 286 bp, Bacillus clausii; identical to SEQ ID NO: 5676
  misc_feature (1)...(286): n = A,T,C or G

SEQ ID NO: 5689 - DNA, 261 bp, Bacillus clausii
ttacattcaatacgcacatgcacgggtatgcagcattcttcgccaaggagaagagctaggcgtctcttatagtgcaaacacggatttgtcgccgattgcaagcgacaaagaatacgagttgctaaaagcaattggcgagcctcctagtgctgttgcagaagctgcaacaaagcaaattccacagcgcatcgccaattatgcctatgatttggcgcaagctctccatagtttttataatgtgacgcgcgtccttgatacaga

SEQ ID NO: 5690 - DNA, 519 bp, Bacillus clausii
ctctttgtatgaatcagggcaagtcaagcggggcttgcaagtccttaaagataaaaatgaaacttacgaaaaggacggggcgacttggctacgctcaactgcttacggcgatgacaaagaccgggtgcttgtgaaacaagacggtacgtatacgtatttaacgcctgacatttcgtaccatcttgataaatttgaccgtgggtatgaccgtttaattgatgtgctaggtgccgaccatcacggatacattccaagaatgcgggcggcgattaaggcgcttgggtttatgatcccggatcggtttaacgtaacagattatcccaaattgggtaagcctgttcccaaggcggcgaaaaaagttaaaatgagcaagcgcacggggcaaagcggtgacgttgcgttgaattgatggaagaggttggcgttgatgcgacgcggtatttttttgcgatgcgtagccccagatactcatcttgatttcgatatggactttagctgtgtcaaagtcaaatgaaaacc

SEQ ID NO: 5691 - DNA, 609 bp, Bacillus clausii
  misc_feature (1)...(609): n = A,T,C or G
gcagtggtagcgctccccacggcgttgcctggaaggccaagcctatcctggaacatgcaaaaggctgaccgcggcgnagcgagctgccaaagcgggccaaaaagacgccttcattacgctttgccgtagacaaatggcccactgctgaaaaaatggacttagaaatggagaagctgctccgccgcggcggcgattttgtcgttcagcgtgcggacggcatcataagctatcaacttgctgttgttgtcgacgatgcgttaatgggcattacggatgtcctccgtggccaagatttatacgactccacaccaagacagctattgctttatgccgcgctcggatataccgctccccggtttgcacatgtgccattgctttatggtccggatgggcggcggctggccaaacggcatcgtgatttgtcattggcagcgatccgcgcaaatgggtgccggccagaggacattgttggtctactagcagcgttaagcggtttaattgagcgccaagaaccactgaccgcagcggaattaattccagagtttcggctagaaaagctgacgacagagccaattttattggacacgcatatgctgcaactgctcaact

SEQ ID NO: 5692 - DNA, 196 bp, Bacillus clausii
ttgtggcgaataaccgtgctgttcgcgtcggcgaacaaatgaaaaaagaattgagtgacatccttattcgcgacattaaagatccccgtgtccgttttgtcacggtgaccggggtagatgtcacaggggatttacaacaagcaacggcttttattacggtgctcggtgatgatgaagaacgcaaagcgacccttgc

SEQ ID NO: 5693 - DNA, 164 bp, Bacillus clausii
gacggcattgtcatttatgaaggcgaactgaacgctcttaaacgctacaaagacgatgccaaagaagtgcaagctggctatgaatgcgggattacgcttgataagttcaatgacattaaagaaggcgacatgattgaagcgtatgtcatggaagaagtgaaacg

SEQ ID NO: 5694 - DNA, 663 bp, Bacillus clausii
  misc_feature (1)...(663): n = A,T,C or G
gttatggggatacgagcaagtacaaacgccgacgctagaatattatgaaacagtcgggaaagcgtctgctatttcagataagcngttattcaaattaatagattttnatggaaatacgctcgttttgcgccctgatatgacggcgccaattgctcggctcgtttcttcaagtatgaaagacatcccttatccacttaggctatcgtactgttcaagcctttatcgagctttgcaaacggaaggcgggcgtcctgccgaatttgcacaagttggtgttgagcttgttggtgatcataccgctagcgctgacggggaaatgttgctgttgttgaacagagcccttattcaagcaggtcttgaccattttcaagttgccgtcggacatatcggttttttaaatgcgttatttttagaaattgttggcaccgaagaacgggccgagctgttgcggaggcaactctatgaaaagaacgatgttggtttcaaagagcaagtaaaggcatttgggctatcgtcgattgatgaaaagaagctgttaaaactaagccggttgcgcggcaatgaagcgattcttgctgaagcggaggagctaaccgaatcaccagaaggcaaacaggctgtggcagagctgcgagacctttggcaaggtctgaaagaaggagg

SEQ ID NO: 5695 - DNA, 567 bp, Bacillus clausii
ggtatcaggactccagcgtgttcggggaatgacgttaaacgatgcccacattttctgccgccctgaccaaattaaagatgaattcgttcgcgtcgtacgtcttatccaagaagtgtacaatgattttggcttaaacgactataaatttcggctgtcgtaccgtgatccagaagacaaggaaaaatatttcgatgatgatgacatgtggaacaaagcgcaagcgatgctcaaagaagcaatggatacgttagggtcgccatactatgaggcaattggtgaagctgctttttacgggccaaaattggatgtgcaagtgaaaacggcccttggcaaagaagagacgctctcgactgtgcagcttgattttctccttcctgagcgctttgatttaacctatgtcggcgaagacggaaagctgcaccgccccgttgtcgttcaccgtggcgttgtctcaacgatggaacgattcgttgctttcttgttagaagaatacaaaggcgcgctgccaacttggcttgcgcctgtccaagtgcaagtgattcctgtttctaatgaagtccacttgga

SEQ ID NO: 5696 - DNA, 252 bp, Bacillus clausii
ttaaccaatatagttatgtatcttgtgaattggaaacaggacgaacacaccaaatccgcgtccatttcaactatattggccatccattagcaggcgatccgaaatatgggccaaaaaaaacgcttccgatcaatggccaagctttgcacgcggaaactcttggctttacccatccacgaacaggggaacggctccgtttttcagcacctctcccagcagagatggaaaaattgctcgttgatttgcgaaatg

SEQ ID NO: 5697 - DNA, 549 bp, Bacillus clausii
caatcgcaccgtagcgatgatcaataaatactttaatggggaaatccctgcttacgtcaaaagtgcatcgccatttgacgaggacttgcttgaccttgtccaagcaacgattacaaaagtggaagacgcgatggaggaaatggagttctcgattgctttgacagcgatttggcaacttgttagccgtacgaacaaatacattgacgaaacgcagccgtggatgcttgcaaaagaagaagataagcgcgaacttcttggttcagtcatgtaccacttagccgagtcacttcggatcatttctgtgctaatccgcccattcatgacacgaacgccagcaaaaatatgggcacagctaggcattgacgagagtcttgccggctgggaatcgatgcgcgtgtttggccaactcccagctggtacaaaggttagcaaaggcgagcctgttttcccacgccttgatgtcgaaaaagaagtcgattatattgttgagcttatgggtggcaaggctgatccagaacctgaggaagtggaagatgaaaatgaaattac

SEQ ID NO: 5698 - DNA, 483 bp, Bacillus clausii
gaggatcgagttccggatccggtgcggcggtagcttcctaccaatgttatggttcagtcggatcggatactgggggatcgattcgaatgcctgcctccatgtgcgggattgtcgggatgaaaccgacttttggcagagtgagcaggtatggcgccatccaattgtgccccactttagaccatttagggcctatgacccgaactgttacggataacgcacttctattaaacgtcttatccggttttgacgagaaagatcgttattcggttgcttcaaaaaaagaaaattttactgaagggattaatgcaagtattaaaggtaaaaaaatcggcattccaacttctttttattttgacatcatcgacacggaagttcaacgtgtgtttaactcagcggttgaaaattgccgcctgcttggtgccgaaatagtcccgattgaacttcctggtatggatgatcttttgacagcacagcaagttattt

SEQ ID NO: 5699 - DNA, 285 bp, Bacillus clausii
aggaaacgcaatggcgacaaggagtttaactgggattaagcccactggggaagtccatcttggcaattacattggcgcgattaagccggcgcttgcttttacaaagcagactggtttagagtcgttttattttattgccaatgcccatggcttgacgaaaatcactgacagcgaggaaatgcggcaattgacacgaggaatcgctgcgacttggctagctcttggcctcgatccggaaaagtcggttttttatcgtcaatccgatgtgccggaagtatttgagct

SEQ ID NO: 5700 - DNA, 450 bp, Bacillus clausii
tcagaaagggcaagatgtgaaagttaaagtgctttccgttgatcctgatagcgaacgcgtttccctttctatcaaagagatgctagctggcccatgggaaaacattgaaagcaaattttcagctggcgatatcgttactggtacagtcaagcgcctcgtatcgtttggtgcttttgtggaaatcgcaccaggggtggaaggactcgtccatatctcgcaaatttctaaacgccatatcggcactccgcaagaagtgttggaagaagggcaacaagtgcaagcgaaagtgctcgaagttagcgaagcagacagacgcgtatctcttagcattcgcgaagcgtctgaagagcaagaacgaaaagaaacacgtgcctatgaaaagccagccaacgacgagccctctggcttctcgcttggagatatgatcggcgatcagttgaaaaaataccg

SEQ ID NO: 5701 - DNA, 387 bp, Bacillus clausii
tagctgtttcctgagcgcgcctattgcttattacaccgtatgacaagacggcagttgcttcaattgagaaggccattttgaaatcggatttaggccttacaccatcaaacgatggccaagtcattcgcattgcgattccgccacttacggaagaacgccggaaagaccttgtgcgattggttagcaaaaccgctgaagaatcaaaagtggccgtccgcaacattcgccgtgatgccaatgatgaattgaaaaagcagcaaaaagacggggaaatgacggaggatgaacttcgcagcgccactgatgatatccaaaaattgactgacacgtacgttgcaaaaatcgacgaaaaagcaaaacagaaagaacaagaaatcatggaagtgt

SEQ ID NO: 5702 - DNA, 654 bp, Bacillus clausii
  misc_feature (1)...(654): n = A,T,C or G
aggtgtcttttganacagacgggattggcgatttcgtgattgctcgtaaagatggtgtaccgatgtacaactttgccgttgtcgtcgatgaccatttgatgaacatttctcatgtgatccgtggggaagagcatctttccaatacgccacggcaaattttactctatgaggcatttggatgggatgtgccaaaatttgcccacgcttccttgattttaaacccagacaggcagaaaatgagtaaacgtgatgaatcgattatccaatttgtcgagcagtataaatcattgggctatatgcctgaagcgattgtcaatttcctagcattgcttggttggtcgccagttggcgaggaagaaatcttttcgcttgaggaactatgcgaccaatttacactcgatcgcgtttcaaaagcgccggctatttttgatactgataagctcgcctggatgaacaatcaatacatgaaaaacgctgatttggacaccgttgtcgacttggctttgccccacttagttgccagcggtaaactgccagaacagttggatgaaggcaagcgtgaatgggcgcgccgtttaattggcttataccaggagcaaatgcattacggggctgaaatcgtcgaactgacggaaatgttcttcaaagaagaaa

SEQ ID NO: 5703 - DNA, 195 bp, Bacillus clausii
  misc_feature (1)...(195): n = A,T,C or G
aagaacttaaagaaaanggcncctatgttgcacttgcaaagctgccgcgggattcttccccaagcagactaacgagaagatgccggaagaccggccgtccacgcggtgttttgcgcgnctttgaatngtctcggattgcttttcgggaactagcccataaagggcaaattcctggtgtcaaaaaagcaagctggt

SEQ ID NO: 5704 - DNA, 363 bp, Bacillus clausii
atggcatacgcaaaacttggccgtacgagctcacaacgcaaagcgttgcttcgtgatttggtgacagaccttatcatcaacgaacgcattgaaacgactgaagcaaaagcaaaggagctgcgcccaatcgttgaaaaaatgattacgcttggaaaacgcggtgatttgcatgcccgtcgtcaagctgcagcgttcgttcgcaacgaaacagcagacgttgaatcagggcaagatgcaatccaaaagctgtttgcagatatcgctccgcgctttgcagagcgtcaaggtggatatacacgcattcttaaagttggtcctcgtcgtggtgacggtgcaccaatggcaatcattgagtttgtttaa

SEQ ID NO: 5705 - DNA, 381 bp, Bacillus clausii
cgagattattgccagccatggggctgacacgctccgcctgtatgaaatgtttatgggccctctagatgcatctgtagcttggtcaacaaacggccttgatggatcacgccgttttcttgaacgggtttggcgcctgattgttaacgaagaaacaggcaagctgaacagcaatgtcaaagatgtagaaggcaatgaagtgtttgtgcgcacttaccaccaaacggtgaaaaaagtaaccgaagactttgccgagctgcgttttaatacagggatttcccaattaatggtgtttgtaaacgagggaaataagcaagaggtattgccaaaagcgctaatagagggctttgtcaagcttttgtcgccagttgctcctcatattgc

SEQ ID NO: 5706 - DNA, 285 bp, Bacillus clausii
cagatcctcatggcaatgcgatttcttgggctagcgctggcgcacttggttttaaaggctctcgtaagtcaacaccatttgctgcgcaaatggcggctgaatcagctgccaaaacagcgatggagcatggcatgaaaacgatcgaagtttcagttaaaggcccaggagctggccgtgaagcggcaatccgttcattgcaagctgtagggcttgaagtgaacatgattaaagatgtgacaccagttccacacaatggctgccgtccgccgaaacgtcgtagagtgt

SEQ ID NO: 5707 - DNA, 1452 bp, Bacillus clausii; identical to SEQ ID NO: 5656

SEQ ID NO: 5708 - DNA, 142 bp, Bacillus clausii
atgaattttgaaacgattattggacttgaagtgcacgtggaactgaagacagactcaaaaatcttttcgtctagccccaaccattttggtgctgaaccgaatacaaacacgagtgtcattgatcttggctatcctggcgtat

SEQ ID NO: 5709 - DNA, 603 bp, Bacillus clausii
tcaatatggggttgtttacgtacccgattttaatggcggctgatatcctgttgtttcagccagatattgtgccagttggccgtgaccaaatccagcacattgaaattgcccgtgatgtagcgcggcactttaatcatgtctttggcgatgtgtttaagcagcctcgtgtccacatcgaagaaagcgttgctgttttgcctgggctggatggccgaaaaatgagcaaaagctatggaaataccatccctctgttttcagaggcgaacgaactgcaacggctagtgaatcggatcaaaaccgattcactgccgccagaagcgccaaaagatccagagacatctaacttatttaccctttataaggagtttgctgagccacggcaagtggaagcgatgcgggcccggtttgctgagggcattggctggggggaagttaaaaaagagctgtattgggcgatcaatgagtttatgagcgaaccgagacgtaggtacaacgagttattggcatctccagaagtggaccgcctactggctgaaggggcggaacgggctagagcatatagccagccattcttacaggaaataaagaaagcagtcggtcttt

SEQ ID NO: 5710 - DNA, 174 bp, Bacillus clausii
atgctatataactggtcgtaaagcgcgttctgggaataagcgctctcatgcaatgaataaatcaaagcggggctttggtgcaaacgtacagaaagttcgtatcttggtagacggaaagccgaagcgtgtatatgtttcggcgcgcgcccttaaatcaggaaaagtagaacgcgt

SEQ ID NO: 5711 - DNA, 758 bp, Bacillus clausii
  misc_feature (1)...(758): n = A,T,C or G
accaatatggcaaagacgatgccattgcaatggcaaatgccaataacattccccntgaagtgtgtttgcgcgtcaataggatgaagacaccagcagcagaactagtggcgcatttagggaatgaaggagttgaggcagaaaggagcaagctgcttcctgatttggctgtcctaataaaaaaaggcaatccatttggaggggaagcctacaaaaaaggacttttcaccgctcaagacgaagcgtctatgcttgtcgctaagcttcttggtccagaagagggaatggatgtccttgatgcttgtgcggcgccaggagggaaaaccacccatattgccgaacaaatgaacgggacgggccatattttagcattagacctccacccccataaagtcaagctcattgccgagcaagcagcgaggctcggtcttgagaacattgaaacacgtgcagaagatgcaaggaagcttcaaacaaaacaacactatgaccgggttcttgtcgatgcgccttgtacgggatttggcgttatccggcgcaagcctgacatccgttggtcgaagacagaaaaggacgtaaagcacattgccaacgtccaagcagcgattctcgcccatgcaagccagtttgtcaaacagggtggcacgcttgtctatagcacgtgtacaattgaaaaagaagagaacgaacatgcgatagaacgctttttagacactcatccacagttcgaaacgaatgaacgattttatagaaggttgcct

SEQ ID NO: 5712 - DNA, 459 bp, Bacillus clausii
tcgcttttgcggcgatccgttacaatatgcttcgttataacacgacatctgacattgtgttcgatttaacagaggcaacgcaagtgacaggcaatacaggcatctatttaatttacacgtatgcccgggcaaacagcattattaccaaagccaaacaggcaggcctgtctccagaaggggcaacctttaaaggcgctgaagatgcggagcgggcgttgctcaagcacttggcaggctggagtacagtcaagcgcaaagcagctgcatcgtttgaaccaaatttaatttgtacttttgcctttgagcttgcaagcctctataaccgtttctattcacaatgcccagttttaaaagctgagcctttggaacaagcgaagcgtctagcgatcacagaacgtgttagccagcaactcgagcgcgttttcacgatactcggtttgccgagcttgaaaaagattt

SEQ ID NO: 5713 - DNA, 318 bp, Bacillus clausii
atgagcaacctcattgcagaaatcacaagtgagcaattgcgcacagaccatcctgatttccgtcctggcgatacgctatcgatccacgtaaaagttgtcgagggtactcgcgagcggattcaattgttcgaaggcgttgttattaaacgccgcggctcagggattagcgaaacgtttactgcgcgtaaaatctcatacggtgtaggtgttgaacgtacattcccattacattcaccaaagatcgataagatcgaagtgaaacgttacggtaaagtacgccgcgcgaaactttactacttgcgcagccttcgtggcaaa

SEQ ID NO: 5714 - DNA, 195 bp, Bacillus clausii
aaagcgtgtcgggaatgccgtttgtcgaaatcggatcaagcgccttgttcgcgtcgcttttcaagaacttgaaggacggcttcggccagactgtgactatgtagtgatcgcgcgaaatccagcccgggatctttcctttaaagaagtacggagcagtttggagcatgttatgaaaaaagcgaaagtattggcccc

SEQ ID NO: 5715 - DNA, 255 bp, Bacillus clausii
tgatcgtaaaacaaccacttgttgaaacaggcgtaactggccaatacgacgtccacgttaacgtcaatggcggtggcttcactggccaagcaggcgcaatccgccacggcattgcccgcgccctactgcaagtcgatcctgacaaccgtgcaacactaaaagcagcaggcttccttacacgcgatgcccgcatgaaagaacgtaaaaaatacggtcttaaagccgctcgtcgtgcgcctcagttctcgaagcgtt

SEQ ID NO: 5716 - DNA, 276 bp, Bacillus clausii
aaggcggcatcgtcaaccacttgctttatgaaataacggtcaattgccttcctgctgacattccggaagcaataacagttgatatttcaaatttaaacattggcgacagcctttctgtttctgacattcgtgccaatgtgcctgttacgatcgtcaatgaagacgaggagacggttgtaacggtaacaccgccgacggttactgaagatccagatgcaacagaggaagacaatacgacggcagaatcagtggaagcgacaggagaacggaatgacg

SEQ ID NO: 5717 - DNA, 247 bp, Bacillus clausii
atgaagttagtagtgggtctagggaaccctgggaaaaagtatgaacacacacggcataatattgggtttgacattattgaccgttgcgcacaagaacttgacttgcccctggacaagcaaaagtttaaagcaatttatggagaaaagcggatcggtagtgaaaaagttgttcttttaaagccgttaacgtatatgaatttatcaggcgaagctgtacgcccgtttatggattattttaatatcagca

SEQ ID NO: 5718 - DNA, 489 bp, Bacillus clausii
ttttagagcaaaaacaacaagttgtagctgaagttgcggcaaaattgcgcgacagcaaatcaacggtcattgttgattaccgcggactgaatgtagcgcaagttactgaacttcgtaaacagttgcgtgaagctggcgttgagtacaaagtatacaaaaatacgcttgtgcgccgtgcaacagcagaagctggtcttactggcttggatgagcatctcgttggcccaactgcgattgcgtttggtgtcgatgatgttattgctcctgcaaaagtgctaaacgaatttgcgaaaaacaacgaagcattaacaattaaaacaggcgtcatcgaagggaacatttcgactgcagatgaagtgaaagccttggctgagcttccttcacgcgaagggcttctttctatgcttgccaacgtccttcaagcgccagttcgccaatttgcacttgctgcaaaagcggtggccgagcaaaaagaagagcaaggtgcgt

SEQ ID NO: 5719 - DNA, 363 bp, Bacillus clausii
atgagcaaagaccaaatcattgaagcgattaaagaaatgactgttcttgaacttaatgaccttgtaaaagcaatcgaagaggagtttggtgtaacagcagcagcacctgtagcagttgctggcggcgcagcagaaggtggcgcagctgaacaaactgaattcgatgttgttcttgagtctgctggttcttctaaaattggcgttatcaaagtggttcgcgaaatcactggccttggcttgaaagaagcaaaagcccttgttgacggtgctccggctccaattaaagaaggcgttgcgaaagaagaagccgaagaaatcaaaggcaagcttgaagaagcaggcgctagcgtcgagttgaagtag

SEQ ID NO: 5720 - DNA, 610 bp, Bacillus clausii
ttgagtgagcattattatacaaaccaaccgtcttcgccccatgatgagaaaacatggacgttcaccttgcgaggcgaaccgttttcctttacaacagaccgcggtgtgttttcgaaaggcgaagttgattttggaagtcggcttctcattgagacatttgtttttcctaggctcgatggcgatatacttgatgttggctgcgggtatgggccgattgggctagcattggcaaaagcggacccttcaaggcgggttgtgatggtagacgtcaatgaacgcgcttgcccattggcgaaaaaaaacgccaaagcgaacggtgtgaaaaatgccgacgtttgtttcgatgaacggggcttaactgggtttgagcgagtggcccgttatgctgcaattgtaacgaatccgccgatacgtgctggaaagaacgtcgtccacgacatttatgaacaagcgtacgaacggttaattcctgagggagaattttgggtagtgatccaaaaaaagcaaggggcgccatcgaccaagcaaaagttagctgagctatttggagcagaaaatgtcgaggtcaaggggaaaaagaagggttattatgtctttcttgcaaaaaaga

SEQ ID NO: 5721 - DNA, 738 bp, Bacillus clausii
tccttacgataaaaacaatgccattttagaactccatcctggcgcaggcggaactgaatcccaggactgggcttctatgttgctaaggatgtacacgcgctgggcagaaaagcgtggttttgctgtcgagacgctcgactatctccctggcgaggaggcaggcgtcaaaagcgtcacgctgctcataaaagggcacaacgcatatggctatttaaaagcagagaaaggcgtgcaccgcctcgtgcggatttcgccatttgactcatcagggaggcggcatacatcctttgtgtcatgcgaagtgatgccggaattggatgatgcagttgacatcgaattaaatagcgaagacttaaaaatagatacgtatcgtgcgagtggggcgggcggccagcatgtcaacacgactgactcggctgtacggattacccatttgccgacaaatacggttgtgacttgccagagcgagcgttctcaaattaaaaaccgggaacaagcaatgaaaatgatgaaagcgaaactgtatcaactgcggattgaagagcaagagcgtgaacttgctgaaatccggggcgaacaaaaagaaattggctggggaagccaaattcgctcctatgtgttccatccttattcaatggtgaaagaccaccgcactggctttgaaattggcaatacgaacagtgtcatggatggggagattgacgggtttattgacgcttacctgagacaatcgctggc

SEQ ID NO: 5722 - DNA, 138 bp, Bacillus clausii
aaagaggtgtcgggtcgatcacaccagaccagctacgggcaatcgctaaaataaagcttccagatttaaatacgacaaagattgatagtgccatgaaaatcatcgcaggaacagcgaaaaacatgggaatcgagatcg

SEQ ID NO: 5723 - DNA, 944 bp, Bacillus clausii
gtgaattataaacagacgaaacgatggattgtggataaaggacatgattcaggcgaacaaaccgagatgattcaagaagcagctatgtggataaaacaaaataagctgattgctttcccaaccgaaacggtctatgggcttggcgccaatgccctctcatacgaggcggtcgcacaaatattcgcagcaaaagggcgccctagcgataatccactgattgtccatattggcgacaacagccagttggacaagctggtcaaatcgattccggcaaacgccagcaaactcatggcagctttttggccaggagcgttaacattgattttagaggccaaagaagccattgctgaaaatgtaacagccggactatcaactgtcggtgttcgcatgccttcccatcccgttgctttaaagttgttacaggaatgtgggctgcccgttgcagctccgagcgccaatgtgtctggccgtccttcaccgacaacggcggcacatgtaatcgccgatttagacggcaaaattgacggaatcgtcgatggcggagcgacgggcattggccttgagtcaactgttctggatgtatcgaaaccgacacccatgctttaccgaccaggcggcgtgtctgttgaagaaattgaagcggtcatcggcaagatcgacattgacccggctttgggaacgacacatagtgctccaaaatcgccggggatgaaatatacccattatgcaccaaatgcagaagtaacgctcgtcgacagtgacgacacaatccatcatttagtggcggaagcgagaaaagaagggcgaaaagtcgctgtgttcgcaacgacgggaacggccgattataaagcggatattgttcgccgaggcgagtcgcttgagcatatcgcccatattttgtatggcgttcttcgcgaatttgatgagcaaggagcagacgtcat

SEQ ID NO: 5724 - DNA, 544 bp, Bacillus clausii
atgtgtttcaagggaaaacaagcgcttatcgacaaacacattcgcattctccatccactcagtttcatagaagacccgaccaggcttttccgcgctgtccgttttggcctgcgcctaaacttcagcctctccttcgagacactgcaccaagcaactaaaacaggtgctgctctgcaccacattagtgccaaacgcttgcggcaggagcttgatttgctagctaatgaaggcgttctgcttgaaggctttcgccaattggcagacctccatgtatggacaacgttgtttggttcccctttctccaaacgagcctggcagcatttggccaacttgcagcaacatggtttgaatgatggcatgttctttttgctggctggcgctgtcgattgcgatcgtcttgacgttgcaagtcgttacgcgctaaccaagcaagagaaacgcttaacggaggaagcaagcttgccaatttggcaacaaatgtcggcaacctcctcaatcggagaagcgcatcgcgacttagcgcaaatttcaagcgaaatcgttc

SEQ ID NO: 5725 - DNA, 531 bp, Bacillus clausii
taataaccaaggagtggagtggtatcctggccatataaaagatgggcgctttggccatttcctagagaacatggtcgattggaacatcggccggaatcgcttttggggcacaccattaaatgtgtgggtttgccaaacgtgcggccacgaaaaagcgcctggctcactacaagagctgcgtcaatgggctattacagagataggagaagggtttgaactccataaaccatatgtcgatgatgttcaattcgcttgtccttgtgggggacaaatggaacggacaaaagaagtgatcgatgtgtggtttgatagtggggcgatgccatttgcccagtaccactatccttttgagaatcaagcttcctatcacaagcagtatccagctgatgtggtgattgaaggtgtagatcaaacacggggctggttttacagtcttctcgctgtttcaactctttacaaaggcgttgctccgtacaagcgagtgttgtcattaggtcatattttagatgaacatgggcagaagatgtcgaa

SEQ ID NO: 5726 - DNA, 1325 bp, Bacillus clausii
tagctattcaatttccagatggaaagagcaagcaatttccgcaaggtgtaacactagctgagcttgcacaatccattagtccgagtctttacaaaaagacgattgttggatgtataaatggtgtgccttccgatttagcacatccaatcacagaaaacgctcatatttccttgtatgatgtggcttcaaaagaaggaatagaagtgcttcgtcattcaacagcccacttattggcacatgcattaaagcgattatacccggctgttcatttaggagtgggtcctgtcatcggagatggatttttttatgatgttgcgttggaccaaccgattaccgtgggtgatttgccaaaaattgaacagatgatgaagcaaatcatcaaagagaacatggagataacacgtaaggaagttacgcgcgaaaaagctaaacagttgttcaaacaggaccctttaaaacttgagttgcttgaagatataccgccagatgaaacagtgactgtgtacgaacaaggtgatttttatgatttatgtcgtggtcctcatataccttcaacaggcaaaatcaagcattttaagttaacgaaagtgtctggtgcatattggcggggcaatagcgataatcaaatgcttcaacgtatttacggtgttgcgtttgcgacaaaagatgagttacaagattattttgcctttctagaggaagctgaaaagagaaatcaccgtaagcttggaaaagagctggaattgttcatgttctcagaagaagctccaggaatgcctttctatcttgccaatggtcaaattatccgaaatgagcttgaatcttttttgcgaaatcttcaagccaaatacgactataaagaagttcgcacgccgatcatgatgaatcaacggctatgggaacaatctggtcactgggatcactacaaagagaatatgtattttacacaagtggatgagcaacaatttgcgctaaaaccgatgaattgccctggccatatgctcatttttaaaaacgggctgcattcgtaccgagatttaccaattcgcatggcagagtttggtcaagtgcatcgtcatgaattcagtggtgccttgaatggtttattgcgtgtccgtacattttgccaagatgatgcccacattttcgtaacaccgcaacaaattgaagaggaaatcacacttgcattaaaaataatcgaccatgtctaccaagtatttgggtttaagtacgaaattgaattatcgacacgtccagatgattttatggggagtgaagacctttgggagcaggctgaaactgctttagagaatgtactgcaaaaa

SEQ ID NO: 5727 - DNA, 226 bp, Bacillus clausii
atgcaagaacagctaacggcattaaagcatgaggcgttggacaaagccgaggaagcgaaatcagagcaagatattcaagcgattcgcgttgcctatttagggaaaaaggggccgattaccgaagtccttcgcggcatggggaaattgtcagcggaagaacgcccaattattggtgccctcgccaatgaagtgcgtgatgaaattaagaacaaattggatgaaaaaa

SEQ ID NO: 5728 - DNA, 465 bp, Bacillus clausii
aaaggcggagtcgttgcttgattgttggattctatctaggctgcattcgctcataaaagaagtgaccttcagtttagaggcctatgatttgacaaaaggggcgcgtttaacggcaactttccttgatgaaatgagcaactggtatatccgtcgaacgcgccagcggttttgggcaagcggaatgaatgaagacaaaaaggcagcttactctactttgtatcgtgtgcttacaaaaacagcgcaacttattgccccttatgccccttttgtagcagatgaggtatacagccagttgaaaggggacagcgtccatttatcggactacccgcaagctgacgattcgctaatcgatcaagagatggaagatgaaatggcactggtgttgcaaattgttgaaagagcccgttttgcccgcaataaagcagcattaaaaacaaagcagccgctacaaacactggtcgtaat

SEQ ID NO: 5729 - DNA, 564 bp, Bacillus clausii
taataaccaaggagtggagtggtatcctggccatataaaagatgggcgctttggccatttcctagagaacatggtcgattggaacatcggccggaatcgcttttggggcacaccattaaatgtgtgggtttgccaaacgtgcggccacgaaaaagcgcctggctcactacaagagctgcgtcaatgggctattacagagataggagaagggtttgaactccataaaccatatgtcgatgatgttcaattcgcttgtccttgtgggggacaaatggaacggacaaaagaagtgatcgatgtgtggtttgatagtggggcgatgccatttgcccagtaccactatccttttgagaatcaagcttcctatcacaagcagtatccagctgatgtggtgattgaaggtgtagatcaaacacggggctggttttacagtcttctcgctgtttcaactctttacaaaggcgttgctccgtacaagcgagtgttgtcattaggtcatattttagatgaacatgggcagaagatgtcgaaaagcaaaggcaatgttcttcatcctcttgaagt

SEQ ID NO: 5730 - DNA, 579 bp, Bacillus clausii
atgctgctttagttatctggacgacgacaccatggaccattcctgcaaacttaggcatcaccgtccatcctcaattggaatacagcgtcgtgcgcacgggcggccgttcatttgtggtagcaagcggtttgcttgaacatgtccaaacggaactaagttgggaagatgtggttgttgaaaagacagtcacaggaaaagaattggaatatattgtttgccgccatccgttttatgatcgtgactcccttgttatgaatggcgagcatgtgacattggacgccggtactggctgtgtccatacggcccctgggcacggcgttgatgactttgtcgtcggccaaaaatacgggctagacgtgttatgccctattgatgacaaagggataatgacgagtgaagcgccaggttttgaaggcgaattttatgacaacattaacaaaatggtgactgagaaactagaagcagtaggcgctctgttaaagctcgggtttattactcactcgtaccctcatgactggcgtacgaaaaagcctgttattttccggggcaacttcgcaatggtttgcctccatcgccaat

SEQ ID NO: 5731 - DNA, 246 bp, Bacillus clausii
aaggatttaaaccggacgttattttagtagaccctccacgcagcggctgtgaccgccaattgttaaaaagcatgctaaaagcgaagccaaaacgaattgtctacgtctcatgcaatccatctactcttgccaaagacgtacaacatctgatcgaagctggcggctatgcgattcaatccatccagcctgtcgatatgttcccgtggacggcacaggtcgaaagtgtaactgagctgattctcaaat

SEQ ID NO: 5732 - DNA, 222 bp, Bacillus clausii
caatacgttctcgaatatgaaagcagtgttggaatctgaagggctaagtgctgaaaacattacaaaggtaaacatatgggcgactgagcaaatcgattgggattttttatatgcagagtgggatcggctgtttgaaaaggagtatccagcaatgacgattgggtaccttgcggagttaggattgccagagatcaaaattgaaatcgaaatttgggcagctaa

SEQ ID NO: 5733 - DNA, 323 bp, Bacillus clausii
atgaaggaaaaggtggttgaacaggaacgacggctacgaaagcgatggacaaaagagggaacattccagaaatcagtggctaaccgcgaaggccacaaaacatttgtcttttatgaagggccgccaactgcaaatggactgccacacgctggccatgcattagggaggacagttaaggacttcattgctcgttataaaacgatgcgaggttatcaagtgttgcggaaagctggctgggatacacatgggttgccagtagaattggaaagtggaaaaacaattgaacattcgcgcaaagaggagattgaagcttatggagtaga

SEQ ID NO: 5734 - DNA, 672 bp, Bacillus clausii
atcgcgcaagtatgattggcacagggcagttgcctaaatttgaggaagatgtttttaaaattagcgaagaagattattttttgatcccgactgcagaagtgccggtcacgaacttgcatcgcggggaagtgctgcaaggagagcagctcccgattgcttataacgcctacagcacgaatttccgctctgaagctggttatgctggtcgcgatacacgggggctcattcgccaacaccaatttaacaaagtagagcttgttcgtttttcattgccggaggattccaacaaccagctcgaaatcatgacaacacacgctgaaaacgtgttgaagcgcttaggattgccttaccgggtcgttacgttgtgtacaggagatttgacctttgcctctacgaaaacgtacgatttggaagtatggatgccgagcgccaatacgtatcgtgaaatttcttcgtgctccaatattggtgacttccaagcaaggcgtgccaatatcaaattcagtcgcgatccaaaaagcaagcctgagtatgtccatacgctcaatggttcaggggtagcggttggccgtacggtagcggccattcttgaaaattaccagcaagaagatggctccattgtcatcccggaagcactgcggccatatatgggtaatgtgaacgttctttcat

SEQ ID NO: 5735 - DNA, 603 bp, Bacillus clausii
  misc_feature (1)...(603): n = A,T,C or G
taagagatcttagcatcttcctagaaaaaatgaacaataacagcagtactcatattggcttttgtggggaagataagggagaaatatacgatcatttaatgaatgatttttctgatttggaattgaaagattcatttttggttgcttataatcactctcgtatagttggtgcaatcggtttggatatggacttaaaaagaggatgtgcggacgtatgggggccgtttgttgagggggaagatatcgacatggctcaagaattgtgggaaacgattgcttcgaaaacacctcctatgataaagacattttctttctttttgaatgaggataaccactttggaaaagagtttgtgttacaaaataaaggcatagatcaagggtcggatttggttttgagcataactagagatcgatttattaatcacacgcctagcgatgttgaaacgtactctgatgcctaccgtcaatcttttatcaatctacataatgaagtctttcccacaacctattttgatgcacataccattattagtccattaaatgactttaaccatttattcttcgttacgggaaaatgaacatgnatataaaggggttatgtcc

SEQ ID NO: 5736 - DNA, 868 bp, Bacillus clausii
  misc_feature (1)...(868): n = A,T,C or G
atgcgccaagacggccgaaaacaaaatcnactaagagaggttgagatcattcctcattttacaaagcatgccgaagggtctgtactgatttctgttggcgatacaaaagtgatatgcacagcaagcattgaaaaccgcgtccccccgtttttacgtgggcaaaataaagggtggctagcggcggaatattcgatgctgccacgagcgacaggccagcgaacgattcgcgaagccgcaaaaggcaaattgagcgggcgaacaatggaaatccaacgcctgatcggccgggcactccgggcagttgtcgatttataaaagctcggtgaaaagacgatctggatcgactgcgacgttatccaagcagatggcggtactcggaccgcatcgattacaggtgcatatgtggcgcttgtgctcgcggttcaaaaagcgtttgctgaaaaaccaattagcgcttggccgattactgattttttagcacctatatctgtcggccttttgcctgaagaaggggcngtgtgtgatctgtgtnacagcgaggattcacaggcaaaggtccatatgaatatcgtccnaacaggttcaggcgattttgttgaagtgcaaggcagtggagaagaagctgtttatacacgcagtgaattgaatgcgctccttgacctcgctgcagagggcattggccaattgattcacatccaacgcccgtttcttggcgaggcagctagttggattgaagaaaaaaaggggacatgaacattgnacgaattggttgtagccacaaaaaacaaaggcaaacttcacgactttcaaacattgtttactgatcgttacatagtcaaatcactttacgattaccctgaagtcccct

SEQ ID NO: 5737 - DNA, 317 bp, Bacillus clausii
  misc_feature (1)...(317): n = A,T,C or G
atgtcgattcagctgccgcgggggacgcaagatattttgccagaagacgcagcaatttggcagtacattgaacaagttgctaaggaaacatgcgaaacataccattatcaagaaatccgtacaccgatctttgaacataccgaaattttttcaangggtgtnngcgatacnactgatattgttcaaaaagaaatgtataccttttcggaccgaggcggtcgcagcttaacactaaggcctgagggaacggcggcagtcgttcgttcttatgtcaaccataaactgtatgcatccccagcacagcccnacgaaatttt

SEQ ID NO: 5738 - DNA, 507 bp, Bacillus clausii
ctttgtatgaatcagggcaagtcaagcggggcttgcaagtccttaaagataaaaatgaaacttacgaaaaggacggggcgacttggctacgctcaactgcttacggcgatgacaaagaccgggtgcttgtgaaacaagacggtacgtatacgtatttaacgcctgacatttcgtaccatcttgataaatttgaccgtgggtatgaccgtttaattgatgtgctaggtgccgaccatcacggatacattccaagaatgcgggcggcgattcaagcgcttggttatgatccggatcggtttaccgtacaaattatccaaatggtaagcctgttccaaggcggcgaaaaagttaaaatgagcaaccccacgggcaaagcggtgacgttgcgtgaattgatggaaaaggttggcgttaatgcaacccggtatttctttgcaatgcgtagcccaaatactcctcttgatttcgatatggactttagctgtgtcaaagtcaaatgaaaaccct

SEQ ID NO: 5739 - DNA, 261 bp, Bacillus clausii
acattcaatacgcacatgcacgggtatgcagcattcttcgccaaggagaagagctaggcgtctcttatagtgcaaacacggatttgtcgccgattgcaagcgacaaagaatacgagttgctaaaagcaattggcgagcctcctagtgctgttgcagaagctgcaacaaagcaaattccacagcgcatcgccaattatgcctatgatttggcgcaagctctccatagtttttataatgtgacgcgcgtccttgatacagaaa

SEQ ID NO: 5740 - DNA, 168 bp, Bacillus clausii
tgttggtgcaaacggctcctaagcgcaagcttgaccaacttgtcggccatagcaaccaccaaggcgtcgtcgcctccgttgctgcgtacgaatatgcagacatggatacgttatttgccaaagctgctgccgctaatgaagccccatttttcctcgtgcttgacgaaa

SEQ ID NO: 5741 - DNA, 548 bp, Bacillus clausii
  misc_feature (1)...(548): n = A,T,C or G
tcagtaaatgattntaaaacgggcttaaccattgaagtcgataatggcatttggcaagtgatggagttccaacatgttaaaccgggaaaaggagcagcgtttgtccgctcaaaactgcgtaacttgaggacgggcgcaatccaagagaaaacgttccgtgctggtgagaaagtcgcaaaagcgcatattgaaaaccgtcgtatgcaatatttgtatgcaagtggcgacacacacacatttatggataacgaaacgtatgaacagcttgaactgcaaacagcacaaattgagtacgagctaaaatttttaaaagagaacatggaagtacatgtcatctcgtatgaaagcgaaacactgggcgtagaagtgccgaatacggtcattttagaagttgtggaaaccgagcctggaattaaaggcgatacagcctcaggaggtacgaagccggcaactttagaaacaggtttgactgttcaggtgccttttttcgtaaaccaaggcgataagctagtaattgacacaagatcagcttcttacgtatcaagagc

SEQ ID NO: 5742 - DNA, 315 bp, Bacillus clausii
  misc_feature (1)...(315): n = A,T,C or G
tgcgggatgtgcntgcagangcagagncgattagccaccagctcatgntgcgcgcaggaatgatgcgncnaattgccgcaggngtttatgngtacttgccgctagcaaancgnacaatcgcnaaaatacaannnatcatccgcgaanaattanatgccattggtgcccaagaattgacgttgccnagtttgcacccagctnaactttgncaagcttctgnccgttggnaggcgatgggtgatgagttagtgcgcttaaaggatcgccataaccgcgattttgccctcggcccaacacatgaggaagtcatcacct

SEQ ID NO: 5743 - DNA, 264 bp, Bacillus clausii
atgcaaattgaggcaattcgtgctgggcgccaattgccgagcattcagaaagaagaattggttgaacagtggtctgccttgccgatcaaagcgaaaagcgatttggcgattacaggccgtgatttgcttcatgcaaaagctgtaccaggcccatggattaaggaggcgctacaagcggcagaaaaggccgttgtgacaaaaaagtgcccgaatgaaaaggctgcgattttggcatttttaacgacgagggaggaaggaaaatga

SEQ ID NO: 5744 - DNA, 318 bp, Bacillus clausii
gcatgagcgatttgaaaaatttgtcgacggcggaacttgagttaagaaaagaagagttggaaaagcaatacaacatgtacaaaatggaaaacatacagcttgatatgtcaaggggaaaacctgggccagaacagcttgacctttcacatggcctcctccatgctttatcggaagtagacgtgaaagctgacgacaatggcgatattcgcaattatggccaactggatggaattcccgaagcaaaggcgctttttggcgagttgcttggcgtacaagcaagcaacgtatttgtcggcggcaattcgagcttatccttat

SEQ ID NO: 5745 - DNA, 696 bp, Bacillus clausii
cttattcaaatgaaactgttcaacgtctagctgcattgaaaaccaaagctgaagatttccgcattttttgggacaatgcctacgcgtttcaccatttgacagacacaccagatgaacttgccgatatttttgctgcttgtgcacaggctggctaccctgatcgcgtttatatgtttgcatccacatcgaaagtgacgtttcctggagcaggcatttctgccttctttagctcagaagccaaccttgcttacgctaaaaagcagctgtcagtgcaaacgatcggatacgataaaatcaaccagcttcgccatgttcgcttttttgagcaaattggcggcgttggcgaacttatgaaacaacatgcccaactgatcaaaccaaaatttgatcaagtcaaccgcacactaacagaggagttgggcggaaaaggcattgccgagtggtccgaaccgcaaggaggctattttattagccttgacacgctagatggctgtgcaaagcgcgttgtctctttggcaagagaagccggtgttattttgacaggcgctggagcaacattcccttatggaaaagacccgcgtgaccgcaacattcggattgcaccaacatttccgtctgttgaagagttgaaaaaagcaatggaagtcgtgtctgtctgtgtagaactggcttctgtggaaaagttgttagctgcat

SEQ ID NO: 5746 - DNA, 309 bp, Bacillus clausii
  misc_feature (1)...(309): n = A,T,C or G
cggtacgtnccgccgccatgtatggacattgaaagaacatttacgggagcggaaagactggttacttggtttgctccagaaacactttggcgaactagggtcttgtggagacgtgcaaggcggttttttcatttggtttacttttagaaaagagcgagcgcctcatatgcaacgttttgtgactgcttgccacagaagaggcgttgtcattcatcctggatttatttacggagaggagagacaggcatcgatccgcttttcttttgcgtttgaaagcttggaaaacatggagaagggtctcctgcaagt

SEQ ID NO: 5747 - DNA, 573 bp, Bacillus clausii
ttgcggctgacattcgcgcaaaaattgaagctggcgaatggtatccgacgatgaagctgccgacccaacaagagcttgctgcctattatcaggtaaaccgaagcactgtcatagcagctttagaccgtttaaaggcaagaggcatcattgtttcgattcaaggaaaaggctcttttgttagcaacgattctggcaatgaagaaggcgttgtatggaaagagttggcgaaatggtcgttttatccgaaaaacaaagcgcttgtccagcatttgaacgaatgggaaaacgatgctactcttattcagctaagcaaaggggtgcttgctcatgaattgcagccaaagaatgcaatcaaggaagcgctcacggcaatggctgtacaaaatgttggtttcgattatggcgatgggagaggggatgaagggttaagacaggcactatctgtgtacttacaggaaaaggggattcaagcatctcctgattcgatcttaattgtttccggagcgctcggcggcttgcagttaataggcacagggattttgcagacgggcagtgtgttgttccacgagcctg

SEQ ID NO: 5748 - DNA, 504 bp, Bacillus clausii
ctcttacatcgagtcgttgcatttgttccaatcagcgggcatgcgcctttctcgccttcattctggcgccgaaaacatgacgtacagcaagtcacagaagcacggattgttttatacgatcccgacgctaaacaatccgtcagggacgatattgacggaggcagatagacatgacctctaccaacattggacaaatttgcaaatcccgattgtggaagacgatgtgtataatgagctcgctttttccaccatccccccggcgatgaaatcgtttgacacagcaggaaatgtcttatatcttggcagcctttcaaaaacggtcagccctggattaagaatcggttgggtggttgccccagaaccagtcgtcgataggctagcggacataaaaatgcagtttgattatggggccagcggcttttcccagctactcgctgccacttggctcgcttcgcctcatcatgaagcccacatgcggcaactacgggaaaacctacagcaacg

SEQ ID NO: 5749 - DNA, 542 bp, Bacillus clausii
atgactgcaaacaaagcttataaccatttagagaaacaagggttgatcgaaaaagtccaaggaaaagggacttttgtccgaaaaaatagcggggcaagcaaaacggaaaacgaaaaaaagctgctatcttatgattggcaattaacggttactgattacttgccacgtgctcagtacatgcaatttaatacagggaaagaaaaaatccagttttcctcctctaagatatggcccaacttacttccgaaccgttacctcataaaagaaacaataagaatcctttctgaggaaccttatatactttctacttatggagaaggacgaggagacatcacactaaggaaagaaatgtcagcttatttaaaacatttaaagatagcgattgaaccagacgatattgtcattacgaatggggtgcaacaaggcattgatattgttgcccgtagttttgttggcccaggagacattgtggttaccgagactcctacttactcggcggcaattgacgtattcagaggcagaggggcatcgattgtatcgat

SEQ ID NO: 5750 - DNA, 288 bp, Bacillus clausii
agaatgttatggttaattgtttgcaagaggcgaaagagcgcggctcgatccagtttatcgaaccagaaggcggcatgttcctatgggtagaggcagaaccgcacattaatacagaagctttgctgccacgcgctgtagaaaagggaatggcctatgtaccaggaaggcctttttatgcaggagcaccccaattaaatacactgcgccttaacttcactcatgcaactgatgcagaaattgaaaaaggtatgagcattatgctcggcatttttgaagaagcgaaagagc

SEQ ID NO: 5751 - DNA, 510 bp, Bacillus clausii
caagaggttctgcaaaccaagagctccatttcttgcagcttttgcgaaccaaacaagtcgatggccttattcttgcttcgctcgttaatgattgggaaacgattgccccctatacggattatgggcccattgtcatttgcaatgaatatccacggcagtctgatggagtaccagtcgtgacaattgaccagagtaaagcgatgtacgaagcaactgtccatttgttaaaaaaaggttataagcaaattgcttattgcaatccgatcacaaaaacggaatccgatgccgttatttcgccacttgcccaagatcgttatttagggttttgccaggcaatggaagaagccgggatgcacatgtatggcgaatgtttgtttttgggacattcccttgaggacggcagaaatatattcaaacaaatggtgtgcttagctaaccggcctgatgccattttgacaggaagcgatgaagtggcagctggaataatcgctgaggcaaaagctgctggct

SEQ ID NO: 5752 - DNA, 286 bp, Bacillus clausii
atgtttgcatcacgattaaaagaatgccgcattaaaaagcagttgacaatgaaagaactgggccaagcgttaaatatggcacaatctacaatttcaggttatgagaatggcaccagaaaacctgacttagacaatttggcccgccttgccgactactttaatgttagcactgattatttgataggccgactggactcaaacgattcctttatactccattctgatcagctcactagcgatgaaaaattgtttctagcagattgcttgcagctatacagaaaacatt

SEQ ID NO: 5753 - DNA, 336 bp, Bacillus clausii
aaacaagtttcaatcgatttatcaagcgctcacacaagcaatcaatagcggtgtttatgctcctggcgaaacgttgccttctgaaaacgaactgacagagatgttccaagcatcaagggaaacgattcgcaaagcactgaaaatgttatcagaacacgggtatattcaaaagatacaaggcagaggttctgttgtactcgatgtcgcccgcctcgatttcccggtttcaggggttgcaagcttccaagaactaaatgaaaagcttggtttgcaagctaagaccgatgtcgtctgctttacagctgctaaagcagatgaaacaatggcaaagaagtt

SEQ ID NO: 5754 - DNA, 565 bp, Bacillus clausii
atgaagattgatgacattgcaaaaattgccaaggtctccaagtccgccgtttcattggctttaaatggaaagcctggtgtcagtcaagaaacgagagaaagaattttaaaaatcgcagaaaagcacgattataacccaagacctttttcaaaagcacccaacaataacaaatcaaagattttccgttttgtcgcatgtacacataccggaattatcactgatcaatatcaatctcaatctttttttatggagttaattaataatatagatcaatctattacctcaaaaggatattctttaatcatttcctcaatcaatgttgactcattggagcaagaaataactaacctagagaaacagcaacgttcttctggaatattaatgctaggaacaaacttaactgaagagcaaatcaaagctgtagctaaattgcaaccaaatttgattgttttagatacatgctccgaaaccttagatgttagctttatagtaatgaataatgctttgggggcctatcaagcgggggaatatcttgtaggattaggtcataaaaagattggctatg

SEQ ID NO: 5755 - DNA, 447 bp, Bacillus clausii
tgaaagacatcattatggttgtatccggatcaggcataggcggtgcgatcattaaggacggcgccctccatcggggagcgaacggctacggcggagaatttggctacatggtaatgaataagcacggcgaaacattcagcggcatcacatcacccgttgaactggcgaaacgagtgtctgctgcgaaacgaacaaatattgatgccgttcgcgtatttgaactggctgaagctggtgatgaagtcgcccgtagggaagttgatcggcatttttattatttggcagtaggcctgtacaatttacaatttgcctatgacccagaagcgattcttataggcggagcaattagtgaacgatgcgattacatttcacgtatttacgagaaaattgatttgcttatcacagccaattcgatggcggatctgcgacccaatttatgcaaatgcc

SEQ ID NO: 5756 - DNA, 211 bp, Bacillus clausii
atgctgtacccttcaattgacaatttgctagaaaaattggattcaaaatactcgcttgttacagtctctgcacgtcgtgctcgtgaaatgaaagaagacgctgcccgggtgcctcttgtggaaaagccgaagtcacataagtttgtcggcattgcccttgaggaaattgtgaacgatcagctgacaaagcgtgtgccaaaagaggagcagt

SEQ ID NO: 5757 - DNA, 243 bp, Bacillus clausii
aagtgctgcaatacaagcttagcgtgcgtgaagtcgaacaactcgtccagagattaaatgaacatgttccacgtgaaacaaagcaagtcaaagtgaagttaccgccgattattaaagaacagcaagaacgtttaagagatacgcttggtacatctgtattaattaaacctggaaagaaaaaaggcaaaattgaaattgactatttttccgaggacgacttggaacggattttatcgttattgg

SEQ ID NO: 5758 - DNA, 339 bp, Bacillus clausii
aagagctgcttgcctattttcaaaatgaggcgaaaaagcctgttacagtagatgaattagaagagcagttcggcatagcttctggcgacgactttaaaaagttgatccaaggcttgaatgaactggaagaagaggggagcattgtgcgcacgcggacaaaccgttacggcatccccgaaaaaatgaatttagtgcgtggccgtgtccaaggccatgcaaaaggattcgcttttgtgttgcctgaaaacggcgaggaagacatttatgttccacaaggctccttggcaggggcaatgaatggcgatatcgtccttgtccgtatggatgaacggacaagcg

SEQ ID NO: 5759 - DNA, 456 bp, Bacillus clausii
  misc_feature (1)...(456): n = A,T,C or G
aaaaatcangtccgtcagtcaatattgattacacacaagcggctgaagacgcgatccagtttttaattgaaaaaggccataaacgaatcggcatgttgagcggttcgctggaagacccaatcaatggctaccaaaagtttgctggttatcgccaagcacttcagaaaaacaatattgaatttgatgaaaacctgattgtcattggcgattacacgtatgattcaggaatggaagcaatggatgcatttcttgcccttgacgaaaaaccgacagcgctattcgcttcaaatgatgaaatggctctaggcgtcatccatggcgtccaagatcgtgggtatgatgtgcctggtgatattgaagtaatcggttttgacaatacacgtttggctacaatggtacgcccaaccttgacgaccgttgtccagcctctttatgacattggcgctgtctccatgc

SEQ ID NO: 5760 - DNA, 665 bp, Bacillus clausii
  misc_feature (1)...(665): n = A,T,C or G
atgagtgcagaggtgaaaaacagcggcaaaaaaaagccactatccgataaacaagtgaaagagcttattgcaaaaagccaggaaggcgacacagaagcacgggattcgatcgtcaaccataacacacgtctcgtctggtcagtggttcaacgttttttgaatcgcggttatgaggcagatgacctttttcaaattggctgcattggtttaattaagtctgtcgacaaatttgacctttcctacgacgtgaaattttccacgtatgctgtgccgatgattattggtgaaatccaacggtttctgcgggatgatggcacagtgaaagtaagccggtccattaaagaattaagcaataaaatccgcaaagcaaaagacgaactgacgaaaacgctgcgccgggcaccgaccattaatgagatcgctgaacatttaggcgtgacgcctgaggaaattgtatttgctggagatgccaaccggagcttgtcctcaatccatgaaacggtttatgaaaatgacggcgatccgattacacttctagatcaaattgccgaccactcacaagtcaaatggtttgacaagattgctttaaagaagcgatttgcgaccttggcganagggagcggctaattggtatttgcgttatataaggatcaaactcatcagaa

SEQ ID NO: 5761 - DNA, 452 bp, Bacillus clausii
  misc_feature (1)...(452): n = A,T,C or G
aacggattaaacaaaatgaagcgtcattgacaggttcagagaagaaaattattactcaactaaaaaagcatgaaaagccatttttgttgtccatgaatgaattggcgcttttaagcaaagtgagtgaaccaagcgttgttcgcttatataaaaagttgggctacagcagctaccaagagctaaaagtcgcgcttgctcaggaactagctgaaatcaaaccggcatcaaaagaaagcgctgacattgaggctgaggatctggctgatacggtgtttgtcaaaatgagtgaacagattacagcagctttaacgatgaccaaacatgcaatagagttagagaaaatcgaggaagcgattggcaaactccacgcagcaaagcgcttgtatttctttggccaangcttatcggggacaattgcagaggacggcgcccacaagtttatgcggctaggg

SEQ ID NO: 5762 - DNA, 273 bp, Bacillus clausii
gttgaacgaccaagctccatgcgcgtcaacaggcccgtaactcattcgttaacgcagcagcttcttgggcggtaaagcccaatttggtggacagcgtttcggggagatggaagtatgggcactggaagcatatggtgctgcttacacgcttccaagaaatccttcactgttaaattcagatgacgttgttgggcgtgtgaaaacgtacgaggcaattgtaaaaggggaaaacgtttcctgaagcccaggggtgccagaatcgtttaaagtcct

SEQ ID NO: 5763 - DNA, 523 bp, Bacillus clausii
atgtttacgcaaccgtttattcatgcactgacagacagccaacaagaaaacaggtgccgcaattcaaatgtggacacgatttttttacttactggaaagatgcatttgctgcctgaccaagtttattgtttccagaaacagaacaaaaaagtgtttgtccatgtcgatttgatttctggaatagaaagccacacgcctgatggcatgcgttacatcgccgaagtgatcgcacctgacggcatcattagcacaaggagccaatcgattatacaggcgaaaaaatgtgggttaaagacgattcagcgtgtatttttaattgacacacaagcaatggaaaaggcggtacaaacggttaacaaaatcaagcctgacgcagtggaagcgatgcctgggttaatgccaagggttataaaggaattagttgaaatgactaccgtgccaattgtagccggcggattgtttaaaacaaagcaagaaatggaaagcgcgcttcatgcaggcgcagtagctgtgtcagctagca

SEQ ID NO: 5764 - DNA, 318 bp, Bacillus clausii
aatggcaataagaagccagctgcttaaaggagtattgccagcatgcatactagcagtgattgacaggcagcccgtttacggttacgaactcgcgcaaaaacttgaggaaagcggcttgccagaaattagcgacggtacgatctatccgatccttttgcgtctacaaaaacagaagctggtttacagcgaaatgaggccatctgaaagtggcggcccgaaacgcaaatattattttttgacagctgaaggaaaaaacgaattattgcaaatgcgggcggagtggggagcaattgccaatcctgtgtcaacaatgttaaa

SEQ ID NO: 5765 - DNA, 446 bp, Bacillus clausii
atggataaaatggatcgcgatattctgaagctgttgcaggagaatgcgcgaatgacaatcagtgaattatcaaaagaattgtcgctaagccgccctagcatgtcggaaaggctgctgcggcttaaagagaaaggcattattgaaaatttcacgacacgcgtctcactgaaaaaaattggcaaagatatactattgctgatccaagtcagtggtttaaaagtgcctgttgcggaatttgaagaaatggtgcgacaggagcatgacattattgaatgccaccgggtaacaggggaagtgagctactttattaaagcggctgtatcagatgtaggcagcatgagaaaattaattgaccgccttattccgtatggaacgatcaatacgtctactgtattaaattccccggtgccttatcggattattttgcctgatgaagagggatatga

SEQ ID NO: 5766 - DNA, 540 bp, Bacillus clausii
aaaggggttgggaaaagggctacaagcgttctttccagaacaagaagacacgcaagaagagcaaattgtacaagttgatcttgcagacgttaggccaaatccgtatcaacctagaaaaacgttttctgaagaagcattaacggaattgagcaactcgattcgcgaacacggaattttgcagcctgttactgttcgcaaagcaattaaagggtatgaaattgtaatgggcgagcggcgcgtaaaagcggcaaaacaagcaggattaaaacaaatccctgtcattgtccaggaacttgatgaaaataaaatgatggaaattgctttaatcgaaaacttgcagcgtgaagatttgaatccaatcgaggaagcaatcgcctatgagaaattaatggaacatacgaatagcacacaagagcagttagcaaagcgccttggaaaaagcaggccccatattgccaaccatatgcgattgttgcaattgccaaaagttgttcaagagttcatttcggttggcaaactgacaatgggccatggacgtgc

SEQ ID NO: 5767 - DNA, 603 bp, Bacillus clausii
  misc_feature (1)...(603): n = A,T,C or G
tgttgtgttgngggaacgctcagttncggagaagctgattnaagaatttatgctttccgctaatgagactgtcgctgaacacttccattggttaaaattaccgtttgtataccggantcgcgaagaccctgatgcggataaattcaattcgtttttagagtttattactgggtttggctatgtggttcggggcacagccaataccgttcatcctcgtgccttgcaagcacttttagaggaaatttccggcgaaccagaagaaatggtcattagccgcgtcatgctgcgctcaatgaaacaagcgaagtatgatgtccatccaggtggccactttgggttgtcagcagacttttatactcattttacttcgccaattcgccgntatcctgatttgctcgtccaccgcctcatccgcacgtactngatcaaaggcaaaacggatcgcaatacgacggcaaaatggcaggaagngctgcctggnnnaacagctcacgctncggaaatggagcggcgcgcganngacgctgaacgggatacagacagcgngaaaaaagcccaatacatggaagataaaattggcgagacgtttacagggatcattag

SEQ ID NO: 5768 - DNA, 540 bp, Bacillus clausii
aagtaagccggacgcctgtgcgtgaatcgtttctaaggctatcggaagatgatttgctcgatattcgcccacaacgtggctcgtttgtgacaaaaattgatctttctcatgtggaagatgcccgttttctacgggaacacatggaagtggctacgattcggttagcctgtgaaacagtgactgaaaaagcattgcttttattagaagaaaatgtcgttaaacaaaaacaggcaaaagagcgtgaagatgaagaggaactgtttgcattagaccgtgaatttcatcgtctcatttcagagggcacggggaaattgcggatttgggaagtcgtacaaaaaatgaacacacacttaaatagagcgctgaagctaagcatccattcaaaactaaattggaatttattgatccagcaccatgagggaatggcgcaagcgatacgcgcgaaacaagcagatgaggctgaagcgcttgtccgtgaccaccttaaattaattacgtatgaccaatacgagctaaaggaagcctatccaacttattttg

SEQ ID NO: 5769 - DNA, 234 bp, Bacillus clausii
  misc_feature (1)...(234): n = A,T,C or G
cagcatttatgcctacattgagaagcnattaggccttgccatcagctttgccaaaaaagaaattgtcgttgaagcggcgacggaggaagacgaggccatgcttgacctcgatgaaagcggccgcgtagtcgttgtcagaagctatacgtattttgacaatgccgtgcctttccagtacacagagtcgcgccaccgtgctgaccgcttccgatttgttgattttgccagacgcaa

SEQ ID NO: 5770 - DNA, 519 bp, Bacillus clausii
tcgtgattggcacaggcattggcggagcgttgatcaaagatggccagttgcaccggggatttgatctcctcggtggtgaattaggatacacactcttatccattgaccctgttcagagaacagctgtgccatttagtgagatggcctccgcttctgccattgcccgccgctacgcaacgtggacaggccagccaggggatcgtttaaccgcaagtgatgtgtttgcggcttatgaagcaggcgatcatgctgcaaaaaaggccatcgatgccttttacttttgtttagcggcaggtatccataatgtccactatgtttacaatccagaaaaaatattgcttggcggcggcatttcagcacgtgatgatttattggacggtgtccgccatgcctatatgcaattgaaagaccagctttccgactacacccttcacatgccacgctttgaacgttgccatttccaaggaaacgccaatcttattggcgctatgcaccatttcatgcaacaacaggggcaac

SEQ ID NO: 5771 - DNA, 317 bp, Bacillus clausii
atgcaaatcattatttccaacagttcaaaggagccaatttatgaacaaattacgaatcaaattaaatcggctattttatcgggtgagctgccagagggaacggcaatcccctctatgcgtaaactcgcaaaggacttacaaattagtgtaataacgacaaagcgtgcctatgaggagttagaaaaggccggttttatttattctattgtcggaaaaggctcttttgttgccgagcaaaatttggaggttatgagggagaagaagttaagggtcattgaggagcagctgagtacggtcattgcaaatagcaaggaaat

SEQ ID NO: 5772 - DNA, 383 bp, Bacillus clausii
aaacgaaagaaatgtcagaggcgattggcgtaaatccgaccacgattcaaaggtggaccaaatattttaaaattgattgcgacgtaacggaacaagggcattttctttataccgaaaaacatctgcaactatttaaaaaaataaagcgtgagcttgacgaagggaagcgcatgaaggacatcaacttgaatgaacgccaaggggtgccaagtgtacctacaaagcaatatgaagcaaagcttgaaaagatgttggtgcaagtggatgcactcgaagaaaagctagcgacaaaggccgatgacgttgtcagctaccaattgctcaagcatcgaagcgagcttgatgaaatgatgaaactggtcggaacccttgaagacaggctg

SEQ ID NO: 5773 - DNA, 510 bp, Bacillus clausii
ccaagaactcagctatcttgattcgctgctcgcgcaaatggcttctgcctctccccgcgacattgaggagattcgtgaagagctgatcgaaggtggctacattaaaaagcggcaacaaggcaaaaagaagaaaaaacaactggataaaccgcagttggaaacataccgttcttctactggcattgagtttttagtagggaaaaacaaccgccaaaacgactatttgacaaaccgtctcgcacggcaagatgacatttggctccacacgaaagacatcccaggttcccacgtcgtcatccgctcggcctcgccagatgaggaaacgttaacagaagcagcgcttgtcgccgcctttttctcgaaagcgcgtgactccgcttccgttcctgtcgattatacgaaaatccgctatgttaaaaaaccaagcggcgccaagcctggctatgtcacatacgacaagcagacgacgctttacgtaacgccaaaagaagacattgtccgctcgcttcg

SEQ ID NO: 5774 - DNA, 273 bp, Bacillus clausii
atacatgtcttttgacggcatgatgacaagagcgatcacacatgaattgcagcaattagtcggcggccggatcaataaaatccaccagccatttaaaacagaacttgtatttacagttcgagcaaaagggaagacccatgcccttctcgcctctgccaacgctgtgtttgcgcgcatgcacttaacaacggaaaaatacgacaatcccgccgagccgccgatgttttgtatgttgttgcggaaacacttggaaggcggcatcattacgtccat

SEQ ID NO: 5775 - DNA, 207 bp, Bacillus clausii
atgtaacaaaagtgtccatatcaggctatgaaaatggcaaccgcacccctgacaccgatacattacgccgccttgcagatgtctttggtgtttcaacagattatctgctagggcgttccaaagagaaaaacggctctttcttttatgacaatgaacttacacacaaagaggctcagctattgcgtgaacaccttgcctttatccgct

SEQ ID NO: 5776 - DNA, 461 bp, Bacillus clausii
atgcaattaaaccggcttgtcaattttcacaaaacgcttggagacaaaactcgtttgcgcatcattgctttgttaaaagatgggcctcttcacgggcaggcgatcgcagaaaaactcggcttaaaaccgccaactatttctcatcacattgccaagctgcgtgaaattgatttaatttaccaaaggcgtgacaaaaacacgatttatttctatttgcatgaaaagaaattaatgcaaatggcgcaagcgattgtgttgcttggtagtgaagacatgtttggagcaatcgaggtagatgaggaagtcaaacaaaaagtcatcggaaattttttgctggcaaatggcaggctgaaaacgttgcctgcacagcggaaaaagaaactgattatgcttgaatatatgacaaagggactgcggactgggaaagtttatacggaagaggacattaacaatcatattca

SEQ ID NO: 5777 - DNA, 462 bp, Bacillus clausii
atgattcctggttttggttttccgttgacagcaaaagtgctctgtgccgtccaggacggagacgtggacaaggctttttggcttgttagcggagaacaggcacagctttacaacgaaaaaacgattgctgaacaaacgcttgccttgctccgcaatccagatttatcgccaatcgaagggaagaagttaaaaagccatatgacgataggcgaggctgcgacactgacagaagtccctccttcggctatccgccattgggaaaaagaagggctgatccatccagaccgtcatcccgaaaatggctatcgattgttcactcccatgcatatccgccaaattttattgattcgtacgatgcgccggaccgtctattttcttgagaacataaaagaagtggttcacgcccttgaacatcacagcatggaagaagcgcagaaaatgacagaacaggcattgtctaca

SEQ ID NO: 5778 - DNA, 259 bp, Bacillus clausii
atgacgataggcgaggctgcgacactgacagaagtccctccttcggctatccgccattgggaaaaagaagggctgatccatccagaccgtcatcccgaaaatggctatcgattgttcactcccatgcatatccgccaaattttattgattcgtacgatgcgccggaccgtctattttcttgagaacataaaagaagtggttcacgcccttgaacatcacagcatggaagaagcgcagaaaatgacagaacaggcattgt

SEQ ID NO: 5779 - DNA, 402 bp, Bacillus clausii
atgaaccgacgtgtagcaaggctgcgagctgtgcaaacactctaccagctgactttaattgatatcgacgtggacaaagcgatcgaaaatacgctaaatgatgaagaagaaccgagcgaattttacaaaacgcttgtctatgggacgcttgaacaccaaaatgaaattgacgggtatttaagcgaaaatttaaaagggtatacgcttgaccgactgggccacgttgaccgggcaatcgcacgcatgggattgtttgagatgttgtatttagacgatatccctgtaaatgtgacgttgaatgaatcaatcgagcttgcaaaagcatttggcgggactgatgcaggacgttttatcaatggggtattgtcgaattcatatgatacggcaatgaaaaacaaataa

SEQ ID NO: 5780 - DNA, 585 bp, Bacillus clausii
atgattaaaaacggtgaatttcctgctcatagtaagctcccgtctgaaatggagcttgcagaactctttggtgtcagtcgttcccccatccgtgaggcgttaagtgttttagaagcaagcggcttaatcgagtcaaaacaaggtggcggcagctgggtcaaagaagttcaattaacgaatttgttagagcaagtgacattggatatagtcgatatcggccaagtctatgatttgctcgaactccgaagcattattgaaacagaggcagcagcattagcggctgttcgctatcaaaagcaagatattttggaattagagcttgcgctcgctcaatttgcaaaaacagtagaggatcgagaggttgtcggggatgaagccgattacatgttccatcgtgtcattataaaagcttcttacaatccatttttagagcaaacgatggcgaatgtatcagagctgctccagaaggcattggccttttcactaaaaaagaaccgcttgcaacaaaaacgcgaagaagtgtaccgagaacatttaacgatttttaacgccattcgtgagcgccattcagaggcggcaagaaaa

SEQ ID NO: 5781 - DNA, 368 bp, Bacillus clausii
  misc_feature (1)...(368): n = A,T,C or G
atgacgataggcgaggctgcgacactgacagaagtccctccttcggctatccgccattgggaaaaagaagggctgatccatccagaccgtcatcccgaaaatggctatcgattgttcactcccatgcatatccgccaaattttattgattcgtacgatgcgccggaccgtctattttcttgagaacataaaagaagtggttcacgcccttgaacatcacagcatggaagaagcgcagaaaatgacagaacaggcattgtctacactncaccaacgcaaccgagaccaattttggggcattcaaaaactaatggcgctctgccatgaagtcggactcattaaagaagagtgggaaaaatttttattttt

SEQ ID NO: 5782 - DNA, 675 bp, Bacillus clausii
  misc_feature (1)...(675): n = A,T,C or G
atgattcctggttttggttttccgttgacagcaaaagtgctctgtgccgtccaggacggagacgtggacaaggctttttggcttgttagcggagaacaggcacagctttacaacgaaaaaacgattgctgaacaaacgcttgccttgctccgcaatccagatttatcgccaatcgaagggaagaagttaaaaagccatatgacgataggcgaggctgcgacactgacagaagtccctccttcggctatccgccattgggaaaaagaagggctgatccatccagaccgtcatcccgaaaatggctatcgattgttcactcccatgcatatccgccaaattttattgattcgtacgatgcgccggaccgtctattttcttgagaacataaaagaagtggttcacgcccttgaacatcacagcatggaagaagcgcagaaaatgacagaacaggcattgtctacactncaccaacgcaaccgagaccaattttggggcattcaaaaactaatggcgctctgccatgaagtcggactcattaaagaagagtgggaaaaatttttatttttaatgtgcgtcggaagcctaatgttaaagggctttacgactggcgaatccaggaaagtagatgttggaaaaggagaaggcttgtcgcctaatggaatggtgttctattaa

SEQ ID NO: 5783 - DNA, 392 bp, Bacillus clausii
atgattaccatcgaccacgaaacaatgaaagacatgaacaaatcaacggttttccgcctcattcaaaggcacgctcccatttcccgggcggatatagccaagagaagcggattaaataaagccactgtctctgctctagtcgcacagttaattgaaaaccaatttgtctatgaaatcggtactggcgactcaagcggaggcagaaaaccagtgttgttgtattgcaacgatcgggccagccatgccatcagtgttgacattggcgtcaatggcttgctcggcattattacggacctctccggcaaaacgatagccaaacgggaaatggcgctaactagtaaagaattcaacattgttgtggttaacacagaagcaatcattgagcaattgat

SEQ ID NO: 5784 - DNA, 543 bp, Bacillus clausii
tgaattaacggatgtgctcgggatcactcatatggccgtacgcaaacacctgaatgttcttttaaaagatggctttgtccagtttcgtgaaataaagcaagacatagggcgccccctgcaaatgttttcaatttcagaaaaaggagaccgccttttcccaaaaaattatgaagggttgacagtcgactttctgcacgacattcgagaccttcatggcgacgaatccatccattatttgtttaaaaaacgggaactgcgtttaacgaatcgttattttaagcggatggtccataaatcgcctgaagaaaaaatggccgagctagggaaaatccaaaacgaaaaaggatacatggccgaagtcactcagcatgatgcctggacatttgagcttgtcgagcataactgccctgtatttgcagtcgccaaacaatttaaagctgcctgccaatgcgaaacatccttgtttaaaaatgtacttgaaacggaatcagtcaaacgagtggcatgtcaatcagacggcgacactgaatgtcggttcgtgat

SEQ ID NO: 5785 - DNA, 299 bp, Bacillus clausii
atgcgctgtcccaaatgtcagcataacggaacaagagtgctcgattccaggccaagtgatgaaagccgctcaatcaaacggaggcgggagtgcgaaaaatgtttgcaacgttttaccacctatgagacagtggaagaacggcctcttctcatcattaaaaaagacggtatgcgtgaggaatttagcagcgataaaatgctgcgcggtcttgtgcgtgcctgtgagaaacgtcccgttccccttgaaacgcttgaagaaatggtattggacgtagagcgcacgctttgcaatgaagggaa

SEQ ID NO: 5786 - DNA, 306 bp, Bacillus clausii
aaatgtcgccatcgtcgcttcacttgtaagcgaaccttcccgtgcggcgatattaaccgccttattagatggtcggttccatcccgcaagtgagttggcctatatggcaggcatcaagccacaaacagctagcttccatttagccaaaatggtcgatgccaacgttcttggcgtcgaaaaacaggggagacaccgttattatggaattcaagatccagaaattgcaaaaatcatggagtcgcttttatcgattgcgccgccacaaaaaatcaagtcattcaatcaagcctctcaagacaaagcaat

SEQ ID NO: 5787 - DNA, 180 bp, Bacillus clausii
ccatgtatgagagccgaaaaatcagtctttacgccgaaaaacaaacgcttaaacagcttcattatgagcatgagcaaatttataaggcagtcgaagcgcaagacaaagacaaagcccacgaggcaatgatggttcatttagtcaatgtggaacaagcattaatggaatatgataagcaaa

SEQ ID NO: 5788 - DNA, 573 bp, Bacillus clausii
atgaatggtaaagtggatcgaagaattgaaaggactaaaagagacattcgaatggcttttatcgatttaattagagaaaatgatgctaaggatcttacagttaaagaaataaccagcttagctaattacaatcgcactactttttatgctcattattcaggtcaagatgaattgattgaagacattattgatgatgccatacaggggtttatcagtaagattgaaccgacatttcaaaacggggaggtgcctctttcaattaaactctcttcaaccgcatctaaaacggtttttaaatacattgaagataacaaagcgatgttcagtttgctgtttgatgttaataaattccctagctttcaagaaaaactttgctctgcaataaaggatttattagagagtgacattcatttcttaaagcaatataaaagtaaattagatcgaagcttatattgttatactcaatctgctgctttagtaggaaggattaatttttggatcaaagaagggtacacatatagtgctgactacatggctgagcaaatggtggaatacttaaagctttttaaataa

SEQ ID NO: 5789 - DNA, 469 bp, Bacillus clausii
atgactgaggtctactatgcaggaattgacattggtggaacgaccgtaaagttggcgtttcttacggaaacaggcgagttaaaagataaatgggagattcccacagacgtgagcgaaaacggcaaacacattgtcgaccagatcgccgcaagcattcaaagccggctgccgcaacatgcaaccttgttgggggctggagtaggtgcgccaggattcattgaaatggaaactggttttattcaccatgccgtcaatattggctggcgcaactatccactaagagaagagctggaacgcgcccttggagtggttgtccgcgtcgacaatgatgccaatttggcagcacttggagagaaatggcgcggcgcaggggatggcgctgaagaagaattgtttatcacacttggtacaggtgtcggcggtggcattattacaagaggacaaattctccacggcgcaagtggaatgg

SEQ ID NO: 5790 - DNA, 426 bp, Bacillus clausii
tcgatttcttgattctagaatatttccagcaagatggcaagtgtacgtacagccaaatcgcccgcaagcttggtgtcagcgaggggacagttcgaaaacgggccacaaaaatgcgaaaagacggcgtatttgattttatgattcgcattaatcctttaaaggtaggctattccgtaaaagcgtttatcggcattcattcgcagttgggaaaacaacatgaaataggacaatggctaaagacgtttcctcaagtgatttatattgcatcttattcgggctatcatgatttaatcctgcaagcgtattttgaaaataatgaagcgcttgtccattttgtcaatacagagctcacgccagaaaacggaattgaaggaattgatgtcagcatccaactaaaacagtacaaagattcaatttcttatctat

SEQ ID NO: 5791 - DNA, 453 bp, Bacillus clausii
gcgaaatcgacatagggattgtgcacttgcctattaacgagaaggtcatggaaataaccccttttaaaacgacgacttgccttttttgtactagtccaacatacaaaacgcttcatgacggtacccattcattagcggagctaacccgctacccgcttgtctctttttcagcagggagcagtactcgctcttttcttgagcatttattccaacaacaggggcaaacgttttctccagagttgaaagtcgaaagcattgaactgctaattgagtgcgccaagcttggcatgggaattggctttgttgctaaagagctgatcgaaaaggaacttgagcgaagcgagttagtcgaaatcccagtcgatatagccatccccactagggaaatcgcgctcatcacaaaaaaagcagcgccactgtcaatcgcagcgcgccgcttttttaaccatttac

SEQ ID NO: 5792 - DNA, 201 bp, Bacillus clausii
atggaacaaggtacagtgaaatggtttaatgcagaaaaaggttttggttttatcgaacgcgaagatggagacgatgtattcgtacacttctctgctatccaaagtgaaggattcaaatctttagacgaaggtcaaaaagtaacgtttgacattgagcaaggtgctcgtggagctcaagcagctaacgttcaaactgcttaa

SEQ ID NO: 5793 - DNA, 624 bp, Bacillus clausii
  misc_feature (1)...(624): n = A,T,C or G
atgatcgtcttgaatatagagagtttacgaatgttttgtaaagttgcagacggagggagcatcagtcaggctgcgcgcttaagttttgtaacccagccagcggtaacaaaacaaattcgccaactagagaacagttatgggacggctttatttgatcgaactgaaggaaaaatgttgctatcagaagcaggagaacaattatatccctatgcaaaggaaatagtggaaagttatgataactcggtacaagctcttcaagaagtgatagggattcgagatcctaaactaaacgttggagcaagcttaactataggtgaatatttgcttcctggcctattgggaaactttcaacaaaaacatgccgatattaaattcagtttattaattggaaatacaccatatatattatcgaaacttgaagcaaatgaaattgatattgcgctcatagagggacgcgtcaatcagtctgaatatagcctgaaaaaatttgcagttgatgagctgattctcgttacatcttacaaccatcgttggaaggaaagagaatcaattgacattcacgaacttacagaagaaaaaatgctttggagagaaaaggattcanggaacaagattgattggtga

SEQ ID NO: 5794 - DNA, 288 bp, Bacillus clausii
cttccgatatatgaacaaagcattaccaaaaccctaagcttaatttaacccgtgtagcagagcatgtcggcagaaacccttcgtatttaagccagttgttttccatacggctcaaacaatcgtttcgccacgcgttgcaagacattcggattgccgcggccaaggaactccttgctgaccctatgctggccatcggtgagattgccgaacgggtaggctatgcaaacccagcctatttttcaaaagcattcaaaaaacaaaccgcatacagtccgaaccagtaccgta

SEQ ID NO: 5795 - DNA, 540 bp, Bacillus clausii
atgacggacgaagagctcgcacgaaaagcaattcgcggcgatgtagccgcttttgaatctttgttaatggctcattatgaaaagctttactataccgcaatgaaatacaccaaccaacataatgatgcccttgacgccattcaagaggcaagctgcaaagcatacttatcgattcacaaattgaaccatccacaatatttcatgacgtgggtgacaaaaattctcattcgtgaatgctaccaactgctgcaaaaacaaaaggaaatgatcccttttgaagacgtggatctattcaaaaagttagaaggcaatcaagaagcgccagcacatgcttcatcgttatcagccgccattcttgatctcgatcaaaaataccagtcggccattatcgtgcattattaccacgatctccctatcaaagaagtcgccgacattatgaaaaaaccacaatcaacaattaaatcctacctgcttcgagggagaaaacggatgaaagcctattttgagaggagcgaacgtttgcatggaaccatcatttga

SEQ ID NO: 5796 - DNA, 280 bp, Bacillus clausii
atgaaatcaacaggtatcgtacgcaaactggaccaactaggtcgaattgtaatcccgaaagagcttcgcagcatgctgaatattgaaattaaaactccgcttgcgatactaattgatggagaccaaatcgttttagaaaaatatcagccatacaaagcatgtatggttacaggcgaaagttctgatgaaaatttgacacttgcaaacggaaatattgttttaagcaaagaaggagcagagcaaattattaaagaactgcaacaacagcttgaaagcaccg

SEQ ID NO: 5797 - DNA, 486 bp, Bacillus clausii
aaggaaaagggacatttgtgaatgagaaaaaaatccaaacacctgtgtttagtttttattatcctgaaaaattcggaaaaaaacacaccgttttgtcagctcaggaaatagcttgctcggcgacagtccagtcggcattgcaactatttcctggcgaacttgtctatgagctcatccgtctccgctattttgaggatgaagttgtcgctgttgaaacatcttatttaccgagtgcagcggttcctggcttgttgcagaaaaatcttgaaggcactctttatgaactattgattactcagtacaatctgcaaatccaagcatatgacaccacggtagaaccggtaatcctaacccagttggaaaccgaacgcctacaagttgaaggtaacggacagcctgctttaaaaattacaaaaatcggctcaacatggaataaaaagcgcttaattctcacgaaaagcattttcagaggcgaccgctgtaaac

SEQ ID NO: 5798 - DNA, 278 bp, Bacillus clausii
atgaaatcaacaggtatcgtacgcaaactggaccaactaggtcgaattgtaatcccgaaagagcttcgcagcatgctgaatattgaaattaaaactccgcttgcgatactaattgatggagaccaaatcgttttagaaaaatatcagccatacaaagcatgtatggttacaggcgaaagttctgatgaaaatttgacacttgcaaacggaaatattgttttaagcaaagaaggagcagagcaaattattaaagaactgcaacaacagcttgaaagcac

SEQ ID NO: 5799 - DNA, 151 bp, Bacillus clausii
atgaaagcaacaggaattgtacgacgcattgacgatctcgggagagtggtcatcccgaaagaaatacggcgcacgttgcggattcgcgaaggcgaccctttagaaatatttgttgatcgtgacggcgaagtgattctgaaaaaatactcgc

SEQ ID NO: 5800 - DNA, 459 bp, Bacillus clausii
aatactccattggggaatttgcaaaactgactgggattactgaacgaacactgcgacactacgatcaaacagggatattgaaaccttttaactacacggaacatgggcatcgagtttataacagcagatccattgtccagcttcagaaaatattagtgctaaaatttttggatttatcactcggagaaatttcagaatacttagagcgcccggaacaagatttagcacagtcaatggtcgagcagaaaaatatgctgctagaaaagaaaatacagattgatacagtgatacaaatcattactcgtgttcaaggaattgtttcaggttcagatcctgtagatgaacaatcattgcttgtccttattcatgccttaaaaaatgcagaggtacgaaatcgctggataactgaacatgagtccgattctgtgtataataaactacactcacatacagaaaaac

SEQ ID NO: 5801 - DNA, 504 bp, Bacillus clausii
atgatcggtgtcacccctgcctacatttcgcaaattgaacgcaatttggcggagccctctttgtctgtttttcgtaagctggccacaacgctaaacgtcgaattgctgtccctcctggagtttgaagcgccgtcagaaattttaattacggcagaggaagagacgatcgtaaaaacatttccagaggctcatgccaaatatcggctactgtcgccaccccaattgaagaacggggagaagccggatatgtcggtcatggtggtggaaatcgcagcgaagcaaacggattacgacgagatggtcacacatgattttgtggagttttgctatgtgctggaaggctgcatcgagtataggacgggttcaagaacctatagcttgtccgaaggggatagtatttatctaaaagcaaatgtaccgcatttcgtttacaaccccggtacgcaagaagcaaaactgctggccgtgctaggcaatattcatccgcatgtacagaaggattga

SEQ ID NO: 5802 - DNA, 559 bp, Bacillus clausii
atgatgttggccattgatactggcaattcttcgatcgtaacaggcgtctacgacgagaacgaccaactggcattcatatttcggatcgcaaccacgcacgataaaacgagtgatgaatatgccatgttgctgcactctttttttgagcaaaaaggttgccgtttcaacgacgtcaccggtgtgatcatcgcgtctgtcgttccaacaattatgcaccgctttcgccgcatgtgccaagattatttacacgtaacccccttaattgtcggacctggcattcgcaccggcctttcaatccattatcaagatccgaaagaagtcggtgccgaccggattgctaatgccgttgcagcaattgctcgctacggtgctccgtgtattgtagtcgacattggtacggctacgacattttgctgcattgatgcaaagcaccgttaccgagggggcgttattgcccctggaaccggctattcgacggcagctttgtcgaataaagcattctaaaattgccgaaaaatgaaccttaccaaagccggcattttggttgtagggaaagacc

SEQ ID NO: 5803 - DNA, 543 bp, Bacillus clausii
ttatgttagcccatacattcaagcgacgaaccttccctacttggatatttgtgccgatgaagggtgggggaaaaatattattgactgtacgttaagcatccatcgatcgattgaagagcagcccccttattatgaaattgatgtcactaccaagatggtggcgatatggaaacttctaatctcaaatggactgcgattagaatacgaccagaacaagatgatgcaaaatcgacgagtaaagggaatgcttcaatggattcatagccactttggagagaacatttccttagatgatatagcaaaggcagggcagctaagccgctctgaatgttgccgctattttaaacgaatgctaaaaacgtccccccttcaatacgttactgattaccgtatccaaaaaagcttgcctctcttgcagcagccaaacgcaactgtaacggacgtagcttatcaagtaggttttaacagcacaagctattttatcgctcgattccgaaaagtgatgaacatgacaccacttgcctacaaaaaatcgaaacttaa

SEQ ID NO: 5804 - DNA, 1029 bp, Bacillus clausii
  misc_feature (1)...(1029): n = A,T,C or G
agaagagctgcttgcctattttcaaaatgaggcgaaaaagcctgttacagtagatgaattagaagagcagttcggcatagcttctggcgacgactttaaaaagttgatccaaggcttgaatgaactggaagaagaggggagcattgtgcgcacgcggacaaaccgttacggcatccccgaaaaaatgaatttagtgcgtggccgtgtccaaggccatgcaaaaggattcgcttttgtgttgcctgaaaacggcgaggaagacatttatgttccacaaggctccttggcaggggcaatgaatggcgatatcgtccttgtccgtatggatgaacggacaagcggcgcccgggctgaaggaaaagtgatccgcattattgaacggaaagtgacagaagtcgtcggcgagtataancagttttcttcgtatgcgttagtcgttgccgacgacaaacggattagcgcagactttcttgttgtcaacggccaggaaaaaggcgcagttgatggccataaagtaatcgcgacgattaccaaatatccagaagggcgtttcggcggagaagcagaaataaaagaagtccttggccataaaaatgacccaggcatggacattctgtcgatcatttacaaatatggcatcccgcaaagtttttccgaagaagcgcttgcacaagcggcaaacgtgccagatgagattacagaagcagacttgcaggacaggcgcgacttaaggaacgagcaaatcgtcaccattgacggggctgatgccaaagacctagacgatgctgtacaagtaaaaaaattggaaaacggccattttttgctcggcgtacacattgctgacgtttcccattatgtcgaagaagggtcgccgattgacaaggaagcgtctgaccgcgctacaagcgtctatctagttgaccgtgtgattccgatgattccacaccgtctttcaaacggcatttgcagtttaaatccaaaagtagaccgtttgacgctgtcttgccaaatggaaatcgacgaaaatgg

SEQ ID NO: 5805 - DNA, 264 bp, Bacillus clausii
cgttatccaagtaaatgtcgaagaagcatcggtcgactttgaaattgtcggtatgcagccccgcaagccgcggaaaatacttgagcggccaaaagtgattgatggcggaaaaagacagcaacggaacggaaaaaaacgtgacaagaatcgtttgacaggcgatccaaataaagatggcagccggtcaaaggcaaagcggaagaaaaagccgttttatgaaaacgcccctaaagcgaaacgaaaaaaaggccgtcgtaaaacgcg

SEQ ID NO: 5806 - DNA, 553 bp, Bacillus clausii
atgtctgagaagattgatcgaagaaagaaatatacaaaaatggttttaaaagaaagcttggttgatttgctgaaagaaaaaccaatttcctctgtgacagtcaaagagctatgcgagcttgctgatattaaccgatcgacattttacagccactatgccgacccttatgacttgcttacgacgatcagtgaagaagtgatgctcgatatggaccatcatttgaacgagtatcattgtggcaaagaagaagaagctttgcatatgacagaaaagattatggagtatatcgccgaccgaagcgatatatgccaagtgctgttaagtgggcacggcgatgccacatttaaaaagcgaattatggagctcgcaaaaaaacacatattagaaaagtggatcgaccagtacaaattgcgaggaaagctctctccttatatcccgttaatgattgtgagcggggcgattgacgcgattgaaagctggttagtcggtggcaaaaaagaaagcccagcagaaatggccgtattggtctaccaatttacaaattatggcttag

SEQ ID NO: 5807 - DNA, 342 bp, Bacillus clausii
atgagtatggctgaatacaaaggcaaagtgaaacatattcaagatacgccttttggttacacattgtctgttattggcggtaaatggaaaatggttattatttaccttttggcggaaaacgaaacggtacgcttcaatgagttgaaaaggcaaataggaacaattacttataaaacattaagttcgcaactgaaagaattggaagctgatggcatggtgaaacggaaagagtatccgcaaatccctcctaaagtcgagtacagcctcactgaaaaagcagagacattattacctgttttggaggaattatgtgaatggggagtcgctaaccaaaacaattaa

SEQ ID NO: 5808 - DNA, 454 bp, Bacillus clausii
gtgggtgttacgatcaaagatgttgccaaaaaagcaaatgttgccccttctaccgtgtcacgggtaatcgcgaacaatccaaaaatcagcgcaaagacaaaagcgaaagtccaggcggtaatggaagagttaggctactacccaaatgtaaacgccagaaaccttgtgaacaaccgcacaaatgttgtcggcattattatgccaagtgtttcttacgcgccgtttcaaaatccgtttttcccggaagtgttaagaggcatcacagcacaagcgaatgagaaaaaatacgggctgtatttatcgactgcgcaaaccgataaaggcattttagaagaagtcatcgaaatgtactatacacgccgcgtcgacgggatgattttgctgtattcaaccgtctctgacccaatcattgagtttttgctggaaaaagcattttccttttgtcgttgtgggc

SEQ ID NO: 5809 - DNA, 732 bp, Bacillus clausii
aaaagagctgtccgctcgcgctggggtcagtgaggcaagtgtcatccgcttctgcaagaaaatcggaattaacagtttccggctgtttaaaatggaactgatgaaagatgtaacggcttcaaaagaaaggttgaccgacttttcatcgttgcaagaaaaagacgcgccttatgatttgttccgcagagtgacgtttacgaataaaagcgcgatcgaattgtcactatcatcgatagatcggaagcagcttgaagctgctgttgctgccctaatgacagcgaagcgcatcgtcttttacggagtcggcggctctgccgctgctgcattcgacggcagctataagtttacgcgaatcggctatcaggcatcttcttctcaagatttccattacaatctctcgctcattccttatatggaaaaaggcgatatatttgtggcaatcagcttgtctggaaaaacgcaggatgtagtggaattggcctcattcgcaaaaaagcaaggcgtcaccgttgtggcgattacgaaaatggaacgctcgccattgtataggttggcagatattactctttgtacgccaaatgtggaggaagacttccgcatcggcacgatcgcctcgcgaatgacgcagttgaacattattgatacgctttatttaagtgtattccatgaaaaagacgaagacacgattaccgcgtttttaaaagcccgtgacgaagcattgcgcttacgccg

SEQ ID NO: 5810 - DNA, 323 bp, Bacillus clausii
atgaaaattagcgaagtcgccaaaacgttaaatttgcccatctcgaccatccgttactacgaaaaaatgggcatcgttccggaacattatgtgaccagggacgaaaataattatcgccattatgatgaaacaatcatccaccaccttcaagtcgtcaaaacgctcttagcagttggcttttccattggtgaagtgaggtcgatgattgagcggaacggatttacaaaggaagagcatactcggatactcaaagcgaaaattgaggaaatcgaagaagcacaaaggaaattagagcagtctaagcaatatctttacgacattct

SEQ ID NO: 5811 - DNA, 281 bp, Bacillus clausii
ttgcagatatcgccaaaatcgcaggggtagccaaaagtacggtatcacgctatttaaatggtggttcggtcagcgatacgacaaggcttaaaattgaacaagtaatcaaggaaacggggtacattccgaactcatttgcccaaagcttaaaagcaaagaagacaagcatcatcggtgcgatcgtcccccggcttgattcattctcagctgcacagactgttaccggcatggaagaagaacttagagaaaatgggtaccagatgctcatccttaacaccaac

SEQ ID NO: 5812 - DNA, 342 bp, Bacillus clausii
tcggttgccgattcaactagatgagtcaagccgcacccccatttacgatcaaattgaagcacagctgaaatcgctgattgtgagcggccaacttccggctggaacggcattgccgtcaaatcggaaactagcagcgtcactgtcttgcagtgtgattacgacgaggcggtcataccaaaaccttgagcaacaaggctacattaaaacgatccaagggaaaggaacgtttgtgagcgaaatgagtatgcaagaccagtcggagcaaaaacaagaagcggtgcaaaaagcgttagagcaagctgccgcagtagggcgcagctatggttatagcaaggaagagct

SEQ ID NO: 5813 - DNA, 282 bp, Bacillus clausii
  misc_feature (1)...(282): n = A,T,C or G
caagcccaggagactttggcgaccgtccaggcaagcagaatccgccaacttggtttcacaatacgagaacacaatatggngcccttaaaacgtggacggtgacgaaaaagcaagcgctgcttgaccacttgcctgttaatccagtcacgattgccgatttgcaactagaggatcatccttgcattacggttcgtatcggtattaaggaaaatgcgctccataaaggcggaatcaatttatttggaaaagaatttggcgatcatccccaagacttgaaattag

SEQ ID NO: 5814 - DNA, 465 bp, Bacillus clausii
  misc_feature (1)...(465): n = A,T,C or G
attgattgcaacgttaagcgatgaggggaccattcgcggtgcttcccgcaagttatacatatcccagcctgctctcagccagcggcttaagcaaattgaacaacgctttggggaaccgctgtttatccgcacccacaaatcactcattcccacaccagtcggggaagaagtgattgcctttgccaaacgccgtgttcaagaagaaaaacaactacaagaccgtcttagcaagntgacaggaaccgtacgcggtacgctttcantagggatntcatctgtcattgcccaatatgtattgccaaagccgttgcgtgcttatgtgaacgcttatcccgatgtcaaaatcgatttgcataccggccttagttttgctatttatcaaaacaggcatcatacgcacctttcgattatccgcggcgatgtcgatgataaagaagggcttacgctgctattttctgaacggct

SEQ ID NO: 5815 - DNA, 549 bp, Bacillus clausii
agagttgtccattcatgaaccagtgagattgcgcaaggtgtgccatgcgttgtcgacggatgtccgcgtccgcatggttgaactactaagcaaggaaacgtatagtgtgcatgagttagccaccctcatcggcgtccctatttctacagcggcgtcaaacgtaaatgtgctacaagaggcagggctcattttaaccgaactacgcccagctagccgcggtgccatgaaagtgtgtacacgcaactttgatgacatccatatcgccttaaatgatggtagtcataggactgaaaagcgcacatacgaaatcaatatgccaatcgggcactatgttgacttttctgttacgccgacatgcggcatggcaaacagcgatggcgtcgttttaaatgaagacgatcctgtccaattttaccatccagaccgttcaactgcacaaatgatatggacgaggactggcttttttgagtataaatttccgttcgccctaaaaccaaaacagaaaatagccagtttgcttttttcctgtgagttgtgttcagaagcgcc

SEQ ID NO: 5816 - DNA, 633 bp, Bacillus clausii
cgactctaagaggatcccccgccatattgcaaagttttgagcctgcaggcgtaggggcccgttcccttggggaatgcttggccttacaacttaaacgaatgcctgattgccatcctcttgcgattgacatcgtcttaaaccatctcgaagcgctagctgcccggaagtggaagccacttgcgaaacaatacggcgtcgctgttcaagctatacagcaactatacgaccaattaaaggagcttgacccaaagcctggactacgttattcgaaggaaacggccatttacgtccagcctgatgtgctgatggcaaaggatgaatctggaaagctgcttgtcttcatgaatgatgacatactaccagccattcgcgtacatgaggaatacgaccatttgttgaaacaacaagtcgagacaagcgcgtacgcgaagcaaaaaaagcagcatgtcgagtggttaaagcgcagccttgaacaacgccagcaaacggtgcgtcgcgtggcggaagtgttggcgagcgagcaggcagactacttgcttcagcctaatggggtgctcaagccattgacgttaaacgatgttgcccaagttctcggcatccatgaatcaaccgtaagccgggccaacagcaaat

SEQ ID NO: 5817 - DNA, 471 bp, Bacillus clausii
atcgaagacttttagtaaaaatcgcccaaatgtattacgaggaaggggcgacacaatcggaaattgcccaggccattggtgtaagtcggccgcttatttcaaagtatttagcgaaagcaagggagttgggtgtggtagagattatcattcatgatcacgacacacatccatttaccggattggaatcgaaagtagagaaacgctatggattacgggaagttgtttgtgtagaatccaacgaaaatgatgcttctaaagcgcggatgggacaagcggcaagcacttatttgttgcggatgattcgcgatggccagacaattggcatgagctctgggacgactttgcatgaagtagcgatggcattgtcatctagccagcactttccaaacttgcaattcatccctctcgtcggtggaatggggcatgaaagagtcgacattcatgccaaccaaattgttgccaagctggctg

SEQ ID NO: 5818 - DNA, 321 bp, Bacillus clausii
  misc_feature (1)...(321): n = A,T,C or G
acattgctaaaaaagccggtgtttcccaagcgaccatttcgaaaatcctaaatgattaccctgatgtgagccagaaaacaaaagaacgggtttttcgaattatggaagaagcaggataccggccttcccactctgcccgcacattggcgcaaaaaacgtcaaagctcattggcgttatttacgcagggcggataaatgccgattttgaccacccttttttantgaaattgcnaacccctttnaacngnacannnggntncccgggttccaattgttgtttttttccnannaaacnttcccaaagggnaaaaaaatttctat

SEQ ID NO: 5819 - DNA, 364 bp, Bacillus clausii
atgaaatcttcacttgatgaaaccaaacccatctttcaacaaatacgagagatgattgaagatgacattgtgaatggcacactgacagaagaagcacaagtcccgtcaacgaaccagctagtggctgcttatcaaatcaatccagcaacggttttaaaaggattcaaccaattggttgacaatggcattttgtacaagaaaagaggcgttggcatgttcgtcaaaagcggagccagaagcaagcttattaagaagcgcaaacaggcatttaaagaaagttatgtccgcagcatgctgcaagaagcgcgaaaacttggcattactgacggagaattacacgaaatgattaagtcgataggaggag

SEQ ID NO: 5820 - DNA, 375 bp, Bacillus clausii
atgaaatcttcacttgatgaaaccaaacccatctttcaacaaatacgagagatgattgaagatgacattgtgaatggcacactgacagaagaagcacaagtcccgtcaacgaaccagctagtggctgcttatcaaatcaatccagcaacggttttaaaaggattcaaccaattggttgacaatggcattttgtacaagaaaagaggcgttggcatgttcgtcaaaagcggagccagaagcaagcttattaagaagcgcaaacaggcatttaaagaaagttatgtccgcagcatgctgcaagaagcgcgaaaacttggcattactgacggagaattacacgaaatgattaagtcgataggaggagaaatggaatga

SEQ ID NO: 5821 - DNA, 225 bp, Bacillus clausii
atggacactccatgttttgtcgcgaataaaccgtttaatctctcctaccactgtaggaacagcgaacgattcaaagcttctgccatagtcttcgttataacggtttcattgcggcgagaaggccgaccatgccgacttgatacaagtcttcatcgtattcccgcccttttgaaaacttccttgaaagggagcggacaagcgcttcaaaatggtttaccaatttga

SEQ ID NO: 5822 - DNA, 420 bp, Bacillus clausii
  misc_feature (1)...(420): n = A,T,C or G
aaagcacggatacgctaaccattgagttgcaacgttcccttatgttcatgaaattgccgagtacctttcaagttacngangaagaagtgcttgagacaatggaaatgagcaaaagctaccaagcactatccgtcaatcgccctcttgaggcagaccaagaaggtggggaagtgacgctccttgatctcgttggcaatgaagaggctggctatgagcaagctgatcaaaaattattgcttgaaaaagcgtttgaagtgctaaacgaacgggaaaaggacatccttcaatgcacctattatgagaatttaagccaaaaagagactggcgaaaaattgggcatttcacaaatgcatgtatcccgtttgcagcgccgtgcacttcaaaaactgcgcgactccatacgtgtggagcctacggaga

SEQ ID NO: 5823 - DNA, 351 bp, Bacillus clausii
  misc_feature (1)...(351): n = A,T,C or G
ttggaatgatagcaagggcattagattctatcagcaatatcgagtttaaagaatttgaccttacaaaaggacagtatttatancttgtgagaatctgtgaacacccaggcatcattcaagaaaaactagccgagatgataaaagtagatcgtacaaccgcagctcgcgcgataaagaaactggaaaagaacggttttattgaaaagaaggaggatgcacataacaaaaaaataaaaaaactctttcctacacagaaaaggggagcgtgtttatccttttataagaaaagaaaatgattatnccccataccgttgccttaacacggattttctgaaagtgaagcagaaacca

SEQ ID NO: 5824 - DNA, 387 bp, Bacillus clausii
tgtgtgcaaaaaacgtattttacgctccgatacgttgcaaacgttagaagtccggtatgcgctcgagcgcgagggagctcatctagcagcccaacggaggacagacgacgaggcgaacgaacttctgcttcagttggaacgttgcgaggctgcagcaaaacgcggtgacattgatcgctttgtaacagcagacattcatttacatcaaacgatcatccatgcatctcacaatgaaatactaattgaaatttacagccatatcggtgaagcaatgcacgattcgattacaagcctaactcgttatgaagtcgatgccgacttcgtggaaatgcatcggcaattggtcgaagcgattgtcgctcaggacggtgatcgtgccgtggcagc

SEQ ID NO: 5825 - DNA, 576 bp, Bacillus clausii
ccgtggggaagtgacgcttcttaaagatcaggggctcattgaactgacgacggctggcatgcgcctaactgaagcaggcgaatcgttgtttttagagcttgccgatatgatggcagagctgcttgggcatcgccggctggaagaaaagctggaagaaaagcttggcgtcggccaggcgattgttgtcgctggcgatagcgacgaagaagaatgggtgaagcaggagttaggtagagcttgcgtcgatgaattgaaacgtgtggctaaaaaaggcgacgtcttcgccgtaatgggcggcacaacgcttgccgcagtagcaaatatggtcacgccagatgagacgctagcgacaacgacgttcgtgcccgctagaggcgggttgggcgaaaaagttgaaatccaggctaataccattagtgctgagtttgccagacgctcaggagcttcttaccggctgctgcacgttcctgatcaattaagcgaagaagcataccattcacttgtattggaacgatcagttagggaaatcctagatgtgattacgtcttctgcggttgtcatgcctggcatcggcga

SEQ ID NO: 5826 - DNA, 879 bp, Bacillus clausii
  misc_feature (1)...(879): n = A,T,C or G
tgcaaagttttgagcctgcaggcgtaggggcccgttcccttggggaatgcttggccttacaacttaaacgaatgcctgattgccatcctcttgcgattgacatcgtcttaaaccatctcgaagcgctagctgcccggaagtggaagccacttgcgaaacaatacggcgtcgctgttcaagctatacagcaactatacgaccaattaaaggagcttgacccaaagcctggactacgttattcgaaggaaacggccatttacgtccagcctgatgtgctgatggcaaaggatgaatctggaaagctgcttgtcttcatgaatgatgacatactaccagccattcgcgtacatgaggaatacgaccatttgttgaaacaacaagtcgagacaagcgcgtacgcgaagcaaaaaaagcagcatgtcgagtggttaaagcgcagccttgaacaacgccagcaaacggtgcgtcgcgtggcggaagtgttggcgagcgagcaggcagactacttgcttcagcctaatggggtgctcaagccattgacgttaaacgatgttgcccaagttctcggcatccatgaatcaaccgtaagccgggcaacagcaaataaatatgcacaaacacctcgtggcttagtcgaattaaaaggattgttctctgcccatgtttcaaagtcagataccccaatttacccaatcaccacgtttaaagtgttggcttaaagaaatgaattagccttnaaggataaaagcaaacctttgtcagacccaaaattagcggagcagttgagaatcgaaaaaggagtagctttgtcgcggcgggtagtagcaaaataccgcgatgaacttgggattttgccatcttcgaaacggaaacgctaca

SEQ ID NO: 5827 - DNA, 240 bp, Bacillus clausii
agttatggaaacaatgggatgacgaacattcagaagtagctgctgaagcgttgatcgaacactatatgccgctagttgcttaccatgtgcaacgcatatcgaatggcttgccgtcatcgatttcaaaagatgaactgaaaagccacgccttaagcggcctgctagatgcaattgccaagtttgattccaagcgagcgctaaaatttgatacatatgcatcgttttcgaatccggggagcg

SEQ ID NO: 5828 - DNA, 210 bp, Bacillus clausii
  misc_feature (1)...(210): n = A,T,C or G
agatacggaaaatntattaaagacaggcagcattatngacgcngctcatnaagtgtggtcactgtcgaanaaacaggcagaacgntcaaacggactccatatccaagatcgccatcattagcaaaaagcacggcaagtgttagccagcgaactggtagctgtccaagatttttcagaagaacaggcctatgaatttattgacaacaattt

SEQ ID NO: 5829 - DNA, 303 bp, Bacillus clausii
atggatccaattgaagtgttcaaggcgttgtctaacgagtcgaggttacagattttacagtggcttaaggagccggaaaaacattttgtgccccatgaaggagtggatatgagggaaatcggggtgtgtgtcagtcaagtgacggataagttgaacatgacacaatcgacagcgtcgcagtatttgtccattctacagcgggccggactgattcgaactgagcggatcggcaaatacacgtactacaaacgagacgaagagaagatcagcgagttggctgcatatttgaatcagaaactctaa

SEQ ID NO: 5830 - DNA, 871 bp, Bacillus clausii
  misc_feature (1)...(871): n = A,T,C or G
gtggattggctagcgaatttgaacagggctatgcaatacattgaagatcatcttgctgacgatcttgacttgaaggaggccgctaggcaagcttgttgttcagactaccatttttcgagaatgttttcatttcttgctgggattccgttatctgaatacattcgccgtagacgcctaacactagctgcattcgagcttcagactagcgattcaagagtgatggatgtggcgatcaagtatggctacagctcagcggacgccttttccagagcctttcaagcattgcatgggatgacgccgtcactggcaaaatccaatggtcattcattacaagcttatccacgtatgactttccaattaaccgttcagggaggaagcgtcatgcattatcgtatcgtagagaaggaagcattccgaatcgtcggtattacgaaaagggtacctatccaatttcacggcgtcaattcggaaatcgagtcgatgtggagtcgtttaacatcagaagatatcgcgcagctcaaagccctttcgaatctggaaccgcatggactggttcaagcctcggtgaatttttcggaggagcggatggaggaaaagggattgcttgatcactatatcggcctggcaaccagcaaggagtgtcctgaacacttgacgaagttggaggtttccaaaaggacttgggctgtattcgaagcggtcggcccttttccagatacgttgcagaacgtctgggggcgtatttattcggaatggtttccctntgccagctacgagttggcaagagggccagagatgctatggaatgaaagcaaagaattaacctcgccaacgtttcgaagtgaaatttggatacctgtcattaaaaaac

SEQ ID NO: 5831 - DNA, 487 bp, Bacillus clausii
  misc_feature (1)...(487): n = A,T,C or G
atggaccaaaaagattgggaattaattaatgcgctgtataaatacaaaaatttaaccaagacggcagaaaagctatttgtttcacagccatccttgagttaccgattaaagcgaatggagcaggaatttcaagtggagctgtttttcaaaacgaaaaaggggatcgggtttacggcagaaggagaatatcttgctgaatgcgcgaatgaaatgctagagaaaatccaacaaacaaaagaccagttgctgcacatgcaaaagcatgtaagcggaacgcttcgcattggcgcatcaagcaattatgcccaatacttactgccaaaagtgctcaaagggttttcaagccactatcccaatgttcgtttccaagtccggacaggatggagtacgcaagtattagaacatttgcaaagcgcttccgtccatgttggtattttgcgcagtgactttacatggccaggnagaaaagcatctacttgggagaaga

SEQ ID NO: 5832 - DNA, 585 bp, Bacillus clausii
atgccacctaaaaagaaattttcaacggaacaaatcattgaagcggcgtggagcattgcgaaagaggaagggatcgacagcatgacgatccgaaaagtggctgatcggcttggaagttcgattgctccgatttacgtgaatttttcggatgtagaggagcttaaacaagcagttgtaaagaaagttagccaaatcgggcaacagatgatccatgagcaaaatacaggcagtccattcggtgatatcggagccgcgagccttcaatttgcccaggagtatccagcgttggtccgagatttagctatgaagccaaacgattacttgaaaaattatgatcaggatatgggatcagagcttgtaaacaatatgaaaaccgatccggagttagcaggttttgaagaacaggaactgagaatgattttgctcaaaatgagggcttttcaaacaggattaacaatgatggttgtcaatcggcagctgccacctgagtttgatttaaagagcatgaggaagcttttggatagcgttgccgaagacgttgtcattgctgctaagttacgcaagcaagaggattcgtccgactga

SEQ ID NO: 5833 - DNA, 1245 bp, Bacillus clausii
  misc_feature (1)...(1245): n = A,T,C or G
tagaaaatgcgaaaagcttgcttgaatctcgctttttcgatcctaagcgttatgacctcgcaaatgtcggtcgttataaaataaataaaaagcttcatatcaaaaatcggctatttaaccaacgtttggcggaaaagcttgttgatccggaaacaggcgaagttntagctgaagagggaacacttnttgaccgcagaacgttggataaactgatcccgcatttggagaaaaatgttggtttccgtacagcccgtacatctggcggcgttcttgaggaatccgacgtcgaaatccaatcggttaaaatttatgtagcagatgactacgagggcgagcgcgtcatttccgttattagcaacggcatggttgaacgtgacgtgaagcatattgcccctgctgatatcatcgcttccatcagctatttcttcaacttgctgcatggtgtcggcgatacagacgacattgaccatttgggcaaccgccgtctccgttcggttggggaactgttgcaaaaccaattccgaattggcctttctcggatggaacgcgtcgtccgtgaacggatgtcgattcaagacccgaatgtaattacgccacaagcgcttattaacattcgcccagtcatcgcatcgataaaagagttctttggcagctcgcagctttcacagttcatggaccaaacgaacccgctcgctgaactgacgcataagcgccgtctttccgcgcttggcccaggcggcttaactcgtgagcgcgctggaatggaagtgcgtgacgttcactactcccattacggccggatgtgtccgattgaaacgccggaaggtccgaacattggcttaattaacacgctgtcctcttatgcgaaagtgaatgagttcggctttatggaaacaccatatcgccgtgttgaccctgaaacagggaaagtgacagcgcgtatcgactatttaacagccgatgaagaggacaattatgtagttgcccaagcaaatgcgaagctgaatgaagacggatcgtttgtcgatgataacatcattgcccgcttccgcggtgaaaacaccgtcgttccttgcgaccgtgtcgactatatggacgtttcgcctaaacaagttgtctctgcggcgacgtcatgtattccgtttttggaaaatgacgactcgaaccgcgcactaatgggcgcaaacatgcagcgccaggccgtgcctttgctcgttccagaagcaccgcttgtcggaacagggg

SEQ ID NO: 5834 - DNA, 1080 bp, Bacillus clausii
  misc_feature (1)...(1080): n = A,T,C or G
taagtgagcgcctagtcaaagatgacgtttatacgtccatccatattgaggaatatgaatcgggatgcccgtgatacaaaactcggacctgaagagattacggcgcgatattcccgaacgttggtaagaatgcattacgcaaccttgatgagcggggaattattcgcatcggggctgaagtcaaagatggcgacattcttgttggtaaagtgacgccaaagggcgtaacggagctgacggcggaagaacgcctcttgcatgcgatttttggagagaaagcccgtgaagtgcgggatacttcattgcgtgcaccgcatggtggagacggaatcgttcttgacgtgaaaatctttaaccgtgaagacggcgatgaacttcctccaggcgtcaaccaacttgtccgtgtctacattgtacaaaagcggaaaattaaccagggcgataaaatggctggccgtcacgggaacaaaggtgttatttcccgaatcctgccagaagaagatatgccgtttttaccagacggaacgcctgttgacattatgttaaacccacttggcgtgccttcgcggatgaatatcggacaagtgcttgaactccatcttggtatggctgcccgcaagctaggcatccatgttgcgtctccagtatttgacggcgccagtgaagaagatgtttggggcacattggaagaagcaggcatggcccgagacggaaaaacaattttatatgatggccgtactggcgaaccgtttgacaaccgcgtattcagttgggattatgntatatgatcaagcttgcccatatggttgaacgaccaagctccatgcgcgtcaacaggcccgtaactcattcgttaacgcagcagcttcttgggcggtaaagcccaatttggtggacagcgtttcggggagatggaagtatgggcactggaagcatatggtgctgcttacacgcttccaagaaatccttcactgttaaattcagatgacgttgttgggcgtgtgaaaacgtacgaggcaattgtaaaaggggaaaacgtttcctgaagcccaggggtgccagaatcgtttaaagtccttc

SEQ ID NO: 5835 - DNA, 603 bp, Bacillus clausii
atgctgtttcatccggagcaagtgcatgacggaaagtcacaggaccgaagcggcattgattatgtcatgatttacatcgatcctggtcagtttctcgatttgatcggcaaaaaagaggttgttaaattctccgcacctatcgtgtacaaccagaagctgaagcagagtatattgaacttggttcaggcgatctacagcgatcaggacgaaacgatctgtagcgagttactagtggctcttgcggatcatttcgcggatgttgaaatgagcacgatgacgaggccaaataaccgtctaattgagagagccaaggacatgatctacgagaacctaggcgatatcctaaagcttgatgagcttgccagtgagcttggaatgaccaagttccagtttatccgaaccttcaaagcaagtacaggcatctcaccgtatcgttttttcttgaacagcaagttggaacatgccaagcgcatcattgaacgccatagcgatatctactcggctgtggcagcttgcggatttgtggatctgtctcatcttaacaggcattttaagcgtgtgtacggcatcactgctatggaatataggtcttctattcaataa

SEQ ID NO: 5836 - DNA, 447 bp, Bacillus clausii
acgaattggtgcatgataaagtattgacaaagaaaaaaggggttggcacatttgtgaacccccttcctaaatatacgggtttcaagccaggtgtaagctttactttggaagcaaaaaacagagggatgcgaccctccaccgaactattacaattaacaaaagtgtttgctgatgataaacaggcggaggatatgcaagtggcaattggcgatccattatggctagttgagcggatccgatatgcagacaatgttgccgtatcttatgagttagagtattttgatcatcacttggtgggcaatcttacagaagaaatatgcgaacactcgatttatgaatttttggaaaaaaagggcattgaatatgagtttgtcgatcaaaaaatttctgctgttttagctgaagagacttcctctaatcatttaagtgttcctatagggtctcccg

SEQ ID NO: 5837 - DNA, 240 bp, Bacillus clausii
ggttggttttaacggccaagggcaataaaatcggcaaaaggctcgtttatcgccatgaattgctcgaggattttatgaaaatcattggtgtggacgatacccatatttataaagacgtagaagggattgaacatcatatcagctgggatgcgatagaccggattggcgaccttgtccaatacttccaagaaaaccaaacgcgaatcgacgagttgcgggaaattcaaaagcgcaacgact

SEQ ID NO: 5838 - DNA, 255 bp, Bacillus clausii
  misc_feature (1)...(255): n = A,T,C or G
tatcggaagggataaatccggcaaccgggtatttactgacacggatctcaactgggtagctatggnatgctgtttaaaggatacgggaatgaagatcaaagacatcaagcagtacgccgattggtgtgcggagggcttgcagacgattgaagaacgaaaaacaatgctcgccgaccatcgtcaacaagtcgtaaagcagatggaagcactgaagaaaaatctggcgcttattgattcgaaaatcgccgtttacga

SEQ ID NO: 5839 - DNA, 312 bp, Bacillus clausii
  misc_feature (1)...(312): n = A,T,C or G
atggaacgctccattgatggtgaagtggtcagttcaacgtttgatgaagtcccagaaaaccatattaaagtagcagagcttgtccttgaacgggcaatgcgcttagtcgaacataaaaaagatgtggtcattcttatggactcgattactcggttggcacgggcctataaccttgtcatcccaccgagtggtcgcacactctcaggcggcattgaccctgccgcgtttcaccgtccgaagcgtttctttggtgcagcgcgcaacattganggaaggcggcagcctgacnatattagcgactgcccttgttga

SEQ ID NO: 5840 - DNA, 294 bp, Bacillus clausii
tgatgaacgcccataagaagtaaccgatatggaacgctccattgatggtgaagtggtcagttcaacgtttgatgaagtcccagaaaaccatattaaagtagcagagcttgtccttgaacgggcaatgcgcttagtcgaacataaaaaagatgtggtcattcttatggactcgattactcggttggcacgggcctataaccttgtcatcccaccgagtggtcgcacactctcaggcggcattgaccctgccgcgtttcaccgtccgaagcgtttctttggtgcagcgcgcaacat

SEQ ID NO: 5841 - DNA, 708 bp, Bacillus clausii
atgtccggcatcctcgctgcactcacatattttatgaaagaagtgtttgtttttgtttcctatgtcaaaaacaacgctttcccgcagccattaagcaaagaagacgaaaaaaaatacttagcccggatggcagaaggcgatgcttctgcacggaacatgttaattgaacataatcttcgccttgttgcccatatcgtcaagaaatttgaaaacacaagggaagatgtcgaggatttaatttccattggcacgatcggcttgattaaagcaattgaaagttattccgaaggcaagggaacgaaattagcgacgtacgcggcacgttgtattgaaaatgagattctaatgcatttgcgggctttgaaaaaagtaaaaaaggacgtttctttgcacgatccaatcggtacagacaaagaaggcaacgagatcacactgatcgatattcttaaagacgacagcgaagacattgttgatgtcttgcagacggaaatggaaaaaaagcaaatttacgagtacattcatgtgctcgatgaacgtgaaaaagaagtcattattggccgattcggtttgaatatggaggaagagcggacacagcgggaaattgcgaaagaattaaatatttcccgtagctacgtctcccggattgaaaaacgggcgttaatgaaactgtttcatgagttttacaaacatagtcgtggccgcagttaa

SEQ ID NO: 5842 - DNA, 351 bp, Bacillus clausii
  misc_feature (1)...(351): n = A,T,C or G
acgaaaaacgagcctccaacgcgantttatcccacattatggaatggattcgggtatacgcgaaccaacctcttaccgttaagcgtgtctccgaccagtttaattacaacccagactatttaacgaggcagtttaaacagcatattggcatgtctttgcaaaaatacattatacttgtcaaaatgacaaaagcaaaagacatcttatcgcggacgagacgcacgattaaagaagtcgctgctgacgttggcatccaagacgaaaaatattttatgcgcctcttcaaaaaaacagaaggcatgacgccgactgcattccgcaaagcgttttaccgaatccatttaacaaatt

SEQ ID NO: 5843 - DNA, 168 bp, Bacillus clausii
acttgagcgtgtacggacagcagacggtatgcctgtcgtttactgccttgaccagcttccggcggatttagtcggcaaccgctctattcatgaaatgaagtcgatctttcagtttttagaagaggcaggccgaccaattgcttatgcgcttgcttggattgagccgat

SEQ ID NO: 5844 - DNA, 299 bp, Bacillus clausii
gtgtcttataaagataagaaagtaattacaatcggcgttgtaagtgaacttaccggtctttcagaacgaaaaatccgctattacgaagaacggaaattgctgtttcctgaacgttcaaaaggaggcacgcgcaaatattcttttcttgatgtcgaacgattagttgacattgccaataaaatggaagacggtatgcaaacattcgaaattcgcaaaatggaacaaaaagcattgcgcaaacaggaagtccgtgagcgcatgttaagaggccagctgaacgccgcctttaatattcgtaa

SEQ ID NO: 5845 - DNA, 300 bp, Bacillus clausii
  misc_feature (1)...(300): n = A,T,C or G
atacgtatattgctgaagcgggggcgccaaagaaagaatttgccaataaggcaattgncgatgcggttgagtctgctatggtagagcgtaaatcttacttggaagccaatgctggtgaatacaaccttgttggcgatcacaaagacgattatcaaggatacgttgtcgcgccaatcattgcgggcggcgatcccattggtacagtggtgatcttctctaaaaatgaaccattgaacggcaatcttgaacaaaaaatggctgaaaccgcagctggctttttggctaggcaaatggagcagt

SEQ ID NO: 5846 - DNA, 456 bp, Bacillus clausii
  misc_feature (1)...(456): n = A,T,C or G
tgcggaaaaatcangtccgtcagtcaatattgattacacacaagcggctgaagacgcgatccagtttttaattgaaaaaggccataaacgaatcggcatgttgagcggttcgctggaagacccaatcaatggctaccaaaagtttgctggttatcgccaagcacttcagaaaaacaatattgaatttgatgaaaacctgattgtcattggcgattacacgtatgattcaggaatggaagcaatggatgcatttcttgcccttgacgaaaaaccgacagcgctattcgcttcaaatgatgaaatggctctaggcgtcatccatggcgtccaagatcgtgggtatgatgtgcctggtgatattgaagtaatcggttttgacaatacacgtttggctacaatggtacgcccaaccttgacgaccgttgtccagcctctttatgacattggcgctgtctc

SEQ ID NO: 5847 - DNA, 407 bp, Bacillus clausii
atgaatacgaccatttatgatgtagctagagaagctggcgtctcaatggctactgtttcccgagtagtcaacggaaatccaaatgtaaaaccgacaacgcggaaaaaagttctggaagcaattgaacgcttaaactaccgtccaaatgcagtagccagggggctagccagcaaacgtaccacaacagtcggcgtcattatccctgatatttcaagcattttcttctctgagctggcgcggggaatcgaagacattgccactatgtataagtacaatatcattctttgtaactctgaccaaaacaaagacaaagaaatccacttgattaatacgctattggaaaagcaagtggacggtattgtgtataagggcggagaagtgacagaggagcatggagggcagattaa

SEQ ID NO: 5848 - DNA, 414 bp, Bacillus clausii
agggttccaaaaagtcatttcagaaaacaatttaatgatcaagcctgaacacatatttcaaatgtcacctaccgatgtctctgttcaagaagcgttcaagcaatcgatattgaatttaaaaggcaacttgcctacagccttattttgtgaatgcgactacatggcgattagcgtaatcaaaacacttaacgatttaaacttaaccgttcctgaagatatatcagtcattggtttcgataatattactgagtcaaaaataataagtccagaattaacgacgatccatgtaaagaaagataaaatttcatcacttgctgtcgagaagttaactagagaaatagatcacaatgaagatgttaaaatgaaaatctttgtcgacactgaacttattgttagaaaatcttgttgttcaca

SEQ ID NO: 5849 - DNA, 645 bp, Bacillus clausii
gaacgttggtaagaatgcattacgcaaccttgatgagcggggaattattcgcatcggggctgaagtcaaagatggcgacattcttgttggtaaagtgacgccaaagggcgtaacggagctgacggcggaagaacgcctcttgcatgcgatttttggagagaaagcccgtgaagtgcgggatacttcattgcgtgcaccgcatggtggagacggaatcgttcttgacgtgaaaatctttaaccgtgaagacggcgatgaacttcctccaggcgtcaaccaacttgtccgtgtctacattgtacaaaagcggaaaattaaccagggcgataaaatggctggccgtcacgggaacaaaggtgttatttcccgaatcctgccagaagaagatatgccgtttttaccagacggaacgcctgttgacattatgttaaacccacttggcgtgccttcgcggatgaatatcggacaagtgcttgaactccatcttggtatggctgcccgcaagctaggcatccatgttgcgtctccagtatttgacggcgccagtgaagaagatgtttggggcacattggaagaagcaggcatggcccgagacggaaaaacaattttatatgatggccgtactggcgaaccgtttgacaaccg

SEQ ID NO: 5850 - DNA, 320 bp, Bacillus clausii
  misc_feature (1)...(320): n = A,T,C or G
atggaggagatggatttgaaccacccattaaaagaatcgattgtctttagccataaaatggcgttgttaagcaaagccctctggaaatctgttgaaaaagattggcaagcatggattaaaccattccacctaaatttaaacgaacaccatattctttggattgcctatcagcttaatggcgccaccatttcagacatcgcttcacacggtgttatgcatgtctccaccgnctttaatttttcaaaaaaacttgaagcaaggggattgctttcattttcaaagaaaaaagacgacaagcggaataccgtacatttgtctga

SEQ ID NO: 5851 - DNA, 405 bp, Bacillus clausii
acttttatgatctgcttgaagaagtcgctaagctaaaaggaatgtcagaaacagaaatggatgagcggatttcattcttatatacagatttaaacctggacgggcgctttttaacgcttggcgacaacacgtggggtttgcgctcttggtatcctcatgaacaagcggaagaggaaatcacacactctgctaaaccagccaaacgtcgcaaatcaggcgatgacgacggggaggaagagtatgaccttgtcgacgagcttgaagaggatgagtttgaagacttggaagatgaactggacgagttggctgatgaagaggaccaagatggcgaacgggatgactatgacgataaagatgatgcgctgccaggatttgacgaggaagacggccaagcgcttgatgagg

SEQ ID NO: 5852 - DNA, 260 bp, Bacillus clausii
atcaagtggatggcgtgatcgtctgtacatacaaccgtggattaatcgacgtgtccgagcaaatgcctacagttgcatttgaccactatttatcaagtgggatcccagtcattagttccgataattatgcagggggagaactcgcagccgccacgcttatcgaagccggttgtaaaagcattgtccatattaatgggccagctgaactagagacacctgccaatcttcggcgtagcggttatgaagcagtgatgcaacga

SEQ ID NO: 5853 - DNA, 513 bp, Bacillus clausii
atgagcaaaacgccgattagaaatgcattggtgcggcttgaatcggaagggtttgtgaccgtttcttctaagcaaggcatcatcgttgtcgatatatcgatcgaacggatcaatgatatttacaatttgcggattgcgttagagacgtttaattgccaggaaatttataagcgcataacagatgaccaaattaacgagttagaagagaatgtcgaagccacgaaagaggctgcggctaataaagatgtgaaggcatttgccactttggatcatgagtttcatttagcgataagcgagtttgctggaaacagtgagatcacgaaaattttattaaattatcaggatcatttgcggagaattacgcttcggcatttacggaaagaccctgatcgggtcaaaaaattttatacggagcatgtcgacattttaaatgcattgaaaaccaaaaatgacaactgctctgatttgatgaaaaagcacttgtacgaatcaaagatgatgtattttcaatga

SEQ ID NO: 5854 - DNA, 389 bp, Bacillus clausii
  misc_feature (1)...(389): n = A,T,C or G
aaggcaacgaactatgcactgcatacaatggcttttttgacgctaaatgaaaaagacgaagcgattggcgttgaacagntggcgaagatgcaaaatctctcgcctacgtatctgtcaaaaattttaactaagctggttaaagccgggttaatcgaatcaacgcctggtgtaaaaggcggctaccgtcttttaaaacgccagaaggaaacgtcttttcttgatgtgatccaagcaattgaaggtcaaacgagcttgtttcattgttcgctcgaccacaaagagctcccacacaatcatggttgtttgattgagcaagtcatgatgaacgccgaggcaaaaatgaaagcggatctcgatgccacttacattgcagacatcgccagacaaat

SEQ ID NO: 5855 - DNA, 558 bp, Bacillus clausii
ggaattggacaaaccacttgtccaattcatttgcggtctttctccgttgatcgcagctgaattgtcgcccgggccaaattggcgaaccggcaaacgttgccacctgcatttgttagcacgttggcaccgttgaaaaaccacgagtacacgctagaaatcgtacaaggtgaaaaagactttttttcagtccatccatcttactcataaagacggggaacgccacgtgtattcctcaccaagcgctcttttagatcgctattactacggcaaagcagaacgggaccgggtcaaacaacaagcgttcgatttggagcgcttgctcaaaaacgaataccaaaaaaacaaacggaaactaaaaaagttagaacagacgcttcaacaagccgatgaagcagacagctaccaaaaacgaggagagttgctaactgccaacattcatgccgttcaccgcggcgcttcatcggttgacgtcattgactattatgacgaaaatggccaaactatcactattgccctcgacccgcagaaaagcccagcggaaaatgcgcagtcctattt

SEQ ID NO: 5856 - DNA, 180 bp, Bacillus clausii
aacttgacttatcggtccgttcgtacaactgtttgaagcgtgctggcattaatactgtacaggaattgacgcacaaaacagaggaagacatgatgaaagtccgcaaccttggccgtaaatcacttgaagaagtacaagagaagttgggcgaacttggcctcgggcttcgcaatgaagaat

SEQ ID NO: 5857 - DNA, 178 bp, Bacillus clausii
  misc_feature (1)...(178): n = A,T,C or G
atgattgaaattgaaaagccgaatattgaaacggtggaagttagcgaagacgcgaaatacggcaaatttgtcgtanagcctctagagcgcggttatggaacaacactaggaaactccttgcgtcgcatccttttgtcctcgcttncaggagctgcgggtacatctgttcaaattgacc

SEQ ID NO: 5858 - DNA, 147 bp, Bacillus clausii
gttataacgaagactatggcagaagctttgaatcgttcgctgttcctacagtggtaggagagattaaacggtttattcgcgacaaaacatggagtgtccatgtaccgcgccgcatcaaagagctgggtccgaaaattaagaaagcac

SEQ ID NO: 5859 - DNA, 735 bp, Bacillus clausii
agcgaaaacggagtcagcggcgggtagagctgacggaagaacaaaaaaagcagtttgacgacctccttgtccggacgggtctaacgtttgaaaaccgcaaactactgattcaagcatttacccattcctcgtatgtgaatgaacaacgaattttttcatcatcggataatgaacgtttggaatttcttggcgatgctgttttagaattggctgtctcccaatatttatttaaaacgtacaaaaatatgagcgaaggcgatatgacgaaattgcgcgcttcgatcgtatgcgaaccatccttagcccgttttgccgaagagttgcagttcggcaaacttgtccttcttggcaaaggggaggaagtgacagggggacgaacacgccctgcgctccttgcagatgtgtttgaggcatttattggtgccctttatatggatcaagggcttgagcctgtgtttatgtttttggcgcgttttatgtatccgaaaattaaagagggcgcgttcacatacaagatggattttaaaagtcaactgcaagaatttgtgcaacgggataaccgcggccaaattcgttatttaattgtccaagaaagagggcctgcccacgatcgtgaatttgtctcagatgtgcagctaaatgaggaaacaattggcacagggacagggcgctccaaaaaagaagctgagcagctagctgcgaaacaagcgctgcttgcgctcaaccaaaaagaaa

SEQ ID NO: 5860 - DNA, 325 bp, Bacillus clausii
atgaaaacagaggctaaatggattgtgctcggaatactgtcaggaagatgtagaacgggatacgaaataaaaaaggtcattgataatagttttgagcatttttggaagatgagctatggacaaatttatcccgctcttaaaactttggtcaaagaggggtatgttattcaaatcggaggcgagggggatcggaaggagtatgaggtaacggaagcgggaaagcataaacttcatgattggctggctgctcccatttacgatactgggcttcataaaaatgagctgctcgttaaactgttttttggaaacgaaatgaaccgggaac

SEQ ID NO: 5861 - DNA, 300 bp, Bacillus clausii
ggaaaacaactatgttgatttagatgaagaaacgttgtttattgtctcgcaaacattcaaagctcttggggacccaacacggatacgaatcttgcatttgcttgctgaaaaagaatgcgctgttggcgaaattgtagaagcgttggcgctcggccaatcaaatgtgtcccatcagcttcgttttcttaaaaacttgcggttggtaaagtcgcggcgagtaggcacagccatgtattattcaccggaagacgagcatgtaatggaaatactagaaaagacgatccaacatgccaaacatga

SEQ ID NO: 5862 - DNA, 131 bp, Bacillus clausii
  misc_feature (1)...(131): n = A,T,C or G
atggaaatcagacagttgctgtattttatggaagtagcgaaacgggagcatgttaccgaagctgcagcggccttgcatgtcgcacagtctgccgtcagcagacagatctttaatttanaaagcgaattagg

SEQ ID NO: 5863 - DNA, 273 bp, Bacillus clausii
  misc_feature (1)...(273): n = A,T,C or G
ttatcggaagggataaatccggcaaccgggtatttactgacacggatctcaactgggtagctatggnatgctgtttaaaggatacgggaatgaagatcaaagacatcaagcagtacgccgattggtgtgcggagggcttgcagacgattgaagaacgaaaaacaatgctcgccgaccatcgtcaacaagtcgtaaagcagatggaagcactgaagaaaaatctggcgcttattgattcgaaaatcgccgtttacgaaaacccggagcaggccg

SEQ ID NO: 5864 - DNA, 440 bp, Bacillus clausii
atgtcagaagagaaaaaacattacatgaccgcagaaggtaagaaaaaacttgaagaagaactgcattatttgattacaacacgacgtaaagaagtcgttgaacgtataaaagtcgcccgtagctttggcgacctgtcggagaactccgagtatgattctgccaaagaagaccaggcatttgttgaaggccggattgcccaactggaaaaaatgattcgcaatgccgtcatgattgaaaatgaaaaagtagatggcaatgttgtttcattaggaaaaacagttcgcttaatggaactacctgatggggaagaagaagaatatacgattgtcggttcagcagagtcagatccgtttgagggaaaaatttcaaatgactctccgatggcgcaaagtttgttaggtaaaacagttaatgaccgtgttgttgtgaatacgccagg

SEQ ID NO: 5865 - DNA, 599 bp, Bacillus clausii
atgaaaaacgacgacaatagcccatcaataactgaagcatttcagcttttcttagattcgctaaatgaatcgaagaaaaaaacagcaaaacaagaacaaattatccaagcagctgccaagctattcgcagaaaaggggtatgaggctagttcaactgctgatatcgctaaacaagctggcgttgccgaagtaacattattccgtaacttcaagtcaaaatcaaatctgttgtaccatattttagcacctgtttttattgaacttggttcaaaaaaatatctggaaacgatccaagaaattttccgttcacccgagccaaataatgcgaaagaaacattgacaatggcttttcgagacaggctggaacagctcgcccaaaaccaatccattataaaagtcctctttcgagaagcttattcacaggacgagattaaaaaagcaattgtaacgaacatcactactcctgcgatggaatcgacaaaatcatttattaggcaaaaacaagaacaaggtgagtttaaggacatggatgagtctggtattgccaacttatttttatattatcttcggctatatcttttaccaccaagtcttggcga

SEQ ID NO: 5866 - DNA, 600 bp, Bacillus clausii
atggagcgcttgcaatgggtaagccgtgatcgcaatgagacatatgcgattgggagcgctataggacgttttgggagtgcttttttccagcagttcgatctgagtgaagattttcgacgcttggccgagccagtgatgcgcaatcttcaagaatcgatccaattagcagtgcttgaaggcagcgacgtccaatatttagctaaagtggaagcccccagtcctgtccaaatggtttccggtcccggagtccgcttccctgcgcatgcaactggcctaggaaaagctttgatggctgacatgagcgaacaacaaatatgcaatttatacccggaagaatcacttcctaaaattaccgttcatacgattggctcccgggaagctttgatccacgagcttaagaacgtacgaaaagctggatatgcaatggatattcaagaaggcgttatgggcttttgctgtacagctgcaccgattcgtaaagcaaacggagaaatcgcagctgcaatcagctgttccatgccaattcaccattgggaggggaagaaagagcgtgccttggatgaaattgtccaacttgcccagcgcctttctcacatttaa

SEQ ID NO: 5867 - DNA, 441 bp, Bacillus clausii
  misc_feature (1)...(441): n = A,T,C or G
taatagccaagaacgactaagaggatttttaaatgcactagaaangaaagggttgcctattggggaaaaacaaatctacaacggcgattacagcattgaatcaggctatgaaatcactaagcaattaatgatgaaaaataaagaggtgacagcaatcgtggcggttaacgacgggatggcgattggcgcgattaactgcttgattgcaaaccatatccaagttcccggtcaagtctcagtgttagggttagacgatacaacacttgcgaaagcatccagacctgccttgacaggagtacactattcctataaagaactcgggaaaaaaggggctatgatgctgctgaggcaaattgaagagcaaacgtatcggtttgagaaagagatcattccatatgagataaaaatacgtggtagtgtagcacaagtagaaaggaaaga

SEQ ID NO: 5868 - DNA, 461 bp, Bacillus clausii
atgaacgtatacgagcaaatgaaagaagcgattataactggccgctacaaacaaggggagcgccttactgaggaagcgcttacaattgactggaatgtgagcaggacgcctattcgcagcgcattaaagcagcttgaatttgatgggctagtccaaccgctaaaacggggatttttcgtccgagccttttcaaaagaagacttgcggcaaatttacgatttacgagcattgctcgaaagctatggcgccgggcaagctgccctgcatcaccaatcagaagatttggcggcaatacaacaagcaaacagccagtatgaacaagcgatattggcttcatccttgccccatgaagagcggatcagtgctgtcattgctgccaacacacaatttcatgatgcagtttatcgtgcgagccgcaaccggcatatccaagaattaattgcaaaagtggtcgtattgcc

SEQ ID NO: 5869 - DNA, 368 bp, Bacillus clausii
atgtcgaaccaaacacctagcatatcggaagcagaatgggaagtaatgaaagtcttgtggaaaaagggacggcaaacagccaatcaagtcatctccgcgatccaagagcaaacggactggaagccgaaaacgattcgtacgttactggatcgattaacgaagaagaaagtagtaggcgtggataaagaacagaaaatctatgtcttctttccgctatattcagaagaagagtgtaagcacgcagaagcacagtcttttgtaaagagagtttacgggggaacagtaaaaccattgttggtccagttcttggaggaagaatcattaacaaaagaagagctggatgaactgtatgcgattttagaacaaaa

SEQ ID NO: 5870 - DNA, 307 bp, Bacillus clausii
ttggataaagaacagcttaaaggcaacttagatttaattatacttgcacacgttttcaaaacagatgactatgggggtgccattgttaaaaaaatatatgacgaaagtaaccaacaatacaaaatgagtgaaggaaccttgtattcacttttaaaaagacttgaaaaaaaaggactcctttcctcttattggggagatgaaacgaatggcggcaggcgcaggtattattctataaccgaggcaggaaaagtgacattcaaacaaaaattggaaagttggagatcaatcaataaaatgattgaaaatt

SEQ ID NO: 5871 - DNA, 405 bp, Bacillus clausii
ttgacaggtcaactaattcagtatggacgtcaccgccagcggagaagctatgcgcgaattaatgaagtgctcgaactgccaaacttgattgaaattcaaacagcttcttatcaatggtttcttgatgagggtttgcgggagatgtttcaagacatttcaccgatccaagacttcactggcaatttagtgttagagtttattgattacagtctaggagaaccaaagtatcctgttgatgagtcaaaagagcgtgacgtgacgtttgccgctcctctacgtgtcaaagttcgccttattaataaagagacaggcgaagtaaaagaacaggaagtctttatgggcgatttcccgttgatgacagaaacagggacatttatcatcaatggcgctgagcgcgttatcgtt

SEQ ID NO: 5872 - DNA, 318 bp, Bacillus clausii; identical to SEQ ID NO: 5764

SEQ ID NO: 5873 - DNA, 510 bp, Bacillus clausii
accgaggcaataaatctgagagacggattgagccagttgatgttgggaaggacaatttttcgatgctgcttttaggaagtgattaccgtgaaggggatggcgccgaacgaacggactccgtcatggtagcaacttttaataaaagcgagagatcgattatcctaacgagcattccacgtgacacttatgtagaaattgtcggctatcgaggtggcggctttaaagataaaattacgcatgcccacgcgtttggtggtattgatatggcgattgccaccgttgaagaactgctagatataccgattgaccattacgcgctcatccgttttgacggtcttgtagatgttgtcgatgctttaggcggcattgaccttgaactcacatacgacattgactttgaagaaaaaagccgcggtgttgactttcaattccgtaaagggcctgcccatttaaacggcgagcaagcactcgcttatgctcgtgaacggaaatccgcatctggcggcggcc

SEQ ID NO: 5874 - DNA, 201 bp, Bacillus clausii; identical to SEQ ID NO: 5792

SEQ ID NO: 5875 - DNA, 455 bp, Bacillus clausii
atgtttcaaattggcgataacattgtttatccgatgcacggagcaggtgtaattgaggcgatagaagaaatagatcttttagaggaaaaacaacagtattatatcataaaaatgtcaatcaacaatatgaaagttatgattccaactagcaaaatagtgagttcaagtatacggccagttactgatgtacttgcgataaaccacattatacacatatttcaacacggagaatcagatacgttactgccgtggaaacaaaggtataaagtaaacgcggacaaaataaaaatgggtgaaatgcaagaaggcgctgaagttgtacgcgatttaatgcgcattaagaaagaaaaagcacttaatacaagcgaaaaagaaatgttggataatgcctatgaatttttgcttagtgaactggaagtcgttaaaggaatcaccgatagtcaaataaaaagttt

SEQ ID NO: 5876 - DNA, 663 bp, Bacillus clausii
atgtatattaaaaattacaatatggtatattataatataccatattattcattcgtcatctattacattattgagaaaggagtgatccaattggcgaaagaagagcttgccgaaaatcaagaagccggcaaacaaattggtaaaaacctacggcaattgcggacaagcaaaggaataagcatcgaggcacttgccaaacaaattggtgtcagcaaactgacattgctaaaaattgaacaaggggaaggcaacccgactctatctgtcatttggaaaatcgccaacggacttcatatcccgattaccgccttgctatcatttgaagctgatgtggccatcgcccgagccaacaaggcgatgaaactctccagctcagatgacgagttcatcgctgagccgttgtttcgctcacaaggactgatggaatgctaccgtggttatttgcggcctcaatgccgctatgaatcagaagcacaccgccttggtgtggtcgaaacggtaacggttatggctggacaactgacgattgaagtcgagggggaaagccaccatttgtcaacctatgactcgatccgtttcaaaggcgaccgcccccatgcttacatcaatccaggaaaagagacagccgtactccattttctcatttcttactcccttctttaa

SEQ ID NO: 5877 - DNA, 222 bp, Bacillus clausii
tttccccgaagtgaaagcactgtatttaatgtctggcgcatacgacttgtctgtcgtgatcgaaggcaaaacgatgcaagaaacagcccgttttgtgtcagaacgtctatcgacgattgattccgtcttatcaacgacgacccattttcaattaaaaacatataaacatgatggcgtgatttttaaagagccagagtctgataaacgaatcgtggtgagccc

SEQ ID NO: 5878 - DNA, 480 bp, Bacillus clausii
aaaacatgcggacgtattgcgttcctactacggtagggcgtgtgcttggcatcatttacatgaaccggaagccaatgacgcttgaagctctttccgatgaaacaggtatgagtaaaacgcggatgagccaagttgtacgggaaatgttgtctttaaatgttgcccacaaagtgtttgaaaaaggtgtccgcaaagatttatatgatgtcgaaaaagattactaccaaacgttcatttccattttcgtcgcaaattggcaagctgtgattgctaaaaaccgagcagttggaaaaagaattcaaaatgaggttaaacggtttatggaggcagaagcagacaacttgtccgctgacgaaatggagcaattgaaccatttgttaaaagaaacggagcagtggctccattattacaaatggttagatgatcttgttgatttttttgagagcggcgatgtatttcaccatgtgccccaagccagac

SEQ ID NO: 5879 - DNA, 546 bp, Bacillus clausii
accgtccacttttagtactgaggtccaagaaacctatgaagagattattcaaatgctaaatgacacacggaatttggctgataatgaggtcctcaaaaaggctgccacttggataatggaaagccgatccatctatctatttgggattgggttttcagggctagcagctcaaggcgcgcaaattagactcatgcgcctcggctataaagcgtatgctttttcggatcaacatacacaatttattagctcccacctgatctctgagggcgacttagcgattgcctttagcattactggagatacgaaagaaacaattcgctggcttgaaaatgcgaagaaaaacaaggcaaagtccattgcgatcacaaatcattcccactcgccgatcacgaatatcggagagatgattattcatacagcaggaaaagaaatcgaacaagaaggtagtacgttaattacacaaatgtcacagctttttgtaaccgaacaaatttgtcaacatctatatgagttagataaagacaatatcgaattagccaaaaagaa

SEQ ID NO: 5880 - DNA, 582 bp, Bacillus clausii
atggcaaaaggatattcccttggttacatcgtggaggtttgccaagggctggaaataagaataaaacaagcgctccaaaagcggttgccgaatagatcgtttgattccattgaactacggttacacggaaaacttgatctccgttattacaacacatcaagcgcaattgaagaactatttcttcgtgatctcgtcgattttcttggagaattaaaagaagacgaacagaataactggatgattgagaagattaaacattacattcacaagcattatcagcaagatttgcgggcggcagaagtggctgagcgtcattttattacgccaaattatttcagcatgcttttcaaaaaagaaacaggtcagagtttctcagagtatgtaaatcgcctccgtatcgaaaaatcggcagagctattgctaaccacatcgaataaagtctttgaaattgccgagtatgtgggctacaaagaatacaaatattttgtgcaagtgtttaagaagcaagtcggattgacgccaactcagtaccgacgactgaatgtaacccgagatagaagagaaaaacagatagaatcgtaa

SEQ ID NO: 5881 - DNA, 420 bp, Bacillus clausii
accaagcattcgaagcactggaacaagtcattaaagaaagagaagccgctgacagaagaaggaaggcaatgaaaggcagccaggaggaagcgattgtttctgattggacactgactcaattacacattgtggcgattgtaaaagaacaagaacgagcgaataataccatgctcgcagaacatttaaacgtatcgaaaccagctattacaaaagcagtaaagaaattattggatcagcaaatcctggagaagacacaactagcagataacaaaaaagaagtttattaccgtctaacgaaatcaggagagatgctcgcctttatccatagtcaattgcatgaacaggcaaggaatcgctatatgcgcatctttgctgaatttaattcaacagaattagagacacttattcgttttttacatg

SEQ ID NO: 5882 - DNA, 543 bp, Bacillus clausii
atgttagcccatacattcaagcgacgaaccttccctacttggatatttgtgccgatgaagggtgggggaaaaatattattgactgtacgttaagcatccatcgatcgattgaagagcagcccccttattatgaaattgatgtcactaccaagatggtggcgatatggaaacttctaatctcaaatggactgcgattagaatacgaccagaacaagatgatgcaaaatcgacgagtaaagggaatgcttcaatggattcatagccactttggagagaacatttccttagatgatatagcaaaggcagggcagctaagccgctctgaatgttgccgctattttaaacgaatgctaaaaacgtccccccttcaatacgttactgattaccgtatccaaaaaagcttgcctctcttgcagcagccaaacgcaactgtaacggacgtagcttatcaagtaggttttaacagcacaagctattttatcgctcgattccgaaaagtgatgaacatgacaccacttgcctacaaaaaatcgaaacttaagg

SEQ ID NO: 5883 - DNA, 339 bp, Bacillus clausii
tgctgttaaaacatgagcggattgcttttattggtggtcgtgaagaagcgtacgtcacgctagaccgcaagaaagggtatatagaagcgggagaggaagcaggaatgacgccagatgactcttacgtcgtccaccatgatgagatttttgagggcggcgaacaagcggttattgaactaatgtcacgaaaacatcctcctacagccatgatcgtaatggatgacttaatggcactgggcgtgctgcgcatgttatttaacatgaatatttccgtgcctaatgaggtgtctgttgtgagcttcaacaatgtgctaatggcagagctggcgacaccgccag

SEQ ID NO: 5884 - DNA, 471 bp, Bacillus clausii
tgatttggaaacgatgtcaggctttgctaaagcgcttgatgagacacttaacagcgaaatggaactgcaccgtgcttatgcaaagcgcctcggaattacacgggagcagttggaacagacggttcctggcccagtaacgcttgcctatagcagcgcgatgatggctgaagcgcaaaaagggtcccttgccgagctcattgctgcgatcttgccgtgtgcttggagctattatgaaattggcacagaactcgcaaaaattcctggcgccacagaacatgaggcatatggggaatgggtgaaaatgtactcttcgcctgagtttggcgcaattgcggactggctgattgcaaagctagacgagcttgccgcagaaaagagcgaggccgagctagaccggattgaaacgatctttatgaatacaagccgttatgaatatatgttttgggatatggcctataaacaagaaaactg

SEQ ID NO: 5885 - DNA, 740 bp, Bacillus clausii
gtgaataaaaaaggcactgaccagtcgctccatgcttacgttaaacaagagttagttaccgccatccaacaaggagtttatcccgttaaatcccagctgccaactgaggcagaactgtgcaagatgtatgatgttagccgaacgacgatccgaaatgcactacagcaacttgtcatcgatgggtatgtagaacgtatccaagggcgaggcacctttgtcgccagcagaagggtcaagcaaacgttatctgcaacgcaagggaattatcgggagcaattgcaattgcaaggaaaaaaaccaaaaatacaagtgatcgatttgaaagtcgttccttctgatgagttcttgtctgccatgcttgaaatcgaagaaaatgagcctgtccaccgccttgaacgaatccgttatgcagacgacgcccccttacaatacgaaatcgcttatttgccttggcgcaagacgacttggctaacgaaagaagggggagaacactcactctatcaactactgcaaagccagccggatctctcgcttcaccagacaaaagaacatttgcatatcgccctcgcagatgaagaagtagccgcaaagctagggatttcagttggcgacccttgcattcaaattgaaacacacgcttatttagccgacgagtctaaaatcgaatattcaatcgcttatttccatggagaaaaagctagttttacgattgaacgaaattatcaaaaaccgaccaagac

SEQ ID NO: 5886 - DNA, 546 bp, Bacillus clausii
ccgcccagttactggcccagggaaccgtccgttaaaatcattgtcccatatgctaaaagggaaacaagggcgtttccgccaaaacttgctcggaaaacgggttgactattccggccgttcggttatcgtagttggccctaacttgaaaatgtaccaatgcgggcttccaaaagaaatggcgctagaattattcaagccttttgtgatgaaagagcttgtttctaaagggcttgcccataacattaagagcgctaagcggaaagtcgagcgtgtccagccggaagtttgggatgtgcttgaagaagtcatccgcgagcaccctgtcctcctgaaccgtgcgccaacattgcaccgtcttggaattcaagcgttcgagcctatcttagtagaagggcgtgcaattaaattgcatccgcttgtctgtacagcatacaacgccgactttgacggcgaccaaatggctgtccacgtgccgttgtcggcggaagcacaagcggaagcacggattctcatgcttgctgcacaaaacatcttgaaccctaaaga

SEQ ID NO: 5887 - DNA, 1142 bp, Bacillus clausii
tttggtattttaaagggattccaagtcggatgggccttgtgctggatatgtcgccccgttcccttgaggaagtcatatacttcgcttcttatgtagtgactgaaccaggcgatacaccactagagaaaaaacagcttttgtcagagaaagagtaccgtgcttattacgataaatatggccgtacgtttacagcttctatgggtgcggaagcgattcgcaaattgcttgccgacattgacttacaaaaagaagtcaatgccctgaaagaagagctcgaaacagcacaagggcaacggcgtacacgtgcgattaaacggctagaagtgctggaagcattccgcaattctggtaatgaaccgtcatggatggtgcttgatgttcttcctgtcattccgccagaattacggccaatggtacagctagatggcggccgctttgctacttctgatttaaatgacttgtaccgccgcgtcattaaccgcaataatcgtttgaaacggttgcttgatttaggagcgccgaacattattgtgcaaaatgagaagcggatgcttcaagaagctgtcgatgccttgattgataatggacgccgcggccgcccagttactggcccagggaaccgtccgttaaaatcattgtcccatatgctaaaagggaaacaagggcgtttccgccaaaacttgctcggaaaacgggttgactattccggccgttcggttatcgtagttggccctaacttgaaaatgtaccaatgcgggcttccaaaagaaatggcgctagaattattcaagccttttgtgatgaaagagcttgtttctaaagggcttgcccataacattaagagcgctaagcggaaagtcgagcgtgtccagccggaagtttgggatgtgcttgaagaagtcatccgcgagcaccctgtcctcctgaaccgtgcgccaacattgcaccgtcttggaattcaagcgttcgagcctatcttagtagaagggcgtgcaattaaattgcatccgcttgtctgtacagcatacaacgccgactttgacggcgaccaaatggctgtccacgtgccgttgtcggcggaagcacaagcggaagcacggattctcatgcttgctgcacaaaacatcttgaaccctaaagat

SEQ ID NO: 5888 - DNA, 502 bp, Bacillus clausii
gtgaataaaaaaggcactgaccagtcgctccatgcttacgttaaacaagagttagttaccgccatccaacaaggagtttatcccgttaaatcccagctgccaactgaggcagaactgtgcaagatgtatgatgttagccgaacgacgatccgaaatgcactacagcaacttgtcatcgatgggtatgtagaacgtatccaagggcgaggcacctttgtcgccagcagaagggtcaagcaaacgttatctgcaacgcaagggaattatcgggagcaattgcaattgcaaggaaaaaaaccaaaaatacaagtgatcgatttgaaagtcgttccttctgatgagttcttgtctgccatgcttgaaatcgaagaaaatgagcctgtccaccgccttgaacgaatccgttatgcagacgacgcccccttacaatacgaaatcgcttatttgccttggcgcaagacgacttggctaacgaaagaagggggagaacactcactctatc

SEQ ID NO: 5889 - DNA, 702 bp, Bacillus clausii
acaagtttcaatcgatttatcaagcgctcacacaagcaatcaatagcggtgtttatgctcctggcgaaacgttgccttctgaaaacgaactgacagagatgttccaagcatcaagggaaacgattcgcaaagcactgaaaatgttatcagaacacgggtatattcaaaagatacaaggcagaggttctgttgtactcgatgtcgcccgcctcgatttcccggtttcaggggttgcaagcttccaagaactaaatgaaaagcttggtttgcaagctaagaccgatgtcgtctgctttacagctgctaaagcagatgaaacaatggcaaagaagttggaaattgtaacaggagagcaagtttggcaagtggagcgaattcgcttcattgatggggaacggattatattggataaggacacatttgtttccagacttgtccctggtttaacgaaagacatttgtgcgggcagcatttatgcctacattgagaagcaattaggccttgccatcagctttgccaaaaaagaaattgtcgttgaagcggcgacggaggaagacgaggccatgcttgacctcgatgaaagcggccgcgtagtcgttgtcagaagctatacgtattttgacaatgccgtgcctttccagtacacagagtcgcgccaccgtgctgaccgcttccgatttgttgattttgccagacgcaacc

SEQ ID NO: 5890 - DNA, 828 bp, Bacillus clausii
aaaggggttgggaaaagggctacaagcgttctttccagaacaagaagacacgcaagaagagcaaattgtacaagttgatcttgcagacgttaggccaaatccgtatcaacctagaaaaacgttttctgaagaagcattaacggaattgagcaactcgattcgcgaacacggaattttgcagcctgttactgttcgcaaagcaattaaagggtatgaaattgtaatgggcgagcggcgcgtaaaagcggcaaaacaagcaggattaaaacaaatccctgtcattgtccaggaacttgatgaaaataaaatgatggaaattgctttaatcgaaaacttgcagcgtgaagatttgaatccaatcgaggaagcaatcgcctatgagaaattaatggaacatacgaatagcacacaagagcagttagcaaagcgccttggaaaaagcaggccccatattgccaaccatatgcgattgttgcaattgccaaaagttgttcaagagttcatttcggttggcaaactgacaatgggccatggacgtgcgcttttagggctgcaagataagcaaaaactttcacagctgttagaaaaagtgctgcaagacaagcttagcgtgcgtgaagtcgaacaactcgtccagagattaaatgaacatgttccacgtgaaacaaagcaagtcaaagtgaagttaccgccgattattaaagaacagcaagaacgtttaagagatacgcttggtacatctgtattaattaaacctggaaagaaaaaaggcaaaattgaaattgactatttttccgaggacgacttggaacggattttatcgttatt

SEQ ID NO: 5891 - DNA, 852 bp, Bacillus clausii
atgaagcaatcgttttcacgcctatttggcttaaatgataaaaacgacgatgctgaattaactgcaaacgaagaggtacagcagcttgctattaaagatatcgtgccgaatcgcttccagcctagaactctatttgatgaagaccggattgccgaattagcgcaaacgatcaggacgcatggagtcatacagcccatagtcgtccgtgttcgcgatgataaatacgaaatcattgcaggagagcgcaggtggcgtgctgttacttcattgcaatgggaaacgatccctgctattgtcaaagaatttaatgactcgcaaacagcttcgattgcactaattgaaaatttgcagcgtgaaggcttaactgcaattgaagaagcaaccgcttatgcaaaattaatcgaaatccacaacttgacgcaggaaagtttggcgcaacgccttggcaaaggccaatcaacgattgcaaacaaacttcgattgcttcatttgccacaagcagtccaagacgcaattttaaatagagacatttcagagcgccatgctcgcgcgttaattgctttaaaagatgctgaagcccaagaagccgttttaaaacaaatcattgaagagcagttgaatgtgaagcagacggaagaacgagtgaaagcgtattttaaagcagcggaagaagaagcacctaaaaagaaaaagccaaaacggaaatcttatccgaaagacatgcgtattgccatgaatacgattcgtcaatccgttgatatggtgatgaaaagcggcttaaaagtcgataccgatgaagaagacaatgaagaattttaccaatttacgattcgcattcctaagaaaaaatga

SEQ ID NO: 5892 - DNA, 706 bp, Bacillus clausii
gtgatgaaggcggatcatcggccgctttatatacaagtgatcgatcagttaaaggaagaaatcagccactacagtgaagggagtaagctcccatctgaatatgagcttgccaagcagctaggtgtaagcaaagaaacattgcgggaagcgttgcgcctactagaggaagacggactcgtcgtaaggcgctacggcgtaggcacatttgtgccttcaaagccgctgttttcagcgggattcgaagagctgcaaagtgtaaccaacatgattgcgtctgcaaatatgacgccaggcacgatttatttgtcgtcaacgatcgaagtttcggcagaagaagacagagcgcgttttaatcgatcgaaatcgtttgaaatgctccaacttgagcgtgtacggacagcagacggtatgcctgtcgtttactgccttgaccagcttccggcggatttagtcggcaaccgctctattcatgaaatgaagtcgatctttcagtttttagaagaggcaggccgaccaattgcttatgcgcttccctcgattgagccgatcggctaccatgagcatgtaacggaagtgctggagtgcactcctgaaacggcgcttcttcttttaagacaaacccattatgatcaccatgatcaagcggtgctccactctttcaattattttcggtctgacaaatttaagtttaatgttgtaagaaaaa

SEQ ID NO: 5893 - DNA, 642 bp, Bacillus clausii
atgatcgtcttgaatatagagagtttacgaatgttttgtaaagttgcagacggagggagcatcagtcaggctgcgcgcttaagttttgtaacccagccagcggtaacaaaacaaattcgccaactagagaacagttatgggacggctttatttgatcgaactgaaggaaaaatgttgctatcagaagcaggagaacaattatatccctatgcaaaggaaatagtggaaagttatgataactcggtacaagctcttcaagaagtgatagggattcgagatcctaaactaaacgttggagcaagcttaactataggtgaatatttgcttcctggcctattgggaaactttcaacaaaaacatgccgatattaaattcagtttattaattggaaatacaccatatatattatcgaaacttgaagcaaatgaaattgatattgcgctcatagagggacgcgtcaatcagtctgaatatagcctgaaaaaatttgcagttgatgagctgattctcgttacatcttacaaccatcgttggaaggaaagagaatcaattgacattcacgaacttacagaagaaaaaatgctttggagagaaaaggattcaggaacaagattgattggtgagagcgcattaactgactac

SEQ ID NO: 5894 - DNA, 602 bp, Bacillus clausii
atgcgactcgaagaggacttattgattgcaacgttaagcgatgaggggaccattcgcggtgcttcccgcaagttatacatatcccagcctgctctcagccagcggcttaagcaaattgaacaacgctttggggaaccgctgtttatccgcacccacaaatcactcattcccacaccagtcggggaagaagtgattgcctttgccaaacgccgtgttcaagaagaaaaacaactacaagaccgtcttagcaagttgacaggaaccgtacgcggtacgctttcactagggatctcatctgtcattgcccaatatgtattgccaaagccgttgcgtgcttatgtgaacgcttatcccgatgtcaaaatcgatttgcataccggccttagttctgctatttatcaaaacaggcatcatacgcacctttcgattatccgcggcgatgtcgatgataaagaagggcttacgctgctattttctgaacggctttactatgtccgccgcgccgataccgaaaaaccaactgtgttcatttcttttcaaagcgacgatgcctttcaatcgctcattgaagaatggctatatgctgaggctgccattcgacc

SEQ ID NO: 5895 - DNA, 669 bp, Bacillus clausii
tgcaaagttttgagcctgcaggcgtaggggcccgttcccttggggaatgcttggccttacaacttaaacgaatgcctgattgccatcctcttgcgattgacatcgtcttaaaccatctcgaagcgctagctgcccggaagtggaagccacttgcgaaacaatacggcgtcgctgttcaagctatacagcaactatacgaccaattaaaggagcttgacccaaagcctggactacgttattcgaaggaaacggccatttacgtccagcctgatgtgctgatggcaaaggatgaatctggaaagctgcttgtcttcatgaatgatgacatactaccagccattcgcgtacatgaggaatacgaccatttgttgaaacaacaagtcgagacaagcgcgtacgcgaagcaaaaaaagcagcatgtcgagtggttaaagcgcagccttgaacaacgccagcaaacggtgcgtcgcgtggcggaagtgttggcgagcgagcaggcagactacttgcttcagcctaatggggtgctcaagccattgacgttaaacgatgttgcccaagttctcggcatccatgaatcaaccgtaagccgggcaacagcaaataaatatgcacaaacacctcgtggcttagtcgaattaaaaggattgttctctgcccatgtttcaa

SEQ ID NO: 5896 - DNA, 678 bp, Bacillus clausii
cgattaaagacattgctaaaaaagccggtgtttcccaagcgaccatttcgaaaatcctaaatgattaccctgatgtgagccagaaaacaaaagaacgggtttttcgaattatggaagaagcaggataccggccttcccactctgcccgcacattggcgcaaaaaacgtcaaagctcattggcgttatttacgcagggcggataaatgccgattttgaccacccattttttattgaaatgctaaacccctttaaacggaccatcggcatgcccgggttccacttgttgtttttttccgatgaaactttcccaaaggaagaaaatttctatgccagatgcctttattataaagtggatggctgcattattattgctggtgaagatgtccagcaatcgattgaggacttaacaaaaagtgaaattccctgtatcggtgtggacattcaattagatgggcccaagtccagctacgtaatgaccgataacaaaaaaatttcccaatccgttgtcgactatttctatttgcaaggccaccctgatatcgcttacattggaggggcaaacgaatcggctgtttcgaatattcggctaaaagggtttcgcgaaagcatccatgaatatgggctgacgctccgcccagaatgggtaattgaaggggatttctttgaacaaagcggct

SEQ ID NO: 5897 - DNA, 453 bp, Bacillus clausii
atgaaggaaattctccgtgagattggaatgatagcaagggcattagattctatcagcaatatcgagtttaaagaatttgaccttacaaaaggacagtatttataccttgtgagaatctgtgaacacccaggcatcattcaagaaaaactagccgagatgataaaagtagatcgtacaaccgcagctcgcgcgataaagaaactggaaaagaacggttttattgaaaagaaggaggatgcacataacaaaaaaataaaaaaactctttcctacacagaaaggggagcgtgtttatccttttataagaaaagaaaatgattattccaataccgttgccttaacaggattttctgaaagtgaagcagaaaccatttttcatctactgcaaagagtcagaaaaaatgtagaaaaggattgggagtttgtaaaaaagggcaacaagagacattattga

SEQ ID NO: 5898 - DNA, 603 bp, Bacillus clausii; identical to SEQ ID NO: 5835

SEQ ID NO: 5899 - DNA, 730 bp, Bacillus clausii
atgcggacgcttattaatctgcaaagacaaattgttcccgaattaatggaaacaatggcaaagcgttatcgcttgctgcaatatatccgtttaatgcagccaatcggacgcagaagcctagcaaccaatttgcaaacctccgaacgtatcgtccgtggggaagtgacgcttcttaaagatcaggggctcattgaactgacgacggctggcatgcgcctaactgaagcaggcgaatcgttgtttttagagcttgccgatatgatggcagagctgcttgggcatcgccggctggaagaaaagctggaagaaaagcttggcgtcggccaggcgattgttgtcgctggcgatagcgacgaagaagaatgggtgaagcaggagttaggtagagcttgcgtcgatgaattgaaacgtgtggctaaaaaaggcgacgtcttcgccgtaatgggcggcacaacgcttgccgcagtagcaaatatggtcacgccagatgagacgctagcgacaacgacgttcgtgcccgctagaggcgggttgggcgaaaaagttgaaatccaggctaataccattagtgctgagtttgccagacgctcaggagcttcttaccggctgctgcacgttcctgatcaattaagcgaagaagcataccattcacttgtattggaacgatcagttagggaaatcctagatgtgattacgtcttctgcggttgtcatgcctggcatcggcgatg

SEQ ID NO: 5900 - DNA, 469 bp, Bacillus clausii
atgttaaaagaagaaagactgcaacggatattaaagatgctcgaacagagtgacataattaaagtggcagatgtaatgaaagagctacaagtggcagatatgacggtgcgccgcgatttgcaggcgcttgaagaagcaggattgcttgtccgtttacatggcggagcgacaaaagcaggctacaaagagctatctaatacagaaaagcagagtttaaaccaaaaagaaaaaaaggcgattgcgaaacaagcagcttcactcattcatgaccatgacacggtctttctcgggcctggcacaacaaatgaatcgatgcatgcgtacattcaggctagcgacgtgaagattgtgacgacttcattgccgatttttatggaatttaaaggcgattctcggtttgagctattgttggcaggaggagaataccgtgaacggactggttcattcatcggagctctaacaaggcagt

SEQ ID NO: 5901 - DNA, 215 bp, Bacillus clausii
ttgcaaacttcaactgatcgtatgctgactcgaattaagtccatctacttgtacatcaaacagaagggaactgtcacgacgaatgaattagttgaagagttcggcatcacacagcgcactgtgcagcgagatttaaatgtattggagtacaataatttagtcacaagttctgccaggggtaaatggaaagcaactagtaaaaaaacaaaagtgtc

SEQ ID NO: 5902 - DNA, 792 bp, Bacillus clausii
atgtttgctaaagaaagagaagaaaaaataaaaaaggagatctaccgcaaaggaactgtttatgtcaaagaattagcaaaaacatttaatgtatcagctccaacaattcgaagtgatctggatagaatcacggcagactcggatgattttgaacgaactcatggtggggttatttacaaaagaaaaaaagaagaaagtaaagataaaatcgtaatgtacaatattcgtgcttccatcaataaaaaagaaaaagaagaaatcgctcaagtagcgctatctttagtaaatgaaagagacacactcttactagactcaagttcaacctgctttgaatttgcttcattattagccgacccatcctataaaaacaaaaatactattctaacaaatgggctatcaacagcgatgattttaaagcaaaatccaaatttaactgtcattatttttgggggcattgtacggacagattcaaatacaatccatgatgaatttcaagatcctattttagaccgatttaacattgataaatacttcttttctgcatctggtttatcaatcgaaagcgggttttcagagtttaatattgaagaagttaaaacaaaaaaagaaaacttaagacgagctaaattaaaaatcgctctcatcgatcatacaaagtttaatcaagactcgagttccacctttggttcactagattgtgccgatattcttatctctgattctggcttagataaagctattcaaaacaaatatagcgcattgattcctttacgaacctatggaattcgttga

SEQ ID NO: 5903 - DNA, 463 bp, Bacillus clausii
atgttcacattggaacggcacgaaaaactgcttgcctatttagcgaaacataaatcgatacgcgtttcccaagcgagcgaatggcttggtgttacagaaaaaacaattcgcttagatttagagcggcttgaagaaaaaaagctgcttaagcgtgttcacggcggtgccgtattaatggaaaccgacacaagcttgtttccaattcaggagcgggagcaaagaaatgaaaaggaaaagcacgatatagcggaaaaagcaaaatcgttgatttgtgagaatgacgtgattttgctagatggcggcagcacgacgctggcccttgctgagcgccttggcgacaagccgatgacggtcattactaatgacatccggatcgcgaacgccctttatgaaaaagaagcaattcagcttattttgctcggaggaacacgacttggcacttcttcggcacttgtatagccag

SEQ ID NO: 5904 - DNA, 234 bp, Bacillus clausii
gtcagcattgccccatggccttaccaatgccgaccaactcgagtacgaaattaaaaagatcgcagccgaaaaagcacgtgaggtatttttgcttgccgaccaatcaaaatttgggaaatccacgctattgacatatgctcccttcaaccgagtcgaccacttaattacatcagctccactcgatgaagagtacgcagcctattgccaagaccaccatatcgatgtcgtggtcgc

SEQ ID NO: 5905 - DNA, 840 bp, Bacillus clausii
ctatatacgcccgattgagcgagaccatgatgaaacgaaacaacaagcgttacaaacgttaatacgtccgtttttgttgcgccgtacgaaaaacgaccctgctactggactacaattgccaaacaagcgggaaacgaccgagtctgtccccctttccttggaacaagctgccttttaccaagcagtagtggaagatgtgtcagaacgcctcgccacagtcgctaatttggaacggaaagcaatgatcctgcgcgccattacacggatgaaacaaatttgcaatcaccccgctcaattttataaagacggggatatagccgggcatcaatcagggaaatgggatgctttcctcgacattgtcgccagcattttctcaaaaggcgagagtgtcttgatctttacgcagtataaagagatgggcaaattgattagccaagaattgcaggcacgttacgggatgtctgtaccttttttacacggtggcctatcccgtagccaacggcgtatggccattgaccaatttcaacacgatccacatgcggccgcatttgtcttgtcgttgaaagcagggggcgtcggcttaaacttaacaaaagcaacaaacgtgattcactacgaccggtggtggaacccggctgttgaaaaccaagcaacagaccgtgcttacaggatcggtcagactaagcctgtccaagtatacaaactgctgacggctggcactgtcgaagaacgaattgatcagcttatcaatggaaaaaaagcgcttgctgaaggggttctgcagacacctgcgtttttaacagaattaaatgatgatgaattgctttcccttattcaact

SEQ ID NO: 5906 - DNA, 1206 bp, Bacillus clausii
cgtccgttccctcctttctgctgacaacgtctctgctgcctttgctgcttggaaacaagccgttccccaggaaatggtgccttttttgcattcattggaaacaggccgctcgaagacagtttcaccgccaagcacattgtttgcagaacagctgggccttaaaagggcggagccgtttcaaacagctcttgttttacacgatccaccatccccaaaggaaagctggtctgtctctttatctgtagctgaccgcaaccgtccagaaacattagtaggcatggaacagctgatggctggcagtcatccttggcggacaaaccctgtctcacggttaaaaagcgatgttttgctaatatcgaagcacattccgctactagcaggcctgtcgctgggagctcctacaaagacgatgagcgctgaagaagcgtatcagctctttaccacttacgacaggcaacttgctgaaatgggcatccaattgatcgtgccaaaatggcttaaagagcgaagtccatgaagcgttcgcctgattggggatcaccaaaatgcacaaaacggggcagaccccgttttaaactggcaagatttagcgaacttccaatacacagtctccattggcgggcaagccgttacagaggaaacgtttaaccaatatgtacaagaaaacaaaccatttctttatgtaaacggccagtggctagcttgggacccaacgttagcaaagcaacttaaagcctatctcgaagatatcaatagccgttttacttatttggatgcttggaaaatcacgaaaacacaagatgtccccgaagcccttgccactgttccatttcagctagaatggacagacgagctagaagagaggctgacggcgctctataagcagcagcctgaaccggtaacaatgccttccgccttaaaaggcgcgttaaggccttaccaaaaacaagggcttgattggctttcccatttgcgcaaagttggctttggcggctgtttagccgacgatatgggcttaggcaagtcgattcaaacaatcgcctatatgttatatgtccaagaacagcaaacggagcaacaaacagcgccattcctcctcatctgcccaacttcgttgctttacaactgggccgacgaatgtaaaagatttgcgccgagcttaaaggtgttcatccaccacggccaagatcgccttgaaaaaggaga

SEQ ID NO: 5907 - DNA, 489 bp, Bacillus clausii
atgattcgcggccttgtcaaaaaagcgcttattttagtgccagcttcactcgtgtcacaatgggcgatcgagctaaacagcaaattttacattcctgcgattccgcaaaaaaaagcatatgtatgggagcaatgcgacgtggtcgtcgcctcaattgacactgcaaaacgccagccgcaccgtgagattgtgctcgcccagccatacgatatggtcattatcgacgaagcccataaactaaaaaacccaaaaacaaaaaactacgagtttatccgtttgttgaaaaagaaattttgcctgctgttaacagcaacgcctgtgcaaaacaagctggaggaaatctttaatttagtgtctttactaaagcccggccaccttggcaatatcgagagctttaaacaacaatatcgggccaataaccgttctgcaaaaaatgatgaacagctccgtgctctcattcaaaaagtaatggttcgcaacccgccgtga

SEQ ID NO: 5908 - DNA, 705 bp, Bacillus clausii
accattttacgttgcttacgttgaagcgagaattatgctctagccgggaagctgtctttgttacgctgaaaaacatgattgataaatatgaacaagaggggaaagagacaggggcaattgtcgaattgctcaacgacgcgacagcagttgatggccacgccaaggccgaaaaagcactcgaattgattcaaaaaattgatgacaaagtcattatttttaccgaataccgcgccacccaattgtacttgcaatggtttttaaaacaacatggcattacaagcgtgccctttcgcggtgggttcaaacgtggcaaaaaagactggatgcgggagctattccaaaaacatgcacaagtgctgatcgctactgaggcagggggagaaggaatcaaccttcaattttgccaccatattatcaactatgatttgccgtggaatcccatgcgtgtcgaacagcgaatcggccgtttgcatcgcctaggccaagagcatgatgtacgcatctataattttgctgtccaacatacagttgagcaacatattcttgagctgctctacgagaaaatccatttgtttgagtccgtgatcggtgaattagatgacattttagcaagaattgatctacctgaaatagaagagtacgttcaatccgtcatggctcagtctacttcagatggtgaaatgaaaattaaatttgatcacttag

SEQ ID NO: 5909 - DNA, 705 bp, Bacillus clausii
caaccattttacgttgcttacgttgaagcgagaattatgctctagccgggaagctgtctttgttacgctgaaaaacatgattgataaatatgaacaagaggggaaagagacaggggcaattgtcgaattgctcaacgacgcgacagcagttgatggccacgccaaggccgaaaaagcactcgaattgattcaaaaaattgatgacaaagtcattatttttaccgaataccgcgccacccaattgtacttgcaatggtttttaaaacaacatggcattacaagcgtgccctttcgcggtgggttcaaacgtggcaaaaaagactggatgcgggagctattccaaaaacatgcacaagtgctgatcgctactgaggcagggggagaaggaatcaaccttcaattttgccaccatattatcaactatgatttgccgtggaatcccatgcgtgtcgaacagcgaatcggccgtttgcatcgcctaggccaagagcatgatgtacgcatctataattttgctgtccaacatacagttgagcaacatattcttgagctgctctacgagaaaatccatttgtttgagtccgtgatcggtgaattagatgacattttagcaagaattgatctacctgaaatagaagagtacgttcaatccgtcatggctcagtctacttcagatggtgaaatgaaaattaaatttgatcactt

SEQ ID NO: 5910 - DNA, 327 bp, Bacillus clausii
tctttttcaagaagatcctgattccttttacggcacatttattgagacagatcgtgctttactggacgccccactccacaatcgcctgtttcaatcacctgcgggggaggcaacgatttaccaagcgaatgaaggttgggacgcctatccatttccagtcgaaggaatcacgttatccataaaacaatttatcgcttatttccctgtttttcagacatggaaacagaaagaacccctttgcctaggggcggacttttcagcatggcttgccattgtagaaagcatttatggatttatacgagcaggccttgtcgtgccaggtacaag

SEQ ID NO: 5911 - DNA, 459 bp, Bacillus clausii
gcatttggatccatggaggctggattgacagtcgtttttttctatggggcgaacaaccgcaaggaaaaggaactggacaaaatgggtttatgtatccttttttggttccgccatttgaattgaaactgcttctttttcaagaagatcctgattccttttacggcacatttattgagacagatcgtgctttactggacgccccactccacaatcgcctgtttcaatcacctgcgggggaggcaacgatttaccaagcgaatgaaggttgggacgcctatccatttccagtcgaaggaatcacgttatccataaaacaatttatcgcttatttccctgtttttcagacatggaaacagaaagaacccctttgcctaggggcggacttttcagcatggcttgccattgtagaaagcatttatggatttatacgagcaggccttgtcgtgccaggtacaagac

SEQ ID NO: 5912 - DNA, 414 bp, Bacillus clausii
ttgccgctactgagcaagaacactcggactgcgccaatgtacggcaccatgtattcattgaagagcaaggcgtctccccttccattgaacgggatcagtatgacgagtccgctacacacatcattatgtacgacggaaaaacaccgattggtacagggcgtgtccgcttattgactcataacgaggctaaaattgaacgggtttgtgtgatcaaagaaaagcgccggtcaggggcagggaaacaattgatgacggcgcttgaggaagcgagcgcgagaatgggagcaaaagcagcaaagctcaatgcccaaacacacgcgagctatttttatgaaaagcttggttatacagtaacttcccctgaatttatcgatgctggcattccccatgtcacgatgagcaaaccgcttaaat

SEQ ID NO: 5913 - DNA, 507 bp, Bacillus clausii
atgatagagattattaaagctacagatgatcatattaaaggtattattaaagtgtgcacagatgcatatagggctacatacaaagatttatatacaaatgaatacatagaaaagattataaaaaaattttataattatgatagtgttttaacagaagttcaaacttcaaatcgtaattgggccgggtattatgttgccattgagaaaggtcatataataggggctggcgcagggggaattcttgatgatggtagtggtgaattattcgttttatacctcgcacctaataggagaaatgaaggtatcggatctacattactttatgctattacagaacaacaaaaggcattaggagcaaaaaagcaatacgtttccgttcaaaaaggaaatcacaaaggtattcccttttatgaagcaaaaggatttgtatttcaatacgagcaaaaaagctacggtaattccgaaggcgatacttatatatcgttaagatactgtagaaaaatataa

SEQ ID NO: 5914 - DNA, 456 bp, Bacillus clausii
tcgccaaagtccatgtagatagttggcaagaaacgtataaaggcatcattccagaccagtttttagaaagccttacgtacgaatcaagggaaaaaggatgggaagagcttatagctgatccaagacaagagattttagttgttgaaaataatgcaggcgagatcgttggctttgttagtggagtgatgcaggaagacaaacgtaccggagagttaaaggcgatttatttgttgaaagaagagcatgggaaagggattggccggcagttagttaggatgcttttcagccgtttgaaagcaaaaggctgtgaaacgatttttgtggaagtccttgcacaaaatgatgcctgccgtttttatgaaaaacttaatgcgaaatggcatgccacgacttcgattgccattgccggcaaacttctgcgcttatgtgtgtataaatgggaggacgccgatttgg

SEQ ID NO: 5915 - DNA, 456 bp, Bacillus clausii; identical to SEQ ID NO: 5914

SEQ ID NO: 5916 - DNA, 468 bp, Bacillus clausii
acttcaagacattagttatgaaacatacaatgaaacatttaaggatcataatacacccgaaaatatgaatgcctatttgaaaaaagcatttaacgaaaaacagttagaaaaagagttagccaaccgttcctcgcatttcttttttatttactttaacaatgacgttgcgggatatttaaaggttaatatgaatgatgcccagtctgaagacatgggggctgaatcacttgaaatccaaaggatctatataaagaccaaataccaaaagcttggacttggtaaatatttgttaaatcaagcgatcgaaatggcaatcgaacggaagaagaagaacatctggctcggcgtatgggaaaagaatcacaatgctctttctttttataagaaaatggggtttgtgcaaacaggagcacactcattttacatgggagatgacgaacaagtcgatttcatcatgagcaagacact

SEQ ID NO: 5917 - DNA, 495 bp, Bacillus clausii
tgcaacttcgagaaataacaattagcgatgcaaagccgtttttgcagttgcagttgcaattagataaagaagcgagttacatgctctatgagcctggggaaagaacgacaacggtacgagaacagcggaaggcgattgccgatattcagcaatctccgtcatctaccatttttgtagcggaacacaacaagaagcttattggctatctgagtgtgtttggttcccgcttgcagcgcattcgccatgttggctatattacgatcgggattttagaggagtattgcaaccaagggattggcaggaagctgttagagcaagcggaccattttgcccagagcgttcagcttcaccggctagagctaacggtgattgaagagaatggacgggcgctgcacttgtaccaaaaatgcggttatgagcaagaaggcgtccgccgccgggcaatccgacatggcgacaagtggcttaatgagatttatatggggaaattgttgt

SEQ ID NO: 5918 - DNA, 414 bp, Bacillus clausii
acgagttatataacagagaatttcaatatgacttatcgtttcgtgattttattgcagacagtgtaacggggtttatggacaggtccaatcgtcgagaaaacatttggatcctagagattaacggcaaacaaaaaggctcaattagtataaaagaggcgagcgatgagacagcacaactcggtttgtttctccttgacccttccacaagagggtgtggctacggacaggagttgctagaaacagcgattgcgttttgtaaggaaacaagctttgagaacatcattctgtggacaaatagtgatcacaaagcggcacgaaagctctatcaacgaaatggatttgaacttacagaaacaagagttcgactgttgtcaaataaacaactaaccgaagagcaatgggcgcggcccctct

SEQ ID NO: 5919 - DNA, 390 bp, Bacillus clausii
  misc_feature (1)...(390): n = A,T,C or G
ccgtccgggaaattggtgaagctgttgggcttgcttcaagttccaccgtacacggccacttggccagactagaaaaaaaaggctacattcgccgcgatcctactaaaccgcgggcgattgaagtcctttctctcggatttgataatgatacatttgtcaaaaaagagacagcaagctttattccggtaatcggaaaagttaccgcaggtgtgccaattactgctgttgaaaacgtcgaagattacttgccactccccgaccaccttgccgcttacgacaatacgtatgcgcttgtcattcaaggggaaagcatgattgaagcaggtatttacgatggagaccaagtgatcgtacggcaacagcaaacagccgataatggcnatattattn

SEQ ID NO: 5920 - DNA, 342 bp, Bacillus clausii
  misc_feature (1)...(342): n = A,T,C or G
ccgtccgggaaattggtgaagctgttgggcttgcttcaagttccaccgtacacggccacttggccagactagaaaaaaaaggntacattcgccgcgatcctactaaaccgcgggcgattgaagtcctttctctcggatttgataatgatacatttgtcaaaaaagagacagcaagctttattccggtaatcggaaaagttaccgcaggtgtgccaattactgctgttgaaaacgtcgaagattacttgccactccccgaccaccttgccgcttacgacaatacgtatgcgcttgtcattcaaggggaaagcatgattgaagcaggtatttacgatggagacc

SEQ ID NO: 5921 - DNA, 492 bp, Bacillus clausii
aaagcctattcaacaggacgaggcttcaattaccgtacgcgctaaaaccgaaattgtcgaaaacaaaggcaaacagtcgattatcgtcacggaactgccataccaagtcaataaagcgcgtctgattgaaaaaatcgccgaactagtgcgtgacaagaaaatcgatggcattaccgaactgcgtgattcttcagaccgcaatggcatgaacattgtcatcgatgtgcgtagagacgcaaatccaaacgtcattttaaacaatttgtttaaacagacagccttgcaaacaagttttggcattaatatgcttgctcttgtgaacggccggcctgaagtcttaaacttgaaacagacgctggaacaatatttggctcaccaagtagaagtgatccgcaggcgcactcagtttgacctaaacaaagcggaagcccgtgcccacattctggaagggttgcgcattgcccttgatcatattgatgaaatcattgcctt

SEQ ID NO: 5922 - DNA, 330 bp, Bacillus clausii
cattgtttgggccccaccgtgatgacgtttctttctctgtcaatggtttagatgtccaatcctacggctcacaaggacaacaaagaacgacggcgctgtctgtcaaactagctgaaatcgatttaatctatgcggaaattggcgattacccgattttgcttttggacgacgtactatctgaactagacaattatcggcaatcgcatctgttagaggcgatccaagcccgtgtgcagacgtttgtaacgacaacttccacaagcggaatccatgagggcgtgttggctgaagcttgcctcttttccgtagaccaaggcacagtgaaacgat

SEQ ID NO: 5923 - DNA, 557 bp, Bacillus clausii
ttgtttgggccccaccgtgatgacgtttctttctctgtcaatggtttagatgtccaatcctacggctcacaaggacaacaaagaacgacggcgctgtctgtcaaactagctgaaatcgatttaatctatgcggaaattggcgattacccgattttgcttttggacgacgtactatctgaactagacaattatcggcaatcgcatctgttagaggcgatccaagcccgtgtgcagacgtttgtaacgacaacttccacaagcggaatccatgagggcgtgttggctgaagcttgcctcttttccgtagaccaaggcacagtgaaacgattggagttaagtatgtatattcacatcggtggagatgtcattttgccagctacacaaattatcgcaatcttgccctatgcagagggcgaactggcaaaagatacagccgtttttttacacgaatgggatacgaaacacgattgcaaaaaaattgcatcagaagattcagtgaaaagtgtcattgtaaccgatacttgcatctatttttccccggtttcctcgcagacgtt

SEQ ID NO: 5924 - DNA, 642 bp, Bacillus clausii
  misc_feature (1)...(642): n = A,T,C or G
tctaccgtaaagaagtaaaagtcgttgttgaagcgcgctcggctgtatttgctcngtttacaaacattggcctcattatcattgacgaagaacacgaagcgagctacaaacaagaagaaacgccgcgctaccatgcgaaagatgttgccctttaccggggacggaagcacaaggctcctgttcttttaggcagcgccactccttcagttgaatcgtttgctcgtgccaaaaaaggcgtataccgccttttgtctttgagggaacgaattaaagggcgcccccttccagaggtcgatgttgtcgatatgcgtgaagaactgcgacgtggcaaccgttcgatgttttcagggcagttgctgcaagcgttgcaagcacgccttgaacgcaacgaacaaagtgtgctgtttttaaacaggcgcggctactcgacgtttgttatgtgtcgggattgtggttatgtggccagctgtagccattgtgacatttcctatacataccaccgggctggcaattcgctcaaatgccattactgcggcgatgaacagccaatgccaaagacgtgcgcagaatgcggaagcgatcatattcgtttttttggctctggtacgcaaaaagtcgaagaagagttagcgcgccttttgc

SEQ ID NO: 5925 - DNA, 589 bp, Bacillus clausii
gtgattgcccgtgtcattgttgatgtgccgacagcacagacggacaggctatttgattacgaagtgccgcacgaatggcgagcgtttgcacgcccaggtgcccgtgtgattgtcccttttgggcctaggcgcatacaagggtttgtcgtcgctctcgaacaaacgagcgaagcaacgaaactaaagccaattagtgaagtgcttgatccattgccagtgcttagcaaagaattgttagaacttggggactggttggcaaaaacaaccgtttgttacaaagtcaaagcgttttctgcgatgctgccagccgcgttaaaaacaaaagtcagcaaacaagttgagcgtaaagcggcactggatttgttgccattgccgctgcaaacgctgttcgcggaccacgatgtcgtaccatgggaagaagcacgcagtctcatgaaacaagatctgtcgcttctaaaaacagcgcttgacgaaggggtagtctcactcgtatataaagtgactgaaaaaggcgccaaaaagacagcgagactcgtacaagctttgccgaaacaagtagaggacattcccgaacgtgccaaaaagcagc

SEQ ID NO: 5926 - DNA, 465 bp, Bacillus clausii
taaagacactaacagtttagcacatacaaagtggaattgtaagtatcatatagtatttgccccaaagtacagaaggcaggtaatctatgggaaacttaaaaaagacattggagaaatattaagaacgttgagtgaaagaaaaggtgtcgaaattattgaagcaactgcttgtaaagatcacatacatatgctggtgagtattccgccgaaaatcagtgtgtcttcatttgtgggatatttgaaagggaaaagtagcttgatgatattcgatcggcatgcaaatttaaaatatcgatacggaaatcgaaaattttggtgcacaggtttttatgtagatacagtgggaagaaataagaaagtaattgaagaatatataaaaaaccaaatacaagatgatatagtcgcagaacaattaagtttgttggagtatgtagatccatttacaggtgaagaggtaaagcgtaa

SEQ ID NO: 5927 - DNA, 819 bp, Bacillus clausii
ttgtttcccctatgcttttaaaccgaattgacacgccgtcggaaaacaattggctgactgagctaaaattcgatggcatacgtctgatcttgtccaaacatgacggcttaacacggctgtataccagacataaaactgaggttacaaaccgatttcccgaactgtgcaacaatgatattgccgacggtaccattttagatggcgaactgattgtactaaacgaggaaggcaagcctgactttgaactagtcatgtctcgctttcgctcttccaaaacaactcccataatacccgtgcagtttgtggtttttgacataatgaagcacaaacatacctggactactgccctgcccctcatacaacgcaaagaaatcctatccaatgccttacatccgcatccccatatgtttgagattaaatggctagaaggacaagccgactcttactttgacgctgttaaaaatagagaattagaaggaattgtgataaaaaatccggcatctacctacaaaataaataaacgatcaggggattggctcaaagtcattaattatcagttcacagaaggcctgattacagggtatagaaaaaacgaattcggcttgctgctagaaagttttgagggcgagtcatggggagtcatggagcatatgcctatcaagtcacgcagggaattttacaagctgactaaattacagactgttaacgaaagcaagaactttgtacacctagagacgccattcccatgcaaaattaggtacagacataaaacaagcaaaggttatctccgtatacctacttttgttgattggctaatat

SEQ ID NO: 5928 - DNA, 450 bp, Bacillus clausii
tatatgcgtatacgcaacgttggttctcgtgccgagccatgggacaagccctcaaagaaaacctgccgatgatgtggctcgctgctggacaagccccaaactttcggacgatcaatcgctttcgctcagaacgtttccaatcgttgatggaaggcctgtataccgaaatgacgcatcttctgatcgaagaaggctatgtcgacatggaggcctattttctcgatggcaccaaaatcgaagcgaacgccaataaatactcgttcgtttggaaaaagagcacgctttcccacgaagagaagcttcaaatgaaaatcgataaaacgttagaggccattcaagaagcgattacgttggataccgaaaccttaaagcaggaggacgccacgtttgaacggcaactaatcagccgcaaacgtcttcaagacgtcgtcacaaaggtggaaaaggaac

SEQ ID NO: 5929 - DNA, 1338 bp, Bacillus clausii
agaccgccaagggacgattatttatgttggtaaggcaaaagtgttaaaaaacagagtgcgctcctactttacggggagccacgatagcaaaacacaacgccttgttggagaaatttgcgattttgaatacatcgtcacctccagtagcatcgaagcattgattttagagcttacactgattaaaaagcatgaccccaaatacaatgtgttgttaaaagatgacaaaacgtatccgtatattaaaatcacgaatgagcgtcaccctcgtttattaattacgcggaaagtgaaaaaagacggggcaaagtactttggcccttatccgaatgcaggcgcggctacggagacgaaaaaactgttagaccgcctgtatccattgcgtaaatgccggaaaatgccggactccgtttgtttgtattaccacatcggccaatgtcttgctccttgcgtatatgaagtgagtgaagaaaccaacgaaactatggtgaatgagatcacaaagtttttgaaaaatggtcatagcgacataaaagagcaactgcgcgaacgaatggaaaaagcggccgaagacctagactttgaacgggctaaagaattaagggatacgattgcacaaatggaaaaagtaatggaaaagcaaaaaatggcgtttgctgacaaaacggacagggacgtatttggcttttcatacgataaaggatggatgtgcgtccaagtattctttattcgccaaggccgcctcattgaacgagacgtgtccattttccccttttaccaggaggcaagcgaagagctgctaacatttattgcccggttttatttagaaaaaaaccatattaagccaaaagaaatttttgttgctgaaagcgtcgataaacaattgctggaagagttgcttgagacgcgcgttacacagccaaagcgaggccaaaaaaaagcgttgcttgatttagctgaagaaaacgctgctctcgctttaaaagagaaattttcgctcattgaacgtgatgaacagagaacggtgaaagcagttgaacgtctcggggaggcaatcggaatcaatgcgccttaccggatcgaggcatttgacaattcgaacattcaaggtgttgacccagtgtctgctatggttgtttttgtaaacggcgtgccgcagcgaaaagagtaccgtaaatataaaatcaaaacggtagaaggccctgatgattatggatcgatgcgtgaagtcgtgcgtcgccgctacgtccgccttttaaaggaaaaacggccgttgcctgatttgattgtcattgatgggggagccgggcaaattgctgcggctaaagaagtgattgaaga

SEQ ID NO: 5930 - DNA, 251 bp, Bacillus clausii
ccactcaatgacaaagccattttccagttgcttcaacaagggaaatcaacggggattttccaacttgagtcggcaggcatgaggcaagtgctgaaacagttgcagccaagccagtttgaagacattgttgctacaagtgctctttatcggccagggccaatggagtttattccagaatacatccgtggcaaacatgggcacacgcaagcgattatcccccatgaatcgctgcggccaattgtcgagccgac

SEQ ID NO: 5931 - DNA, 456 bp, Bacillus clausii
cagtttagcacataccaagtggaattgtaagtatcatatagtatttgccccaaagtacagaaggcaggtaatctatgggaaacttaaaaaagacattggagaaatattaagaacgttgagtgaaagaaaaggtgtcgaaattattgaagcaactgcttgtaaagatcacatacatatgctggtgagtattccgccgaaaatcagtgtgtcttcatttgtgggatatttgaaagggaaaagtagcttgatgatattcgatcggcatgcaaatttaaaatatcgatacggaaatcgaaaattttggtgcacaggtttttatgtagatacagtgggaagaaataagaaagtaattgaagaatatataaaaaaccaaatacaagatgatatagtcgcagaacaattaagtttgttggagtatgtagatccatttacaggtgaagaggtaaagcgtaaaaa

SEQ ID NO: 5932 - DNA, 525 bp, Bacillus clausii
accaagcccaacgctattcaaaacccgctgatggccttaaagctaaaagaaggggacgaagtcgttcggcgtgcttttgacagacggccagcaagaactgttcgtagccacttgcctctggatatggactttggttttcggaagaagatgtttccctcgtcggccaacgtgccgccggagtaaagggaatcaatttaaaggaaggcgattcctgcattggcgccgaagcatttggccttgaagattcggttgaatttctcgtcgctacacatcggggcgcggtcaaaaaaatggccattactgaatttgaaaagtcaagccgcgccaaacgaggcgtgttaatgctaagggaattgaaaaacaaccctcatcgattagttggactcaagcgtgtccgctctcaagatgaaacgtttgccatcgaaacggcaaaaggagacatgattgaggtctcgccaaaggactatcgccgtgctgaccgctactccaacggctcctatgctttcgaccaacacgaaagcggcg

SEQ ID NO: 5933 - DNA, 426 bp, Bacillus clausii
  misc_feature (1)...(426): n = A,T,C or G
atgttgccaaaacgattgaatgctgatgaagcaattgtttacaatgcggtaaaaaaccggtttctgatgcaatttatgccgccagcagaatttttagaaacgaccattcatacaaagctagaagaaggcgtagcagaagggttttttgtttcaaagggaagggaaaagcgagctgatggctggcaccaagtagagcaagtaaacgggaaggaaacatttttgcccaatgtggaagaaggagagcgtgtcaaagcgctttctggaaaaacgagcgaccatatgacaacaccgcctaaaccacatactgaaaaaacgttgttgcatattatggaaacatgtgggcggaagctcgacaaagacgatgcagaacagnttatgaaagggtatgcgattggcacagctgcaacgagagcagataccatttaa

SEQ ID NO: 5934 - DNA, 582 bp, Bacillus clausii
gaacacaaatgattgccaaagggctcgattttccgcggattacccttgttggcgtattaacagcagacacgatgctgcatattcctgatttccgcagtgctgagcggacattccaactgttggaacaagtggcagggagggctgggcgtgaccagcttaaaggcgaggtcattatccagtcatatacacctgaccactatagcatccagctcgtaaaaagccacgactatgaacaatttttcgccaaggaaatgcaactgcgcaaacagggcagttatccgccttattactatatggcgctcttgaccatttccgatacggagcttgcgagcacgatatcagcggcacaaaaagttgcccgttacttaaaagagagcttaaacgaagaaactgttgtcctcggcccggttgtctcgccaattgccaggatcaaagatagatatcgctaccaatgcgtgataaaatacaggcatgaaccaaagcttcaagaaatacttgataccgtcatgcgccattatttgcgcgatgcaacgaacaaaaaactgcaaattagcatagatgtaaatccgcatttctttatgt

SEQ ID NO: 5935 - DNA, 812 bp, Bacillus clausii
  misc_feature (1)...(812): n = A,T,C or G
atggacaaaaaacaagcgatccaagtgttagaaactatcgcgacttacatggaaataaaaggggaaaacccttttaaaatagctgcttaccggagagcagcccaggcattggaacaagacggccgcacgttagcggaaatggatgacccaaaagcgattcctggaatcggccaagcaacggccgatgtcatccaggagctgaaggaaacaggagcgtcatcgttgctaaatgaattggcacaacaattgccggcaggattattgccgcttctaacgattcctggacttggtggcaaaaaggttggcaagctttaccgagaacttggcattactgacgcagaaagcttgcttcaggcagccaaagccgggcaaattcgcgcgcttgcaggatttggcaagaaatcagaagacaacatgattgaagcgcttgccgtttggaatgtgcggccagaacgccttcctgttgccgacgtgctgccgttttccgagcaacttgaacaacagattgccgactttcacgatgtaatacgcttttctcgagcaggcagtttacgaagaatgcgggaaacggtcaaagacttagactatatcattgcgactgacaacccatcttcggttaaggaccaaattttgcagcttgaagggattgccaacattattgcaaaaggaaatggcaaagtatctgttgaacttgaccttgaagaacatacgatttctgttgattttcgccttgtccctaatgaatcatttgctacagcnctgcaccattttactggctccaaagaccacaatgtccgtatgcggcaactcgc

SEQ ID NO: 5936 - DNA, 207 bp, Bacillus clausii
ctacggaggaagccatttgaaagctggaaacttctttacctaaaaacgccattcaaacagccaccgtagagcgtggaaaagagtttgcctgttatgcatccatcgagtaaacaaactctttcctttattttgcggatccttattctttttggccaagaggcagtaacgagaatgaaaatcggtttctgcgagatttctacccgaagg

SEQ ID NO: 5937 - DNA, 423 bp, Bacillus clausii
tatttaaagatagaaacagttattccaaaacagatcacgatgcaacttttatgcgaatgaaagatgactatatgcagaatggacaattaaaagctgggtacaacctacaagtagctaccgaaggtcagtatgcattagcttatgatatatttccgaacccaacagatacacgcactttgattccgtttttaaataatatagaagataattatttcgaactaccacaatatatcgttgccgatgccggatatggtagtgaacaaaactatgataatgtattaaatgtgcgtaagcgaattccacttattcatataatcaatatagaaaagagaagaaaaggaagtttaagaatgatccatttaaacggcaaactggcaatatgatggcgaaacaggtcgtttattggtccaaataatcgcagat

SEQ ID NO: 5938 - DNA, 192 bp, Bacillus clausii
  misc_feature (1)...(192): n = A,T,C or G
catggcaaagaggcagnaacgagaacgggaatggcctccngcgagagttctacccgaagggaacggatncngnntgcatcganccatnngaattanctaggaatttagctcttatcaangaacgaccaagaaaatgtttacaatggcgaacagcacacnaggctnnnacccatgaactggatgcacttgaat

SEQ ID NO: 5939 - DNA, 1144 bp, Bacillus clausii
atgaaaccaatgaaactgacggagacgaccgcatttcctcagtcaacaggctgggtcggagagcctaaatacgatggctatcgttgcctagtttccatcacagacacgagcgttgagctaatcagccgcaacgggcgattgcttaaccatgctttccctgaagttgtaagtgcttttgaagaaaggcaaacaaagctttcaggccagttgccgatcgtattggatggagagcttgtttgtttgctgaatggctatgcaagccattttcctgctgtacaaacccgttcgcgcatgagcaatgttcatgtgatcgaaaaggaaatgttaagcaggccttgccaatggatggcctttgacatactcaaccaacctaatgttccttatcgagaaaggcgcaaacagttgttatcattctgcaaacgggccgacattcccatcgttactccattaggcgatgtcccgacacttggtgtggttgagtcgacaagcgctattcaagcgctcctaacgacggtgaaacgttataatggcgaagggattgtccttaaaaaacagctaagcccatacaatcaaaatatccgttcaaaagattggctaaaactgaaacattaccggtttgtgcctgttcttgttactttttttgatgcgacgaatggctattttcacggcagcgtttatcaccaacaaagggagttaaacgaagtcgctatttttaagcacggcctttcgccagacgatgccaaaacgttagccaatttttttagaacaaaaggaacagctgaaaaaaatgggtttcgcctcgctccatcaatcgtcgttgagctcgcttgcattggcctttctggtggacaactccgtgaagtctcctttgtccgctttttgcatcatgctgatccagacgacatcaccatggccacactgtttcatggtttgtatccattgccagacattgtagagacgacaagtttggataaaccgttatgggaacaggtcacaaaagcggattaccttcattatttgcaagctgttatgccttttatgctgccttttttatatcaacgagcgcttactgtcattcgatttccccatgggacgtttgcaaatgagcgtttttaccaaaaacatattccaagttatgcgcctg

SEQ ID NO: 5940 - DNA, 231 bp, Bacillus clausii
aaccacatacaagccgtgaatttgcaaatggaccaggtaaattaacgaaagcaatggggattactatggcagactatggccgccttttaaccgaacctccgctctattttgcgaaaggtgacaacacagacgcatccattgtagcgacaaaacgtatcggcattaaaggcgccggttcatgcagccaccacccatggcggtttatagatggaaacagccgtgctgtatctg

SEQ ID NO: 5941 - DNA, 1020 bp, Bacillus clausii
  misc_feature (1)...(1020): n = A,T,C or G
gggcaaatgtcatttttcttgttgatatggaatcgttttatgcgtcgatcgaacacgcggccaatccccagtacgatgggcgcccccttgtcgtttctggtgacgtgaatcggagaagcggcgtcattttggcggcatgcccattagcaaaggctaagggagtgcgaaatgctgagcgcttatttgaggcgcagcaaaaatgcccagacttagtcgttgtgaaaccacatatgcagcgctacgttgatatttccctacaaatttcaaaaattcttggcacgtttactgatttggttgagccctattcgattgatgaacagtttatggatgtgactgggagccaaaagttgtttggccccccttatgagatagcagaaaaagtgaagcaagccattatggaccgctttggcgtaaaagcaagagttggcatcggcgaaaacaaagtattggcaaaactagcatgcgacaattttgccaaaaaaagcagtgaagggatttattggcttagaaaagacagccttgatcttgatttgtggtgcttgccgattgaaaaactgtttggcgttggccgaaaaatgagcgtccaccttcgcaatatggggattcgaacgattggccaactggcgcaaacggatggcgcacggataaaaaaacgttttggcgtccacggccaagtcttgtggatgtcagccaatggcgaagattactcgcctgtaacgagagccgcccatgcccgccgtaaagggtatggaaatggcatgacgctgcctcgggactatgtgaaaaaggaggacatttgtgtcgtgttgcttgagttgtgccaggaagtatgcgcgcgtttaaggcangatggctggatggggagtacggnncccctaagagtcaatggcgccgattttgttgaaaaacgccggtttcaccggtgcagtcatccgattcctttgaaacccancattccaatgnaagtatacgaagcggcgtgcgcgttgctagancggttttgggncggcnatccaatcc

SEQ ID NO: 5942 - DNA, 192 bp, Bacillus clausii
cttgcaaagtgaccaaaattggcagcttagcttatttgacgacaatgcgagcagggatcgtctgtcaacgattggttatgtgatggacggcatccgccaaaagtatgggaagctcgcgatccagcgtgcttcttcgttgcaaaaagcgtcacagcttcgagacagaagccaaaaaattggcggccattataa

SEQ ID NO: 5943 - DNA, 1206 bp, Bacillus clausii
aataccgatgaacacttacagagtcagggaagcaagtgatattgtgaggtcatcggcgaatatgtgcagctaaaaaagcaagggcgtcagtacggaggcctttgcccgttccatgacgagaaaaacgccgtctttttctgtatcggaagacaaacaagtgtaccattgttttggctgcggagccggtgggaatgtgtttacttttttgcaggaattgaagggctggtctttttctgaaactgtctctcacctcgcagaacgtgcaaaaatagctttgccgcaaatgcaaagaacagagacggacaaacctgaagatgcgcgcatcaggcaaatgaaaaaaggccacgagctcgctgcctctacttaccatagcattttgacgctaacagaagaaggggctccagggcgtgtttatgcacaagagagacttttcacgcaagaacagattgaacatttccgaatcggctatgcccttaatgattgggaaacgctcgctgtgatctttgaaaaaaatggtcttgacttagctgtaatggcagaatcaggccttttggcgaaacgcaaacaaggaaagggttattatgacttgtttcgtgagcgacttatgtttccgattacggatagtcaaggaagcgtagtggcatttggcggtagggccattggcgaaggccaaccgaaatacttaaacagcccggaaacgccgattttccacaaagcaaagacgttattccatatgcatgaagctcgtccgagcatacgtaaacaaaacaaagccctattagtagaaggggcatttgacgtaatggctgcttggaaagctggagtgacaaatgttgttgctacgctaggcactgctttaagcagcgatcatgcaaaacttcttcgccgcaatgcagaagaagtcattttatgttatgatggcgaccgtgccgggagagaagcgattcgcaaagcgattcccgtgttggaggaagctggctgcaaagtgtcgatttgcctacttcccgaagggctcgacccagatgattatgtgaagcagcatggcgaagaggcatttgtgcgcatactcgacaacgaatgcttatccgtaatggcattccgaatgttggatttaaagcaaggcaagaatatgcaaaatgaaggagatcggctccaatatatcgaagaaatcgtacagatgttggcaaaactcgagcattctgtcga

SEQ ID NO: 5944 - DNA, 362 bp, Bacillus clausii
  misc_feature (1)...(362): n = A,T,C or G
atgaactgtacttggncgagggcgactctgctggcggntcanccaaacaagggcgtgaccgcaaattccaagctgatcttccccttangggaaaagtcatcaataccgnaaaagccaagcntgatgacattgtgaaaaacgaagaaatccgnacgannntncatacaattggcgctggnntnggagccnattnngatagtgctgactgcaattatgacaaagtcgncatnatgacagatgctgatacnnacggngctcatattcaagtgctgttgcntacgtctatttatcgctncatgaaaccgntcatagatgaagggaaaatttacatcgccttgcctgctttatacaaagtaagcaaa

SEQ ID NO: 5945 - DNA, 303 bp, Bacillus clausii
tggccggtttgccaaagcaggtgacaacgagggcagaggcgcttttgactgagttggagcatcttccgcaaagaccgacaagtgcttcggaagagcaacaaatcgatagcgcaaaaacggaaacagcagcaacggtcgaagaaccgcagcagctctcgctatttccagctgatgatgaaacaaagccaaaacagctaacaaaaaaagagcgttcggtactagcgaaaatggctgaagtcgatgtgttgcacttgacaccgatgcaagcacttgaaaaaatcaatgagtggcaaaagcagctaa

SEQ ID NO: 5946 - DNA, 216 bp, Bacillus clausii
atggccgttattcaacagcttgacgatgcgctttctaataaaatcgccgctggcgaagtcgttgaacgtcctgcttctatcgtcaaagagcttgtcgaaaatgcgattgatgcaaacagcagccagattctagttgaaattgaagaaggcggcctttcgtccattcgcattgttgacaatgggacaggcattgagccgaatgaattagaattggct

SEQ ID NO: 5947 - DNA, 222 bp, Bacillus clausii
  misc_feature (1)...(222): n = A,T,C or G
tgaaacaaaggatttgccgtttgaggaggccatgaggcagttggaatggctcgtggaaaaactagaggaaggcaatgtccctctcgaacaagcaattgatatgtttaaggaaggaatggacttatcgcaaagctgccatgaaaaattactgaaagtcnagaagcagcttgaccaaattatgcatgaggatggggaactggttgaggcgaatttagaagagga

SEQ ID NO: 5948 - DNA, 132 bp, Bacillus clausii
ttatcgaagcccatgcgatgattgatcacatacacatgctggtgaaaattccgccaaaaatgtcggtatcgtatttcatggggtatttgaaagggaaaagttcgttgatgatccatgatcgtcacgcaaacg

SEQ ID NO: 5949 - DNA, 615 bp, Bacillus clausii
atggacttttttgcgggttcaggctcaacaggacatgcagtattagatatgaatgccgaagataatggtttaagaaagtttatattagttcaattaccagagattccaaaggactcagagttcgatagaataacagaactgacaaaacaacgtttacgaaatagcatagctcagttaaacgagaaagacggaaacgctgaaaaattggacagaggattctctgtttataatttggataaaacaaatattaagaaatgggaagagtatgaaggtgacgatataaccgtattaaacgaaggtttagatctgtttacatcgcacccattgaatgagcaaacaagtgaaataaatattattactgaattaatgttaaaccagggcttcccactcgacagtaggattaaaaccaataaagtggacaatgaactttggattgttgagcatgaagatgtttcattctctttagttgtttgcttagacgagaagttagatgaaaaatcaggggattacctggcaactaattatgaaaaatcaacattcatttgccttgatgatgctttaacaaataagcaaaaaatccttctaagcgaagcaatgaatgttaaaacaatttaa

SEQ ID NO: 5950 - DNA, 1272 bp, Bacillus clausii
atgaattatacacaaaaccagaaaatcaagcaaatcacaccatccaccttaatcattggcattgatatcgccaaagacaaacatgtagcccgcgctcaggatgaccggggcatcgagtttgggaaacgtctgatctttgaaaaccacattcatggctttgaacagctaattgtctgggccgaacgatatgcacaagagaatggaaagaagaccatccttttcggggcagaaccaaccggtcactattggaaaaacctcgcttattaccttgttgcgaagcattaccagttcgttgtcgtcaatcccatgcacgtgaaaaaaagcaaagagcttgatgacaattcaccaacgaaaaatgatacaaaggacgctaaagtgattgcacagctgattaaagacgggcgatactccgtacccaatctcgtagaaggcatttatgcggaactaagagaaggcgccaaaataagagatcagctcgtcgaacagcttatgaccacagaaggcagaatccaaaatctgattcagcgctacttcccggaattcttcggtgtattcggagactgggaaggaaaagccgccctttgtacgctaaagttctttccttttccttctgacatttctcagatgactcctgaagaagtgcttcagaaatggaagccctatgtccaacggggagtgggaatccaacgggcgacaaagctggtagaagccgcaaagaaaagcattggtctttccgtcggcattcgctttgccaggcaggaaatgggctgccttctcgaccaatacgagctgttcaagacccaactggaagaactagatcaggaccttgaagaggtgggaaagaccattccaggagctaaaaaaatgatggctattaaagggctgggagtcgctaccgtgacaaccatcctggctgagacaggcgatctgaccaaatacagccatccccagcagttgattaatttagcagggctgtctttacgagaaaatcgttcagggaaatggaaaggacaaaccaagataacgaagcgaggccgcagtaagctcagaagagctttataccttgccattcgcccgctcgttgcccataattccacctttaaagccctgcattcctattacacaaaacgccctgataagccgttaaaaaaacaacagtcattgattgctttgtgtgggaagttactgaaagttatttttgtcattggacagcgtcagtgtccatttgatggttctaagcttttgtgtggcatccctcagaaccaagcatga

SEQ ID NO: 5951 - DNA, 1260 bp, Bacillus clausii
atgttggatcagattctatcaagagacaatctcctccaagcgctcaagcgcgtggagtccaataaaggaagtcctggtgtcgatgggatgacgacaaaatccgtccgatcttatctcatggaaaactgggactccttgagaagggcaatcatggaaggaacctactctcctcagccagtaagacgggtcgaaatcccgaaaccgtctggaggcgtaagggcattaggcattccaacggtgattgaccgtctgatccaacaagccatcgctcaagtgttgtcaaagaagatggacccaagcttttccgaaaatagctacgggtttcgtccaggaaaacggggacatgacgcggtcaaaaaggcgaagacgtatatccaagaagggtacggatgggtcgtggacattgacctctcgaagttcttcgatcgcgtccatcatgaccgcttaatgagacgtctgagccagatcattcaagatcgacaagtgttgcgtctgattagacgctaccttcaagcagggattatggaaaacggactggttcagccgagtacagaaggaacgccgcaaggcggaccgctcagtccgcttctttccaacattgtgttagatgagtgggatcaggaactagagaaacgaggctaccgattcgttcgttacgcggatgactgccagatttacgtcaagtcacgacgggcggcaaaacaaacgctaacaaagatgacgacgttcctagaggatcgtctccgacttcaagtgaatcgggaaaagagcgcatgggggcgcccgtgggagcggagcttcctggggttcaccttcacgcgcaaccgacaagacccgaagatacgaatcgcacccacaagccttaaacgatgtaaagatcgcattcgcgaactcacctcacgtcgccactcgattgagatggaggaacgaattcgcagactgaatcagtttcttataggatggataggctactttcagttagtcgaaacgccatctttcctacagaaattagacgcatgggtgaagagacgcctccgaatgatccgctggaaagaatggaagaaaccgaaaacgagacagcggaagctcgtctcacttggcgccaggataggaaaagcgtgggaatgggccaatacgcgaaaagcctattggcgaatcgcgaaaagtccgatcttacacaaaaccctcgactctgcttattggaagagtcaagggctcaagagcttaatggaacgttatgatacacttcgtcaaacttaa

SEQ ID NO: 5952 - DNA, 307 bp, Bacillus clausii
atgctggtgtcgctgaagcttggacagtaagcgaagcgacacgttatattaagcaattgttagaagacgatccccatttgcctgaaatatggatacgcggcgaactttccaattttaaacagcatacgcgcggccatatgtattttacaatcaaggatgaaggatcgaggatgcaagctgtcatgtttgctggctataaccgcttcctccgctttaagcctgagaatggcatgaatgtgctcattcgtggcgaaatcaatgtgtacgagccatatgggcagtaccaattttatgcaaaagaaatgca

SEQ ID NO: 5953 - DNA, 465 bp, Bacillus clausii
taaagacactaacagtttagcacatacaaagtggaattgtaagtatcatatagtatttgccccaaagtacagaaggcaggtaatctatgggaaacttaaaaaagacattggagaaatattaagaacgttgagtgaaagaaaaggtgtcgaaattatggaagcaactgcttgtaaagatcacatacatatgctggtgagtattccgccgaaaatcagtgtgtcttcatttgtgggatatttgaaagggaaaagtagcttgatgatattcgatcggcatgcaaatttaaaatatcgatacggaaatcgaaaattttggtgcacaggtttttatgtagatacagtgggaagaaataagaaagtaattgaagaatatataaaaaaccaaatacaagatgatatagtcgcagaacaattaagtttgttggagtatgtagatccatttacaggtgaagaggtaaagcgtaa

SEQ ID NO: 5954 - DNA, 523 bp, Bacillus clausii
atggaatcaaacaacaaaccaaccttatattggtctttgctaacgtttagagatttgaatttttatatcgcttcaacctctaagggacttgtgtttgttggctcaccgaacaaaccattcgaggaattgtccgaatgggctaagaaacgctttagcggaagtcctttggtggaagcagctgaaaagcttgagccctatgcggttgaaatcaccgagtatttagaaggaaaaaggaaaacctttacggttccatttgattacgatggaacagcattccagcttgcagtctggaacgcactttgtgcaattccgtacggacaaactaggtcctattccgacattgccaattctataaataaaccagcagccgttcgagctgtaggggcggcgattggagcgaatccagtattaatcaccgtaccatgtcatcgtgtagtaggaaagaatggatcattaactggctaccgtggcggattagaaatgaagacacggcttttggatttggaaagacaaggcttatcga

SEQ ID NO: 5955 - DNA, 267 bp, Bacillus clausii
tggtttgctagatcctatagtagaagtccgcccgattgaagggcaaatcgatgacttaatcggccaaatccatgaccaaatcgccaaggacgagcgtgtgttagtaacaacgcttacgaaaaagatggcggaagacttaactgattatctaaaggaaatcggtattaaagtccgttatctccactcggaagtcaaaacgctagaacggctagaaattatccgccaactgcgccttgggacatttgatgttcttatcggcataaactt

SEQ ID NO: 5956 - DNA, 660 bp, Bacillus clausii
atgttgtcaaaaaaagatacacaatatgcaattgatcaaatgggagagctttttccagaagctgaatgcgagctaacccattccaatccgtttgagttgttaattgccgttgttctttctgctcagtgtaccgatgcactcgtcaacaaagtaacgccgaagttgtttgccaaatataaaacgccagaagactacgtgcaagttcctttagaagaactacaagaagatatccgttccattggcctctatcggaataaagcaaaaaacattaaaaagttgtcccaatcactgcttgagcattttaatggacaagtgcctagagagagggaacagcttgagtcccttgctggtgtcggtagaaaaacagcaaatgtcgtgacgagtgtcgcttttggcgagccggccattgccgttgacacccatgtagagcgagtctcaaaacgcctcggcatttgtcgttggaaagacaatgtacgccaagttgaagagacgctaatgaaaaaaattaaaaaagaagattggtccgatgcccaccatcgactgattttttttggccgctaccattgcaaagcgcaagcgcctaaatgcccgacatgtcctctgctagacatgtgtagggaagggaagaagcgcatgaaaaaaagcatggtcgaagcatga

SEQ ID NO: 5957 - DNA, 504 bp, Bacillus clausii
aaagaaaaccagaagctcgctatggaaaatgatattttaaagcaagcggcgctgatcatgggacgaaaatagacgtgatccgtcaaaatcgcgggatctacccagtggctgccatgtgtgcgattttgaacatcccccgtagcacgttttattatgaagccaagcaacgggatcacgaagaagaggaagaacagctgaccgcattgatcagcgacctttttcgtcagagccgaggcatctatggccagcgcaaaatcaaaaaagaacttactaaacaagggtggacggtttcacgccgccgcattggccggatcatgaaggcacaaggacttgtatccacgtacacggtggcccaatttaaaccaacgaaattcgtgtgcaacgaatcggaaatagggaatacccttgaccggaagttccaacaagaaaaagcgctaaccgtagtcgtcagcgacctaacgtatgtgccggtcggtgcaaactggcattatatttggatcatca

SEQ ID NO: 5958 - DNA, 1260 bp, Bacillus clausii; identical to SEQ ID NO: 5951

SEQ ID NO: 5959 - DNA, 375 bp, Bacillus clausii
aattaaaacaaaaaacatccaatcctatttgatttatacacctgacttctttagggaaatgaagcaagccattggcgatgggtcctttcaagaaaagctggaagctgtccgaaaagcccctgttctgatgctagatgacattggagcggaaacaacaactgcttggacccgtgacgaagttttaggcccaattcttcagtacagaatggctgagaaactgccaacgttgtttacttcaaattacgattacgatgagttagaagagcagcttgcctattcggaaaaaggcgggatcgaacggctaaaagcaaaacggattatggaaaggatcaaacattttaccacattcgtagaagtgggcggacaaaatcggcg

SEQ ID NO: 5960 - DNA, 765 bp, Bacillus clausii
atcaggtgcagggcaatacttcacaccacgtgtcttaattgatgtgatggtacaattagtagacccaaaaattggtgaacgttgtaatgacccagcggctggtacatttggctttatgatagctgctgaccaatatttaaaaagcaaaaccgatgattatttcgatcttgacccacagaaagcagaatttcaaaagaaagaagcattcagtggtatggaacttgtcaaagggacccatcgtttggcgctcatgaatgcattgcttcacaatattgaagggcgaatggaaaacggtgactcgttatcaagtaacggcaaatggatgaaaaattatgatgtgatcttaacaaaccctccttttggaacaaaaaaaggcggagaacgtgtatcacgtgatgatttaacatttgaaacatcgaataaacaattgaactttttacagctcatttataatgccttaaaagataatggacaagcacgtgcagcagttgttctaccagataacgtcttatttgaaagtggtgtaggcgcccaaattcgtcgggacttaatggacaagtgtaacttacacacgattctacgcttgccaacagggattttttatgcgcaaggtgtaaaaacaaatgtcttattcttcactcgaggaaagacagataaaggcaatacaaaagacgtctgggtatacgatatgcgtacgaatatgccatcattcggtaaacgaaaccagctaacaatggctcattttgaacagtttatgaaagcata

SEQ ID NO: 5961 - DNA, 870 bp, Bacillus clausii
gcgtgtaattgactattttgatgccgctgtattagggctgacagcaacgccagcattgcacacaaccgatatattcggtatgccaatttttaaatactcgtatagtgaagcggtgctagatggttttttagttgaccatgagccgccatacttgtttaaaacgaagcttgtcgaagagggcattcactttgagaaagacgaagatgttgaagtttataacgtcgatgcaggtgaaattattttagaaaaaatggaagacacgcttcatttcgaagttgagcaatttaatcgtcgtgtaataaccgaatcttttaaccgtgcgattttaaatgagcttgttcaatatattgacccaacaagtaaggaaaagacgctcatttttgcagcgacaaatcaacatgccgatttaatcgtacgtttattaaaagaggcgtatcaagagcttggtgatgaaattgaagatgatgcgattatgaaaatcaccggctccatttataagccgctgaacgcgattaaacgttttaaaaacgaacggttgcctaatgttgttgtaacggtagacttgttgacgacagggattgatgtaccggcaattacaaatttggttttcttgcgtcgtgttcagtcgagaattttatatgaccaaatgttagggagagcaacgagattacatccagagatagggaaaacccactttaatatttatgatgcggtcggcatttatgaaaagctacaacactataccgatatgaagcctgtagtgaaaaaacaaacgatgacaattgccgatttagctgacggactagcccaagctgaatccgaacaagagacgaactactaccgagagcaattaacagcaaaattgcaacg

SEQ ID NO: 5962 - DNA, 693 bp, Bacillus clausii
  misc_feature (1)...(693): n = A,T,C or G
atgcaagtggctgacgaaatcatcacacctacaacaggtgactaccaagttccattnttatatgcgacaaatgggcgacgttatttaaagcagcttcaagaggaatcggggatttggttttgggattcaagaaagccaaccatacatgctcgaccattagaaggctggcattcacctgctgatttaaagcttcttttaagtcaagatgaccaactggcgaatcaaaaattagaggagcaggatattacaaagtttggacttaggctttatcagcagcgagctgtcaaagcagttgaaaaagccttgattgcaggacagaggagaatgcttgttgctatggcaacaggaacgggaaaaacaagaacggcgattgccttaatgtatcgcttaattaagtccagaaaggcaaggcgaattttatttcttgttgaccgaagttcgcttgggcagcaaaccgaggattctttaaaggatacgaagtttgaagagctgtcttttgctgatatttatgatgtgaaatcattagacgatatgacaccagaagaagctacgaaagtacatattgccactgtacaaggcatggtgcgccgtctgttttatagtaaggatacaacaaatataccatctgtcggccaatatgatttcatcattgtgatgaggcacatcggggctatacgagcgataaggaaatga

SEQ ID NO: 5963 - DNA, 201 bp, Bacillus clausii
aagacggtcacatgaccatgggcaactcaaggcaagggtatactggccagtggcgacgcaaaaccaattcattcttcactacacggttcaccaacacccaaccgatatccgttgtttgatcccgcattatgagcaccttaaagcgacaggtctgcctctgccaaactggttcattgccgatgcaggctacggaagtaaagc

SEQ ID NO: 5964 - DNA, 972 bp, Bacillus clausii
aaagcggccaggaaatgggaaaacaatcaccattcacaaagccaacaagcacaacttaaaagacgtcaccgcctcttttccattgcaaacattaaccgctgtcacaggcgtttcagggtcaggcaaatcgtcgcttgttttcgatgtccttgccgaggcgacgccgtctcattttgaaggctgccaacatattagcggacttgaacacgttgatgcgatcattcgcgtcgaccaagcgcccctttcccggatgcagcgttcaaacgtagcaacatacatggacttgttcgcctatctgcgaaaactatttgctgcattgcccgccgcaaaagaacgtggattaagcgcaaaaagcttttcatttaatacgccaggcggacgctgcgaccgttgcgaaggacttggccaagtcgccgttgacatgcatttcctttcccacgtgcaagtagaatgccccgtttgccacggcaaacggtttaaagaggacgtacttgccgtaacatttagcggctataccattgcggacatgctaaacttacggatcgaagagagtttggcgctatttgacagccaaaaaaaactaacttcgctgctccagctcctttgtgaagtcggccttggctacttgcaatggggccagccagttacaacgctttccggcggcgaagcacagcggttgaagctggcaaaagaactagccatacatacggcaggccatactctctatttgctcgacgaaccgacaacgggcttgcacccttctgatattgaaaacttgttcgttttacttggaaagctcgttgacgcaggcaataccgtcgtcgttgtcgaacatacaacagaattgattgccgcatccgactgggtgattgatatggggcctggcggaggagacgctggcgggaaagtcgtcgcaacaggaaagccacaagacattgcggaggaaaaaggctcatttactggcgccttttt

SEQ ID NO: 5965 - DNA, 1146 bp, Bacillus clausii
gtgtaaacatgcaaacgagcacaggaagtgcaggcatgcaagtcgagcttgaggggggcaagatcgtccataagcagccctctgaagcacgcaaaggcacaaccatcgtcgtcactgctttgttttacaatacgccggcacgcctaaaatatttaaagacggttttaacggaggcggggcatgtgagcgaagtcatgaaccgtatggcgttggcatacccgcacattcgttttcactatgttagcgacggcaaaaccgtgctgaaaacagcagggaacggcgacttgcgccaagtcattgcccaagtctatggccgcaaaacagcagaaaaaatggtccctattacgggttcatcgttggattatgagctaagcggctatatcgctaagcctgagttgacacgagcaaacaggcagtatatgtcgattttcataaatgggcgctacatccgcaactttaagttggcaaaagcgatccaacaaggctttcacacaaagctgccgattggccgctttccgatcgctgttcttaagttggaaatggacccgacgctaattgatgtcaatgtccatccggctaagctggaagtacgcttgagcaaggaagaagcacttagcgaaatgattgccgaaagcattaaaaaggcgttaagtgaacaaacgctcatacctgagccgaaaaaagaaaacacagcttaaaccaaaagcgaacagctctctttctctttagcgtacgagttgcaaccagaaaaggagcatgtgcgcgagacgatgcaacagccacgccagcgccagcttgctgccgacgaccaagttaatcgcaaagaggaaagcacaagcatgggcaacagttggtcgccatcatatcagcaagaggaggaagtcgaacaagaaagaagcagcgatgccagtatgcttcctcgaaatgaacaagtggaaaccaacacagaggatggatatgagcagccggatagaagaacagacgagtcccttccaatggaagaggaggctgctctagtcgagccagaaccgcctttaggcaacgatgcagaggcaaagggggcgatgccgcctttgtatccagtcggccagatgcacggaacgtacattgttgcccaaaatgaacaaggcatgtacttaattgatc

SEQ ID NO: 5966 - DNA, 657 bp, Bacillus clausii
cattcaggatgtggaaggagtcggctttagccgcgcagaccaattagggacggcgattggcttaactgggaaccatccagagcgtttgcgggcggggctgctttatttgctccgggaatgttgtatgcaacaaggccatttatacttgcacaaagaagcgctcattacagaaggggctgcattattatcgagccccaacgtccaaattgaagcttccgagcttgatgccatcctcatcgaaatgaatgaagagggcatgctcgttcgtgaagaagatcgcgtctacatgaagtcattgtattatgcagaaaaaggaattgccaccaacatccgccgaattttaagtcaagaactgacacaagaattcactgaagcagaaatcgaaaaaacactcgggcatattgaggaaacacatgctgttacctattcaaacacgcaaaaagaagcgattgctactgctcttcgatctccgctgttgttgctgacaggtgggccaggaacaggaaagactacggtcattaaaggaattgttgaagcttatgctgcgcttcatgggctttctcttgaagtgtctgcttacaaaaataaatctttgccccttaagttgacagcgcccactggtcgagccagcaaacggatggctgaagcaacggaact

SEQ ID NO: 5967 - DNA, 129 bp, Bacillus clausii
  misc_feature (1)...(129): n = A,T,C or G
tgctccaagtgactctcgntnangcgatcaaagcanatgagatatttgaaattctcatgggcgaccgagtggagccaaggcgcgnttttattcaagaaaatgcncattacgtgaaaaatttggatgtgt

SEQ ID NO: 5968 - DNA, 1186 bp, Bacillus clausii
atggctgaagaagatgtaccaagactaagagaaagacaaatagacgaggaaatgaaagaatcgttcatcgattacgcgatgagcgtcattgtcagccgggcgctgccagacgtaagggatggcatgaagcccgtgcatcgccgtattctgtatgccatgtttgagcttgggatgacgccagacaaaccatataaaaagtcggcgcggatcgtaggcgaagtgcttgggaagtaccacccacacggcgatacttctgtatatgacgcaatggtacggatggcacaagattttagttatcgttatatgctcgtcaacggacacggcaacttcggttctattgatggcgactctgctgcggcgatgcgttatacagaatcaaaaatgtccaagatttcaatggagctagtccgggatttaaacaaagataccgttgattttatcgataactatgacggtactgagcgagaaccgaaagtgctgccctcccgctttccgaatttactcgtcaacggcacgtccgggattgcagtcgggatggcaaccaatattccgccacatcaattaggcgaagtaattgacggtgtacttgctttagcaaaaaatcctgacattagtattcctgagctcatggaatatattccaggccctgattttccaacaggcggcgagattctcggccgctctggcatacgcaaagcctattcaacaggacgaggctcaattaccgtacgcgctaaaaccgaaattgtcgaaaacaaaggcaaacagtcgattatcgtcacggaactgccataccaagtcaataaagcgcgtctgattgaaaaaatcgccgaactagtgcgtgacaagaaaatcgatggcattaccgaactgcgtgattcttcagaccgcaatggcatgaacattgtcatcgatgtgcgtagagacgcaaatccaaacgtcattttaaacaatttgtttaaacagacagccttgcaaacaagttttggcattaatatgcttgctcttgtgaacggccggcctgaagtcttaaacttgaaacagacgctggaacaatatttggctcaccaagtagaagtgatccgcaggcgcactcagtttgacctaaacaaagcggaagcccgtgcccacattctggaagggttgcgcattgcccttgatcatattgatgaaatcattgccttaa

SEQ ID NO: 5969 - DNA, 240 bp, Bacillus clausii
agtcgtccatgtcaatgattctaaaaatgaacccagttctcggaaagaccgccatgaaaacattggccatggccatattggccttaaagcgctcgactatattgtccatcatgaccaatttaaagacattcctaaaattctagaaacgcctttcataggtaaagataagaaagataaaaggcctccatacaaacatgaaattgcgttgttgcgccgggagttgcttgaccctattgaaaa

SEQ ID NO: 5970 - DNA, 318 bp, Bacillus clausii
ccgaacacttttgcagttggttaagaacaagaccattgcggacgttgacgtcggctggccgaaaatgattaaggaaccagatgatgtagcacgttttgtacagctattaaaggggcaaacaatcgaagacattgggcgcagaggcaaatttttgctgtttgtgctgaacgactatgtacttgtctcccatttgcggatggaaggacgctatggtttgtatcaaccaactgacgaaaaaacgaagcatacgcatgtcgtgttttcatttacagatgggtctgaattacgttatgcggatgtgcgccaattcggtacgat

SEQ ID NO: 5971 - DNA, 260 bp, Bacillus clausii
atggcacaagaagaaatccaacaactcttgaacaaacaagtagcaacctggagtgttttatatgtgaaattgcataactaccattggtatgtgaagggcccgcacttttttacactccacgagaaatttgaagagttatacaacgaagccggagaaacagtggacgagttagctgaacgcctgcttgccttaaaagggcaacctgtggcaacaatggatgagtttctacaactatccgcgataaaagagggcgataaaac

SEQ ID NO: 5972 - DNA, 595 bp, Bacillus clausii
ttgtgattgattatattaaagggaatttggttgcagttgaacctgcttatctcgtggtcgagaccaacgggattgggttccaaatttactgtgcaaacccttaccgttttataagcgatttaaatcgggaggtagtgatcccgacacaccactatgttcgcgaagacagccaacgcctatttggctttacaacaaggacagaacgcttgttgtttgaaaagcttttgaatgtctctggcattggcccaaaaggagcgctcgccattcttgcttcgggagaaccagaagatattatccatgcaattgaacaagaagatgaggcactgcttgtccgtttccctggagtcggcaaaaaaacagcaagacaaatcattcttgacttaaaagggaagcttgatgagatggcaccaatgctagaatctgctgctggcgctgacaaacagcaaaaaaatccacagcttgaggatgctttagaagcgttgcgtgctttgggctatgtcgaaaaagagctgaaaaaagttgaaaaacagttaaaagcggaaacgctggaaacagatgaatatattaggcgtgcgcttgcgcttatgttaaaacg

SEQ ID NO: 5973 - DNA, 392 bp, Bacillus clausii
atgagggttattgccggtgaagcacggggcttacagttaaaagctgttcctggaaaaacaacacggccaacaacagataaagtaaaagaagcgatgttcaatatcattggcccttattttgatggagggaaggcgttagatctttatgcaggtagcggcgctttagggatcgaggcgctgagcagggggatggaatcatgcatttttgttgaccaaaacaagcatgcagttgcaacgattcacgccaatttaagccatactggctatacagataaagcagaagtatatcggaacgatagcttgcgcgctttaaaagcagtcggtaaacgagacgtctcctttgaactgattttgttagaccccccgtatgccaaacaacaaattgcgacgat

SEQ ID NO: 5974 - DNA, 435 bp, Bacillus clausii
ttgccctgcctgtgcccgtgtccatgaaccgttaacaaaagcagcgttttcatttaatacaccaagcggcgcctgcccttcatgcagcggcctcggcacggtgacagacatcaacaaagatgccgtcttccagatggacaaaagccttgaagaaggcgctgtcaccttctggtacgatagtgtccggcaatattacacagctatccttgaagcagcggggggctattatggcctcgacatccgcggaaataaagcgctcaacgcatatagcgaagctgaactcgacttgcttttctacggcgtagaaagcgacacgtttgcacgccatttcccacatacaaaaccacctaaaaccgtaagcaaaggaaaattcgagggtgttctgactggcatgtggcgccgctaccaagaaaagaacgggctctctggcgaggc

SEQ ID NO: 5975 - DNA, 750 bp, Bacillus clausii
atgagggtacgttattagcggcgatggaaaaacctgcccagcatatggaagcgaaagatgagacgattaaaaagacgcttgcacaagctgggggaattgggacagtagcgacgcgggccgatattattgaaaagcttttctctagcttctacattgaaaagaaaggcaaagatttatatatcacttcaaaaggcaagcagctgcttgagcttgttccggctgaattgaagtcgccggcacttacagcagaatgggagcaacggctcgaaaagattgtccaaggcaaagaccaaaaacaagcgtttattgcagaaatgaaggaatacgccaaagccgttgtcgcccaagtgaaagctgacacagccactttccgccatgacaacaaaacaggggaaaaatgccctgaatgcggcaaattcctcctcgaagtaaatggcaaaaagggcaaaatgcgtgtatgccaagatcgggaatgcggttatcgaaaaaacattgcaatgacgacaaatgcacgctgtccaaaatgcaaaaagaaacttgaacttcgcggtgaaggcgaaggccaagtgtttgcgtgtgtttgcggccaccgcgagaaaaaggcgcaatttgaacaacggcgcaaacaaaacaaacataaaaacgtatcaaaacgagaagtgcagaactatatgaagaagcaaaacaagcaagaccagtttgcgaattcagcgcttgccgaccagcttgctaagctaggcctcggaaaag

SEQ ID NO: 5976 - DNA, 1050 bp, Bacillus clausii
  misc_feature (1)...(1050): n = A,T,C or G
atattatcacgtgggcgcttggccatttagtancacacgcagttcctgagcattacggcaagcagtataaaacctggaagctagaaganctgccgatgttgccaaaacgcctggaacttgtcgttatcaaacaaacagcgaaacagttccatgctgttaagcacgtattaaaccgccaagatgtaggagaggtcgtaattgcgactgatgccggacgcgaaggggagctcgtcgcccgctggattttggagaaagcccatgtcaaaaaacctgtaaaacgattatggatttcgtccgttacggataaagccattaaagatggatttaaacaactgaaagacggcaaacgttacgaaacgttatacgctgcagcagcagcaagagccgaggcagattggtacgtcggaattaacggaacaagggcattgacgacgaagcataacgcccagctgtcctgcggccgtgtgcagacgcctacacttgccattctagctgaccgggaggaagcgatccgcaagtttgtgccaaaaccgtaccacaccatttcggtcgaaacgaaagacggtgtcacattccgctgggcggacaggcgctcaaaagaggaacggatttttgacgaaaagcgggcgaacatgctgcaagagaagctgcagcagtctgccgttgtcattgattctatcaacgcaaaaacaaaaaggacgcctccaccgcctctttacgacttaacggaactgcagcgcgaggcaaacaagcgctttggctattcggctaaagaaacgcttgctgctttgcaacgtttgtatgaacaacataaagcgattacgtatccgcgcacagattcgcgctatctttcttctgatctagtcgaaacgttgaaagaacgcctccatgccgtcgatgtccagcctttccgcaaaatggtagcaaacgccaaaaaacaagggcttgctaatgcaaaacggcaaatggtcaacgatgcaaaagtgtcggaccattacgcgctcattccaacggaacaacctcagagcgcaagcgccaatgagcgacaag

SEQ ID NO: 5977 - DNA, 324 bp, Bacillus clausii
ttctcatttatgactggcgtgccccgatttctagcgtctattatgattcagaaattggccctgttacctatacggcgccagctggtacagtcaaaggggtgttagagaacaagcgacaatatgtgtttcgccgcggcgagttaaaagccatgttcgatacatcgcttgcgattggtgacgaacgtttaaaggaatctcttggcgaaggcgcttcccgttatatgaaaacgattgtttccacgattcaaaaagaacaaaaccaagccatacgtgatgaaaaaagccggtatttggttatacaagggagtggcaggcagcggaaaa

SEQ ID NO: 5978 - DNA, 327 bp, Bacillus clausii
gttgattaatttagcagggctgtctttactagaaaatcgttcaggtaaagggaaaggacaaaccaagataacgaagcgaggccgcagtaagctcagaagagctttataccttgccattcgcccgctcgttgcccataattccacctttaaagccctgcattcctattacacaaaacgccctgataagccgttaaaaaaacaacagtcattgattgctttgtgtgggaagttactgaaagttatttttgtcattggacagcgtcagtgtccatttgatggttctaagcttttgtgtggcatccctcagaaccaagcatgacaggctgt

SEQ ID NO: 5979 - DNA, 633 bp, Bacillus clausii
tggaacacgatattcaagagtttatccattttattaaagtggaaaaagggctgtcgccaaatacaattgagtcgtatgctagggacttaaagcaatatggcgcctatttaaaggaacgagggatcgaacaatttgccaatgtggacagggcgacgttgcagcattatttatatacgctaaaggaaataggcaagtcttcagcgacgattgcaaggaacgtcacaacgcttcgagcgctgcatcagtttttgtaccgtgaaaaatggacagaccatgacccgacattatggatcgagacgccgcgcattgataaaaaactgccaggtgttttatccattgaggaagttgatgcactgctagctgcaccagattcatctacgccgtttggtgtgcgcaataaagcaatgctagagcttctctatgcatctggcatgcgtgtcacagaattgatttctcttgggctcgatgacgtccacttgtctatgggatttgtccgtgtcgtccgcaaagggaataaagaacggatcgttacctttaggccaaagaaacgaccaaagcgtttaaacacctatttaaaaccgggcaaactttctttgcttaagcctgaacggcttgataaattgtttgtccatc

SEQ ID NO: 5980 - DNA, 477 bp, Bacillus clausii
taaagacactaacagtttagcacatacaaagtggaattgtaagtatcatatagtatttgccccaaagtacagaaggcaggtaatctatgggaaacttaaaaaagacattgggagaaatattaaagaacggttgagtgaaaggaaaaaaggtgtcgaaattatggaaggcaaactggcttgtaaagatcacatacatatggctggtgagtattcccgccgaaaatcagtgtgtcttcatttgtgggatatttgaaagggaaaaagtagcttgatgatattcgatcggcatgcaaatttaaaatatcgatacggaaatcgaaaattttggtgcacaggtttttatgtagatacagtgggaagaaataagaaagtaattgaagaatatataaaaaaccaaatacaagatgatatagtcgcagaacaattaagtttgttggagtatgtagatccatttacaggtgaagaggtaaagcgtaa

SEQ ID NO: 5981 - DNA, 552 bp, Bacillus clausii
ctattttgaacttgaaaatggtcaaattcgctttgggcttttgccaatcgctggagttaacgtccaagcggtcaatgaaatcataagcaagcggggaaaaaacagcgacagcaacttgtttatgttttacgctcgtgttgcctcaacagctgtcaaccgtcgggtaatggaagctctgattaaagctggggcattggacgagtttggccaatcgcgagcgacgctgctcggcaatttggataaagcagaagcttttgctgagcaagtccgttcgtttaaagcatcttcaggggggctgtttacaatcaagcctgccgttccagcttacttggatgtgacgccgtctacgaaaatggaagatttagaaggggagcgtgaagtgcttggcttttatttatctggccacccaattgaaaatgaactagagcggctagaaccattcggtcgtatccctttagctgaatgtatcccttcaagataagctgttcgaatcgccggaatggtcatcgatgtaaaaaaaatagtaacgaaaaaaggcgaagcgatggcctt

SEQ ID NO: 5982 - DNA, 1392 bp, Bacillus clausii
agcgttgcagttagggatcgacggtcatgcagtgacgcaagcggacatggatagtttggagcgtctaggacttgtgaaatttgactttcttgggctgcgcaatttgacgttgcttgaacggatgctcaaagtgattgaacaagaagagggtgtcgcgctaaacttgcagcacatcccactcaatgacaaagccactttccagttgcttcaacaagggaaatcaacggggattttccaacttgagtcggcaggcatgaggcaagtgctgaaacagttgcagccaagccagtttgaagacattgttgctacaagtgctctttatcggccagggccaatggcgtttattccagaatacatccgtggcaaacatgggcacacgcaagcgattatcccccatgaatcgctgcggccaattgtcgagccgacatttggcgtgctcgtttaccaagagcaaattatgcaagtggtgcaggcgacggccaattatagtttagctgaagccgatttgttccggagggccattagcaaaaagcaacatgatgtcatcattcaagaaaaacgccaatttattcaccgggcagtcgaaaacggatttttgcccgaagaggcagagtctattttttcattaattgagcggtttgccaattatggctttcctaaaagccatgcgacagcttacagttttattagctattggcttgcttatttgcgtgtccattttccagctgccttttttgctgcgctcttttcctctgtttggcaaaatcacgaaaaattgtattcgtatataaacgagcgaaaaagaagcatcatgtgtgctcgtctgttgcaaagcgtctgctattttgaacttgaaaatggtcaaattcgctttgggcttttgccaatcgctggagttaacgtccaagcggtcaatgaaatcataagcaagcggggaaaaaacagcgacagcaacttgtttatgttttacgctcgtgttgcctcaacagctgtcaaccgtcgggtaatggaagctctgattaaagctggggcattggacgagtttggccaatcgcgagcgacgctgctcggcaatttggataaagcagaagcttttgctgagcaagtccgttcgtttaaagcatcttcaggggggctgtttacaatcaagcctgccgttccagcttacttggatgtgacgccgtctacgaaaatggaagatttagaaggggagcgtgaagtgcttggcttttatttatctggccacccaattgaaaatgaactagagcggctagaaccattcggtcgtatccctttagctgaatgtatcccttcaagataagctgttcgaatcgccggaatggtcatcgatgtaaaaaaaatagtaacgaaaaaaggcgaagcgatggcctt

SEQ ID NO: 5983 - DNA, 594 bp, Bacillus clausii
acggttggaacatgagttagccattattgcagaacgggggtattcctcgtattttttaattgtcgctgactttgtcggctatgccaaaaaatcaggcattttaacaggcccaggcaggggctcgtcggctagttccatcgtcgcttatacgttgtccattaccgacgttgacccactagcccatgatcttttattcgaacgctttttaaaccctgagcgtgcaagtttgcctgatatcgatgtcgattttccagactatcgtcgtgatgaagtgattgcttatgttagagagcggtttggccatgatcgagttgcccaagtgttaacgtttggcacgtttgcagcacgcgctgcgattcgcgacgttggaaaggcgctgtcgatccgccatacttttgtggatcgcgttgcgaagtcgttaacccctgcttctctcagccttagcgaagcacagaaaaaaggcgtctttcaaggccttgaatcgcctgaattggacgagttgctttttttcgctaagcaaattgaagggttgccgaggcacgcatcgacccatgctgcaggggtgattattagcgacaagccacttaacgataa

SEQ ID NO: 5984 - DNA, 435 bp, Bacillus clausii
tattggagaagtacctgaatccaggttgtttatttccgaaatgttggggagtatggtgaaaagcaaaacaaaaaatttaatggagaattttaaaaagtgggcaaaattaaatggtgtgtttgatgattctataattttaggcataccgcaagataacccagagattacgcctaaagaggaatgtcgttatgatgtttgcgttgttataaataaaggttttaatgtggaaaaaccagctcatattggagaattttctggtgggaaatacgctgtttttttgcttgaccatacaaaagaggcagtcagtgaattttggggcaatattttttctgagatagaaagaaataatctatcaataagagaacaaccaattatagaaagatatacttcacaaatgattgataatcatttgtgtgaaatattagttcctataca

SEQ ID NO: 5985 - DNA, 462 bp, Bacillus clausii
aaacagatgtccgcttaatgggacgtactgcaggcggcgccaaaggcattaccctttcggagaatgacggtgttgtcggcatggacgtagttgatgaaaaccaaagcgtcctcgtcgttaccgagaaaggctacggcaaacggacgccacttgaggaataccgagtccaaagccgcggcggtaaagggattaaaacatgcaacattaccgataaaaacggtcctcttgtctctttgaaaatggtggccgacgaagacgacattatgattgttaccgccaatgggattattattcgcaccaacgtagacggcatttcaacaactggccgaaatactcaaggcgtgacgttgattcgtgtcggcgaaggagaagaagtagcgacagtggcccgtgtgaacattaacgacgacgaagtcgatgacttagaagacgatgatgagcaagagcaaccgacatcagagg

SEQ ID NO: 5986 - DNA, 537 bp, Bacillus clausii
  misc_feature (1)...(537): n = A,T,C or G
attattantacaacgcttcaaaagtttcccgttcattttagaaaaagtagcgggcttagagcgtaaaaagtatgcggtcattattgatgaggctcactcatcccaaggtggaaaagcttccacagccttaacgaatgtgttatcggataaaacgttagaagcagcttatgaggaagaccgtattgcggaagaaaacttagatgatatagatgaaaaaatcgttgaagcaatcatgaaaagtggtaagcaagataacgtatcgttctttgcttttacggcgacaccaaaacctaagacattagagaaatttggtacagttggtattgatggtaaaccagaggccttccatcaatacacaatgcggcaagcgattgaagaaggctttattttagacgtacttgaaaattatacgacctataaaacgttctggaaaattgcaaagacagtagacgatgatccggaggtatcaaaaaaacaagccacgaaaaagctagcacaatacgtgtcacttcatccacatagcatcacacacaaaac

SEQ ID NO: 5987 - DNA, 525 bp, Bacillus clausii
ctgaaaatgaagtaaatgctttaaaaggacttagagtaacattcttgcctatggaaaatatcttaggcccaaatgaagttgatattagtataaccaagaatattgaagaagtttattcaggatatacgtattttaaaaataatgatttagtaatggcgaaggtaacaccttgttttgaaaatggaaatatagctgttatgcaaaacttagaaaatagtattggttttggtactactgaattacatgttcttagagcaaagcctaagcaaaatattactttttatttttatttggcacagtctgctccgtttaaacaagaaggtgtttcggctatgtatggcgttggtgggttaaagcgaattccgagtgaatttatttttaattacaagtttgcaaggccatctgtatcagaacaaaatgaaatcgtagagtttttaaatgagaaatgtacagagcttgaaagtattaagaagttaattaacggacaaattgataaactaaaagaataccgccaatccctaattt

SEQ ID NO: 5988 - DNA, 763 bp, Bacillus clausii
atgaacaaaaccgtacatgaactacaagatcactttcgtcagctacgcctagcagagactgcggaggagctgccacagcttcttcgcgaagctgaaaaagcatcatggacctacttggaatttttagagtctctcactcgatatgaattagccaaacgcgaagagaaaagccttgagaaaagaatgaaatgggcacgcttccctttcgtgaagtcattagacgagtttgagctgaaaggacaaaacgttctgacggctcgtcagctttctcaactccgagaattaagctggctggagcaacactataatcttatccttttagggcctcctggcatcggtaaaacgtatatcgcaattggacttggacttgaggctgtttacagagggtttaatgtttatttcgctacaatgggtgaactggtgcagcttctaaaatcagaagaatacctgaacaaatctaaagttcagcttaagagaattagaaatgccgacttagtgattattgatgatttaatgtatatggccatggaccagagagaagcaaacctattctttcatttaattaaccatttatacgaacgaagttcgattatcctgacatcaaataagagtccagatgaatggggcaatttaatcggagaccaaggcatcaccactgcgattttagatcgcttacttcatcgtgtggaagtgatccatggtagcgaagaagagagaagtcacaggatgaaaaatcggaagagcattttttcagcagatgtgt

SEQ ID NO: 5989 - DNA, 264 bp, Bacillus clausii
  misc_feature (1)...(264): n = A,T,C or G
aatacattttcggcattcgttcgatgcgccaaacgatcaaagagattgaaaccaatgtggcctaccgttggtttttaggatttggctttgaggacaagattccccacttttctacgtttggnaaaaattatgctcgtcgttttcgtgagagtgacgtgttngaacgaatcttttatcgcattctgaaaacagccatggacaaaggatttgngaacccagangtggcttttatcgatncgaccccgattaaagccaacgccaata

SEQ ID NO: 5990 - DNA, 183 bp, Bacillus clausii
tttgatttcatttatgaccttgtcgaagatctttattcaaaggacaaggggccggccgagtgtggatcccgtggtgttagttaaaatgggattgattcaatacatttttgggattcgttcgatgcgccaaacgattaaagagattgaaaccaatgtggcctaccgttggtttttaaggatttg

SEQ ID NO: 5991 - DNA, 297 bp, Bacillus clausii
  misc_feature (1)...(297): n = A,T,C or G
tatccctgaaaccggtacggccaacgtttacancacggatgatccattgttngtcgcttttgattttacaaggcgtacataccattggtcctatgaaaacgacgcgcctaaagcgttgacagaaattgccttgcaaaaaatgatccgcacagaagtggcgcgggctggcttgcgcaaaggcatttccgcccagcattttcgtcattcatttctgctcaagttaatgcttgcaggggaacagtggacaacgatccagcaaaaagcagggctaaaaagcatgctttccttgcggcgcta

SEQ ID NO: 5992 - DNA, 864 bp, Bacillus clausii
gatttgtaaatccagaagtggcttttatcgactcgacccccattaaagccaacgccaataaacgaaagcatcgtaaaaaggtcgtacgcaccgagacgcgtgcctatcaaaaccaactagaacaagaaatcaatggggaacgggtgaaaaacggaaaaaagcccctgcctccctcgaaaaaagatcctacgagggaggtcaaggagagcaccacagatcctgagagcggttattacgtcaaaagcgagcgggaaaagatgtttgcctacagtttccataccgcttgtgatgccaatggatttgttttaggtacgatcgtaaaaccggcgaatgtccacgacagccaagtattccacgaactgtttgaccaattgaaagacaaggtgtgccgaccgaaggtcgccgctgtggatgcgggctataaaacgcctgccattgccaaaaaacttcaagaagaaggcgttcatccggttctcgcccgtataaaccgcccgatgacccctaaaggctatatccgaaaaaacgagtttgtctatgatgaatactacgattgttttctctgcccacaaaaccaggtgctttcttaccgaacgacgaatcgagaggggtaccgggaatatgtctccgaccctcggatttgtgagacgtgcccactgctcgctcaatgtacaaagagccaaaaccaccaaaagctcgttcttcgccatatttggcaagatgctctggatgaggcagaacatctgaggcatacggaacggaaccgagacatctatgccaagcgaaaagaaacgattgagcgtgtctttgccgatctgaaacagaagcatggtctgcgttggaccaacctgaaagggttggaaaaaa

SEQ ID NO: 5993 - DNA, 690 bp, Bacillus clausii
caaattgagcccctttcaccaattgaaaaagccattaaacaatgcatcgatgataacggctacgtcccttgactcagccagcacgagtttacggacagtgcggcatcaaatccgcagctatgaatcagggatcaagtccaagcttgatcaattaacgcgttcgtccaatacacgtaaaatgttgtctgatgcaattgtgaccatccgtagtgaccgttatgtgctccctgttaaacaagaatacagggggacatttggcggcatcgtccatgaccaatcatcctctggggcgacgctgtttatcgaaccggcagcgattgtgacgttaaacaaccaattaacagaagcaaaggcaaaagaaaaacgggaaattgaacggattttaagagaactgtcggcaaaagtggcagaggaaagcgagcagctgctccttaatgtcgataagctggcgcaacttgatttcatatgtgcgaaagcctattatgccaaagccgttaaggcagtgaagccaacattaaatgaccgtgggtatttggatttgcggcaagcccgtcacccgcttttgcctccaaacgaagtcgtaccgagtgatatggcgatcggcgaccaggtccgttcactagtcattactggaccaaatacaggcggcaagacggtcacgctgaaaacgattggattgctgacgttaat

SEQ ID NO: 5994 - DNA, 366 bp, Bacillus clausii
atgatcgtttcgataaactgcttcaccctttttccaccatataatgtcgaagcaatttcaatcaattctgttgccgacaacaccccgccaatcgctgctcgcttaatatgggggcggacatctgaaatgcctccgagcgggacatgtccctttaaccgcaaaacatttgctgcttcagctgtttcatcttggagatggcggacttcttctaaagacgtagaaggtacaagctcgttgactttctgcctgccaagggaagaagcaacatgttcaagcagttgctgtttcattttgttgtattctaaaacgcgctgcacacgttccattgtgcaacctcctttattcaaagctaatgcttgcgtttaa

SEQ ID NO: 5995 - DNA, 258 bp, Bacillus clausii
ccatccgcgaggcgcttcttgctgttcgtacagagcagcttgagccgtttccagcacaaatgacggtcgctgatttaatggaagcaagattgttatcaggaaaaggggcgagaagccgccgcgaacgtttaggcgaacacttgtcgatcggctatgctaacggaaaacagcttttgaaacggctgcacatctttcggatcacccctgaagaatttaacgaagcggtgaggtggataaacaaacaggaggaaagtgaag

SEQ ID NO: 5996 - DNA, 788 bp, Bacillus clausii
tgaatgacatgcaagatacaataattgaacggatgctatctgaattaaaccctgagcaacaaaaagctgtgacccattcagacgggcctttgctgttgatggcgggtgcgggaagcggcaaaacccgtgtgctgacttaccggatcagttatttgctccggcgccattcgacgccgccttgggctgttctcgccctcacattcacgaacaaagcagcgcgagagatgaaagacagggtggcgcagttggttggaccaattgctgaagatatttggatttccactttccattcgatgtgcgtgcggatgttgcgccgtgatattgaccggattggctacagccgcaattttacgattttggattcatctgaccagctttcagtcataaagcaaattttgaaaagccaaaacgttgaccctaagaaatttgacccaaaagcgatattagggatgatttctgctgctaaaaacgaattgcaaacggcaagcaaatttgcgcaaacagcttcaggcgtatttgagcaagtagcggccgacgtgtatagtgaatatgaaaaacgattgaaacaaaacaacgcacttgactttgatgatttaattatgaagacgatccaattgtttaacgaagtgccggaagtgctcgatttttaccaacgcaaattccagtacattcatgttgatgaatatcaagatacgaacaaagcacagtatcgccttgtgaaactccttggtgaacgtccgcaaaaacatttgggtttgtcggggaatcccgaacaatcgaattaccgt

SEQ ID NO: 5997 - DNA, 629 bp, Bacillus clausii
atgaattcttctactttggaagatttatttgaaattcataagtttaaaccaaacgagggacaattagaagcaattaaaacattagagggtccacttttcttaatggcaggtccaggttcaggtaagacaagagttcttttgtggagaacagtaaatgctattgtattccaaaatgtcaatccagaaaacatttttttgtctacttttacggagaaggccgcaaaacaattgaaagacggacttcagtctatattaggtacagtcacaaatattacaggcgttccatatgacatttcgagagcgtatataggaactgttcattcactttgtcagcgaattattgcagatagaaggtttataaagcaacgttcaagagtaaaaccgccaattcttatggatgaattggaccaatatttctttgtcaattcaaatcaattttggaatatggtcgaagaaatccttcatgtgaaagaaaatgaatggcgttccgaaatgaagaaatacttttcaaagagatcagagtcacgtcatgaaactgcattgtcacttatttctgtattcaatcgtttttcggaagaaaatctgcagatagaaagaatcattgaccatgcggtaaatataaatgatga

SEQ ID NO: 5998 - DNA, 462 bp, Bacillus clausii
  misc_feature (1)...(462): n = A,T,C or G
aaaggagtccaaagacctgcttaaacgttatcaagcgcagcaggaaaagcagcaaacgcttatacaaatgcatanggaaatgtggcgttangaacaggaactaaaacagcgcggctatgtagctgtttgcggcgttgacgaagtgggnagaggcccccttgntggccctgtaacagngtgcgcttgcatattgcntgatggntttcaattattagggntgacggattcgaaaaaactgtcaaaagccaaacgggaagaatatgcaaaaatgattgccgaacaagcagtcgcctatttgattgccagcgtaagcgcagcggaaattgatgaaatcaacattttacaagcgacgaaaaaggcgatgacgaaagcaatcaacggcctcagccagaaggcggaccatttgctgctcgataccgttcgccttgatgtgccaatcgctcataacatcgnttataaagg

SEQ ID NO: 5999 - DNA, 564 bp, Bacillus clausii
aagatgttttaccaattaccggcgctgtttcccgagaagcgctgcatcaattggcagcagcgttggaaaagcaaaatgcgcgcctcgtcttggaaaccattgacgaaacgctcaaaggcggaaaagacccgaaaaggcttttggaagatttgctgttatactatcgagacttgctgttgtataaaacagcgcctgaaacagccgatttgtttgaaagggctgtgcttgatgatgcatttgttcaagtggccgaatcttatagcaggccgtttatttatgctgccatccagagcctttcggaaagccaacaagaaatgaaatgggcgctccagccaaagatcgtgcttgaaatggctgtgataaaattgatgcagcttgcacctgctcaagacatggcgcaagtgggcaatgaagaaatgcgcgcattgcaagaaaaagtgaagcgccttgaagaggagcttgcctcactcaaacaaggaaatacatttgataaaagcgagccggcgcctgcccaaaaagaacggcggcgcatgcagccaagggcgccacagcaaggaaaggcga

SEQ ID NO: 6000 - DNA, 186 bp, Bacillus clausii
cattaatataaatgaagccactgaagcagatttgctaacgttacaaggagtcggcccgtcaaaagcggcggcgatcattggttacagggaagaaaacggcccatttgccacagttgaagagataatgaatgtgagcggaattggcgaaaaaacattcgaagcacttgaaccatttattcgggtgaa

SEQ ID NO: 6001 - DNA, 202 bp, Bacillus clausii
atgagctatcaagccctttaccgtgtgtggcgcccgcagttactagaagatgttgtcgggcaatcacatattacaaaaacattaaaaaacgcacttttgcaacaaaagcttgcgcacgcctacttgttttcaggcccacgggggacggggaaaacgagtgcagcgaaaattgtcgccaaagcgatcaactgcaaacaagctc

SEQ ID NO: 6002 - DNA, 334 bp, Bacillus clausii
  misc_feature (1)...(334): n = A,T,C or G
atgaacagattgtcgttaaaggggcacgatccaacaacctaaaaaacatggatgtaacgattccgagggataagcttgtcgtgttaacaggcctctctggttctggcaagtcatcgctcgcatttgataccatttacgcagaanggcagcggcgttatgtggagtcgctgtccgcttacgcccgtcaatttctgggacaaatggataagccagatgttgactcgatcgaagggctgtctccggcgatttcgatcgatcaaaagacaacaagccgcaaccctcgttctacagttggaacggtaacagaaatccacgactacttgcggctattgta

SEQ ID NO: 6003 - DNA, 243 bp, Bacillus clausii
  misc_feature (1)...(243): n = A,T,C or G
acagcatggcattacgccgcaaacgattcaaaaacggataccagaagtcgtgcaagcaacgtatgcagcggaagagaccggcgattacaaagcttcgtcgacaccatcgaaaaaactaggcaaaaaagaacgccaagcaacgattgagcgtgtagaagcggaaatgaaacaggccgctaaagagttgaactttgaacgagccgctgaattgcgcgatgtgtngtnagaattaaaagcggaagg

SEQ ID NO: 6004 - DNA, 612 bp, Bacillus clausii
  misc_feature (1)...(612): n = A,T,C or G
aattgtatnggaggggtgttcgccaatgtagcccgacgttattcgggaaacaagttctgattatattcgcggaacaaatggaaatgaacatgtcgcagaaaaaatgcccaacgtgcaaagggtataggttaaaaaaagggagcacttngctgttttttgttgggcggcaaaacatttagggggaagtaagccaaatgacatgaacagatgccatcccattttgttaaggcgcttgacttgactgaaaaagaacgtgctattgctcgtttgatccataaagaaattggagaccgtttaggctttttagtcaaagtcggaattgattaattaacccttttcccganngggggggacnntgtctggaggggaagcgcagcgtattaggctcgctacgcaaatcgggtcatcgcttatgggtgtgctttacattcttgacgaaccttccattggcctccatcagcgtgacaatgaccgtttaatcgagacgttaaaacatatgcgtgaccttggcaacacgcttatcgtagttgaacacgatgaggatacgatgctggcggctgaccatattattgacatcggcccaggagcaggggatcatggtggatatattac

SEQ ID NO: 6005 - DNA, 474 bp, Bacillus clausii
  misc_feature (1)...(474): n = A,T,C or G
tgatgaacaacatgatgcaatttatgcggcaattatcaaatcgcttcgggttcgccatgtcggcggcggaaacggggaatgctgcccaaatggcacgttttcgccgttttcaaaaggaagctcagctcgatgtcctccacattccttttgctcagctcccgattgttgtatttgatttagaaacaagcggattccatccagaccaaggcgatggcattttatcgataggggccgtgaaagtaactggaaatgaagttcacaacgatcatttttatgagacgatcaaaccaaagcagcctccatgtgaggaggtgctgcgcctgaccggtttgtctttgcaggagctagaccaatctccgccaataaatgacgtgttgcttcgattctacgatttcactggcgcagcaacacttgttgcccaccatgccgcccatgagcgcaagtttatgcgccatgcgacatggcaagagctan

SEQ ID NO: 6006 - DNA, 981 bp, Bacillus clausii
  misc_feature (1)...(981): n = A,T,C or G
tcagcgtatacgagncggctacagaacaagctgaagcacagtttgtcgtcgaaaaaataaaagaagcagcagcagaaccaggattttcttacaaagatgtagcgattctgtacagaaccaatgcccaatcgcgtattattgaggaatattttgtgaaatctaatctcgactacaatatcgtcggcggtactaagttctatgaccgcaaagagattaaagatgtccttgcttacttgcgcttagttgccaaccctgatgacgacattagcttacagcgtgttgtcaatgtgcctaagcgtggcattggcgcgacgacggtagacaagatcgctgcttatgctgatgcccaggggctctcgatgttcaaagctcttggtgaattggagcaaatcggcgttacagccagagcgcggacgaaacttgtggaatttcgcgaccaagtgaataactgggtgcaaatgcaagattatctttccgtgacagagctagtggaagaattgcttgataaaaccggttatcgcgagatgcttaaaaacgagcagacgattgaagcacaatctcgccttgagaacatcgacgaatttattacggtcacccaagagtttgagaagcggagcgaggaaaaagatctcgtgtcttttttgactgacttagcccttgttgccgatattgaccaactcgataaggacgaggaagcgacgagaaaagaggctattacgctgatgacgcttcattcagcaaaaggacttgaattcccatatgtctttttgattggaatggaggaaggggtgttcccacatagccgttccttgtttgaggaagaagaaatggaagaggagcggcgcctcgcctatgttggcattacccgtgccgaaaaacggctctatttgacgagtgccaaaatgaggacgctctatggacgaacgaataccaacccgacttcccgctttattgctgaaatcccggctgaattgattgaag

SEQ ID NO: 6007 - DNA, 1107 bp, Bacillus clausii
  misc_feature (1)...(1107): n = A,T,C or G
ccctgttgctgccccgatcataaagtggttgtcagagaggctacaacatcttgtcgatattggtcttgattacctaacattagatcgggaaacagatacattgtccggcggcgaatcgcagcgcgtcaagatggtcaagcacctgagcggtagcttagtagatgtcacgtacatctttgatgagccgagcgtaggcttgcatccccgcgacgtacaccgcttaaacgaactgctgcaaaagctgcgcgacaaaggcaatacggtaattgttgtcgagcatgatccggatgtaatcaaggtcgccgatcatattgttgacgtcgggcctcacgctggcagccatggaggtacgatcgtatacgaaggaagttttcaaggcctgttggagtcaggtactttgaccggtacccatatgaagcggccacttgagctgaaacatgacacaaggcagccctccggcaagctgtccatcaagaatgcgacattgcataacttacaggacgtaaatgtcacaattccaacaggagtgctgaccgttgttacaggtgtggctggctcaggcaaaagtacgctcattaacgacgtattcctcagccagaatccaggtgccatggtcatcgaccagtcggcagtaggcgtgtctacacgttcaaatcccgcaacctacacgggcataatggatgatgtgcgcaaagcgtttgcttctgctaacaaagttaacaaaggattgttcagtttcaactccaagggagcttgcgaaaactgccaagggctcggcgtcgtgtatacagatcttgcctttcttgaaagcgtgaaactgccatgtgaagtatgcagaggcagacggtttaaggaagaagtccttgcctacaagttaaatggcaagtctattgcagaagttcttgagatgactgtagagcgggcattggaatttttcgaacaaaaagagattgtccgcaagcttcaggcaatgagtgangtagggttgaattatattacacttggccagccacntagcacccnntcaggcggggaatgccagcgtatcaagttggcaagcgaacttcacaagcagggcagcatctacgtgatggacgagccgacaac

SEQ ID NO: 6008 - DNA, 285 bp, Bacillus clausii
  misc_feature (1)...(285): n = A,T,C or G
aaaaaaataaaaaaantgcctggtgattgccgccgcangcaaaaagatgaatccatccgaagcgcttgcttttgtngaagcangtttaggatttanggaaacgntcaaaaaacaagttcaggaagggaataanttggaaaaaggcagggaggattttattcaantttaagtggcagcgacacaatttgaaaccgttgaatcgtttttgacccatatcgaccatgtaatcgccaaacaacaggaatgccaatcgcttcaaactcgccagccaaaaagcattcaatt

SEQ ID NO: 6009 - DNA, 264 bp, Bacillus clausii
gctgagcgaatggctcgatattcagcttgtggccaaagaccatcatgaatacaaagaaggagcagtcgttttgcctgtttacttggcgaaaggcattgaatttgatgcagtcggcgtatttgatgcgtctgcaagccattatgcttcttcccaagaacggtaccacctttacacagcatgcacgcgggcgatggaccacttaaccgtttttgccgcaggcgaatggtcgccatggctgaagccgatcccgtcccacctttatga

SEQ ID NO: 6010 - DNA, 372 bp, Bacillus clausii
aaaaaaggctttttagattttttttcatcaagtggatgcagacgtgttttgtttacaagaaacaaagctgcaaaaagggcaaatctcgcttgagttgcctggttatgaacaatactggaacgatgcggagcgtaaaggctattcaggaacagcgatttttactaaacactctccgctgtctgtcacatatggaatcggcgatcattttccagataacgaagggcgcgtcatcacccttgagtttgagacctactatgtcgtaacgatgtatacccctaatgccaaacgggacttaagcaggctgccataccggctccagtgggagaaagcagctagggaatacttgactctattggcggcacaaaaaccagt

SEQ ID NO: 6011 - DNA, 441 bp, Bacillus clausii
  misc_feature (1)...(441): n = A,T,C or G
taactattcttttgtagaaccaaaaacaaaggctagtgttcgtcatattgcattagatggagatacactaacgttactcagcgaatggaaggacgtgcagcaatctgtcgttcaaaccaattttgtaatgagctataatggtatccccacacaaaagcatacgttagcgaatgccattacacgtttttcaaaaaaagctggggttcatcgaattagattacatgctttaagacattctcacgcttctttgcttattagtatgggcgaaaacccattaatcattaaagaccgcctaggacatgaagatattgaaacgacacttggcacctacggacatttgtatcctaacagtaactttgaagtagcccataaattagaaggtattatgtcttaccaaacagcaacaganaatgaagatacttcacccaagaatcaattcac

SEQ ID NO: 6012 - DNA, 441 bp, Bacillus clausii
  misc_feature (1)...(441): n = A,T,C or G
tcgaatttatgatttcggcgaacccaggagaaccgttaaaccctcttgcgaaagtcgcttctgnaggggaattgtcgcgaatcatgctggcgctaaagtccgttttcaccgcaaaagaaggaatcacctctgtcatctttgatgaagtcgatacaggcgtgagcggcagaatcgcccaggcgataggtgaaaaaatccagcgaatatcagctggttcacaagtgctttgtatttcccatttaccacaagtggcggcattagcggaccatcatttgtacatttccaaaactgaaacagacaaccgcgtgttcacgagcgtcaaggttttaaatgaaaacgaaaaagtggacgaactagcacggatgctttctggcgtcgaagtgacagatttgaccaggaaaaatgccgaagaattgctcgcgcttgcacaaacaaaaaaaa

SEQ ID NO: 6013 - DNA, 359 bp, Bacillus clausii
ggcattatgaagctcgtccatcctggcaagccgattttgattgaaaaagctggtgtccgcgtgcaagtgtccggccaggcataccattatgaactcgaccagcgtgaccctaagctagactattatccaattaatgaaacagaagcagatacgatgatccacctcgtccatagcatgctcgtcgaaaaagcactgcctgacggcattcctcatacgctgattgaccacatttgggggacgagcgccgacgttattttgacaggacattaccatactggttttggcattaaagagcaaaacggcaaatttatttgcaatccaggcgcagtagcgaggattaataaccattggacagaagt

SEQ ID NO: 6014 - DNA, 666 bp, Bacillus clausii
  misc_feature (1)...(666): n = A,T,C or G
aaggnttgtttgcgattggcgagaaccaccctgccctaaaaaaactcgacccaattggcgttgaatgcgaagaaggaatgctcattctccggcgtgatattacagacgctggaaaaagcatttgccggataaatggcaagctgacaacgattggcgtgttgcgggaagtcgggcaaacattaattgatatgcacggccaacatgagcaccagtcattaatgcggatagaagaacatgttgaactattagacagtttcggcggcgaggccttaaaaaaaacgcgggctgagtatacaaggttgtttaatgaagtccaaaaaatggcggaccggatcaacagtttaaatcaaaattcgcaagaaatggctaggaaagccgatttatatgcgtatcaactacaagaaatcgaacaagcgaagctaacgccaggagaagacgaggagttgttggccaaacgtcataaactggcgaatagtgagaagctttatgaggccttgacccgtagttatgaacatatgtacggcgaggagcgaggccttgattacatgagcggcatgctttcccacttagagaccgctgcctcgattgacaaggaattagcgcctttatatgaacaaatgtcttcgagctactatatgcttgaagaaggcacatatgcgattcgcg

SEQ ID NO: 6015 - DNA, 546 bp, Bacillus clausii
atatgacggtgataagattggtgagttaaatacatttgccagtaatacggatttaacagtaatggttatgaccattgatgcttttaataaggcaagtaacaacatttttaagcatactgagaaattgtcgggtgagtggaaaccatatcagtatatccaagcgacaagaccgataatgattttagatgaggcacagaacttcgaaacaagcaaggcgaaagaagctattcgaacactaaaacccttatttgtgctgagatattctgctacgcatcgcgatgcaccgaatatggtatatagtttgacaccaattgacgcatttagaaataacctcgtcaaacaaattgaagtaattggagtttcggaattaggtaatttaaatgatcagatccttcgcttaatggaaatcaagaggaatccgattacagctactgtgagggccattgtatttgaccaaggagaagcagttgaaagagatattacattaagacaaggcgaagatttatttgcgaaaacaaaaaatcctgattacaaacaatttgttgt

SEQ ID NO: 6016 - DNA, 678 bp, Bacillus clausii
gcaaggttatcacttagtgataccagtcgatacaggcatttctgctttgaatgaagctgctcatgccaaagacatcggcctggattttattatcactgaccaccacgagccgccgccggttttgccagaggcattggcgatcattaatcctaagcagcctggttgcccgtatccatttaaagagcttgccggtgtaggcgttgcctttaaagttgcacacgctttgctcgggcgcctgcctgaagagttgctcgattatgctgtgatcggtacgatcgccgatttggtcccactcgtcgatgaaaatcggctgttggccaaaaaggggcttcgcgcaattgaatcaagcggccgccctgggatccgtgccttaaaggaagtatgcagcataaagcaggaagcaatggacgccgaccatatcggctttgcgattgggcctcgtctaaatgcggcagggcggcttgattctgctaatccagccgttgagctgctcctagctgatgaagatgaagaagcaaaagcgctagccacagaaatcgatagcctcaataaagaacggcaagcaattgttagcaaaatgacagaagaagcgattcgccttgttgaaacaacttatggcacaaagatccctcatgccatcgttgtagcgaaggaaggctggaatccaggggtcatcgg

SEQ ID NO: 6017 - DNA, 344 bp, Bacillus clausii
catggaaagactggcaagaggcacagccgcaggttgtgcctatgcttgttgcgagcattgaaaaaaaccgcttggcccatgcctacttgtttgaaggggaagcgggaagcggcaaacatgaagtggctttgctgatggcgaaacgttttttctgcaaagaacacaacggggcagagccgtgccatgcatgcagtgactgtttgcggattgaacatggcaaccaccctgacgtccaccaagtcggaccggacggacaatcgattaaaaaagaacagatcgaatacttacaaaaagaatttacgtacaggggcatggagtctgctgcaaaaagtgtatattatctc

SEQ ID NO: 6018 - DNA, 195 bp, Bacillus clausii
  misc_feature (1)...(195): n = A,T,C or G
tctgctattagtcgacggctttaacttattgagccgcgggtattttgcgacgagctataaccgcccgattgaaaagttagaacgaaacgaagaaggcttatatgtgaatggccttcgcgtgtttatccaaaaactatttaagctcnttaccgattattcgatttcccattgtatcgtcacttgggacgtgccccg

SEQ ID NO: 6019 - DNA, 534 bp, Bacillus clausii
gtatgaggcagatgacattatcggcgctatttcggccaaatgggaagctgaaacgagcggtccttgctatatttacagcaacgataaagatttgtttcaattgctgacttcccgcaccattcaaattgttgctaagaagcaaacagaagtgttattggatgaagcgtcgtttaaagacagttacggcctctcccctacccaatgggttgatgtaaaggcgctcgtcggcgatactagtgataatattccaggctgtcctgggataggcgaaaaaaccgcccttcctctaattgctgcgtacgggtcgattgaatcgctatatcaacaaatcgacacaatccagccgccattaaaacgggcacagaaaaaactactagctggaaaagcgtctactcagctttcaaaaaagctttctgccattatctgcgacattcccgaactccgccactattctatcaatgacgctgttctttctttgaatcggggcgaagttgacaaggaactttcacgtcttgctattcgcgttaaattggc

SEQ ID NO: 6020 - DNA, 648 bp, Bacillus clausii
agacacagatgaactgttccgaatgatccacgtgtttgctttagacgctcaaggaagcaatgcgacagatgtagggcgtattagttatgtatataaaagcttttcagaagaaggctcgctttggcaagcgattcttgagtgtgcgatgcgcttgcagcttcacggtgaacaagtgctgacgactgtaaaggcagcttatcaagtggtcgaggaaaaagtggaagaagactatgaaagccgttctcttctcgctgacacacaaggagcgattgccgcttttgaggaaacggtgcaattgctgtatgagctcctccttgaatacgacgacaattatgtttactggattgaagtggagccaaaaggggcaaaaaatgctacttatttgtatgcaaagccgattgaagtctcagaaaggctggctgaccaattttttgccaaaaagaaaagcgtcgtcctgacatcggcgactttgacagtcaaccaatcgtttgattaccaaattgacagattaggcttagttgattttggggtgaaaacgaaacaaattgagtctcctttttcttatgagcagcaagcaaaattgcttattcctcatgatattcccgatgtccgtggcccagatgacgagctgtttgcacaggatatcgc

SEQ ID NO: 6021 - DNA, 546 bp, Bacillus clausii
gacacccagtcggaaaaacgatgagtattggggtggtgcattttcatggttaagttcaggagagattcagtttaatattattaatgattcacgagaatatgttactgagaaagcaataaatgaatgtagattaaagttagcccctaaagggtcaattctttttggaatgattggggaaggtaaaacaagagggcaagtggctatcttagatattgactcttatcataatcaaaatactgcttcaatctgggtttcagaaacagaaatagatagtgaatatgtatattattggctgctatctcaatatacgaaaaatagacagaatagcgctggcaataaccaaccggcttacaacaaatctcgagtaaaagaactgtttataccacttccaccgcttgctgaaattaaggtaatgatacatataattaagggattaatgcaaaaagaaataaaggtaaatgaattacttgaattaaatattactatggatagcataaaacaatccatcctctccaaagccttcaaaggccaactaggaacaaacga

SEQ ID NO: 6022 - DNA, 384 bp, Bacillus clausii
gaaaaaaggcatttctgaagtcgatcgctataatcgcgagaaagtggctgaacgctacgggcttgaaccgaaacaaattattgatttaaaagggttaatgggcgattcgtctgataacattccaggtgttcccggtgtaggtgagaaaacagcgctaaaattgcttgctgaattccacgacgtagaaacggtgcttgattcgattgatgcgatctctgggaaaaagctgaaagaacgtctccaagagaataaagaccaagccctccttagcaaaaaactcgccacaattgcccttgacgtgccacttgccgaaacgcttgactcgttcgagtatggcggatatgagtataaacaagttaaagaagcgtttaaagagctgtcttt

SEQ ID NO: 6023 - DNA, 350 bp, Bacillus clausii
atgccagaattaccggaagtagaaacggtacgccgaacacttttgcagttggttaagaacaagaccattgcggacgttgacgtcggctggccgaaaatgattaaggaaccagatgatgtagcacgttttgtacagctattaaaggggcaaacaatcgaagacattgggcgcagaggcaaatttttgctgtttgtgctgaacgactatgtacttgtctcccatttgcggatggaaggacgctatggtttgtatcaaccaactgacgaaaaaacgaagcatacgcatgtcgtgttttcatttacagatgggtctgaattacgttatgcggatgtgcgccaattcggtacgat

SEQ ID NO: 6024 - DNA, 684 bp, Bacillus clausii
aatggttgcggctgattactcgcaaattgagctgcgtgtcctcgcccatatttctggcgatgaacgaatgaaggaggcgtttttaactgggatggacatccatacaaaaacggcaatggatgttttccatgtagaacgcgaagaagtaacagatttgatgagaaggagcgcgaaggccgtcaattttgggattgtctacggcataagcgattatgggctctcacaaagcctaggcattacgagaaaagaagcgaaagactttattgaccgctatttagcaagttatccacaagtaaaagcttatatggaaaatgtggtgaaagaagcaaaggaaaaggggtatgtccaaacactgcttgcgagaaggcgttatttgcctgaactgaaaagccgcaatttcaaccagcgcagttttgcagaacggacagcgatgaacacaccaatccaagggaccgcagctgacattattaaacgggcgatggtgcaaatgagtgaagcgttagaggaaacaggacttaaagcaaacatgttgctccaagtccatgacgaactcatttttgaagtggcgcctgacgatgtggaaccgttaaaagagcttgtcacagaagtaatggaacaggcgcttgagcttgatgtgcctttacaagtggatgtctctagcggaaattcatggtttgacgcgaa

SEQ ID NO: 6025 - DNA, 413 bp, Bacillus clausii
atgtcgatcaaggcgaaattaaaacggtttgaatctcatatgtcgaccaccgaaaaagagaaggaatcggcgacgactaacaacaacgaacatggaagttgggaacaaatgaataccgaggcttgctcgtttgacggtatggtttgttatattcggacgacgcggatgtctttgcaagaaaaacatggccctaaaacatttgctgaaatgaaagcagcaattgatcgttgggatacaagtgctttcgctcatcctttgtcaaagaagggcattcctactgaaaaactgttgttttttgatacggaaacgactggattaagcagtggggcaggcacgcaaatgtttttgcttggatttgcttcttttacagaaaaagaagtggaggttaaacagtatttgctggctaaacctga

SEQ ID NO: 6026 - DNA, 691 bp, Bacillus clausii
ttgatgaggccattttacccccaacttgtgtactttgaaccacaagcgcttaattatccacttggcaaggaactatacgagaagtttaaaaacgcagatgtcgaaattcgggagacaacgtcacacaatcaagtacggaacatcccagggaaaaatgaaaatcaaaaataccggaatgccaaatcgacacttgtagtcggtgtccgaaaaacgttaaaattcgacacgtccaagccatcggcagagtacgccattccattggctacagggtgtatggggcattgccactactgctatttgcaaacaacgcttggagataaaccgtacatccgaacatatgtaaatctcgatgatattttttcggcagctgatcattatatgaaagagcgtgcgccagaaatcacccgttttgaagcggcttgcacatccgatattgtcggcatcgatcatttaacgcattcattaaagaaaacaattgaatttatcggggagcgtgaatatggccggcttcgctttgtcacgaagtaccaccatgtggatcacctcctcgatgccaaacataacggcaacacgcgtttccgttttagtgtcaatgctgcacatgttattaaatattttgaaccaggaacgtccaattttttagaacggatcgaggctgctgaaaaagtcgctaaagcggattatccacttt

SEQ ID NO: 6027 - DNA, 672 bp, Bacillus clausii
tgataccgttgaactttcaagggtattgttgccgacacaggaaagctacaaattgtcagagctatcaagcagccttgatatggaccatgatcaaccccatcgcgctgatagcgacgcagaaataacagcagaactgtttattaaactcttacataaactagaacggttgccacttgtgacattgcaatcattagagcaagtcgcgaaggggttgaaaagcgactgggacgtattaacgcggccgttgattcaaaaaaaatggatgaaagtagacgaagacgaaaaagaatatgacttgtttcggcaactggcgcttaagcgcgtggcagaggaggaagaaaacagcgagtcatccgaccataaaccgtttgttgaagtagaggacgagcttttttctagtagtggcgccatcgcccgtgtcttcgactcatttgaagatcgtccagggcaaaaacagatgatgaaggaagtttacgctgcgtttgaagaacatgcccatgcgctgattgaagccggtaccggcacggggaaaacgttggcgtatttagtaccgagcgcttactttgcttactcccagaaaaaaccagtggtgctgtcgacttatacgattccgttgcaagagcaacttttgcaacgagatttgcgcttgcttgcttccattgttccttttcc

SEQ ID NO: 6028 - DNA, 462 bp, Bacillus clausii; identical to SEQ ID NO: 5985

SEQ ID NO: 6029 - DNA, 426 bp, Bacillus clausii; identical to SEQ ID NO: 5933
  misc_feature (1)...(426): n = A,T,C or G

SEQ ID NO: 6030 - DNA, 218 bp, Bacillus clausii
atgttgtccaaacagctggaagataaacggatgcagatggagatggtctggattgaaaagctggtgccagaggatcatctcgttcggaagcttgatgcggcgattgactttgatttcatttatgaccttgtcgaagatctttactcaaaggacaaggggcggcctagtgtggatcccgtggtgttagttaaaatggtattgatccaatacattttcgg

SEQ ID NO: 6031 - DNA, 612 bp, Bacillus clausii
  misc_feature (1)...(612): n = A,T,C or G
accaagttccattnttatatgcgacaaatgggcgacgttatttaaagcagcttcaagaggaatcggggatttggttttgggattcaagaaagccaaccatacatgctcgaccattagaaggctggcattcacctgctgatttaaagcttcttttaagtcaagatgaccaactggcgaatcaaaaattagaggagcaggatattacaaagtttggacttaggctttatcagcagcgagctgtcaaagcagttgaaaaagccttgattgcaggacagaggagaatgcttgttgctatggcaacaggaacgggaaaaacaagaacggcgattgccttaatgtatcgcttaattaagtccagaaaggcaaggcgaattttatttcttgttgaccgaagttcgcttgggcagcaaaccgaggattctttaaaggatacgaagtttgaagagctgtcttttgctgatatttatgatgtgaaatcattagacgatatgacaccagaagaagctacgaaagtacatattgccactgtacaaggcatggtgcgccgtctgttttatagtaaggatacaacaaatataccatctgtcggccaatatgatttcatcattgtga

SEQ ID NO: 6032 - DNA, 189 bp, Bacillus clausii
  misc_feature (1)...(189): n = A,T,C or G
tctgctattagtcgacggctttaacttattgagccgcgggtattttgcgacgagctataaccgcccgattgaaaagttagaacgaaacgaagaaggcttatatgtgaatggccttcgcgtgtttatccaaaaactatttaagctcnttaccgattattcgatttcccattgtatcgtcacttgggacgt

SEQ ID NO: 6033 - DNA, 516 bp, Bacillus clausii
  misc_feature (1)...(516): n = A,T,C or G
aatggcaaaagcagatccattacttaaaatgacggttgaaaaattttatggattgcgagtcgtnggcattcccgatttatttgaggctttatgttggggtgttctagggcagcaaattaacttagcgtttgcgtactcattaaaaaagcaatttgtagaaggatttggcgattccatcgaatggaatggtaaaaagtattgggtcttcccaccgtacgaacgaattgcacagttgacaactaccgacctagcagatattaaaatgacggtgaaaaaaagtgaatatataattggaattgccaagcttatggcaagtggagaattgtcgaaggaanaattaataaaaatggactttaaagatgctgaaaaaaacttaattcaaatacnaggtgttggtccttggacagccaattatgttctaatgcgatgtttgcgatttcctgccgctcntccaatcgatgatgtcggtttgcataatgtaattaagctacttaccngatctgaaacaaaaccaac

SEQ ID NO: 6034 - DNA, 510 bp, Bacillus clausii
  misc_feature (1)...(510): n = A,T,C or G
gaaatttgacattgagcttcgtcagccatcaccgcgcgatttatgatacacaggcaacggcgtatttgctttggaaaatggtcaaagatgcagcggagaaagaaattgtttaccatgatgaattaaataaccatatggggcaagggaattttcaccgccaacggccgttccactgtacgctgcttgtcacatcgcaaacagggttgaaaaatttataccagctcgtgtccatgtcccatgttgattactatttccggacgccacggatccctcgttcccagttaaataaacatcgcgaagggttgctaatcggttctgcttgcgataaaggtgaagtctttgaaggcatgatgcaaaaatcagccgatgaggtggagaaaatcgctggtttctacgactttttagaaattcaaccgctcagcaattatggacacttgattgancgggaacttgtaaaagatgaaacggcattgcaagagattgtcgccaatattgttgctcttggcgagc

SEQ ID NO: 6035 - DNA, 453 bp, Bacillus clausii
  misc_feature (1)...(453): n = A,T,C or G
catggtatggggcgagctggaatttgtactgccggacgaaaaagtggtgcgtctgcacggcaccgaatggggcgagacgcagcgtttttaccatcatcttgatgctcactggcggcggtggagtggcgagatgagcgaaattgcgtctggtgttttacgccagcaactggatttgattgccacgcgcactggggaaaataaatggctgacgcgtgagcaaacctctggcgtgcagcaacaaatccgccaggctttgtcggcgttgccgttgccggttaaccgactggaagaattcgataactgccgtgaggcgtggcgtaaatgtcaggcctggttgaaagatattgaaagcgctcggttgcagcataaccaggcgtataccgaanccatgcttaccgagtatgcggattttttccgccaggtcgagtcttcaccgctgaatccggcgcaggc

SEQ ID NO: 6036 - DNA, 615 bp, Bacillus clausii
  misc_feature (1)...(615): n = A,T,C or G
ctatgggttatcccattaaagatgagccgacgccgctcgaagcgattgtcgatgaagaacggcgcattaccattcaaggntatgtgttcgcaacagatattcgcgagctccgcagtgggcggacattgctaacctttaaaatgacagattacaccgattcgattttagtgaaaatgttttcccgggataaagaagatgtgccggttatgcaagcggtcaaaaaaggcatgtggttaaaagtgcgaggcggcattcaaaacgatacatttgtccgcgacctcgttatgatcgccaatgattttaaccaagtaacgccaaatgtccgcgaagataccgctgaacaaaaacgagtcgaacttcatacccattcgacaatgagccaaatggatggcgtcgtttctgttggcaggtatatcgagcaggctgcaaaatggggccatccagcgattgccattacggatcacggcgttgtccaagcgtttccagaagcatatggcgctgccaaaaagcatgacattaaagtgatttatggcatggaggcaaatgtcgttgatgatggcgtaccaattgcttacaactcagaccatcgtcacttgctcgaagaagagtatgtcg

SEQ ID NO: 6037 - DNA, 330 bp, Bacillus clausii
tgcttggaagcaagcgaaaaacgaagaaattgccgctgatattattagttttatccgccaagcagccctcggcgaggcacttgttgatcaagaaacacggattaaaaacgcgatgcaaaaagtgtactcgttacatgactggaagccaagacaaaaaaagtggttagagcgtatcgaaaagcagctcattcaattcccagtgcttgcgccaacttcacaggatgctttttccgaagagccgtttgccagccaaggtggctataagcaaatgaaaaaattatttggcgacgatatcgatgttgttgtcaacaccattaatgagaaccttta

SEQ ID NO: 6038 - DNA, 726 bp, Bacillus clausii
ttgatgaagatcgaatagagaagctgaaggaattgtttccagaggcttttggtgatggaagattgaatatagaattacttaaggaacttattaagttaagtgatgatttttcagacgcagattcaggagaattttttgggttgcaatgggctggaaaaaaagaagcaagaaggcttagctcaattccagccacaggaacactaaataaatcggttggcgaaggcattaacgaagacaacactgataatattattatctaaggtgataatttagaagttttacggattttacagaagagttactctggaagaatacaaactatttacattgacccgccgtacaatacggataaagattatatttataaagatacatttaaggaaccagttgaaagttatttgcaaaaatcaaaccaggcagatgaagagggattattaaccagtaatccaaaggcaagtggaagatatcatgctaattggttaaatatgatgtatccacgattaaagcttgcatggagtcttctgaaacccgatggaatattatgtgtgtcaatttcagatatagaagaagcaaacttgaggaaaatattggacgaaatatttggggaagaaaatcatattaatacagtttcggttaaatcaaaagtgagtgctggtgcgtctggtgggggagaggacaaacgcttaaagaaaaaccttgagtatatccatatgtatgctaaaaatc

SEQ ID NO: 6039 - DNA, 412 bp, Bacillus clausii
atgaaaacaatcggcttagacgtagggacaaagacaattggtgtcgccattagtgatgcgttcgggtggacagcgcaaggactgccgacgatccaacgatctgaagacgacccaaaccgtgattttgaagcactagctgagctgatcaaagagaatgacgtccaaaaagtggtgattggttatcctaaaaacatgaacggcacggttggggaaagcgccacacggagtgaggcattcgcacggacgcttgaacaacggtgcaatgtgcaggccgttttatgggatgaacgtcttacaacggctgcagctcagcgcgttttaattgatgcagatgtaagtcgaaaaaaacgcaaaaaagctgtagacaaaatggctgctgttttcattttacaaggatatttagaccgccaaa

SEQ ID NO: 6040 - DNA, 242 bp, Bacillus clausii
atggaccaaacgtttcagcttgtatcagagtattctccccaaggggaccagccaaaagcaattgagcaaattgtaacaggcattcaaaacggcaaaaagcaccaaacattgcttggcgctactggaacgggtaagacgtttacgatgtcaaatgtgatccaagccgttaataagccgacgcttgtgatggctcataataaaacgcttgccgggcaattgtatagcgaatttaaacagttgtt

SEQ ID NO: 6041 - DNA, 486 bp, Bacillus clausii
atacaagcgatttggctgaaattgttgtaaccgagaatcaaatcctgttcaaactcggaaacttgttgtttttctcaagacttcttgaagggaagtatccagtaacgtcgagcatgataccgactcagttcaaaacgtcctttgtcgtaaaaacaaaagaattggtccatacgcttgaacgggcaatgttgttgtcaagggaagcaaaaaacaatgtcattaacgtcaaaacacttggcgacaaccaaattgaaattacgtccacatcacaagaaatagggaaagtgacggaaaaaatggccactgaccaatttgaaggggatgaaatccggatttcgtttaatgggaaaaatattcttgatgccttgaaagtggttgacagcgatgaagtccaaatctttttgacaggtgcgatgagtcccttcgttattcgcccaattgattcagaccactatttgcatttattctcgccagtcagaacgtatt

SEQ ID NO: 6042 - DNA, 330 bp, Bacillus clausii; identical to SEQ ID NO: 5922

SEQ ID NO: 6043 - DNA, 768 bp, Bacillus clausii
atgagcaaaatcaaacatacgatgaaagccaaattcaagttttagaagggcttgaagccgtgcgcaagcgccccggcatgtatatcgggtcgacaagccaaagagggctgcaccatctagtatgggaaattgtcgacaacagcattgacgaagcgatggctggtttctgtgatgaaattaaagtaataatcgaggaaggaaatgccctgacggttgaggataacggccgtggcattcctgtcggcatccaagaaaaaatgggtcgtccagcggtcgaggtcattatgactacccttcatgccggagggaaatttggcggtggcggttataaagtgtcaggcggccttcacggagttggtgcttccgtcgtcaacgcgctgtcgacacatttaacggtcaatgtccatttagacgggaaaatccatagccaatcttatagccgtggtattcccgatgctgatttgaccgtcataggtgaaaccgataaaaccggcacgattattacgttccagccagacccagaaattttccgggagacggttgaatttgattatgaaacacttgctgcccgcattcgcgagttggcgtttttaaacaaagggctgacgatcaaaattgaggacaaacgcacagaggacggcaaaaaggccacctaccattacgagggtgggatttcgtcgtttgtcaaacacctcaaccgttcaaaagaaacgctccatgaagagccgatttatgtggaaagcgaaaaagacggcatttccgtgaagt

SEQ ID NO: 6044 - DNA, 612 bp, Bacillus clausii
atgaaggaggcacgcatgaatcaggctttaaaacaggcttgacgcgcgttattaatgattacgcccgcaaaaatgggttgtttaaagaaaacgatccaaacttaagtggcgaagatgtccgtgaagggctgacagcgatcatttccgtcaaaattcctgagccccagtttgaagggcaaacgaaaacaaagctaggaaacagtgaagcacgtacaattactgactctttattcagcgaaagttttgcacggttcctgtctgagaatccaggagttgcccgcaagattgtcgataaaggattgatggcttcccgtgcccgtgaggctgctaaaaaggctcgtgagttgacacggcggaaaagcgccttagaagtaagctcgcttcctggaaagcttaccgactgtacatcaaaagatgcgtcgattagcgaattgtttatcgttgagggcgattctgccggcggttcggcaaaagggggccgagatccccacttccaagcgattcttcctctgcgagggaaaatccttaacgtagaaaaagcccgtctggacaaaattttagcaaacaatgaaattcggatgatcatcacggcaattggcacgggaattggcg

SEQ ID NO: 6045 - DNA, 345 bp, Bacillus clausii
tggtgcagcttctaaaatcagaagaatacctgaacaaatctaaagttcagcttaagagaattagaaatgccgacttagtgattattgatgatttaatgtatatggccatggaccagagagaagcaaacctattctttcatttaattaaccatttatacgaacgaagttcgattatcctgacatcaaataagagtccagatgaatggggcaatttaatcggagaccaaggcatcaccactgcgattttagatcgcttacttcatcgtgtggaagtgatccatggtagcgaagaagagagaagtcacaggatgaaaaatcggaagagcattttttcagcagatgtgt

SEQ ID NO: 6046 - DNA, 1200 bp, Bacillus clausii
agggctctatattcgcgccgatcagcttgcacatcttcatctcttttctagaccattgccgaaaattaaaacggttcatgaaagacaaacaagcgattgcacccactgtaagcgcttatgcgttttcaattggcgatcttcatgctttggaagagcgcctaggcgcgtgcatacgccttggccaagtggatgaccatgcttcaagtgatttggcttacgtccgtcggcaactgcaaatcatccaaacaaaactaaaagacaaagcccagcagcttgtcaacaataagcgttacgctccctacttgcaggataaaacaattgtggacagaggagggaaacttgctctggctgtaaaaaaagagtttcgcacaaaagtggagggcacggtgattgaccaatcgtcttcaggggcgacactctttattgagccaaccgctttaggtgacattcaagaggaacgggcattgttgcaaattgctgaagaggcagaggtagaacggattttatatgagctgactgagatggtgctcaaccatgaaacagagattcacatcgctatcgaaacgatgcaccattatgatgtcctatttgccaaagcgaagtatagcgcttcgatagacgctgctgtccccactttaaatgaagaatacaggattgacttgcgcaacgcccgccatccaaaacttggcaacaaagctgtccccctctctataaaagtggatgagcacgaacgggcccttgtcattacaggtccaaatacaggggggaagacggtgacgcttaaaacggttggcttgctgacgttaatggcgcaaagtggtttgcccattcctgctgagccagagagttcgattgcgattttccggcaagtgtttgtggacattggcgacgggcaaagcatagcagacaacttgagcacattcagttccagaatggtcaacattattgctattttgcgcgaggccaatgaccagtcgttgatcctcattgatgaactaggttcaggcacagacccaggcgaggggatggcactggcaacagttattttagaacagctttttcaaaaaggggcgacgttgatggcaacgacccattacagcgaaattaaacaatttgctaccgaagacgcctggatttgtaaatgcagcgatggaatttgacatggccacactttggcgccgacataccgcttaatgattg

SEQ ID NO: 6047 - DNA, 453 bp, Bacillus clausii
atgagtgacaacagtttatcacacacaagatggaattgtaagtatcatatcgtgtttatccctaagtatagacgaaagattgtctatgggaagctgcgaaaagatattggagctattttgagaaggttatgtgaaatgaaagatgtagaaattatcgaagcccatgcgatgattgatcacatacacatgctggtgaaaattccgccaaaaatgtcggtatcgtatttcatggggtatttgaaagggaaaagttcgttgatgatccatgatcgtcacgcaaacttaaaatacaaccatggaaatcgcacgttttgggcaaaaggctattacgtgagtacagtaggactaaatcaaaaaacaattgaaaaatacatccgcgaacaagaagcggaggatcgattgcgcgatcaaatgacaaagagggagtacgtcgacccatttaaagataagtaa

SEQ ID NO: 6048 - DNA, 369 bp, Bacillus clausii
gaaaaaaaatgatattgcctttgcagtgaatgatttaattgaaagtattcctgcaaaatcttttcaaaaatttgaacgcagtacaggttgtccagcttatcatccacgtatgatgatgaaaattattttatgcgcatatactcagtctgtattttccggacggaaaatagaagcattactcaaagacagtatccgtatgatgtggttagctcaaggatacgagcctacctatcgcaccataaatcgatttcgtacaaatcctttagtagctgaattgttgcgacaatgctttgtacaattccgttctaaacttgttcaagaagaagagatagatgcagaagctctctttattgatggtacaacgatcaa

SEQ ID NO: 6049 - DNA, 612 bp, Bacillus clausii
ccgtcgtcttgccagcgatgtttccaaatttgcttgtgaatggttcaacaggtatttcggctggttatgcgacagacataccgcctcatcacttgccagagatcattgatggcattacgttgttgatgcaaaagccaaatacgagccttgatgaattattagaaattattaaaggccctgacttccctactggcggaattgtccaaggctcaaacggcatccgccaagcttatgaaacagggaaaggcaaaatcgtcgtccgtggacggacagcgattgaagaaacgcgtggcggccgcaagcagattgtcattactgaaattccttatgaagtagtaaaagcgagcttagttaaaaaaatggatgaaatccgatttgacaaaaaagtagacggtattgctgaagtccgggacgatacagaccgtaccgggatgcgcattgtcgttgaactgaaaaaggaagccgatccagaagcgattctccattacctgtttaaaaatactgatttgcaagtgacgtaccactttaacatggtagcgatacacaataaaacacctaagttaatggggctgcgcgacctgatgcaagcgtacatcgaccatcaaaacaagt

SEQ ID NO: 6050 - DNA, 321 bp, Bacillus clausii
aacatacggactgatgaaagacagatcggcaaaagaagtccaagcgtttatcgactttttactagcagaacaatacattgggttaacgcctgcttcgtatccgaccattcaattgctgccaaaaggcgcggctgttttaaaaggcgaaggccaagtttatcagtacaaagaaacggttgaacgaacagtaagtgacgaagatcccatctttgccgcactccgcgctaagcggaaatcattggctgatgagcaaggaattcctccttatttgatcttctccgataaaacattaagagaaatggccgctgtcgtccctcagtc

SEQ ID NO: 6051 - DNA, 576 bp, Bacillus clausii
ggcgttattggatcaagcggagcacgtgttgcgatcattgtatggctatacggcttttcggcctggccaacaaaaaatcattgagtcgattttaaataaggaagatgctcttgtcgtcatgccaactggcggcggcaagtctctgtgctatcaaattccggctgccgtgcttgaaggcgtcacgctcgtgatttcccctttaattgcgctaatgaaagaccaagtagacgctgtcaatgaaatcggcataccagctacttacattaatagttcattgacgaaagcagaagaacgaaagcgtttgaaagatgtcgctgacggaaacatttcgttgttgtatgttgcgcctgaacgcctctatgaccactcgttccaagcggcgttggcaaagcaacctcttgccttaattgccattgatgaagcccttgcatgtcacagtggggacatgactttcggcaagctatttgacgatggccaactggattgaatcactaccagaaaagtgcaagttgtagcgcttacggcgacagcgacaccggatgtggctcgcgacatatgcaggcgccttcacattga

SEQ ID NO: 6052 - DNA, 276 bp, Bacillus clausii
aaataagagtattccccattctatatgctggagcctcggtaaaatcaaaaaccctatgaaaaccgtgggcgcttcaccgacatccatcaagcagaggcataaagagatccgaaaacgagagaccttcggtcattgggaactggatacggtcatatcgggtcatgggaaaagcaaaggctgcctggcgacctttatcgaacgaaaaacccgttggtattgcgctatccccatgcccgaccgaacggccgtctctatggaggaagccatccgaaagct

SEQ ID NO: 6053 - DNA, 450 bp, Bacillus clausii
atgaaaataactattgaagaagtacctgaatccaggattgcttatttccgaaatgttggggagtatggtgaaaagcaaaacaaaaaattaatggagaattttaaaaagtgggcaaaattaaatggtgtgtttgatgattctataattttaggcataccgcaagataacccagagattacgcctaaagaggaatgtcgttatgatgtttgcgttgttataaataaaggttttaatgtggaaaaaccagctcatattggagaattttctggtgggaaatacgctgtttttttgcttgaccatacaaaagaggcagtcagtgaattttggggcaatattttttctgagatagaaagaaataatctatcaataagagaacaaccaattatagaaagatatacttcacaaatgattgataatcatttgtgtgaaatattagttcctatacagtaa

SEQ ID NO: 6054 - DNA, 1857 bp, Bacillus clausii
actcttacttaaaaatggacgtccacgcaaaacggaatttggaattagtgcaaacgttgcgggataaaaagaaaagtggctcactccttgctgtgattgaccaaacagtaacagcaatgggcggaaggcttttgcgccaatggattgaacggcctttagtggacaggaaagcgatcgtaggcagacaggcagtggtagaagcgtttctggaacatttttttgaacgggagcaattgcgcgattgtctccgccatgtttacgacattgaacggttagcagcccgtattgcttacggcagcgtcaatgctcgggagcttgtacaattaaagcgctcgctgcaaaacattccggagatcgcgtcaacggtggaacaagtcggccttgatgggcgttggttaaagcagtctgagcagtttgctgatttggtggccatgttggagaaaagccttgtcgatgatcccccgctctcattaacggagggtggtcttattgtagatggttataacgaagaactggatgcttaccgggatgcaagccgcaatggcaaacagtggattgctgaacttgagcagtctgaacgtgaggcaacgggcatacgctcattaaaagtaggctacaaccgtgtatttggttactacattgaggtaacaagagccaatgcccatatgctgccagacggccgctatgaacgcaagcagacgcttaccaatgccgaacgttacataacgccagaactaaaggaaaaagaagcactcatattggaagccgatgaaaagctcgccgatcttgaataccgtttatttgctgatatccgtaaacaagtggaagcctatgttgctagtttacaaaagcttgccgccgatattagcgaaatggatgtgctcgctggttttgcctctgttgctgaacaaaacggctacacgaagccaaccatcactgaaagtcgcgatgtcgccatcaaaggtgggcgccatcctgtcgtagaaacggtcattaaacgaggcagttatgtagaaaatgacattgatttaacgggcgacagggatatgttgttaattacggggccgaatatgggcgggaaaagcacctatatgcgccagcttgctttaactgtcgtcatggcgcaaatcggcagctatgtgcctgctgcagaagcaacgctgcctttattcgaccaaatttttacgcgcattggtgccgctgacgaccttgcgagcggacagagcacatttatggtagaaatgctggagacaaaagacgcgcttgtgaaagcaacaccacacagcctcattttgcttgatgagattggccgtggtacgtcgacgtatgacgggatggcgctcgcacaggcgatcattgaatacatttatgaaaccattggcgctaaaacccttttttcgacccattaccacgaattgacgcggttggctgattcccttcatacgttacgcaatgtccatgtatcggctgtagaggaaaaggggacagtggtgtttctccatcaagtgattgaaggcgctgcagaccgcagctacggcgtttatgtcgcagaactggccggtttgccaaagcaggtgacaacgagggcagaggcgcttttgactgagttggagcatcttccgcaaagaccgacaagtgcttcggaagagcaacaaatcgatagcgcaaaaacggaaacagcagcaacggtcgaagaaccgcagcagctctcgctatttccagctgatgatgaaacaaagccaaaacagctaacaaaaaaagagcgttcggtactagcgaaaatggctgaagtcgatgtgttgcacttgacaccgatgcaagcacttgaaaaaatcaatgagtggcaaaagcagctaa

SEQ ID NO: 6055 - DNA, 216 bp, Bacillus clausii; identical to SEQ ID NO: 5946

SEQ ID NO: 6056 - DNA, 184 bp, Bacillus clausii
  misc_feature (1)...(184): n = A,T,C or G
atgcataccccaatgatgaaacngtacttgcaaattnaagcnnantaccaggacgcctttttattttnccggttangcgactttnatgaaatgntcaatgaanatgccattaaagctgcccaagaattanaaattacgttaacgggccgcggccaatgcgaagaccgaattccaatgngcggtg

SEQ ID NO: 6057 - DNA, 468 bp, Bacillus clausii
atggttagcatcatcaccgctgtttttacaactggcgacattcacgtcctaatcgggacaacggcgctgctaggagagggctgggacgcacctagcatcaatacgcttattatggcatcctatgtcggctcattcatgttgtctaatcaaatgcgcggccgggcgttgcgaattgaacgaggcaacccgaataaaaccgctaatatttggcacatggtttgcatagacacgaaacagtatgatgggggccatgattgcctctcgctccagcgccgctttaagtcgctaatcggccttggcacagaggacaatatcatcgagtcaggcatcaaccgccttgcttttcctaaaccacgttatcgccgcaagttattgaaggagtcaaatgaaaagacatttgcctgggcggaaagtcggcaagttctagccgaccgttggagaaaagcggtggcgatggagggaaggccg

SEQ ID NO: 6058 - DNA, 804 bp, Bacillus clausii
atggccatcattacacgccacaaaccatttcgaatatgaccaaaacgatggagaaacaagtcgaagcttttaaagcacgaaccctggcgaagcgatatgtctgtgtctatttagatgccacctttattgcgattaaacgagacacggtttcaaaagaagcggtctatttggccattggtattcaagaggatgggacgaaagaagtgctggcgtacacgatcgcaccaactgaatcggctttggtctggaaagaagtcttagaagatcttcagaatcgaggcgtcgaggacgtgttgctttttgtttcggatgggcttaaaggaatcgtcgattccattcaaagtctctttccttcttcgtcctatcaattgtgttgtgtccatttatcacgcaacctcgcacacaaggttcgcgtttcagaccgggctgaagtctgtggtgattttaagcgagtctaccgcgcgaccagcaaacaagagggccaaaaagcgctcgatgacttcgtgacaaaatggaaaaaagtctatccaagagcaacaaaatcacttgaggagaatccttttatactcacgttttacgacttccctcaagccatttggcgaagcatttattccaccaatcttattgaatcctttaataaacagttaaagaagtacagcaagcggaaagagcaatttccaaatgaaccgtccattgagcggttcctcgttagtcagtttgaaccctacaatcaaaaattctcaacacgttgtcatcttggatttgatttagcaagagctgaattagtaagcatgtttgaacgaa

SEQ ID NO: 6059 - DNA, 1759 bp, Bacillus clausii
ttgcgtaacccaaaggtcactttccaagagtataccatgaatcaactctatctgcctatggatttttccgatcttatccccgaacatcatgtcgcgcgtgtggtcagtgacgtggtggatgggttggatgacgatttctttgttcgtgcgtatgaaggtgggggcagacctgcctatcatccgaaaatgatgacaaagattgtcctatatgcgtatacgcaacgttggttctcgtgccgagccatgggacaagccctcaaagaaaacctgccgatgatgtggctcgctgctggacaagccccaaactttcggacgatcaatcgctttcgctcagaacgtttccaatcgttgatggaaggcctgtataccgaaatgacgcatcttctgatcgaagaaggctatgtcgacatggaggcctattttctcgatggcaccaaaatcgaagcgaacgccaataaatactcgttcgtttggaaaaagagcacgctttcccacgaagagaagcttcaaatgaaaatcgataaaacgttagaggccattcaagaagcgattacgttggataccgaaaccttaaagcaggaggacgccacgtttgaacggcaacgaatcagccgcaaacgtcttcaagacgtcgtcacaaaggtggaaaaggaactggatgcgctggaccaagccatcgcagaagccccatccaaagaagaaaaacgggcccacaaagaagcgagcaagccactacgaaaggcctatcgaagcttaacgaaagaccatcttcctcgtttggaaaaatacgaagaacagatgggtctctttggcgagcgcaacagcttttctaaaaccgacccagatgccacgttcatgcggatgaaagacgatcacatgaacaatgggcaactcaaggcagggtataactggcaagtggcgacgcaaaaccaattcattcttcactacacggttcaccaacacccaaccgatatccgttgtttgatcccgcattatgagcaccttaaagcgacaggtctgcctctgccaaactggttcattgccgatgcaggctacggaagtgaaagcaattatctttacatggaagagcaagaaacggtcacatcgctcattccctacatcacctatcgccaagagcaaaaacgatcattcccaaagcagacctaccatccgtataactggtggtatgacgaacacgaggatgtctattggtgcccaaacaaccggaaggtcgcctttaaagcctatcgccgccgtaccgatcgctatggattcaagcgcgactttaagatttacgaatgcgagtcctgtgaggggtgtccgttcaaagcggactgtacgaaggccaaggggaatcgccaaatccattacaaccccgtctacgaggaactcaaagccaaagaagcggccaaactgcatagtgaaaggggagccacactctacgcgcaaagaaaaacggacgtcgagagtgtatttgggcatgccaaacaaaatctcgggtttcgacgattccatcttcgcgggttggagaaggtgacggtggagcttggttggctgggattggccctcaatctgaggaaaatggcgggcaaggcctgccattattcactcaaaacaacgacccatcaaaaaaaggggagtcgagatcaactcaaatctcgactccccttcttcattttaaaggcttttgggacaacccctgtcttttggcaaacgctcgcatcctttgtagttcatctgaagctgacaagcgttttct

SEQ ID NO: 6060 - DNA, 439 bp, Bacillus clausii
atggcacaagaaaaaatccaacaactattgaacaaacaagtagcaacctggagtgttttatatgtgaaattgcataactaccattggtatgtgaagggcccgcacttttttacactccacgagaaatttgaagagttatacaacgaagccggagaaacagtggacgagttagctgaacgcctgcttgccttaaaagggcaacctgtggcaacaatggatgagtttctacaactatccgcgataaaagagggcgataaaacgctgtctcctgatgaaatcgttcgtgacttagttcgcgattacgaaaaaatttctgatgagctcaaaagcggcatcgacacatgcggctcccttggcgacgatccaacccaagacatgctcattggcttgcaagaaaacatcgaaaaacacgcatggatgcttcgtgcatatacaaaag

SEQ ID NO: 6061 - DNA, 450 bp, Bacillus clausii; identical to SEQ ID NO: 6053

SEQ ID NO: 6062 - DNA, 609 bp, Bacillus clausii
ccaactagaagaagaaatcaatggggaacgggtgaaaaacggaaaaaagcccctgcctccctcgaaaaaagatcctacgagggaggtcaaggagagtaccacggatcctgagagtggttattacgttaaaagcgagcgggaaaagatgtttgcctacagtttccataccgcttgtgatgccaatggatttgttttaggtacgatcgtaaaaccggcgaatgtccacgacagccaagtattccacgaactgtttgaccaattgaaagacaaggtgtgccgaccgaaggtcgccgctgtggatgcgggctataaaacgcctgccattgccaaaaaacttcaagaagaaggcgttcatccggttatgccgtataaacgcccgatgacccctaaaggctatatccgaaaaaacgagtttgtctatgatgaatactacgattgttttctctgcccacaaaaccaggtgctttcttaccgaacgacgaatcgagaggggtaccgggaatatgtctccgaccctcggatttgtgagacgtgcccactgctcgctcaatgtacaaagagccaaaaccaccaaaagctcgttcttcgccatatttggcaagatgctct

SEQ ID NO: 6063 - DNA, 474 bp, Bacillus clausii
gctggaagataaacggatgcagatggagatggtctggattgaaaagctggtgccagaggatcatctcgttcggaagcttgatgcggcgattgactttgatttcatttatgaccttgtcgaagatctttattcaaaagacaggggccggccgagtgtcgatcccgtggtgttaatcaaaatggttttcattcaatacatctttgggattcgttcgatgcgccaaacgattaaagaaatcgaaaccaatgtggcctaccgttggtttttaggatttggctttgaggacaagattccccacttttctacgtttgggaagaactacgttcgtcgtttccgggacagtgacgtgtttgaacaactcttttatcggattctgaaacaagctatggacaaaggatttgtgagtccagaggtggcttttatcgactcgacttccattaaagccaacgccaataaacgaaagcatcgtaaaaa

SEQ ID NO: 6064 - DNA, 1380 bp, Bacillus clausii
atgaaaaagcgtcaggagatcgggcgtggattacgattggctgttgaccaagaaggaaaacgagcagaaaatcatgacatcaatattttaactgtcgttgcaaatgaacaatatgaatcctttgtgtcccgtttacaacaggaatatatagaggacggtacagatgctccaccaacaccgaagaagccagagcaaggagaagtacatcgcaaagaagaagtatacaactccgaagagttcaaggaattctggcaaaagttgaataaaaaaatgagttataaagttgaagttgatacgaacaagttgattgaagagtgtgtgggtcgtctaaataatgcaaagttcccatcacctttgattgaaattacaagaggtcgctttgtaatgtgtgaatacaagctttctcttatagcaactgaaggcgaacgagcaaaacttaagattgagatggaagattcaaaaggaggtcgctttgaaaatgaattttatgtacagaaagatgacgacttaaagaaagtaacaaaggatgatcgtctcagaggattcaaagtgcttcatacaggcgagttgtatggcgaaccatatattaaatttaccaatgaagtaacagtgaaaaagtttgagccatacagatttcatgcagaaagagcagaaaagcctaagaaacaaattgaacaagcggacaagaccacctatcctattcccgattttatcactcgtactgccaatgaaacgaaattgacgaagaagacgattgttgaaatttttaaggggattaggacggaacagaaggaaaagattttctttaatcccgaaggatggatatctgaattcttatctcaaattaaaattactttaagtgatcatattgttgataatatcgaatttgaaattgacgaaaatgttgagatctatgattcggaagaattatttccagaaatggtgaaacaaccacagcgtgagttaatagaggcgggtgtcgctggcctatacgacaaagtccaggtagattcagacgtagagcgtgattttatccagaaccttgttcgacctgatgttgagaaggataatacaattctttattttaaatttccgccgaagtttaaaatattactgccgaaaattattggaaactataatcccgactgggcaatcgtcaggaaagatgaaaccgatgataaattgaagttagaattggtaagggaaactaaaggtggacttaaacttgacgagttacgattcccgcaggaaaaacggaaaatcctttgtgcaatgaaatactttgagaaaattggtgtgaactatagagttgtgacaggggacagttatgattggacggaattaacggagcctgtgcagttaagtttggagacaaactaa

SEQ ID NO: 6065 - DNA, 513 bp, Bacillus clausii
acggatccattagccacaatgaattagacgagttaaaaaaagatcagcacaaaggagtccaagacctgcttaaacgttatcaagcgcagcaggaaaagcagcaaacgcttatacaaatgcataaggaaatgtggcgttacgaacaggaactaaaacagcgcggctatgtagctgtttgcggcgttgacgaagtggggagaggcccccttgctggccctgtaacagcgtgcgcttgcatattgcctgatggctttcaattattagggctgacggattcgaaaaaactgtcaaaagccaaacgggaagaatatgcaaaaatgattgccgaacaagcagtcgcctattcgattgccagcgtaagcgcagcggaaattgatgaaatcaacattttacaagcgacgaaaaaggcgatgacgaaagcaatcaacggcctcagccagaaggcggaccatttgctgctcgataccgttcgccttgatgtgccaatcgctcataacatcgcttataaaggga

SEQ ID NO: 6066 - DNA, 342 bp, Bacillus clausii
aaatgggagagagaggctacaggacggttgccgtaatcgtcaaaacggcgaaagaagcaaacgatgtccatgcccagctgagcgaatggctcgatattcagcttgtggccaaagaccatcatgaatacaaagaaggagcagtcgttttgcctgtttacttggcgaaaggcattgaatttgatgcagtcggcgtatttgatgcgtctgcaagccattatgcttcttcccaagaacggtaccacctttacacagcatgcacgcgggcgatggaccacttaaccgtttttgccgcaggcgaatggtcgccatggctgaagccgatcccgtcccacctttatgaag

SEQ ID NO: 6067 - DNA, 801 bp, Bacillus clausii
aatatttaaagatagaaacagttattccaaaacagatcacgatgcaacttttatgcgaatgaaagatgactatatgcagaatggacaattaaaagctgggtacaacctacaagtagctaccgaaggtcagtatgcattagcttatgatatatttccgaacccaacagatacacgcactttgattccgtttttaaataatatagaagataattatttcgaactaccacaatatatcgttgccgatgccggatatggtagtgaacaaaactatgataatgtattaaatgtgcgtaagcgaattccacttattacatataatcaatatagaaaagagaagaaaaggaagtttaagaatgatccatttaaaacggcaaactggcaatatgatggcgaaacaggttcgtttattggtccaaataatcgcagattatattttgcatatcaatccaatcgaaaagataaatatggatttaaacgaaactttaaagtatacgaatgtgaagattgtacggattgcccattacgctctttctgtacaaaagcaacagaaggtaaaaacagaaagttgttttataatgaaaaatgggaatctcaaaaagaatatataagacaaaagctttcaaacgaagaaacaggcgaagtttacgggaaacgtaaaatagatgttgagccatttttcggatttttgaaggctaatttaggtttcactcgaatgtcggttcgaggaaaaccccaagtgcataacgaaatgggatttgcgttaatggcggtaaatataagaaagtacgccgtcattaacac

SEQ ID NO: 6068 - DNA, 252 bp, Bacillus clausii
aaaaaatcgcctcatcgtttaaaatgaaggtaccactaccaaaattcaaacgaaagcaggcgatttttttgcgtaacccaaaggtcactttccaagagtataccatgaatcaactctatctgcctatggatttttccgatcttatccccgaacatcatgtcgcgcgtgtggtcagtgacgtggtggatgggttggatgacgatttctttgttcgtgcgtatgaaggtgggggcagacctgcctatcatccga

SEQ ID NO: 6069 - DNA, 201 bp, Bacillus clausii
gtgacatggcatgaaatcaacgatgagattattattgcattagctgaagagtttgacatgaattctaacctaggctatctaaaaagggaaaaaaatgaatgtatgtatgaaatcgagaacgatatcattacaagaatgatagccattggggaaattcggttcttgatacagataagcgtcattgataagatggttgttcag

SEQ ID NO: 6070 - DNA, 159 bp, Bacillus clausii
gatgacgttgcttatacgcgatgtaccacaaacagagcgcccccgggaacggtttatccgtgaaggggccaaagcattgtcaaatcaagaaattgtcgcgattttgcttcgaacaggcacgaagcaaagctcggcgctacatgtagcgtctacgttatt

SEQ ID NO: 6071 - DNA, 1177 bp, Bacillus clausii
ttgcagcaattggtgggcagcgtaaaagaagtgcgcgctgttgcaaagggtattgaaaatgaaatgaatgagcaacttcttactggcctgaccggttccgctcgcacggttgtaagcgctgcgttattcagggaaacaggaataagccaactcgtggttacccataatttataccaagcccaaaaaatatatgaagatcttgttgaattattagatgaggacacagtttatctttatcctgtgaatgagctcatctcagcagaaattgccgtcgccagcccggaaatgaaagcgcagcgcttggatttgcttaatgcgcttgtccaagattttaagggcattgtcgtcgctccgctagctgggattcgccgcttattgccgccaaaggctttatggcaaagcagccagctccatttgaaaacaggcgaggacatcggtgatttggaagaatttataaaaaatttcgtcacaatgggttaccgcaggtctgatatggtgtcagcacctggggaatttagtgtgcgcggaggcattgtcgatctgtatccgcttacgaaggaacatcctttgcgaattgagctgtttgatacagaagtcgattcaatgcgctacttttcattggagacgcagcgttctgaaggaatgatcgatgaagtaacaattggtcctgctcaagaagtgctgctccatcatcaacactatagccacggggcgaagttgttggaagaaaaatatgaggcaacgctaaaaaaagtatcaagcaaacaaacgcgggataaattacaagaacatattccttttgaaattgcccaactgaagcaatcggctacgtttgaaggcatgtataaatacatgtcgctttattatgaaacgccgcaatcgttattgtcttatatgccagagaatgcgtttgtctgggttgacgaaatgaatcgcgtcaaagaaatggctgaacacttgcaaaaagaagaggcagaatggcatacggcgatgcttgaacaagggagcatcgtccacggtacgcaattgtcccttgatgcccttgcaaggctgcaacaggcgccgcagccggttctttatacgtcgcttttccaaaaacaagtgccttccacgaagccagagcaaatcattaacttgtcatgtaagtcaatggcaaaaatttccatgggccaaatgg

SEQ ID NO: 6072 - DNA, 627 bp, Bacillus clausii
  misc_feature (1)...(627): n = A,T,C or G
tgacggnccacgcntatcccacgaacgctggcgatttcagtttttggtatatggatgtatcggtgcttgatgaaatgcctgctggcagaaagccaattgaaacgtattgggtccagcacgagatgttagagcgtgtgcttgaatttgtgcgcaaagaagtcaagaaaggccgccaagcgtatgtgatttgccctctgattgaagaatccgaaaagcttgatgtgcaaaacgcaattgattttcatagcatgctaactgcccattttcaaggagacgcccaagttggattaatgcacgggcgtttacaagctgctgaaaaagaggcagttatggccgcttttgcgcgcaatgaattgcatattttagtttcaacaacggtcgtcgaagttggcgtcaatgtgccgaatgcaaccgttatggtcatttacgatgccgaccgatttggccttgcccaacttcatcaattacgaggccgcgtaggacgaggcgatgaaaaatcctattgtattttagttgctcaaccgaagacagaagttggcaaagaacggatgcggattatgacagagacaagcgatggtttcgttttgtcagagcgagatctagaattgcggggtccaggtgattttt

SEQ ID NO: 6073 - DNA, 612 bp, Bacillus clausii
ttccgttccgttacgaggattatgccctcaaacagcctacagaagcagcccatgatgaacgtgtgactatggcgggtaaaatccaaaatgaagcgagcgtccgctactatggcaaaaataaaaacaggctgacgtttcggatcgaagtggatggcgtgttggtgacagccactttctttaaccgcgcgtttttaaagagcaagcttcagcctggaatggacgtgaccgtcactgggaaatgggacgcgcaccggctgaccattacagggtctgaattaaaattcggcatcgttgaacgggaaggcaacctcgaacctgtttatcacagttcaggcaaagtgacaagcaaggcattgcaaaaatggattgctgccgccttctctgcgtacggtagccaaattgaagacccattgcctgaaagcattcgtaaacgctataagttgatgggcaaaggcgaagcgctccgccatcttcactatcccctcaatcgagaagcaacgaagcaggcaagacgacgttatgtgtatgaggagctgcttttgtttcaattgaaaatgcgcgcttttaaagaagcgattcgcaaccagcaaggcgggaggcagcttgacgtaa

SEQ ID NO: 6074 - DNA, 897 bp, Bacillus clausii
aaaagagcaaacttaaagtgctgaaaggcttaaaagcaggatctgtagatttggtcgtcggtacgcatcgtctgctttcaaaagacgtacagtttaaagacttgggattattgatcgtcgatgaagaacagcgttttggcgttacccataaagagaaaatcaaacgcatgaaggccaatatcgatgtgctgacgttgacagcgacgccgattccgcgaactctccatatgtcgatgctcggtgtgcgtgatttatcggttattgagacgccaccagaaaaccgctttcctgtccaaacgtatgttgttgagtttaatccagccattgtacgcgaggcgatcgaacgtgaactaagccgtggtggccaagtgtatgtcctctataaccgtgtagaagacattgagcggatgacggagcaaatttctacgctcgtccctgacgcaagagtaagctatgcacatgggcaaatgaatgagcgcgaactcgaatcgatcattttggatttccttgaaggggaaagcgatgtgctcgtaacgacaaccattatcgaaacaggcgttgacattccaaacgtgaatacgctcattgtttgcaacgctgacaagatgggcttgtcccaactttatcaaatccgcgggcgtgttggtcgctcgaaccgggtggcatactcgtattttacgtaccagcctgacaaagtgttaaccgaagtggctgagaagcgcctacaggcaatcaaagaatttactgagcttggctcaggctttaaaatagcgatgcgtgatttaacgatccgcggtgccggaaacttgttagggtcccaacagcatggttttattgactctgtcgggtttgacttgtattcgcaaatgttgaaagaagcaattgaggaacggaaag

SEQ ID NO: 6075 - DNA, 1362 bp, Bacillus clausii
atgaatgctgaacattttagccgtttaggcttaaacgagcgactgctcaaaggattgagcgctattggggtcaagcggccaaccgagatccaggaacggttgattccagcgattttaaatcgaaaagatgttattggccagtcacaaacagggacaggaaaaacattcgcttttttgttgccgatcatcgaacagctcgacatcgaccgaaacgaggtacaggcagtgatcactgcccctacacgagagctttgcgcccaattatttgatgagttaaaaaagctgattgtctattatgacggtcaagtagatgcgcagcttttcgttggcggcacggacagaaaacggcaagcacaacggttgtccactaagcaaccgcacattgtcatcggcacgccagggcggattgctgaccttgtcaatacatcttccttgcttgtatacacggcaaagacgcttgtcgttgacgaagcagatcagatgctcgacatgggctttttagaagacgttgacaaagttgctggaagattagccgaggacctgcaaatgcttgtcttttcggcaaccgttcctgaaaagctgcagccatttttaaaaaaatatatgaataacccacggcatgtccacgttcaaccagaaaagctggcggcagagcgtgttacccaccagcttgttccattgcgccaccgggacaagttgaccgtgttgaaagagaccattcgcggtttaaacccatatttggcgatcatctttaccaatacaaaagagcaagccgacgaagtgacagcagctttagctactgaggatatactcgttgattgcctccacggtggcctgtcaccgcgggaacgaaaaaaagtaatgaaacgggttgaggacttatcaatccagtatttggttgcaacagatttggctgcgcgaggcattgacattaaaggcgtgacacacatcatcaattacgcgtttccgcaagacttggatttttacgtccaccgtgttgggcggacagcgcgggctggcgcagacggcattgccttgtcgctgtatgagcaaagtgatgaagccgcgtgtgcgaagcttgccagtcgcgggattgtgttttcgtttgtggaattcaaacatggtgaatggacagagctcgttaagcctcctgtaggagcgggccggatcaatcgaaagcaaccaacagacaaagggaaagccactgttgaaaaacaaacaggcaaccggcccattcggaccggcggcaaggcaaaagctaggcctaaaaaagtaaagcctggctataaacaaaaagcgagagcggcaattgccaaacagaaaaaacgggagagacgcttaaacgcgcgtaaagagaaataa

SEQ ID NO: 6076 - DNA, 633 bp, Bacillus clausii
tttgacgcaatatcaacgtgatgttgttatgaagaaattccgcgactcgtcgatcgagtttctcattgctacagacgtagccgccaggggtatcgatgtagaaaatgtcagccatgtcatcaactacgatattccacaagaccctgaaagctatgtgcacaggattgggcgtacagggcgagcgggccggacaggcgcagcgattacgttggttacgcctcgggaaatgaagcatctccgctctattgaaaaagaaatcaagatgcacattccgtcagcaagtgtgccgacgattgaagaagttgttgaaaaacagcaaagctcttggaaaaacttaattgaggatacaattgagcaaggcggcaaagaaatggagttgttcttgccccttgtagatgaaattcttgctgagcaagaccctaaacaagtggttgcggcgctattgaaattaaagttttcaacagagacggcaaccgaagatgctggctacagctttggtgacacaggcggtgccaaaggaatggtccgcttcttcatcaatgttggacgaaatgtcaatttgacgatgaaaattcttggcgaagaaatcggccgccttgtcggcatccctgtcaaatcgattggccgcatcga

SEQ ID NO: 6077 - DNA, 1449 bp, Bacillus clausii
tgacctattttacagactttgatatttcggaccaagtgaaacaagcaatccaggatatggggtttgaagaaccatcccctatccaagaaaaagcgattcctgccattttgacaggtggcgatgtaattggccaggcgcaaacaggaactggaaaaacagctgcatttgggataccggttgtcgctaaaccgaccacagagcgttacattcaagcattaattttgacgccaacaagggaactggccattcaagtttctggagaactgcaaaagctatcggctcataaacggattcggacgttgccgatttacggcgggcaatcgatcggccaccaaatcaaagcgttgcgccaaggagtgcaagtagtgattggtaccccaggacggatgcttgaccatttgcgccgtggaacgctcaaacttaattcggtccataccgttgtccttgacgaagccgatgaaatgctcgatatgggctttgtcgatgacatcgaagcgattttaaaggaagtcaatcaagttcgacaaacgttgttgttttctgcgacgatgccgcctgcgatccgcaagctgtcacgaaaatacatgaacgatccgaaaacagtgacgattaataagggcgaagtgacggcaccttcgatcaaccaagtttattataaagtattggagcgaaataaaattgactccctttgccgcatcattgacagcgatgatgtggagctcggcattttgttttgccgcacgaagaaaggcgtcgctgaattgacagaagcgctccaagcgcggggctaccttgttgatggtcttcatggagacttgacgcaatctcaacgtgatgttgttatgaagaaattccgcgactcgtcgatcgagtttctcattgctacagacgtacccgccaggggtatcgatgtagaaaatgtcagccatgtcatcaactacgatattccacaagaccctgaaagctatgtgcacaggattgggcgtacagggcgagcgggccggacaggcgcagcgattacgttggttacgcctcgggaaatgaagcatctccgctctattgaaaaagaaatcaagatgcacattccgtcagcaagtgtgccgacgattgaagaagttgttgaaaaacagcaaagctcttggaaaaacttaattgaggatacaattgagcaaggcggcaaagaaatggagttgttcttgccccttgtagatgaaattcttgctgagcaagaccctaaacaagtggttgcggcgctattgaaattaaagttttcaacagagacggcaaccgaagatgctggctacagctttggtgacacaggcggtgccaaaggaatggtccgcttcttcatcaatgttggacgaaatgtcaatttgacgccgacaattcttggcgaagaaatcggccgccttgtcggcatccctgtcaaatcgattggccgcatcgaca

SEQ ID NO: 6078 - DNA, 291 bp, Bacillus clausii
aaagtatgaccagtgcccaaaaatgatttttctcccctctatcgaaacactgcaaactttttccgaattgctagcagaaagaaaaatagaccatgctgctgtttatgcagaagcggctaacaggcatgccgatattgctgcctttcgtaagaaaaaacacaacttgctattaaccacaacgattttagaacgtggcgttacggttgaaaatgtccaagttgctgtacttgggtcagaagaccgaatttttaccgctgcctgtttaacgcaaattagcggacgtgtaggacg

SEQ ID NO: 6079 - DNA, 478 bp, Bacillus clausii
ttgcagcgaataactaattgtatactggcaacagctgatcaatgtttaatgcttcaaaagccaagccgtggctggtgggtagctccaggcggaaaaatggagcatggtgaaacgattaaagaagctgttgtccgagaatttcgggaagaaacggggctatccattaaagaccctgaattgcgcgcagtgaccacggtggtcattgtaggtgaggggcaaacaatggaagatgagtggatgatgttctcttttcttgccagcagctatgaaggcacgatgcttgatcagtctccagaagggaagcttgtctggcaaaaacgtgatgctcatgtgcatttgccaatggcagaaggggaccaccatgtctttaaccacattttaaatcaaaagggcgttttatacggaacgttttattatacaaaggattttaagttgattgattatcgacttgatccgaaaccgatgcaagagaaagggg

SEQ ID NO: 6080 - DNA, 543 bp, Bacillus clausii
  misc_feature (1)...(543): n = A,T,C or G
aggggctttggcacgaaacattccattgttggatcgtcgatgattcacaaacagagccttacatttatttgcaacgacgcagcgcccacaaaaaagatttccccagcttgtttgatattaccgcagccggccatttgctcgcaggtgaaacagccgaggatggcgtgcgtgaagtcaaagaagaattagggatcgacattccttttgctgacctagactttctcggccaattccgctgtatgccgaaacaccgtgatatctatgattatgagtttgcttttacgtatgtataccggcaacatatcccgtttgagcaatttcaattacaagaggaagaagtcgctggcatggtgcgcgtgccttttcccgctttctatcaactctgttttggtacggtcgaagcgatcgaaagtaacgggtttgtggaagaaggcaagattcgccgcccttattgcgagcgagtgacattgaatgatcttgttcctcatcaacaacgttttttgcagctagtagccatttcaatcgaccaantgctgaaaaatg

SEQ ID NO: 6081 - DNA, 417 bp, Bacillus clausii
ttaactgggcgcagcgtattcaagccttagcgcaggcgggaattacatttacaaaagacaaatacgacatggaacgctatgacgagttgttggcgataagtgccgaaatgatggcatgtgcgaaaaatcttaatgctgcgagcgtgaaggaaacgtttgtccaacaaaacggctaccagacgccgaaaattgatgtccgtggcgttgtcacaaaggacaaccatattttgctcgtgcaagaagaaacggacggcacgtgggcgctgccaggaggctattgtgaagtgggattgtcgcctgtagaaaacatcgtaaaagaaattaaagaagagtctggttatgatagtaaatacgagcgggtgcttgccctgttcgatacgaagaaacatcgtcatccgctcatatgttccattttta

SEQ ID NO: 6082 - DNA, 489 bp, Bacillus clausii
cctctttcaagtccggtctttggctttaagagctcagcctggagaaatctgcttccctggaggaaagattgagccaacggatcgtgatgcaaaagcagcggccattcgcgaatgcacggaagagttaggcattgacgaatcagacattaccgtcatcgctgcccttcctcctgtacacacgccacagcgcacattcatctttccgtttttagcagaaatttcgtcaatagaagatatttccattaacaatgcagaggttgatagctggtttaccattccagtcgcttacttactcagtcatcccccattgcaaggctatatgaatataaccgtccaaccaggcaaaggctttccgattgaaaaaatagcaaaccgagatgcttacgaaggacggatctaccaaatgccagaatacttttatgaatacaacgactatatcatttggggattgacaggccggatattaaaacagtttcttgacaggcttca

SEQ ID NO: 6083 - DNA, 567 bp, Bacillus clausii
  misc_feature (1)...(567): n = A,T,C or G
gaagagagcttttattttccaaaacatttatgaccaanccgcacaaggcaagtcatcggatatggagtttatgctcgataccggcttttacccgctttccagtggctcggcctttgtgcgccgttatgaaaatacatttcgctcccttcctcagatcttgaaagaacaagggtatacatcggccgctttccacgccaatgacgcgactttttggaaccgtgaagcgatgtatgaaacgctaggatatgacgagtttttctcaaaagacgattatgaggtaacagatgagttgagtgtcaactatgggctgaaagacaaacccttttttgcccagtcgattgaccatcttaacacgttgaaatcgccatatatggctaaatttatccctttgacgaaccatttcccgttcttgcttgaacaagaggaccagtcaattgatccagctgatacagaagtcgatgtagtcaatcgctatgtgacgaccattcgctatcaagatgaagcgattgagcagttttttgccgatctcaaaaaagaaggccattatgaagagaccatcttcttgtt

SEQ ID NO: 6084 - DNA, 417 bp, Bacillus clausii
ttcatacggcaagtgtgggaaaaacattcacttcagcgatcgttgcgaagttagttgaaaacggtctcgccaagtttgaagatccgattgctcgttacttgcctgaaagcctgatggaagggctgcacatttataaaggaaaagagtattcgtctgatattcagatcaaacatttattaagcaatacatcaggtctgcccgattttttcgaagataaacctaaacgccgtaaaccatttctacaggaaatactggatgagccgtcccgtttctggacacctgaagaaacggttcaatggtcgaaagaacatctattaccgcgctttccaccagggcaaggcttccactatacagacacaggctacaatttactcgggctgatcattgagtcgattacctcaaaccctattcaatatg

SEQ ID NO: 6085 - DNA, 545 bp, Bacillus clausii
atgaaaagaaaatggaacgtatggatgctcctgtttgttatgttgtttgcatgcactggtgaagcagcgtttgccaaagaaaaggaaatgcctcagttagctgaaaatgccgcgtccgcaatattaattgaacgggatacaggtgaagtattgtttgaaaaagatagcgacaacatgcttcccccggctagcatgacgaaaatcatgacgatgctgcttattatggaagcgattgaagaaggcacgattaagtacgaggatatggtgaccgttagcgagaatgccgcttccatgggcggatcgcaagtctttttagaacctggagaagaaatgagtgtggatgacttattaaaagccattgccattgcttctgggaatgatgcagcggtagcgatggctgaacatattggcggcacagagcaggagtttgtaaaaatgatgaatgcgaaagcggcagagcttggtttggaaaatacacagttcaaaaatccgaatggcttgcctgaagcggatcattactcttctgctcatgatttagccgttat

SEQ ID NO: 6086 - DNA, 797 bp, Bacillus clausii
  misc_feature (1)...(797): n = A,T,C or G
ttggaaaaaatcattgtccgtggcggcaacaagctgcacggctccgtgaaggtagaaggcgcaaaaaatgccgttctgcctgtcatcgcagcatcgatattagctgagcgtggtgcaagcatcattgaagaagtgccatcacttacagatgtatatacaatgaaggaagtattagcgaatttgaatgtgggagtcgaatatgaaaacggccgttttgccgttcgtgcagaccgcccactaaaaaccgaagctccgtttgaatatgtgcgcaaaatgcgtgcctctttcttagtgatgggcccgcttttggcacgtgtaggccgtgcgagaatcgcgttgccaggcggttgtgccatcggttcacgtcctatcgaacagcatcttaaagggtttgaagcgatgggagcaacggttgaaatcggaaatggctttattgaagcacgcattgatggaaaactccaagggacaaagatttatttggatttcccaagcgtgggggcaacagagaacattatgatggctgctgttttggcagagggaacaaccatcattgaaaatgtcgcagaagagccggaaattgtcgatttggccaattaccttaatgctatgggtgcaaaggttcgtggtgcagggaccggcgttattcgcattgacggcgtanacgctctccaaggagccgttcactccgttatacctgatcggattgaagcaggcacttttatggtggcagcggctattacaggaggcaatgtgtttgtcgagggagcgattgctgagcacatgcgtcccctagttgc

SEQ ID NO: 6087 - DNA, 882 bp, Bacillus clausii
atgaggtcttttttctccaataaaaagcttatcgtcttactggtgagcattatcattctagtggcgttaattggattctcgatgaatcgggatcgggatttgtcagagccggaacaaattatgcgcgatgcaatcgggtgggtgcaaaatgtctttgcccggcccgcccattttgttggcggcatctatgaaaacatccaagaaatctttgacgtctataacgaaaaccaacttttgcgggcccggcttgaagagtatacgcaaatctcggtggaacgggacctcctaaaagaagaaaatgcccgtttagtcgatatgctggggattgacgaaacgctaaacgattatgatcaaatctctgcggttgtcattaaccgttctccagacgcttgggaacaatacgttggtttaaaccgcgggcaaactgacgaagtcactgccgacatggccgtcgttgattcccgaggtggattaatcggcaaagtaagccggacgagcaagtttacatcctacgtacaactgctcagcgacaatgatccgacaaaccgggtgtcggcacaagtagtgcttgaggatgacacggctgtcggcttcattgaaggttatgatgaagaaaatgatttattgatcatgcgcaaagttgacgtggaaagcgaaattgaagaaggacaaaccgtaacaacttcaggccttggcgatgtctaccctgctggtttgttaataggagaagtcgaccatacggaagcagacgaatatggtctttctcaaaatgtatacattcgtcctacagcagatttttcggcactcgattatgtgttcatcgtccagcgtcatctaccttctatggatgaagagctgcttgaagaaggtgaggcggaatga

SEQ ID NO: 6088 - DNA, 869 bp, Bacillus clausii
atgaggtcttttttctccaataaaaagcttatcgtcttactggtgagcattatcattctagtggcgttaattggattctcgatgaatcgggatcgggatttgtcagagccggaacaaattatgcgcgatgcaatcgggtgggtgcaaaatgtctttgcccggcccgcccattttgttggcggcatctatgaaaacatccaagaaatctttgacgtctataacgaaaaccaacttttgcgggcccggcttgaagagtatacgcaaatctcggtggaacgggacctcctaaaagaagaaaatgcccgtttagtcgatatgctggggattgacgaaacgctaaacgattatgatcaaatctctgcggttgtcattaaccgttctccagacgcttgggaacaatacgttggtttaaaccgcgggcaaactgacgaagtcactgccgacatggccgtcgttgattcccgaggtggattaatcggcaaagtaagccggacgagcaagtttacatcctacgtacaactgctcagcgacaatgatccgacaaaccgggtgtcggcacaagtagtgcttgaggatgacacggctgtcggcttcattgaaggttatgatgaagaaaatgatttattgatcatgcgcaaagttgacgtggaaagcgaaattgaagaaggacaaaccgtaacaacttcaggccttggcgatgtctaccctgctggtttgttaataggagaagtcgaccatacggaagcagacgaatatggtctttctcaaaatgtatacattcgtcctacagcagatttttcggcactcgattatgtgttcatcgtccagcgtcatctaccttctatggatgaagagctgcttgaagaagg

SEQ ID NO: 6089 - DNA, 633 bp, Bacillus clausii
tgtttattgcacggatttcaaaagggcgcaccatccgcgaatttatcgcaggcgtcctgctcgtcccgacgctcatggcagtcgtttggttttgtgtgtttggcggtaccgccttaaatattgagatttccggcttgttcccccttgcggagattgctcagtctgaagtggagcttactcttttctatatgctgcaaaatctcccgttcaccacgatttcgagcattttagcagtcattgtcgtcggaatcttttttgtcacatccgccgattcagctgcgtttgtactcgggtcgatgacatcgaacggcttgcttaatccaagctttaaattaaaaatgctgtggggcgtattaattgctggcacagcgtccgtcctcctaataagtggagacggaggactagatgccttacagactgctgcgctgacagctgccctcccatttgcgttcattttagtctttatgctggtctcgatcggcattatgatcgcgagagactggcgaacggagcaacgaaaggcacgccttgcacacgatgaagcattaaaacaacgcttaaaagaagaagcgtacgaagaactgcgacaagatttaagccaagagtggcgtgatgaacttcgcaaagaactgt

SEQ ID NO: 6090 - DNA, 218 bp, Bacillus clausii
  misc_feature (1)...(218): n = A,T,C or G
acatggccgtcgttgantcccnaggtgnatnaatcggcaaantaagccggncgagcaantntacatcctacgtacaactgctcancgacaatgatccnacaaaccgggtgtcggcacaagtagtgcttgaggatgacacggctgtctgcttcattgaaggttatgangaagaaaatgattcattgatcatgcgcaaagttgacntggaaagcgaaatt

SEQ ID NO: 6091 - DNA, 1953 bp, Bacillus clausii
taataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 6092 - DNA, 576 bp, Bacillus clausii
  misc_feature (1)...(576): n = A,T,C or G
naatatggcaataactggggtgctgattattttctatactgtgcatattaacgcagggggtggaaccggattggagtcatttatacatacatcgcagacaagcggttctgttcgggcacaaaatattatccatccagcgattatgcaacaacttggagaaagggaccgaggaaagaaaaccgctaattttgcagtgttgcgtacgtcaaccatgccagcgattttaacagaaaacctgtttattgatcatgccaatgatgcggccaagcttcgggatccggcttttttgactcgtgtcgctcgtggtcatgtcaatgggttggcgcaagcgttcaatttgcagcgtaattccggtggtaacggcacgatttaccgtgtgcaagcaggtgctttttcccaacgcgcaaatgcagaagctcttcaagcacgacttcaagcggacggctatgaagccttaattatccaaagcggttccctttatcgtgtccaggttggcgctttttcagttaaagccaatgcagaagcgcttgttgctgaactaaagagccgtggatatgatgcgattgttattacggt

SEQ ID NO: 6093 - DNA, 255 bp, Bacillus clausii
gttaggtattgaaatggacccttacaggatgggaggagtcccgtccttatcaacattgcaaaaggctgttggcgctgccttcagtcttagacgcttaggacaagcacctattattattaaggaggaattgtttatggttaaaatttttattgatccaggacatggtggtaacgatccaggtgcagtaggaaatggcatgcaagagaagaacttaacactgtcaattgcgacgcaaattcgcgatatgttagtgtc

SEQ ID NO: 6094 - DNA, 360 bp, Bacillus clausii
atgtacttgaccgtgcacaaagaatgggaatggaatcttctggagaaaaagagtaacggttttcaagacgagttcaagcgagctcgtttttcttacttaggaaaggagtggtggaaagtggaaataaaacgggcggtgacaaataaacgtgccgtcacccttttgtttgtgtttcttggtttgttcactattttgcttggccgcatggcgtacattcaaattaccaaagaagtgaaaggccatgatttggtcgctatggcagaggcgaagtataaccgctctcaagtgcttgaaagcgaacgaggggcccattttagaccggcacggcagcgtacttgccgaagatgtgccagcttataa

SEQ ID NO: 6095 - DNA, 1395 bp, Bacillus clausii
atgtcagatgagtataaatcaaggcaggagcgtaaaaaagcccaaaatcgcggcaaaaatggcaaaccgccaaaaaatggtggaaagaaaaaacgaagcatatggaaaaaaatctttatcactatggcgattttaatcggcttagctattattggcggcgggattaccgttgcatctattatatctggagctcctgatattgacgaagagcgattgacactaccacaatcgttacagatttttgatatgaatgatgagcaagtttatacgctagcctctggggaaaagcggataaatgccaatattgacgaaatgcctgaccatttaaaaaatgcctttattgctgtagaagaccatcgcttctatgaccattttggagtcgacttgcggcgcctcggcggggcagttgtagccaatttccgcgaaggttttggcgctgaaggtgcatcaacgattacccagcaacttgttaaaaatttatttttgtctaatgaaaaagcattgacgaggaaaattcaagaacagtatttggccattcagcttgagcgccgttatacaaaagatgaaatcttggaaatgtacttaaaccaaatcaaccttgggccttcagctggttacggcgtgcaattagcagcggaaaagtatttcaacaaagaagacttaaacgatttgaccgttgccgatgccgccgtgcttgcagccattccacagcggccgagctactttgatccccaccgaaacccggaaaacaacgaaaagcggcgcaatgtcgtcattgaccggatggaacgggaaggctttatcacagctgcggaagcagaagaagcacgcaatacaccgattgaagagcaactggattatgttgaaggcgaggacaccgagtatttaacgttttacgatgaagtgttaaccgaactggaagaaatgagcgacttgtctacaaatgacatttacaattcaggcttaaaagtatacacaacacttgatatggatgcgcaagaacatgtcgaccatgtcatgaaatcgggagaatatgccgatctcgtcttcccagaaagcgaagacttccgtgcaggtgttacgctgcttgaaacgcaaacaggcgcaattcgcgcaatgggaaatggcattgacgaaaacgatccccgtgtagaaaactatgcgactatccgtagacagcaaggttcagcaatgaagccactgctctcttacgcacctggtattaacgatcaacaatggtcaacagctaaaatctttgttgatgaagaataccactatcaatctgaagccgaaaaagaagtccgcaactatgaccggacgcataaagggccgatgacgatgcggcaagcattggcagaatcacgaaatgtcccggctgtaaaagccatcaatgaa

SEQ ID NO: 6096 - DNA, 537 bp, Bacillus clausii
atgtatatccatgtcaatggtttaaacgagtgccctgattttttgaaaaaagaaagcaaaatcagactctcgttttccacacaaaatttaggcggacaaatggcatttaaagggtttccagaaacggaaggctactatttttgtgtagatgacgacttgatttaccctgataattatgtcgagcgcatggttgctttaatgaagagctacaacaataagattatcgcatgcgtccacggtgccagttttgatgtaaacgcccctgtcaagaaagtctttaaaaataagacgaattcccaccgttcgtaccaacgattaaaaaaacatacacaggtactcatacctggcgtcggtacatcgtgcatgcattcagactcctttgccatcacaccaaacgattttccttaccaaaacatgagggatgcctttatcgcttgtaaagcagcaaaagagggtgtccccataatcgcgattaaacggccagaaaactggattaataagattgctgggcatacagcgattaccaaaaatgaggaa

SEQ ID NO: 6097 - DNA, 492 bp, Bacillus clausii
  misc_feature (1)...(492): n = A,T,C or G
ggatgcgacgagggagtacgtatatggcgacacgttgcggcaattgtatgncagtgtcgggtcaatccaatcagaaanagtcgatgattatttggcaaacggctatgcccgctctgatcttgtcggcaacagctacttggagcttcaatatgaaaatgtgctccgtggcacaaaagcagaaatttcgcggacatcgacacggactggcggcgaggaagcggaaagcgtcgncgaagaaacacttggnngccgtggcaatgacttagnnttaagcgtcgatatggagtaccancaactgctngatgaagcggtagaaaaacatgtcatgaaaaaccgcggctactacttgcagcagcaagaaggcagcgcctatgcaattgtgatgaatccaaaaacaggtgaaatattagcgattagcggttttgtcgatcctgccggagaagatgaaagctatgtgcacccaacaggagctgtgaacaatgcgtttgagct

SEQ ID NO: 6098 - DNA, 234 bp, Bacillus clausii
aagtatgcaagcctttatggacgttattaccagaaggaacgattcatgaaaatgagcgattatgcaaacatacgtatacgcaaatgggcggcgcagccgatttgtttattacgccccaatcgtatgaggaaacgcaaaccgttttgaaatttgcccatgaacatcgggtgcctgttacgttgctcggcaatgggtcgaatgtcattgtaaaagacgggggcattcgtggaattc

SEQ ID NO: 6099 - DNA, 233 bp, Bacillus clausii
atgaatattgggatctttaccgacacctattttccgcaaattagcggggtggcttcgtctattgcaacacttgaaaaagaattgagcgcccggggtcatcgcgtttacatttttacgtcaacggataaagcggcagatccaggacaggaggaggggaaggtttttcggttttcaagccttgctgttggatttgttcccgagcgacgcttagcttatgctgggatacgcagagc

SEQ ID NO: 6100 - DNA, 582 bp, Bacillus clausii
gctatattggcagccacacttgcgttgaacttttaacggaaggctatgatgttatcattgttgataatttttccaacagcggtcctgatacggttgaccgcattgaagaaatcaccaacaaaaaagtaaagtcttatgacattaatttgcttgattcctcttgtttagaaacggttttcgctgaaaataacattgacgcggtgatccattttgccggtttaaaagctgtcggcgaatcggtcgaaaaaccactttactattatgaaacgaacatcggcagcacgattcaattatgcaaaacgatggaaaaatatggtgtatacaaactcgttttcagttcatcagccaccgtgtacggattgcctgaacaagttccaattgaggaaaacgcgccgttaaaagcagtcaacccttacggcaatacaaaaatcattattgaggacatgctccgtgatttagcgacttctaatagcaactggcgcatttcgctgctacgctattttaacccaatcggcgcccataaaagcggcctgattggcgaagagccaagcgggatcccaaataatttgatgccttatatta

SEQ ID NO: 6101 - DNA, 421 bp, Bacillus clausii
  misc_feature (1)...(421): n = A,T,C or G
atgagcggacgatttncggttattttagcagcagggcaagggacgcgtatgaagtcaaagctttataaagtactgcaccctgtctgtggcaaaccgatggttgaacatgtagtcgatcaagtttccaaattggaatttgatacaacagcggttattgtggggcatggagcagaggaagtaaaaaaaacgctaactgaaaaaattgaatttgtgatgcaaccagaacagcttggtacaggccatgctgttaaatgtgctgagcatctattggcaagccaaaaaggcacaacggttgtgctgtgcggtgacacccctttgattactgccgccacaattaaaaaattaatggatacccatgaagcaaacggagccaaagcaactgtgttgacagctcacgctccagatcctactggctatggcc

SEQ ID NO: 6102 - DNA, 348 bp, Bacillus clausii
tgaaatcgtttggccttaccgctaatgcagcaacactcatctcctgcccaacgtgcgggcggatagagattgatttgattagcatcgccaacgaagtggaagtatacattgcaaaaattaaagcaccgataaaagtcgctgttctcggttgcactgtaaatggcccaggcgaagcccgagaagcagatatcggtattgccggagcacggggcgaaggacttttgttcatgaaaggcgagattgtccgtaaagtcccacaagaaacaatggtggaagagctaaagaaagacatcgataaatcttgcagaagagcattatgcaaaacaacgcgaagctcagccgaactaa

SEQ ID NO: 6103 - DNA, 528 bp, Bacillus clausii
gcatgacactaagagagttaagcgatgcttcgattcgccatagcgataacactgctgcaaacttaatttttgatgaaattggcgggccagagggctttaaagaaggacttcgagcaatgggagacacggtaaccgaacctgaacgaatcgaacctgagctcaataatgttgaacctggagagatccaagatacgagtacaccagaggcgttggccaaaagcttgcaagaatttactttaggagaggcgctgccagctgacaaacaggaactgttaatcgattggctaataggaaacacgactggagatgctttaatacgtgctggggtgccggaaggttgggaagttggtgacaaaacaggagcaggttcctatgggactcgaaatgatattgccattctttggccacctgaaaaagagccaattattttagccatcctatctagcaaagacgaaaaggatgccgaatatgatgatgaactgatcgcgaaagcgacagaagaagtgatcaatctcctcacccaaacag

SEQ ID NO: 6104 - DNA, 792 bp, Bacillus clausii
  misc_feature (1)...(792): n = A,T,C or G
ccagttgaagggcgatgatgtggtaaggcttanccgcataccaggagagcggggcgatctttatgatgttcatgggcaggcgctagccactaatggcgaagtgctcgaaatgggtgttcaaccaagcttgcttgaagggcaagatgatgctgtggccatcttagccaatgagttagggataacggaagactacattgatgaacagttgagtcaaggctgggtgacgccagaagcgtttgtgccgcttaagcaattgcctgctagtgaaagtcgcctagcagattcgattacagagcaagtatctgccgcctcctacaggcgcttgaacggtcgggtttacccattcggtgaagcagcagcccatttgaccggatacatcgggccgattacggcggaagaattagaaaagcgcagcagcgaaggatactcttcttcttcaaacattggtttagccgggttggaattggtgctcgaagaccgtttgcgcgcaaaagacgggatagaaatttatacagcaagtgcagagggtgagcggaaggaaaccattatcgagtctgaaagcgaggatggcgaggatatccacttaacgattgatatggacgttcaagaagcgatttttaacgaatttgctggaaaatcaggtacaagtgtggcgctagatcctctcacaggggaaacgttggcgttggttagttcgccagcttacgatccgaatttagcagcacttggtttttccagcgaggagcgcaaaaaaatcgaggaaaatgaagaaatgccgctgttgaaccgttt

SEQ ID NO: 6105 - DNA, 261 bp, Bacillus clausii
aagcgaaaagtttgggcggtgcagtcgctgcagtgacactatctccagaatctacgattggaaaacttgcagatttaaaggtgatcctaccaggagcaccaaaggatcgagaagaagacagccaatacgaaaccattcaaccaatgggctcactttttgaacaaacctctcttcttttctatgatgcagtgattttgcgttttatggagaaacgagagctgaactcaaagcaaatgtatggcaagcacgccaatctagaat

SEQ ID NO: 6106 - DNA, 861 bp, Bacillus clausii
aaaaacaatcgttcactgtttattgctcgggttcttgttttttttccagagcagcgaggcgcttgcgaatgaacctgcaacatttcctgtttctggacaggccgctattttgatggaacagtcttctggccgtgttctgtatagcaaaaatgaacatcagcctctgaaaatcgccagcattacgaagattatgacggccatcttagcgattgaatcaggcaagctagacgagacagtaaccgtgtccaaacgtgctgagggaacagaaggttcctccctgtatttagtggttggtgaaaaattaacgctacgcgacttggtgtatggggttatggtacggagtggcaacgacgcagctatagcaattgctgaacatgttggcggcagtgtcgaaggctttgttttcttaatgaacgaaaaggcagaggaaattggcatgtctaatacgctatttcgtaatccgcacgggctagatacagatgaagaccacttgtcgagtgcgtacgacatggcgcttttaacccaatatgcgatggaaaacgaagaataccgagagatttcatcgacgaaagactaccgttcaaaaggcgataaagtccgtgtgttccataataaaaaccgcctccttaccgagaagtacagttactcaactggcgggaaaacaggttatacgaaattagcaaaacgaacgcttgtgtctaccgcttccaaagacgggcttgatttaattgccgtcacgttaaatgcccctgatgactgggacgaccatatgcatatgtttaactggggctttgaccattacagccttgaacggcttgtgtcaaaagggcagcttaaaagcaaagtcgatccattttacga

SEQ ID NO: 6107 - DNA, 363 bp, Bacillus clausii
  misc_feature (1)...(363): n = A,T,C or G
gttgtttactgaaaaacaccaaaaatggctgacgcttttctttggaacagaattagcagtcgtggaagatgaagagtatgtcatccatgtcgacacgcctcttggtacagggatcgttaaacggactgatatagaagaagggccgagggaacggacaggggaggcattgntaaaaagcgctcgccagtttattggccttccctatctatggggaggaatgagtgggtttggttttgactgctccgggtttgtttatgcgatccatcgngccagcggcattcttattcctagagatgcctccaatcaagtcttgaccggggaaatcattgatgcaagccggccagctatcggcgatttgctcta

SEQ ID NO: 6108 - DNA, 474 bp, Bacillus clausii
atgggcgaagaatttttctcctcgttattagcggaacaaaaaatcgtcttatcgtccactcagcacgagcagttcaagcgctattttgaactgctcgttgagtggaacgaaaagatgaatttgactgctattaccgaaaaaaaggatgtatacttaaaacatttttatgattcaatcacgccgagtttttactacccgtttactgaccaaaaaattgttgatatcggcgctggggctggatttccaagtttgccgcttaaaatcctttatcccgacttgcaaatctcaattattgattctttaaataagcggattggttttttaacccatttggctaatgaacttgaattaacgggcgtttccttttaccatgaccgggcagaattggccggaaaaagcaagcttcaccgggaagtttatgatgttgcaattgccagggcagtcgcacgtatgtccgttttaagtgaactatgt

SEQ ID NO: 6109 - DNA, 438 bp, Bacillus clausii
  misc_feature (1)...(438): n = A,T,C or G
aaaccgcccagaaaatgcagagcttgcccgctctgagcggatctcggtaactgtatttgagcaggaatggctagaagaggctacacggtttctggcaaaaacncgaaacgatccnctccgtatccatgtcaaaatggacacgggcatgggccgcctaggccaacaaacggttgaaaagacgatcgccgttgtctgtgctgcgcaaaaaataggtgttgttgaagggctgtttacccattttgccactgccgacgagctcgatcatacgtattaccgaaaacagcaagaacggtttgcagcatgtgttgacaaattggaagaagcaagagtttcgattccgttcattcacactggcaatagcgcagcgagcatgcgctatccaggcgatatgtacaatatggtgcgtttcggcatttccatgtatggacttnccccttc

SEQ ID NO: 6110 - DNA, 261 bp, Bacillus clausii; identical to SEQ ID NO: 6105

SEQ ID NO: 6111 - DNA, 783 bp, Bacillus clausii
  misc_feature (1)...(783): n = A,T,C or G
cataaagatcatgacgacgctccacgggacagatattaccgtactagggtttgagccgtctttgcggccgcttattcgctatgggattgaacagtccgatattgtcacagctgtgtcctatgatctggcccggcaaacaaacgagctagtacgtactgataagccgattcagaccgtttataattttattgacgaacaagtgtattatccaaaacaagtggagcaattgcgggcgtgttacggcctttcggaaacggaagatatcattatccatatttcgaatttcaggccagttaaacggattatggacgtgttgaaaacatttcaactcattggtaaaagcagagatgcgaaattgcttttaatcggcaatgggccagagttgccaattgcgaggcagtttgtggaagaaaacggcttggcaaacgatgtccttatgctaggcaaccaaaagcatgttgctgaattggtggctatgagcgatttaatgctggtggtaagcgaaaaagaaagctttggtttagtggcgcttgaagcgatggcatgcggggtacctgtgatcgcgacaaaaattggtggcatcccggaagttgttgaagacgaagtaactggttatttatgcccccttgggaacattgaggaggcagctgcaaaagcgatttccttattggcggatgataaaaagcgccaagcctttaaacgagcggcgcttaaacgagtaaagcagtcgtttgattcgcaacacatcgttagccaatannagcgtttatatgaagccatgct

SEQ ID NO: 6112 - DNA, 540 bp, Bacillus clausii
cggtcctttacccaaatacgtccataaaagggcggtctgttattggggaagactgtgtgattgaatcaggtacagaaatcgcttctgcaacgcttggcagaggcgttcacgtgtgcagttcggtaataagcgacagcgtggtggctgacggctcatcgattggcccatttgcccatatccgccctggttcggatgttggagaaaatgtgcgtgttggcaattttgtcgaactaaaaaaggcaagcgtcggcactggaagcaaagtttcgcaccttacttatgtaggcgatgcggaagtaggcagcgatgtcaacgtcggctgcggcgtcgtgacagtcaattatgatggcaaaaataaacataagacgattattaaagacggcgcttttgtcggttcaggctcaaatttaattgcgcctgtggagattggcgagcgtgcatttgttgcagccggctcaacgatcaccgatgatgttccgagccaagcgctatcgattgcaaggtcgaggcaagtaaataaggacaattacgtgaaaaaag

SEQ ID NO: 6113 - DNA, 693 bp, Bacillus clausii
atgtccgtagcggaccgagcacgagccacgaagttgtcggatggctgacaccgggcgaacaagtagagtataccgacaacggcgatggctggggcgaactagtcgacggcagtggctatatcagccttcattatattacaaatcatgatggagaacctgtcgaccggagcagcgccaaacatgacagtgtcccgccaaacaatgaacggattgtgttggaccctgggcacggggggaaagatagcggagctgtagcgaacggtttaatggaaaaagaaattgtattagatatcggcaaacgaacgcgtgacattttagaaaatgctggttttaccgtattgatgacacgagacgaagatgtatttgtcagcttagaagagagaacagcaatggcaaacgattggggggctgaccagtttattagcatacatgcaaatgggttctctgacccagctgcaaatggtgtcgaaacttattatttcccgggaagtgcagcaggcaagcatatggccgctaatgtccaaaatcaattagttgaaaacacagatcgaaccgaccgaggcatttttgaggaagccttttatgtcatttaccatacggctatgccggcgattcttgtagagacaggatttgtgtcgaatgcccgacgacgcgagccaacttgggagacgcccaattatcgacaaacagtgg

SEQ ID NO: 6114 - DNA, 570 bp, Bacillus clausii
  misc_feature (1)...(570): n = A,T,C or G
tcgaagaagaaacggatttgcagaccgagttaattacgaaactaggctcttctgtcatccagcatcaagcgcttgtacaaggtgacttggacattacagctgctcgctatacaggtacagacttgtctgcggcacttggcatggaacctgttaccgaccgagacgaagcaatggacatcgtgaaacgagaattttccgagcgctttgaccaaacttggtttgattcgtatggttttgaaaatacgtacgccctttctgttaccgaagcatttgcggatgagcatggaattgaaacgatttcagacttggaagcttttgcaccggaactccgttttggcgtcgataattcgtgggtgaatcgcaaaggcgatggctaccaaggttttcaagaaagctattttgcttttggcaacgtgtttccgatgaatgtcggcctcgtatatgaaagcccacgctagcggggcattatggatgttngattggcttacttttcggatgggcgtatttaaggagtncaatttaaaagtgccttgnaagatgaccagcggtttttnccggcttacgatgccc

SEQ ID NO: 6115 - DNA, 528 bp, Bacillus clausii
cggctatattggcagccacacttgcgttgaacttttaacggaaggctatgatgttatcattgttgataatttttccaacagcggtcctgatacggttgaccgcattgaagaaatcaccaacaaaaaagtaaagtcttatgacattaatttgcttgattcctcttgtttagaaacggttttcgctgaaaataacattgacgcggtgatccattttgccggtttaaaagctgtcggcgaatcggtcgaaaaaccactttactattatgaaacgaacatcggcagcacgattcaattatgcaaaacgatggaaaaatatggtgtatacaaactcgttttcagttcatcagccaccgtgtacggattgcctgaacaagttccaattgaggaaaacgcgccgttaaaagcagtcaacccttacggcaatacaaaaatcattattgaggacatgctccgtgatttagcgacttctaatagcaactggcgcatttcgctgctacgctattttaacccaatcggcgcccataaaag

SEQ ID NO: 6116 - DNA, 633 bp, Bacillus clausii
  misc_feature (1)...(633): n = A,T,C or G
cgactttttggacgagcagatctttcaactgcttgggatgacgcgaacgcaagtgtataatcggcgggtggatccaagtgctgtgcctgatgattatgcttggggatacgtctatcggattggacatggcggttacgtcctgcctgatgaagtgcctgaccnganttncntccantattnaaatggntngcaaggggatgggatggttaacagtccagttggcnatttgttgcgactggatcgagccttgtatgatgacaagttcattagtccaatgctgcgtcaactgatgttttcgccagtgacgatggataatggcgagacatttccctatgggatgggatggttgaacgagtatgacgatcggctgggaagcatcgtccaccattccggaggatggccgggatactccacatggttcaaacgctatatcgatcgtgatatcacactaatcatgttgcaaaatggagagcgcgatcatgcttacacgcaacagttggtgaagagcatcgaacagattatggctggagaagcttacgatgtaccaaggccttttgagactaagaaaatcatttcgcttgaaccgaagaaaattgaagcgcagcttgggaagtacagatttgccaacgatac

SEQ ID NO: 6117 - DNA, 519 bp, Bacillus clausii
aaacaatgaacaagacattattggtaaaaagtgcaataagtttaggcgtcatcttcgtcctcggcgcatgtggaagtggaggtgaaggcggaaacgctggagactcaaaagaaattcggtttggagctaccgccggcccgtacagcgatatgattacaaaagccattattcctggtttagaggagaaaggctacactgtaacggtcaatgaatatcacgactacatcattccaaaccgtgaactcgctgaaggcaaagatgacgcgaatttatttcagcaccaagtttatctagatgattttgccgagaataatgacttagagttgtctagtttgatttctgtcccgacagcgccaatgggcatttattcggaggaatatgattcgctcgatgaaattgaagatggtgccgagatcgctattcctaatgatccaacgaatggtgctcgagcgttcttgatgcttgaggaggaagggctgatttcatttgaagatggaatagacccgctgactgtctctg

SEQ ID NO: 6118 - DNA, 783 bp, Bacillus clausii
  misc_feature (1)...(783): n = A,T,C or G
taaagatcatgacgacgctccacgggacagatattaccgtactagggtttgagccgtctttgcggccgcttattcgctatgggattgaacagtccgatattgtcacagctgtgtcctatgatctggcccggcaaacaaacgagctagtacgtactgataagccgattcagaccgtttataattttattgacgaacaagtgtattatccaaaacaagtggagcaattgcgggcgtgttacggcctttcggaaacggaagatatcattatccatatttcgaatttcaggccagttaaacggattatggacgtgttgaaaacatttcaactcattggtaaaagcagagatgcgaaattgcttttaatcggcaatgggccagagttgccaattgcgaggcagtttgtggaagaaaacggcttgacaaacgatgtccttatgctaggcaaccaaaagcatgttgctgaattgttgtctatgagcgatttaatgctgttgttaagcgaaaaagaaagctttggtttagtggcgcttgaagcgatggcatgcggggtacctgtgatcgcgacaaaaattggtggcatcccggaagttgttgaagacgaagtaactggttatttatgcccccttgggaacattgaggaggcagctgcaaaagcgatttccttattggcggatgataaaaagcgccaagcctttaaacgagcggcgcttaaacgagtaaagcagtcgtttgattcgcaacacatcgttagccaatannagcgtttatatgaagccatgctta

SEQ ID NO: 6119 - DNA, 525 bp, Bacillus clausii
cagggggtggaaccggattttagtcatttcttcatacatcgcagacaagcggtcctgttcgggcacaaaatattatccatccagcgattatgcaacaacttggagaaagggaccgaggaaagaaaaccgctaattttgcagtgttgcgtacgtcaaccatgccagcgattttaacagaaaacctgtttattgatcatgccaatgatgcggccaagcttcgggatccggcttttttgactcgtgtcgctcgtggtcatgtcaatgggttggcgcaagcgttcaatttgcagcgtaattccggtggtaacggcacgatttaccgtgtgcaagcaggtgctttttcccaacgcgcaaatgcagaagctcttcaagcacgacttcaagcggacggctatgaagccttaattatccaaagcggttccctttatcgtgtccaggttggcgctttttcagttaaagccaatgcagaagcgcttgttgctgaactaaagagccgtggatatgatgcgattgttattacggtct

SEQ ID NO: 6120 - DNA, 1221 bp, Bacillus clausii
gtaaagtgattccaattgaacaagtccctgaacttgttcaacaagcatttgtcgcaatggaagattcccgcttttatgaacaccagggcattgattttaaagcgattggccgtgccctttaccgtgatattctagcaggtgccaaagtagaggggggcagcacccttacacagcaacttgctaaaaatttgtttctctccaacgaaaaagcatggctacggaaaacaaatgaagtgcttatcgcgatgaatttagagcggcgttacagcaaaagcgagatattggaaaagtacttaaatcaagtttattttggccacggcgcttatgggattgaagcagctgcccatttgtattttaacaagccagcttcagaattaaccatttatgaaggagcctcccttgtagctgtcgtgaatgcaccaagcgcattttcgccaattgatgaaccggagcgcaacaaagagagacgtgatttagtgctaaaggtgatggcgcaacaagggtatttaagcactgaggaagctgaggaagcgcagagccaaccgctggaaaccgacagacaagagcaaacggtggatgagtcgttgtatacgtacattgatatggtcatggatgaagcgagtgagcgattcaacattagccacgaagagctgctaactggcgggtaccggattgtggttccaatgaatttggagttgcaaaagaaaacatatgaggcgctgcaaaacgatcgtttcttcccagaagaaaacaaagacgcccaaagcgctatgatgtctatggactcagaaacaggcggcattctcgctgtccaagggggccgtgattatgtgcggcgcggcttaaaccgcgtgaatgtaaagcgggcgcctgcttcaacatttaagccgttagcggtgtttgctccggcattagaaagtggcatatatcagccttattcgttgctgcgcgatgaattgcttcagtacgatgacggctatacacctaaaaatgtaaatggcgaatatagtggcgaaatgacgatgtatgaagcactgaccacatcctccaacgctccagcagtatggcttttaaatgaaatcggcattcaggagtctgtgtcaacgctcaaaaagttcggctttcacttgcctgataggcagctctccttggcactcggaggcttgcgagaaggggtaactccttatgagatggtacgtgcttaccgagcatttgcccatg

SEQ ID NO: 6121 - DNA, 453 bp, Bacillus clausii
atggggtatgaccaaacaaacgaaagccaatacttcgccgggggaagtggctatccgacacggttgttcaaagaaatggtcaactcctttcctgcttcattgcaggcaacggcgttcgaacagcctgaaggtactgctgatttagcttctccgctagcaatggaaaagattgaaggtttcacggcccaatacactattggcggcaaaggtttaataactgttcagttaaaatgggacgcggttgaagatgagcgtattgcctttaatgtgtatgaagtcgacggtgattccaagaaacaagttgcttccaaattaacagaacctcattttacgattggaaaaatgaatccattctctttgccgaaataccaagtggtcacctatgacctacaaacggataccgaaggggctgcttctgaagcgctcgaaccttcgttttcattttcattctaa

SEQ ID NO: 6122 - DNA, 447 bp, Bacillus clausii
tcctatggactcagaaaacaggcggcattctcgctgtccaagggggccgtgattatgtgcggcgcggcttaaaccgcgtgaatgtaaagcgggcgcctgcttcaacatttaagccgttagcggtgtttgctccggcattagaaagtggcatatatcagccttattcgttgctgcgcgatgaattgcttcagtacgatgacggctatacacctaaaaatgtaaatggcgaatatagtggcgaaatgacgatgtatgaagcactgaccacatcctccaacgctccagcagtatggcttttaaatgaaatcggcattcaggagtctgtgtcaacgctcaaaaagttcggctttcacttgcctgataggcagctctccttggcactcggaggcttgcgagaaggggtaactccttatgagatggtacgtgcttaccgagcatttgcccatg

SEQ ID NO: 6123 - DNA, 1155 bp, Bacillus clausii
tcggtggagctgaggtctctacgaaagaaatggccggcgcctatgctgcatttggaaacattggcgaataccatgaaccgtatacgattcgcaaaatcgtgtttccagacggccgagaactcaatacagagcctgaaccaacgcaagtgatggaagactacacaggctacatgattactgatatgttaaaaacggtcgtcactgccggcacaggcacagaagcacaaattcctggcgtgccgattgccggaaaaacaggaacgacgaactatacagatgatacgaggcagaaatacaatatcccttctgggggattcccggcttcttcctttacaggctatagcaccaattatactgcctctgtttggatcggcttttctcaaaatggagaaggcaactatttgtcgagcaaccatagcaaaacagcacaaagaatgtttaaacacattatgacggaagtccatcaaggcttagatacacctgattttgtgaagccagactcggttgtggagatgcgtgttgaacggagcactggcaagctgccaagcgcagggacgccaagcagtgaaattgtcacagagctgtttgtcaaaggcactggtcctacacaagtgtcccaggaatttgctagtatttctgacccaaccaacgtcagctactcgtataacgaagaatcaaacagtgtgacgttctcttggtcttaccctggagatgaaatcgataacgtccagttctccacttctgttagcagcggctccctaaatgttgacgaaggtagcatgaaagctgtcttaacgggtgtcacaccaggtgaatcttatacctttacagtccgagcccaggcaacggacggaacaggcctacgaagtgcggctgtttcggtaacagcaacgattccaggtgggaccgaagaagaagaggaagaagaaccagaagaagaagaggaagagccagtagaagaggcagaagagccaaacgatggcgaggaaacaccgcctgatgaagatgaaggcaacgatgatgaaaacaacaatgatgagaacgatggttcagactcagattcagattcagattcagactcagattcagatgcagattcagatacggacccagcagatggtggcaatgacaataatgctggcaacggagacggaa

SEQ ID NO: 6124 - DNA, 390 bp, Bacillus clausii
  misc_feature (1)...(390): n = A,T,C or G
cctttcacaaggcgacagtggcgagcaagtcgaacaattgcnantacttttgacagacaatggggtttttgataaagaagacatagacggaacatttggaaactccacganttcagcgattaaagaattccaagcatctgaggatttgcttgttgatggcatcgctggattgcaaacactaggtgccttgcacgcccttgaacatggcgatgaaggcaaattagttgaagaactgcaagagcaattaataaacttnaattattataaaggcgaagtggatgggctattcggttccttaacggaacgggcagtgaaaagctttcagtgtgacaacggtattgaagtagacggtattgctggcccggctacatacagcaagctctattacaa

SEQ ID NO: 6125 - DNA, 420 bp, Bacillus clausii
atatgatgcgtgatgttatgtacagcgcaaatggcaccggccgcacggcagccaacaagttgcagtttcaagctgactgggctggaaaaacaggcacgaccaacagagactatgattcatggtttattgccgtcaaccctgaggtgacattaggcgtatggaatggttatagcggtgacaaaacgattagtttacgcaaacgcgtcggcgggctcggtacaggggggcggacacagtccatttgggcgaaccttgccaacgctgcttatggcgttgaccccgagctgatgacagcaggaggcaaacgctttgagcagcctgacggcattgtcgaaaaacgagtctgtggcttaacaggcggcccaccaacaaaagcatgcgaagaacaaggcttagtcactaccgatctatacagaagcg

SEQ ID NO: 6126 - DNA, 273 bp, Bacillus clausii
  misc_feature (1)...(273): n = A,T,C or G
atgaacaccactgagtatcttaaggcgattattcaggagctccatggaacggtgcaagccatctctgagacggaggctgaccagctagtcgaagccatttttaaagcgaaaaaagtctttgtaacgggggctggtcgttctggctttatgggcaaatcgtttggcatgcgcatgatgcatatgggcattgatgcttatgcagtcngggagacagtgacagcgaatcttgaanaanggtgacctctgatagttgggaccggctcaggagaaacg

SEQ ID NO: 6127 - DNA, 1140 bp, Bacillus clausii
gaaaaatccgcagtgaagtggaccgcgaaattgtctcccttgatgacgtggccgatgaagtaaaatgggcgatcattgctacagaagacgaacatttttacgagcataatggcatcgtcccaaaagcgttgctgcgggcaacgatgcaagagctgacaagttcgtctgtgcaaacgggtggcagcacattgacacaacaactaataaagcaacaaattttatccgatgaagtatcgttcgaccgcaaagcgacggaaattatgctcgcgcttaggctcgaacagtttatgacaaaagaggaaatattggaagcctacttaaacgtcgttccgtttggccggaatgcctcaggccgaaatgttgctggcattgaagcggcagcacaaggggtttttggtgtttcagcaagcgatttaaacttgccgcaagcagcttacttagctggcttgccacaaagcccgtatggctacacgccttttacaaacgaccaacagcttaaagataaagacggtttgcagcctgggtttaaccgttaccaaacagttttaaaccgcatgttacgaaaaagagtacatcacaaaagagcaataccgaaggatgcattagactacgaccttactgctgattttacaacaaccgcgcctgacccaatggaagaacggccgcggcttactgaagaaattatgaaccgggcaacggcagtgctcgtacaacaaaaaatcgataaccgcgatggttgggagaaattaagcgacgctgctaaacaagtcgaacgcaatcagtttaaagctgaagtcgaaaacgcgattattaatggtggttacaacattattacgaccattgataaagatttgtatgatgcaatgaacgaggcagctcaacaatctggcgcttattttggtgccgacaaacaagggcaacgggaagaagtcggctctgttttaatcgaaaataaaactggaaagatccttagctttgtcggtggtcgtgaagaaaacttagatcatttgtataaccacgctacacgtgcttatcgccaagcaggctcgacgagcaaacctgttcttgcttatgcaggcgcgattgaagcaggggtaacccacccagggcttgtcattcctgatgaacaagcgttttaca

SEQ ID NO: 6128 - DNA, 348 bp, Bacillus clausii
agaaacgagtaggcattatttttggagggaaatctgctgagcatgaagtttcacttcaatcagcaaaaaatattgttgaggcgattgataaagatcgttttgacgtgacattgattggcattgacaaaaaaggccaatggcatataaatgaagcgtctaattttttacttaacgcagataatccagctttaattgaactaaataaatcgaatcaaggcgtagcccttattcctgggaaggaagacaggcaactggtgggcacggcaaaccagtcggttctagaccagctagatgtcgtgtttccaattgtacatggcacacttggagaagatggatcgctcaagggat

SEQ ID NO: 6129 - DNA, 300 bp, Bacillus clausii
  misc_feature (1)...(300): n = A,T,C or G
atgtttngtnttgccnatttgccgtttgtcgggtcaaatgtgcttggctcggcagtgagcatggataaagacattgcgaagcggctgcttcaaggggctggcctccacgttgcaagtgggatgacatttacccgtgctgctaagaaaacgattgattttgagagcatngctgatcaattagggctgcctctatttataaagcctgccaaccaaggttcttctgtcggtgtnaacaaagcnacaactgaagcggaatttacggctgctattgaggaagcattctcgtatgaccataaagtg

SEQ ID NO: 6130 - DNA, 248 bp, Bacillus clausii
gtggaaaaattgcgaattggcattagctgttacccgacagttggaggatccggcgtagtggcgacagaactaggaaaacaactagcatctcgggggcatgaagtccattttattacgacggaaatccccttccgccttgatgataaagttaacccaaacattttttttcatcaagttgaagtcaaccaatacgctgtatttaaacacccgccccatgacttgagtgcagccagcaagatagctgaagt

SEQ ID NO: 6131 - DNA, 672 bp, Bacillus clausii
  misc_feature (1)...(672): n = A,T,C or G
ttcccttgctttaggggcacagcctgtcaccgtccttgatatcgccaatgcttacgccgctttagccgacggaggaaaacgacgggaaccggtgtttatacgccaagtgcgtgacggcgagggaaataaagtctacgaacaaaaaccgcctgtccgccaagtcctccgtgaagatactgcctttgtgctaaccgatatgttgcgcggcgtatttgaaccggcgctaaacagctatacatcggttactggtgcaagcgtggcctcacagcttacgcacccgacagccggaaaatctggatcaacgcctcgggacagctggatggttggctatacaccacagctcgttactgctgtgtgggttggttttgataaagacaaagacatcaatcaatcggttgaagggcaaatctcaaagcggatttgggctgactttatggaaacagcgatggccaatgaactaaagcttccatttaaagaaccgccaggggttgaagccgttgacatcgacccccacactgggttgttaacgagcgacgcctgtcctaatggccgcacgacttactttttagcaggaaccgctcctatgaatacttgcgctgaaccagaggcagccgaagacttacaagaagaaccagaaacgaaaganccaggcttttttaaacggttttttaa

SEQ ID NO: 6132 - DNA, 436 bp, Bacillus clausii
  misc_feature (1)...(436): n = A,T,C or G
atgaacaagccgttgctttctgttatcgtcccttcatttaatgaagaggaaaatgttgaaccgttttactttgctttaagggaaacgcttaaggatacccactaccgctgggaagtcatctatatagacgatggcagttccgatggcacgctgccgttgctccagcgtttatctacatggcatccacaagtacattatgtgtcatttacacggaattttggcaaggaagctgctatcgtcgcaggattccagcatgccaagggagactgcgtcgttgtcattgatgctgatttgcaacatcctgtccatttgatcaaagacctgttagaangatttgaagaagggtntgatcaagtgattgcttgccgcgaccgaaaaggagaaggatttttccgcagcacagcctcaaagctgtattacaagttcatcaataaaa

SEQ ID NO: 6133 - DNA, 951 bp, Bacillus clausii
  misc_feature (1)...(951): n = A,T,C or G
agcgcnattggcgcaaatcctgcatgatttaaatgagaatgtacaaggatcggacattgaagaaacgatttttacccagaagccgttagaacaaaagggcattacgttattgcctttttcccgagacaatattaaaaacgggcaacatgttattgtatctgntgcttatggcgaaacacacgaggaaattaaacgggcgcgtgagctcggtttgcaagtggatgtctatccagaatttataggctcctttattaaacagtttacaagcattgctgtttcaggctcacatggaaaaacgtcgacaacagggttgctcgctcatgtgttagggtctgttgagccaacctcttatttgattggcgatgggacagggaaaggtgcggccaattcaacgtatttcgtatttgaagcgtgtgagtaccgncgccatttcttaaattactcgcctgattattgcgtaatgaccaatattgattttgaccatcccgattatttcaagagcgtagaagatgtcgtttctgctttccaaacgatggcgaagcaagtcaataaagcgattattgcttgcggcgacgatgaacatttgcaaacattgcaggcgaatgtgccaattgtttattacggccttggcgaccacaatgattttcaagcgaaatcgattaaaaacacgccagaagggacggcttttgatgcttgggttagaggcgatctgtttgggtcgtttgtaatccctggctttggcgaccacaatgtcaaaaacgctttgtctgtcattgccttatgccactatgaaggcattggctatgaagacattgttgaacacttaaaaacatttgctggcgtcaaacggcgttttagtgaaaagcgttcaggcaagcaaatattaattgatgactatgctcaccattcaactgaaattgcagcaacgattgaggcgacgaaaaagaaata

SEQ ID NO: 6134 - DNA, 441 bp, Bacillus clausii
taggggatgagtatttctttatgatccgcactcattattttatagcggacaagttggatttctccggggtcgaggattttgtctataatgcttcacaatacgatgatgtgaccgagctttatttgttggcggatgttctaattactgactattcgtctgtcttctttgattatgcaaacttaaaacgaccgatcttgttctttacttacgaccttgagaagtaccgagatacgttgagaggtttctacattgaccttgaatcagacgtgcctggcccattattgaagacaaccgatgaaattattgctgcattagcaaacttgaacgaaaccaaggagctttatagggacagaatagaaaaattctatgatgaatattgtcacttggatgatggccgtgcctctgaaaaaattgctgaaaaagtgattgtttctgcaaaat

SEQ ID NO: 6135 - DNA, 407 bp, Bacillus clausii
  misc_feature (1)...(407): n = A,T,C or G
agggactctcgttaggagcggggtcagaccgagtaacattgcctaaaaatggagcanatatttatacaacgttagacacgtcgattcaggctgcaatggagcaggcaatgtcgcaagtcgaggcagaatacgagcctgaaaaaatgactgcgattgctgctgatccccggacaggggaaattttggcgatgtcaaatcggccgagcnttaagccgaattgataccgcaatattgtaaaattacttaaacttggctgttcaggacgtagttgaaaccaggatcaacgatgaaaaatgtttacgatcgccgcagcgatagaggaaggggagtttgaggacgacagtaaataccagtcagggcggtacgaagttgacgccaattctccccctattaatgacgtaaaccgt

SEQ ID NO: 6136 - DNA, 282 bp, Bacillus clausii
  misc_feature (1)...(282): n = A,T,C or G
tttgccgtttgtcgggtcaaatgtgcttggctcggcagtgagcatggataaagacattgcgaagcggctgcttcaaggggctggcctccacgttgcaagtgggatgacatttacccgtgctgctaagaaaacgattgattttgagagcatngctgatcaattagggctgcctctatttataaagcctgccaaccaaggttcttctgtcggtgtnaacaaagcnacaactgaagcggaatttacggctgctattgaggaagcattctcgtatgaccataaagt

SEQ ID NO: 6137 - DNA, 485 bp, Bacillus clausii
gtgcgcgtatcaaatgtgactgtcagaaagcggctgctactcgccttttttatcggtttagctgtgtttgcgatcattgctgtccgcttaggctatgtccagttcggacaaggcgtctggctgactgaacaggcagaagattcgtgggggagaaacattccgtttgaaccaaaacgaggcgatattaccgatcgaaacggcgtagagttagccaccaatattagcgccccgtctgtcattgtttttccacggcaagtgacagacccggtggacgcagctgaaaaattggctgctgttttagagatggaccaacaaaaagcgtatgaatcgttgacgaagtctgcttcgagcgtttggctgcgtccagaggggcaaaaattatcgcaggaaaaagcgcaagaagtacggagcctcaatctgcctggtgtttacattgccgaagactcaaaacgccattacccatttggcagctacctctctcatgt

SEQ ID NO: 6138 - DNA, 1254 bp, Bacillus clausii
  misc_feature (1)...(1254): n = A,T,C or G
gccacattggccatgaagtggtttgtgtcgaccgagatcatgagaagattaagcgacttagccaaggggaagtgccgatttttgaaccgggacttgaagatatgctagcaagcaacatgacggcaggacggctatcgtttacgacccgtttgtccgaagggctggnccggcngncagatgcnagcaattantagcnagttggtaacgccagcccgggcagatggatcggcaaatttggataatgtggaagctgtcgccnaaggagattggctcatgtataacagcggggtttgtcgttattacgaaaagcaccgttccnagtcngggacaaatcggnaaagtgaagagctggattgctgaaacatgcggnccacgaagatttcgaagtggcctcctgcccagagtttttgcgagaaggcactgccatagcncgacacgcttngaaatggagagagccgtgattggcgtagaaagcgtcaaagcagagcggctccntccgtgacttgcataaaccgtttcagacaacaattgtcgcgtgtaatctcgaaacggctgaaatggctaagtacgcagccaatgcgtttttagcaacaaaaattagctttattaatgaagtcgccaacgtctgtgaacaagttggcgccgacgtcacttcccttgccgaagccattggtttagatcgccggattggacgctactttttaaaagctggcatcggttacggtggttcttgtttcccgaaagacacgcaagcgtttatccgcgtcgcccaacaagcaggctacgacctgcaaattgtgcctgcagtagaacgagtcaatgccgcccagcgcttaacggttgtcaataaactgaaaacagcactcggtcataatttggcgggcaaacggattgcaatcctagggctagcgtttaagccaaatacagacgacatgcgggctgctcccgcccttgacgtgtatccagcactaaaacgtgaacaggcaaatacggttgcttttgatccgattgccaccgagcaagcaaaagcagcgttgcctggcattcaactagcaaacacatggcaacaagcagtcagagatgctgatgctgttctgctactaacggattgggagacatttaaggacatttccttgccagagttgaaaaagttgataaagcaaccgatcgtcattgacggccgcaacatgttcgaccctaaagaaatggaaatgcacggcttttattacgattcagtcggcaggccggtcgttg

SEQ ID NO: 6139 - DNA, 372 bp, Bacillus clausii
  misc_feature (1)...(372): n = A,T,C or G
acaaccacttgtatcaataattactcctgtttataattgcgagacctttttacatgagacgattgaatcggttttagcgcaaacatatgccaattgggagctatggctgatcaatgatgcttctagtgatggcagcaagtacattgctgctcaatttgccgaagcagacagccgaatcaagctcgttgatttagaaaaaaacggcggtgcagcagtggcgcgtaacaaaggcctagaaaaggcagaaggcaagtatgttgcttttttggatggcgatgacctgtggcgtcctcagaaattagagaggcaagtccgttttatgnnggatactggccatttgttctcgtttacgagttaccggattataaggga

SEQ ID NO: 6140 - DNA, 1301 bp, Bacillus clausii
atgaagctttgtgtgatcggaacgggatatgtcggtcttgtatcaggtgtctgatatagccacattggccatgaagtggtttgtgtcgaccgagatcatgagaagattaagcgacttagccaaggggaagtgccgatttttgaaccgggacttgaagatatgctagcaagcaacatgacggcaggacggctatcgtttacgacccgtttgtccgaagggttggccggcgcagatgcagcaattatagcagttggtacgccagcccgggcagatggatcggcaaatttggataatgtggaagctgtcgccaaggagattggctcatgtataacagcggggtttgtcgttattacgaaaagcaccgttccagtcgggacaaatcggaaagtgaagagctggattgctgaaacatgcggccacgaagatttcgaagtggcctcctgcccagagtttttgcgagaaggcactgccatagccgacacgcttgaaatggagagagccgtgattggcgtagaaagcgtcaaagcagagcggctcctccgtgacttgcataaaccgtttcagacaacaattgtcgcgtgtaatctcgaaacggctgaaatggctaagtacgcagccaatgcgtttttagcaacaaaaattagctttattaatgaagtcgccaacgtctgtgaacaagttggcgccgacgtcacttcccttgccgaagccattggtttagatcgccggattggacgctactttttaaaagctggcatcggttacggtggttcttgtttcccgaaagacacgcaagcgtttatccgcgtcgcccaacaagcaggctacgacctgcaaattgtgcctgcagtagaacgagtcaatgccgcccagcgcttaacggttgtcaataaactgaaaacagcactcggtcataatttggcgggcaaacggattgcaatcctagggctagcgtttaagccaaatacagacgacatgcgggctgctcccgcccttgacgtgtatccagcactaaaacgtgaacaggcaaatacggttgcttttgatccgattgccaccgagcaagcaaaagcagcgttgcctggcattcaactagcaaacacatggcaacaagcagtcagagatgctgatgctgttctgctactaacggattgggagacatttaaggacatttccttgccagagttgaaaaagttgataaagcaaccgatcgtcattgacggccgcaacatgttggaccctaaagaaatggaaatgcacggcttttattacgattcagtcggcaggccggtcgttgatgg

SEQ ID NO: 6141 - DNA, 741 bp, Bacillus clausii
  misc_feature (1)...(741): n = A,T,C or G
ttgaatacattacttgcttttattgcgatatttagtgtgcttgtctttgtccacgaatggggccatctctattttgccaaaaaagcggggattctttgctatgaatttgccattggcatggggccaaaactgtttgcctttgagcgaaatgacacgatttacaccattcgtttattgccgattggcggttatgttcgtatggcaggcgaagagcctgagcagcctacgatccggcctggctttgaaattggactggtgcttgacgagaaagataccgttaaggnaattatcgtcaacaacaagtcaaaacatccagaagcacaagtcgtgcaagtggaacggattgatttggtccatgacttgtttgtggaaacgattgacgaagacactggcgaacttgttcgttatcaaattgatgaaaaagcgttcatcgttcaagatgaagtggcgcaaatcattgccccatggaatcgccaatttggctcaaaaccactgccaaaaagggcgatggcgatctttgctgggccgttgatgaatttcatacttggttttgtgattttactcggcttaagtttgtaccaaggtgtgcctcttagctcagaaattgntattaatgtggagaactcgcccgcagaagcagctggtcttcaagacggngacgttattacagcggtcaacggtgtagaagttgattcttggaaagaaatgacaacagaagtcaagaaatatcctggtgaagaa

SEQ ID NO: 6142 - DNA, 288 bp, Bacillus clausii
tgagtcattgggaaacgccgttttacgcccatttgatttcgctcacgaaccactatccgtttaacttggatccagaagatgcaacaattgaacgggccactaccggagacaatacagtcgataactattttcagacggcccgttatttggatgaagcactagagcaattttttgctgacttaaaagcgtcaggcttgtacgaggactcagtcatcatgatttacggagatcataacggcatttccgaaaaccataaccgggcgatggctgaaattctaggcacagaaa

SEQ ID NO: 6143 - DNA, 372 bp, Bacillus clausii; identical to SEQ ID NO: 6139
  misc_feature (1)...(372): n = A,T,C or G

SEQ ID NO: 6144 - DNA, 363 bp, Bacillus clausii
tgaaaaaactagtgaaaacccgccggaaaatgtccattttacaggaatccttgaacgccatgagatgaagcattgctacaatgcagctgatttgcttttttcgccgtcttaccatgagttgttcccgatgacgattttagaggcaatgagctgtaataagccgttgctgcttagagatttgcctttatatgaaaacatattatttgatttttatgagcgggctggaacaaacgaagcgtttgcgacgaccatagcacgtttggaggccgaccgcagtttttatgagcagacggtcgaacgggctaaaaaaggtgcaagcttctactcagaagatcgtttgcttaacgagtgggacgcctttta

SEQ ID NO: 6145 - DNA, 303 bp, Bacillus clausii
ccttctcggtgcaactttagcgtttgcggttcttttttttaacaacgaaatggttgatgcctttagtgaccaaatcattcaaaaaggggcaacaggcgacgatgtcgtcgaattgcaatctcgtttgcagtatgtagggtattataatggcaaaattgacggtgtttttggttgggggacgtactgggctgtgcggcattaccagtacgaatatgggcttgaaattgatgggttggttggagacgacatgaaagcaaagctggcgagcacaaccgactacgataaagcctttgtgacaaaagc

SEQ ID NO: 6146 - DNA, 527 bp, Bacillus clausii
  misc_feature (1)...(527): n = A,T,C or G
atgaaagtactgctggcagctgctttagcggctttagttggtagcgcctttttacttatacatgattaccgtgaaacaaacaaggagctggccaaggaaaatgaggaaatgaggcagctttttggctcgatggaagaggaactgcaagaaacaggtgctgttgccgaagaattgtcatttgaagacaatcatcaagtctggtcagaagcaatgaagcttgcggatgaattatatgaagacagcgatggccattttaaaaaagagtgggggatgtatttagctcatttagcggaacagaagcaaatgaatccctaccttgtgtatgaattgctcaaagttgagagcggcgagcagtttgatacaaatgcagtcggcccaaagacaaagtatggtcatgcttatggaatggcgcagtttatgacaantacagctccgtggattgctgaaatggctggtgtagaatatcgtcaagaactgctttttgatccattctacgcgattcaactatccgttgaatatgtggattt

SEQ ID NO: 6147 - DNA, 194 bp, Bacillus clausii
ggcgaactattcttatcgtatgtaatttggtattcggttggacgttttgtgatcgagggcatgcggttagactatttattaattggcgatacgcttcgcacggcgcagattttgtcgatcgtgttagtcgtgacatcgattgccctttgggtatacaggcgcctttgggtaaaaccaccgcggtacttgaatcc

SEQ ID NO: 6148 - DNA, 543 bp, Bacillus clausii
  misc_feature (1)...(543): n = A,T,C or G
agcaggctcttaacaatgcggggatcgacataaaaaaggcggaggagacaatagggtacgtgcctaaacaagcagtaaaacaagctgaacgagagtcgatgcctttgcgtgaactgcttgtgccatttttaaagcttagcaataatggccatggagaagtgcttgtaaaagaaattggttatgtaaaagaaggagaagggagctgggatgcggggttgcctcttgtcgcagaaagcaccgagcagcttggggcaagcggtccttttttactgcgtgatggctcaggcatgtcccataagacgctcgttgcggcaaatgatttaacgagcgtgctctatcacgctcagcagcagcattggtttgctgatttttacaatgggctaccagttgctggagaaaaagagcggcttattggcggaacgatgcggaatcgtttaggcgggatagaaggtgaagtgagagcgaaaacaggctcccttacaggggtttcaagcttaactggctatgcaaggacaaatgacngcgatagctatttgtttacca

SEQ ID NO: 6149 - DNA, 149 bp, Bacillus clausii
  misc_feature (1)...(149): n = A,T,C or G
atggaagaacaaattgaaccgattgaccgcgtttttgtccagcttgggccaatcgcgatttattggtatgccgtcctcatttngcttggagtcgccgtcggttatttaatggcacggcccgagtcggttaagcgaggactgccgcagga

SEQ ID NO: 6150 - DNA, 390 bp, Bacillus clausii
  misc_feature (1)...(390): n = A,T,C or G
caggggaggtcgnngagtcgatttcgcctgtgatgaaacggcaagggatttccgaagaaacatcagagcaagtccgctatgcgatggaaaatgttgtcgccaaaggctctggtaaaaatgcgtttattgacggctatcgtgttggcggcaaaacaggaacggcgcaaaaagcaaaaaacggcaagtacttggaaaacaactacattttatcgtttattggcgtcgcaccaatggatgatccgcaaattgtcgtctatgtcgcaatcgataaccctaaaaatacgatccaatatggcggggtagtggcggcaccaatcgcaggcgcgattatcggtgacagccttgaagcgatgggagtggaaaaaagggatnaccaaattgaaaaagaat

SEQ ID NO: 6151 - DNA, 459 bp, Bacillus clausii
  misc_feature (1)...(459): n = A,T,C or G
cctcaatggtaaacaagcaagtcgagacagcggtaatggaagtatcttcccatgcgttgcatttaggtcgtgtgcgcggctgtgattatgatattgccgtgtttacaaatttaacccccgaccatattgattaccatgagacgatggagcgttacctttatgcaaaaagcttattattttcacaactaggaaatacatatgacggcaaaaccgctgtcataaacagcgatgaccctgccagcgaccggctcattcagatgacaacggcagacgtcgtcacatacggcatcaaaaaacaagcggacgtttacggggaaaacattaaagtaagtgctgcgggcacacggttcacattacatgttcntggtgaaaaaaccgatgttcagctcaagctgattggcttgnttaatgtctacaacgcccttgctgctgctgccagcgcttatgtctcaggtttgt

SEQ ID NO: 6152 - DNA, 519 bp, Bacillus clausii
  misc_feature (1)...(519): n = A,T,C or G
acaagagcaagancaagcgcttgtattttatgacaatgtttgccgccaaaataaagggattgatctagcaagcaaagaccaagaaacattccctgttcaggcggcaatgagtggcacggttacgaaagcgatgaaggattctgtcctcggttatgtagttgaagtcgatcatggcaatggcatcaccactcactactctagtttagaaggcattgaagctgaacaaggcgcagaaattagccaaggcgatgtaatcggtaacgctggaagcaatgtgtatgatgaggaagcaggcgtgcatgttcactttgaaatccgcaaagacggagtggccatgaacccttacgatgcgtttaacaaatcactagaagacatcaatgatgcgtttcctttaggcgaaaaggataagaaaggcaaagagaacgaaaagcctgatgaaaatgacaaagccaaggaaaacgaaaatgataaagccaaggataatgaaaaagacggtgactctaagaaggataaagacga

SEQ ID NO: 6153 - DNA, 270 bp, Bacillus clausii
caagaaacgagtaggcattatttttggagggaaatctgctgagcatgaagtttcacttcaatcagcaaaaaatattgttgaggcgattgataaagatcgttttgacgtgacattgattggcattgacaaaaaaggccaatggcatataaatgaagcgtctaattttttacttaacgcagataatccagctttaattgaactaaataaatcgaatcaaggcgtagcccttattcctgggaaggaagacaggcaactggtgggcacggcaaa

SEQ ID NO: 6154 - DNA, 228 bp, Bacillus clausii
gtgcgtttgatccagtaaaaaaggaagggattgcaatgcaaaagcttttgattgaaggcggccatacattagaaggcacggtgtcgatcagcggcgctaaaaacagcgctgtcgcccttatacctgcggcgatattggcagacagcgctgttgtcattgataacttaccagccatttcagatgtagacttgttggcagagcttcttcgcgaaattggtggggacgttg

SEQ ID NO: 6155 - DNA, 288 bp, Bacillus clausii
tgccgcttcctaatggcagagtaaaaaagctgcgggcttcgtattacttaatgggcgcgatgctcggcaaattcaaaaaagcagttattggcttacctggcggttgcaatttaggcccaaggccaattgaccagcatattaaaggatttgaggcgcttggcgcacaagtaacgaatgagcaaggcgcgatttatttgcgtgctgatgagcttcgaggcgcaaaaatttatttggacgtcgtcagcgtaggggcgacgattaacatcatgcttgctgccgttcgggcga

SEQ ID NO: 6156 - DNA, 401 bp, Bacillus clausii
atttagagtctcacggttactctgacgaggatttccgtattgccctttggcatttttaccaacgtgaacaaagcgttaatattgtaagtggccatgcaaaagtatacgaaacgtttcaaacgctcgacttacatcagcatgcctttgtcatgccccttcatcataattatagctaccgcagtacgtggggcgataagcggggctggggcggtaggcgcattcatgaaggaaccgatatttttgccaattacaatgtcccgatccaatcttcttcatatggcattgttgaaacgataggttggaacccttacggcggatggcgtgtaggcatacgcgacctcgacaatatttatcattattacgcccatttaaatggctatgaaaaaggattggagaaagga

SEQ ID NO: 6157 - DNA, 267 bp, Bacillus clausii
tttaccatcaaggagtacaagctatgaaggctgtttttcaattgctgaaagagcaatacgacaacaaacatcttattttccgcctcgctgcatttgagcagaggagcaagttccagcttcattacttaggtgcgctctggcaactgtttagcccactcatgcaagtcgttgtctttttcgtgatctttggtttacggattcgccaagggaaagatgtaggggacacgccgttttttgtttggcttttgtgcggtttaatcccatggt

SEQ ID NO: 6158 - DNA, 468 bp, Bacillus clausii
  misc_feature (1)...(468): n = A,T,C or G
tgccntnaattgttattgtcngtaattcnaccgcttttttgtcatgcttggcgttcttggcatgtgttggcgatttactcggttttttcgggtgcttatttgttgcagctgccttattacttattgtgcttatacgcggttcctatacgtatttacattgtttagtgctacgatagcggacagtcatccgtgattactataactttttacaagcaggcatgcggatgctgtttttcttgtcgccaattgtctgggtgccggcgtcgatgccagaaaagctgttggcgattttgcagatgaacccattttattacattatgactgggttccgggatacctttatcggcgggcgctggttttatgaagatttgacatatatggcctttttctggtctggaattttgttaattggcttcatcggttcccatgtgttccataaatttaaaaacagctttgtcgattatttat

SEQ ID NO: 6159 - DNA, 244 bp, Bacillus clausii
atgaaggctgtttttcaattgctgaaagagcaatacgacaacaaacatcttattttccgcctcgctgcatttgagcagaggagcaagttccagcttcattacttaggtgcgctctggcaactgtttagcccactcatgcaagtcgttgtctttttcgtgatctttggtttacggattcgccaagggaaagatgtaggggacacgccgttttttgtttggcttttgtgcggtttaatcccatggt

SEQ ID NO: 6160 - DNA, 285 bp, Bacillus clausii
accttcgaacttggcgattttaggacgctatttgttgacaccagaaatctttgcccatttagaaaaacaagagacgggcgcaggcggagaaattcagcttaccgacgcgattcaaaagttaaacgaagaacaacaagtctatgcctacgattttgaaggcaagcgctacgacgtgggtgaaaaactagggtttgtgttaacaacattagaatttgctatgcagcgtgaagagcttaaaccagcgctgattaaaaaaatgaaagagtatctcgaactcgaaaacat

SEQ ID NO: 6161 - DNA, 606 bp, Bacillus clausii
aacgggcgtttattgatacttcctatttatctggatctactagcaatgaaaatatatctggagccaccagtaatgaaaacaaaagcgtcgaccagcaagctgctgtaacaggaaccatttcccgtgttgtcatcgatcctgggcatggcggtagggaccctggcgcgagaggaaatgggctaatcgagaaaaacattacgctcttgttcgctaaacaaataaaaaaatctttacaagagaatggcatagaggtttatttaacaaggtctagcgatgagtatgtttatttacaagaaagggctaatatcgctgattcgttccaagcagatctttttctgagcattcacgcaaatggccatgaaaattcgcttataagaggcatggaaattcattcgtttgcgctaaacaacatagctttaaaactggaaaatcagttccgtgacttgccaaacgctgtataccgaggccactacgagtccaatttttatgtactcagaaatacatcaaccccgtcacttttaattgaattggggtacgtgtccaaccaagctgatgctgcgctgttgcagtcacaacaattacaaattcaagttggcgaggcagtaa

SEQ ID NO: 6162 - DNA, 420 bp, Bacillus clausii
agttggcgttattggtttaggatatgttggccttccgcttgcgctgttgtttacaaaaaaaggctaccatgttaccggaatcgacattgacgcagacaaagtcgcctcgttgcaacaagcgtcgagctatattcccgatattgaaaatagggaacttgctcaaatgttggctacaaacaagttaacgtttgctgctgattatcaaggaatcgaagacttggatattattgtcgtatgcgtcccaacaccgttagcaaacgataacaagcctgatttacgctatttaaagcacgtaagcgaagccctttatcctagactgcaaaaagaacagctcgttattgtcgaaagttcgacttaccctggtacaacacgcgaagtgatccaacctattttagaaaaaagcaatttgatccctggaaa

SEQ ID NO: 6163 - DNA, 431 bp, Bacillus clausii
aatatggggcgctgggccatgtgatttctgacgtcgacacccgtaagccgatttcggttcacgatgggcaaatcatgcgctcttctgtcacgtcgatttcaaaagggctccatggcgaacctggtgaaaagttggcgagcattgcgaaagacaaagacattcttggctccattagcaaaaacagttcttttggcgtatttgggcaactggatcaaaaagcgaatatgaaaaatggcttgtatgacgaaccgatggcgattaccacggcagatgaagtgaaagaagggcctgccaaaatcctaaccgttctcgaaggtgaagaagtcgaacagtttgatgttgaaatagtcagcagcgttgctcaaaatgggcctgccacaaagggaatggtcattaaagtgactgataaaaaattgttgcaagagacaggt

SEQ ID NO: 6164 - DNA, 285 bp, Bacillus clausii
cttcgaacttggcgattttaggacgctatttgttgacaccagaaatctttgcccatttagaaaaacaagagacgggcgcaggcggagaaattcagcttaccgacgcgattcaaaagttaaacgaagaacaacaagtctatgcctacgattttgaaggcaagcgctacgacgtgggtgaaaaactagggtttgtgttaacaacattagaatttgctatgcagcgtgaagagcttaaaccagcgctgattaaaaaaatgaaagagtatctcgaactcgaaaacatgc

SEQ ID NO: 6165 - DNA, 294 bp, Bacillus clausii
taatcgctgtattttttattacgtcagctgattcagccacgtttgtgctaggtagccagtctacaaaaggatcattaaatccatctaacaaaattaaaacaacatggggcctgttaatgtcagcaactgccgctgtccttctctatagcggcggcctgcaagcattgcaaaacacaatgattgtcgtagcgtttcctttttccattatcatcgtgcttatggtgatttctcttttaaaagcattgcgccaagaaggactaaaagagcaggtcaaagagcggcggcttcggcgtg

SEQ ID NO: 6166 - DNA, 603 bp, Bacillus clausii
aactggccatcaagaaagactatattttgtatgagagctttttagggagaaactattcagatagcccaaaatacatttatgagtatttaaatcgcacctatccgggtaaatacaaacatatatgggtttttaatgatccagagagagaagagcctaaaggggtcgtgaaagtaaaacgctttggtttaaaacatttgtactttatggcgagagcgaaattccacgtaaataatatgcgtcaacctaaatggtttgttaaacggcctggacaagtatttcttgcaacttggcatggaacccctttaaaaaagttagtatttgatatgaatgaagtacattcagctaacccgaattataaaaaagatttctatctccaatcgagggcgtgggactatcttgtctctgcgaaccattattcgactgagatattcaaacgggcgttcatgtttgataacgagatattggaacatggctatccaaggaatgatttgctttatgcagaaaataaagaacaaatcgcagagcagctgaaagctaaactgcagttgccaaaagacaaaaaaattgtcctttatgctcctacttggcgcgacgatgaatttt

SEQ ID NO: 6167 - DNA, 603 bp, Bacillus clausii
ttattgtcgccaattcgctgtttggccgaagcagtggcgccgtgttctttacccatgcccaaaacgattacaatgcgttgccggaaattttaggggagaatggctactactcgtctgtcatgcatgccaataaccgaacgttttggaaccgtgatgtcatttatgacacactcgggtatgaccgcttttttgatgtcgattcttatgaagtaacggaggaaaattcagtcggttggggcttaaaagacaaggagtttttcgaacagtcgattgacttgctcaaggaacagcctcagcctttttatacaaagtttattacgctgacaaaccattttccatttgaactggacgaggaagacaaaatgattgaggagtacgattcgaacagcggcacgttaaaccgttatttcccgactgtccgttatatggattatgcggtggagcagttttttgaggatataaaagaagccggcctttatgaagacagcatctttatcctttatggagaccattacggaatttctgacaaccataacagggcaatggccatgtatctagaccaagaggaaattactccatttgattctgtccagcttcaacgtg

SEQ ID NO: 6168 - DNA, 315 bp, Bacillus clausii
tgtttttagatgaaaagaatacatatgaagatgtgacgactttacaaacgaaagcaggagaagtctacagcccagcagagcagaaggttgaacagagcaagggaacagcgccaacaagcaaagctgaatcttatggaccgcttattgagagcattgccgcggagtttggggtcgacgctaaacttgttaaagcggttattcaacacgagtcaaacttcaatgaaagagcggtaagccctgtaggagctagtggactgatgcaattgatgccttctacggctagagcgctaggtgttaaatcgatttttgatcctg

SEQ ID NO: 6169 - DNA, 894 bp, Bacillus clausii
atgggaaaggcttcaacgttcgtaaagatttccataatcatgataatcatactcttggcattatttaaagtagcagataggaaagagcccttttctttttttcgtacggacgaatacgccagtccatacatttatgtaatggatcgagaaacggggcgtgtcgtttatgaccaaaatgccgaagctaaagtatatcctgcctcgcttacaaagatcatgacaacgattgtcgcacttgagcagatggatgatttatctgccgttgcccctgtcgatgtagagacgtatcacgaaatgtttgccaacaacgcgtccatggccggtttttttggcagggaagaagtaacgtaccgtgatcttttatatggaacgatgttaacatcaggtggggaagcagcaaactcgttagcggttcatgtgggaggaaatgtggaaaattttgtgcagatgatgaatgacaaggctgctgaacttggattgaatggcacacacttcacaaatccagaaggtcttcacaatgaaaagcaatatacgaccgcttctgatatggctaagcttttagactatgccttaaacaacaacgatttcaagactatttttacagcaaagacatttcaaaccacaccaacagccgaacatcctgatggccttttactacaatccactgttctgacattcctccataaagaagagcaagatcggtttgacattctaggtggaaaatcaggcaccacctacgaagcaggacaatgctgggccacacttggtttggtcgaagacagcgaatatatcagtatcgtcatgggcgctcccttgaaaaatattagccatccagatcgcgcccaaatcgccgatacgctcaaattgtatcgaaaaatcgaatctagtgaataa

SEQ ID NO: 6170 - DNA, 1011 bp, Bacillus clausii
aggctggatattaattgcggttttagccttatcaaccgtttttttattttccaacgtaaccgcagaaatcacaaacgtacaatcagtgagacaaatagtcaatgaacacattgaccgcgacgccctctacttgtcttctaacagtacaattgtcgatgccaatggccgaacgtttgcggaattaaataacggaacgaaccgagtttatttgccttatagcgatattccagaaacagtcattcacgcttttatcgccactgaggacaagcgtttttttgagcatcacggcttcgatgcaacaggcattgccagagcttttcttgcgaatgctagcgaaggcggcattgaccaaggagcaagcaccattacccagcaaatggtacgcaatatctttttagaccattcccgtacatatgagcgaaaagtgagtgaactgctttatgcctatgagctggaacaacagtactctaaggaagaaattcttgagctttatttaaattccatttacttcggcaacggcgcttatggcgttgaggcagcggcgcagctttatttcagcgaaacaacgaaccagttgtcccttgcgcaaatcgcgtttttgacagccattccgaataatccaacttattatgatccttttaaagacgaagcgacccatacccatgaacggaaacaatgggttttgcaaaaaatggaagaggaagggtttattacgtctgctgagcataacgaagcattggaagaatcgatcgtcttgcaccgttcccagcttaaaaacgaatttcctgattacagcgattttattttagctgaatttaaaatgcttatccgccaacaagaaaatatggaggaagcgcctagcgaggaagtggaagcgcgcgttaacgaactgctgaaacaaggggtgacgattgaaacagcgcttgatccagatcggcaacagcggctagtcgacagcgtggtgcgagaattgccagacaacgcacaaggagctgcgatggtgattgataa

SEQ ID NO: 6171 - DNA, 555 bp, Bacillus clausii
tggcgttgtcacaatgcgagaagcattcaagcattcctacaatgtcccggcggaatacatgctggcacaagtcggcgtcgaaaaagcgctatcttacttagagcctttctcttttagcaaacttaatgacgaggagcgcggcctcgctcttgctttaggcaccgtcgatgtctctgtttatgagatggcccaagcttattccacttttgcacacgacggcaaatttgccccagcacatggcatcgtgcgcgtcgttgatgaacacggggaaacgctctatcaatgggacgatgtggaagaagtacttgtctggtcaaaggaaacgaatgacaaaatgcggacgttgctggcggatgtaattgcttcagggacaggcaaaggaattacgttggggcaaagtggctacatcggcggaaagacaggaacgagcagtcaataccgcgaccttgccttttctggactaaccgacaaatacacggcttcggtatgggtaggaagggatgaaggtttcgtagaagacttgtcgccaagacgaccagcaatgaatatttggga

SEQ ID NO: 6172 - DNA, 555 bp, Bacillus clausii
cgttttatttttattgcttagcggcattacgtatcaacattatcaggaggcggtgagctggatatcgtctttccttggaccggctgtagttgcattagccattcctttgtacaggcagttaccgctaataaagaaatattttcgccctcttatcattagcattacaactggggcgctgtttggcgtcgtgagtggctttatgcttggcgcactagttggattaaaaatggcgtttcttcagcctttgttgacgaagtccgtcactgccccagtggcgatggatataatggcgcttttaaatggaaatacaacactagcagcgattttagtgacaatcgccgggctgacaggcgcgattgtgtcaggaactttatttaaatggactcatatttcacactttattggcagaggcgtagcttttggcgctagtgcccatgcaataggaaccgcaaaagcgcttgagcattctgaagcagaaggggccatttcttccattgcaatgatcgtttgtgcgattatcgtttcgattgcggtgccggttggggagacgatttt

SEQ ID NO: 6173 - DNA, 405 bp, Bacillus clausii
  misc_feature (1)...(405): n = A,T,C or G
ttctcggaatggcgaaaagtggcgttgcttcggcgttgctgcttgcccgtttaggagcggaggttgtcattaacgacagtaaaagccgtgctgaacaaccacaggcaagcgaattagaagctgccggcattcaagtggtgtgcggcgggcacccgctcaccgtgcttgatggctgcagcttgctcgtgaaaaatcccggcattccctatacaaatgtactggtaaaggaagcggaagcccgtagcatgccgatttggaccgaaatcgagctcgcctatttgatttcanaagcanaaatggtcgccattactggctcaaatggcaaaacaacaacgacaacattggtaaaagaaatgcttgagcatagtggacgcaagccgctaattgccggaaatattggcacaa

SEQ ID NO: 6174 - DNA, 464 bp, Bacillus clausii
gacttacatgagctttttgcgcgatttggcaatgatacgattattttgttgcgcctccattctttcataaaggaacaatttgatttagacgcatacggtgaatttgtaaaagacgtatctgcgttccatgatattaacgaactttacttattgtccgatctgttaatcacggattactcatctgtgttttttgattacgccaatacacggaagccaatgatcttttttgtctatgacctagaagagtatcgtgatgaagtccgcggcttttattttgacttggaggcggaagcgccggggccggttgtgcggacaacagcagaagtagcagcagcgattgagcaacttagcgccgaaggcatgaaaccatataaggaaaaatacgaagcctttatcgagcgtttttgtcacttggaagacggtaatgcggctagtagagttgtaacggaagttttcaaggagga

SEQ ID NO: 6175 - DNA, 531 bp, Bacillus clausii
tatacgatacatggccgtttgccaagctccattcgattatctcaagatatggcgaagaaaagttttctaaacaaattgcccgcaaaattgaagcgtacaggatgaagcaaccaattgaaacgactggtgaattggtggacatcattaaagaagcgattcctgcacctgctcggcgtgcagggggacacccagcaaaacggacatttcaagccattcggatagctgtcaacgatgaactaggcgcttttgaggatgcgttaacggatggatttgaactattaaacgaaggcgggcgcatggccgtcattacctttcattcccttgaggaccgtttatgcaagcaaatgtttaaggagaaaacgaagctgccagatttgcctaaagggctgcctattattcctgccgatcaaaaggcaccatttgccctcataaccaaaaagccgattgtagctagtgacgaagaagtaaaagcgaataaccgtgcacgctctgcaaaactgcgcattattgaaaaagaaaaacagagagatt

SEQ ID NO: 6176 - DNA, 459 bp, Bacillus clausii
atgtacttgaccgtgcacaaagaatgggaatggaatcttctggagaaaaagagtaacggttttcaagacgagttcaagcgagctcgtttttcttacttaggaaaggagtggtggaaagtggaaataaaacgggcggtgacaaataaacgtgccgtcacccttttgtttgtgtttcttggtttgttcactattttgcttggccgcatggcgtacattcaaattaccaaagaagtgaaaggccatgatttggtcgctatggcagaggcgaagtataaccgctctcaagtgcttgaaagcgaacgaggggccattttagaccggcacggcagcgtacttgccgaagatgtgccagcttataatgtcatcgctgttttatccgattcacaaggcccaacccaatatgtgaaagatccacatgagacagcgcaaaaactagcgcctttgatcggaatggaagaa

SEQ ID NO: 6177 - DNA, 342 bp, Bacillus clausii
gtggaaataaaacgggcggtgacaaataaacgtgccgtcacccttttgtttgtgtttcttggtttgttcactattttgcttggccgcatggcgtacattcaaattaccaaagaagtgaaaggccatgatttggtcgctatggcagaggcgaagtataaccgctctcaagtgcttgaaagcgaacgaggggccattttagaccggcacggcagcgtacttgccgaagatgtgccagcttataatgtcatcgctgttttatccgattcacaaggcccaacccaatatgtgaaagatccacatgagacagcgcaaaaactagcgcctttgatcggaatggaagaa

SEQ ID NO: 6178 - DNA, 618 bp, Bacillus clausii
aaggaaaaagcttgggatcaatgaaagtgacaaagttattattagcattggccggatggcagaagaaaaaaacatggaggcgctcttgtacgcaatcaaatcattggagagcgaactggatcatgtaaaaacggtgatggttggggacggacctgtccgaaagtctcttgaagcgctggctgtgtcccttggagttagcgaacatgtccgctttactggtgctgttgagtggaaccagattcatcattactaccatttaggcgatttgttcgtaagtgcctcgacgactgaagcgcaaggcctcacctatattgaagcgatggcttcaggctgtattgtagtggccaagtctgatccaagtattaagcggattgtcttagacggcacaactggttttgtctttaaagaagatgaggatcttggaccacttttgcgccgcttactgcactcatcccatttaacgaaagtgcgcaaagctgccaagaaacaaattcagccattaaccgcagaagcttttggcgctaaagtagaacaaacttattttgagctcgcgaaaaacaaaaaaatcgaaaacagttcgccaaaacttatgcaagcaatcctttaccgaaaagagca

SEQ ID NO: 6179 - DNA, 518 bp, Bacillus clausii
atgtcgtctttctcggttcagggttagacgaaggcaagaaggatcgtctcatgttccatgcgatgaaaaagaaaaagcttgtttatgtcgtgccgaaagtaaacgacatgcttttgatgaacacatcggtgacaacaatggacgatacgatggttatgcaagtaaagccttttacgttaacgttaacgcaactgcttataaaacgggctgttgacattgctgcatcaagtgtgatgctgattgctacgctgccggtcatgctcttaacagcgatcgcgattaagttggaagatggcgggccgattttcttcaaacaagagcggctagggaaaaaccatcaaccttttaacattttaaaattccgctcaatggttatggacgcagaggccaaaacaggacctacgttggctaaatcagatgacgatcggattacgaaaacaggcaagttcatccgcaaaactcggattgatgagctgccgcaactgatcaatgtcttgatcggcgacatgtctttagtc

SEQ ID NO: 6180 - DNA, 324 bp, Bacillus clausii
ttgttcttcttagtttttctagtttttggccagacacagctgcaagtgcgcaaaagcagacagatccaaacttatattcagaaaggcttgctttgtataaaaaaatggaagttcttacaagcgtcccttggcactatttagcagctgtcgactcctacgaacggggtttacggaaagcattaagggaccgcgaacaagcaaaaggccttgtgtccatttattatccaaaagaagaatgggttggcgcactgaatccaaacataaacgataatgatccgacgacgattagcttatttgaaggaatcggccttgatggaaatggtg

SEQ ID NO: 6181 - DNA, 888 bp, Bacillus clausii
atggctaaaaaaccaactattaaaaatgcaggattaacttttcgtgagagtctaactccactagcaaaatctaaagttaaaaagattgtgcagcatcatatggcgcaccaaacttgggatattcatgatgtccataaatttcaccgtaactcaaacggctggtcaggtatcggctataactattggattgctttcgacggtactatttaccaaggtcgcggctttaatgtaggtgcacatgtgttgaaccataaccactatacacttggtgtaggatatcaaggtgattttactaagcaaaatatgaccgatgcccaactacaagcaggagctgcacttaatgcttggttagtgtcagaatgcaacttaaaagcatcagatatcattggccataaagatttggcatcaacagcttgcccaggcaaaaacttccgcatgactgagcttaggaatttggtgtccggcggtaaagtttctgagccgaaacctacaaaccctactggtgatgcgtttatccgccaagtccaagaatggtgctgcaactacggttacaaagttgtggtagacggattaaaaggacctaaaactcaccaagctttggtaaaagtctatcaaaacgagctaaacaagcagttcggtgcaggccttgctgtggatggcatcccaggccctaaaacttatgcggctgctcgtaatgtccgcaaaggtgcaaaaggtaatttaacccgtgttctgcaagctctgttatatctagccggatttaacccagggccatttgatggtcattttggcggagggactgaagcggctgttcgcgacttccagagagctaaaaaacttactattgacggtattgccggaaaggctacatggaaggctttgctgtaa

SEQ ID NO: 6182 - DNA, 708 bp, Bacillus clausii
taaaatcgcgctggtggtcgtcatctttttgaatgtccgcgccttaggccgcaaactgattgcccgggcatttaaccgtcctcagacaatccgcgcttcacaagctcgactgaatacgttaaaaagcctgactcaaaatgtattttcttatgtgttgttgtttattgtagcaatgacggtcttagaaatactcggtttcaatttagggccgattttagctggtgcaggtgttgtagggcttgccgttgctttcggcgcacaaggacttgtaagcgatgtggtgactggctttttcttattgttagaacgtcagcttgaagtcggcgattatgtgagtgccggcggcgttgaagggattgtcgaggaactcggcttccgcacgacgttaattcgcggttttgacggtacgctccattacgtgccaaaccgcaacattgccaatgtcgacaaccattcccgcggcaatatgcgtgccctcgtcgacatttccatcccagctgggcaaaaaatagacgaatcgctagcaatggtaaaagaggcactagaaggctttagccatccggctattgtatctggccctgaagtgttaggcgtcgaaagcgacgatttagcgacgacgacaatccgtgtgattgccaaaacggaaaatatggagcaatgggcagtggaacgtgaaatccgccaagcgatccggcaacgatacgatgc

SEQ ID NO: 6183 - DNA, 336 bp, Bacillus clausii
tgatgcaaccgaacaagacatagtggataacccaaaaaatctaacgtttgtcaattctggtgttgctgctgagttgttgccgcaagcatatacgaacaatgaagcggacttgattgcgattaattccaactatgcgatcgatgctggtctatcgccaacagaagactctgtcattcttgaagaaggcgatgccgaaaatccatacgttaatttgattgtcgttcgcagcgaagatgaaaacaatgaagcgattcaaacacttgttgaggtgcttcaatctgaagaaatcaaaacatttattgaagaaaactatggcggagcggtcatccctgccga

SEQ ID NO: 6184 - DNA, 918 bp, Bacillus clausii
gcaagccttacacagccgagcttgatgtaagcgacattgaaaaaggcacatacgcccactttatgctaaaagagattgatgaacaaccattcgtcattcgcaacatcatccaaaagtaccaacacgaagatggcagcacgcgcctcgatgaagacatccgcgcagcaatgaaagaaagcgaccggatttacattgttgcagcaggaacaagctaccatgctggcctagttggaaaacagctgctcgaacgcgtttccggcaaaccgacagaagtgcatattgcgagcgaatttttgtacaatatgccgctcttatctgaaaaaccactctttgtctttatttcacaaagcggcgaaactgctgattcccgcggcgtgctcgtgaacgtcaaaaaacaaggccaccgcacgcttacaattacaaatgtgccaggatcgacgctttcccgtgaagccgattatacgctgcacacgtttgcagggccagaaatagctgtcgcttctacaaaagcatacacagcacaaattgctgttctcgccttgcttgctgttgatgtagccaacgcagcaggaaaaacgcttgattttgatttgctgcaagagctagccatcgctgccaatgcaatggagtcgctctgcaaccaaaaagacgaaatggaacaaattgcccgcgattacttatccgtgacacgcaatgcattctttatcggccgtacatccgattacttcgtggcccttgaaggggcattgaagttaaaagagatttcctatattcaagcagaaggatttgccggcggcgaactgaagcatggcaccatcgcgcttattgaagacggaacgcctgtcattgcccttgctacgcaagaacatgtcaacttaagcattcgtggcaatgtgcaagaagtcgcaagccgaggag

SEQ ID NO: 6185 - DNA, 459 bp, Bacillus clausii
accgcggacaaactgacgaaaccactgccgacatggccgtcgttgattcccgaggtggattaatcggcaaagtaagccggacgagcaagtttacatcctacgtacaactgctcagcgacaatgatccgacaaaccgggtgtcggcacaagtagtgcttgaggatgacacggctgtctgcttcattgaaggttatgatgaagaaaatgattcattgatcatgcgcaaagttgacgtggaaagcgaaattgaagaaggacaaaccgtaacaacttcaggccttggcgatgtctaccctgctggtttgttaataggagaagtcgaccatacggaagcagacgaatatggtctttctcaaaatgtatacattcgtcctacagcagatttttcggcactcgattatgtgttcatcgtccagcgtcatctaccttctatggatgaagagctgcttgaagaaggtg

SEQ ID NO: 6186 - DNA, 438 bp, Bacillus clausii
atggccgtcgttgattcccgaggtggattaatcggcaaagtaagccggacgagcaagtttacatcctacgtacaactgctcagcgacaatgatccgacaaaccgggtgtcggcacaagtagtgcttgaggatgacacggctgtctgcttcattgaaggttatgatgaagaaaatgattcattgatcatgcgcaaagttgacgtggaaagcgaaattgaagaaggacaaaccgtaacaacttcaggccttggcgatgtctaccctgctggtttgttaataggagaagtcgaccatacggaagcagacgaatatggtctttctcaaaatgtatacattcgtcctacagcagatttttcggcactcgattatgtgttcatcgtccagcgtcatctaccttctatggatgaagagctgcttgaagaaggtgaggcggaatga

SEQ ID NO: 6187 - DNA, 707 bp, Bacillus clausii
  misc_feature (1)...(707): n = A,T,C or G
atgggcgaagaatttttctcctcgttattagcggaacaaaaaatcgtcttatcgtccactcagcacgagcagttcaagcgctattttgaactgctcgttgagtggaacgaaaagatgaatttgactgctattaccgaaaaaaaggatgtatacttaaaacatttttatgattcaatcacgccgagtttttactacccgtttactgaccaaaaaattgttgatatcggcgctggggctggatttccaagtttgccgcttaaaatcctttatcccgacttgcaaatctcaattattgattctttaaataagcggattggttttttaacccatttggctaatgaacttgaattaacgggcgtttccttttaccatgaccgggcagaattggccggaaaaagcaagcttcaccgggaagtttatgatgttgcaattgccagggcagtcgcacgtatgtccgttttaagtgaactatgtttgccttttgtgaaagtaggcggcgattttatcgccttaaaaggggctgncagcaatgaagaagtgnccgaagggaaaaaagcaattgccgttttaggcggggaactttccgcgagtcattcattccaactgccgattgaacatagcgaaaggcaaattgtgcaaataaaaaaggcgaaagcaacnccaaacaagtatcctcgcaagcctggggtgcccaataagcagccaat

SEQ ID NO: 6188 - DNA, 927 bp, Bacillus clausii
aagtatgcaagcctttatggacgttattaccagaaggaacgattcatgaaaatgagcgattatgcaaacatacgtatacgcaaatgggcggcgcagccgatttgtttattacgccccaatcgtatgaggaaacgcaaaccgttttgaaatttgcccatgaacatcgggtgcctgttacgttgctcggcaatgggtcgaatgtcattgtaaaagacgggggcattcgtggaattacattaagtttaaaaaaacttaatacgatcacatgcacaggagcggagttagttgcgcagacgggagcgacgattattgaagcgtcacggagagcccgtgatgcggggctgactgggcttgagtttgcttgtggcattcccggcacggtaggtggtgctttttatatgaatgccggcgcttatggcggacagatcgccgatgtgcttgaaagtgtattggtgttaacagaacaaggggaatttaaaacgctctcgaaagaagagtttgattttgattaccgcaaaagtgtgttctcagcaaaacgttatatcgccttggagggcactttccgactgcaaacaggcgacaaggcgcaaatacaagcgaagatggatgagttgacgattgcgcgtgaaacgaaacaaccactcgaatacccttcatgtggtagcgtatttaagcgtccgcctggcatgtttgccggcaagctgatccaagacagcggcctccaagggacacgcatcggcggagcggaagtgtcaaaaaaacatgccggctttattgtcaatgttgataatgcgactgcaacagagtatatgagccttgtccgccatgttcagcaaacggtaaaagacaagtttggcgttgagttggaaaccgaagtgattacaattggtgaagacctcgaagaacctgttagcgattagttaatag

SEQ ID NO: 6189 - DNA, 762 bp, Bacillus clausii
gatcgaagaagaaacggatttgcagaccgagttaattacgaaactaggctcttctgtcgtccagcatcaagcgcttgtacaaggtgacttggacattacagctgctcgctatacaggtacagacttgtctgcggcacttggcatggaacctgttaccgaccgagacgaagcaatggacatcgtgaaacgagaattttccgagcgctttgaccaaacttggtttgattcgtatggttttgaaaatacgtacgccctttctgttaccgaagcatttgcggatgagcatggaattgaaacgatttcagacttggaagcttttgcaccggaactccgttttggcgtcgataattcgtgggtgaatcgcaaaggcgatggctaccaaggttttcaagaaagctattttgcttttggcaacgtgtttccgatgaatgtcggcctcgtatatgaagccaacgctagcgggcatatggatgttgtattggcttactcttcggatgggcgtatttaggagtacaatttaaaagtgcttgaagatgaccagcggtttttcccggcttacgatgcctcgccggttgtacgcaatgatgtgcttgaacaatatccagagctttcgccgcttttagaacgcttaactgataccatcacgacggaaaaaatgcaacaattaaactatatggccgacgtggaattgaaaaatccgcgccttgttgcccaaacctttttagaagaaaacaattactttaaggacaaggaggaaagcca

SEQ ID NO: 6190 - DNA, 1092 bp, Bacillus clausii
aactggccatcaagaaagactatattttgtatgagagctttttagggagaaactattcagatagcccaaaatacatttatgagtatttaaatcgcacctatccgggtaaatacaaacatatatgggtttttaatgatccagagagagaagagcctaaaggggtcgtgaaagtaaaacgctttggtttaaaacatttgtactttatggcgagagcgaaattccacgtaaataatatgcgtcaacctaaatggtttgttaaacggcctggacaagtatttcttgcaacttggcatggaacccctttaaaaaagttagtatttgatatgaatgaagtacattcagctaacccgaattataaaaaagatttctatctccaatcgagggcgtgggactatcttgtctctgcgaaccattattcgactgagatattcaaacgggcgttcatgtttgataacgagatattggaacatggctatccaaggaatgatttgctttatgcagaaaataaagaacaaatcgcagagcagctgaaagctaaactgcagttgccaaaagacaaaaaaattgtcctttatgctcctacttggcgcgacgatgaatttttacaaaccaggcaattacaaatttaagttacaacttgatcctgaaaaaattaaaaagcagcgctaggggatgagtatttctttatgatccgcactcattattttatagcggacaagttggatttctccggggtcgaggattttgtctataatgcttcacaatacgatgatgtgaccgagctttatttgttggcggatgttctaattactgactattcgtctgtcttctttgattatgcaaacttaaaacgaccgatcttgttctttacttacgaccttgagaagtaccgagatacgttgagaggtttctacattgaccttgaatcagacgtgcctggcccattattgaagacaaccgatgaaattattgctgcattagcaaacttgaacgaaaccaaggagctttatagggacagaatagaaaaattctatgatgaatattgtcacttggatgatggccgtgcctctgaaaaaattgctgaaaaagtga

SEQ ID NO: 6191 - DNA, 1068 bp, Bacillus clausii
  misc_feature (1)...(1068): n = A,T,C or G
tcgaatatgctagccttggcaaaggactctcgttaggagcggggtcagaccgagtaacattgcctaaaaatggagcagatatttatacaacgttagacacgtcgattcaggctgcaatggagcaggcaatgtcgcaagtcgaggcagaatacgagcctgaaaaaatgactgcgattgctgctgatccccggacaggggaaattttggcgatgtcaaatcggccgagctttaatccgaatgattaccgtaatattgaaaattacttaaacttggctgttcaggacgtagttgaaccaggatcaacgatgaaaatgtttacgatcgccgcagcgatagaggaaggggagtttgaggacgacagtaaataccagtcagggcggtacgaagttgacgccaattctccccctattaatgacgtaaaccgttctggatggggagaaatctcctatgctgaagggttccagcgttcttccaatgtgttaatggcgaagcttgtcctcgaacggctagggatggaacggttttactcgtatttgaagcagtttggctttactgaacaaacaggcattgacttagcgaatgaagcctcaagcaatgtcgttgaaggaaggcgtgccgatgccgcccgcaccgcttttggacaaaactcaacggtgacagcgatccaaatgatccaagcggcaacagcgatcgcaggcgacgggaaaatgaaaaaaccttatatcattaaagaagtagttgatgaaaacggcgataagatccgggaaacagagccagaagtggctggggagccgatctccgaggagacagccaaacatgtgagagagctattgcgtggagccgtagccgaggatcacggcacaggcaaggcatacaacattcaaggacttgaggtcgcaggcaaaacaggcacagcgcaaattgctgaagacggaaaatatttatcaggccatggccaatacctttactcttttctcggtatggcccctgctgataatccaaaagtaatcctttatgtctctgtcacaaagccgaaattanatgacaaacgaatcgggcaatgcccct

SEQ ID NO: 6192 - DNA, 588 bp, Bacillus clausii
  misc_feature (1)...(588): n = A,T,C or G
ggcaagctcctcagactgtagacaaaggcgagaacgttactcaggctgatcgccatcgctctcttcctcctctgtcgttgcctcctcatctccttcagacactggttcctctacatcctcgaaagcttgttcgagttcttcgtctgttcgctccgcatttgcgccggctcccccttgatcatggccctcttgctcatctcgttcgttgttcgaggcaaactcagcattgagaaggttttgttcctctacaggctcaccaggggctatgctctgggactgcagatagccattgcccttaaattctggcgttaagtcaagcaaagctgccactttcatggcgtcacgcgatgaccagcctgccatgtctggcatcttgacctcgccatctgtaagcaagacgatccgatcgcctggaagaaccttcgttcctggcgctggctgttggtccgtaatatgttctccttcaccaaggacaaccacttcaccaggaatggtttcggctgctttgtctacccgttcaccggccagttgaggcatttcaaaaccttgctcctctgcttcttgcagcaattcctcttcattnggctc

SEQ ID NO: 6193 - DNA, 532 bp, Bacillus clausii
gtgcgcgtatcaaatgtgactgtcagaaagcggctgctactcgccttttttatcggtttagctgtgtttgcgatcattgctgtccgcttaggctatgtccagttcggacaaggcgtctggctgactgaacaggcagaagattcgtgggggagaaacattccgtttgaaccaaaacgaggcgatattaccgatcgaaacggcgtagagttagccaccaatattagcgccccgtctgtcattgtttttccacggcaagtgacagacccggtggacgcagctgaaaaattggctgctgttttagagatggaccaacaaaaagcgtatgaatcgttgacgaagtctgcttcgagcgtttggctgcgtccagaggggcaaaaattatcgcaggaaaaagcgcaagaagtacggagcctcaatctgcctggtgtttacattgccgaagactcaaaacgccattacccatttggcagctacctctctcatgtccttggatttgccggcattgacaaccaaggtctaacagggcttgagc

SEQ ID NO: 6194 - DNA, 594 bp, Bacillus clausii
cattttggcaggcgccttaccaatcatagccattggcttacttgatgataagtttgcgctccgagctaggacgaagttgttgtttcaacttctctccgcctcgatcgtcgtcatcggctcaggagtgtcaattgattttatttcaatcccgtttggagagcggattgatttaggcctgttaagcagtattgtaacagtgatatggctgatcgcgatgatgaatgccattaatttaattgatggcctggacgggcttgccgcaggcgtcgccatcatcgcgctaagcacaatgctagtcattgcggcaggaaacccagcagcttatgggcttgtcttcgcctttggattccctttaattggtagtattggcgggtttttgatatttaactttcatccagcgaagttctttatgggcgatacaggctcgctgtttctcggatacatgatcgggattttatcaacaatgggctttttcaaaagtgtaacgattgtcagcgtcgtggtgcctctgttcatactcggcgtacctattcttgataccgtgtttgcgattatccgccgcaaactgaaccaacaaaaaattggttcgccgga

SEQ ID NO: 6195 - DNA, 215 bp, Bacillus clausii
  misc_feature (1)...(215): n = A,T,C or G
ataaaaaagtggtatcggtgaatgagcggattccaacgttgcaggaaaagcggaagcaaaaagcaaatcggcggattctcgcatttattttgntgctctttttattgattgccgttttggnttatttccaaagcccccttagcggtgtgaaaaccatacatatagacngcaaccaactcgttgctgangagacgatcttaaaagcaagcggccta

SEQ ID NO: 6196 - DNA, 233 bp, Bacillus clausii; identical to SEQ ID NO: 6099

SEQ ID NO: 6197 - DNA, 546 bp, Bacillus clausii
aaacattgcctaaacatgaacaattgcctggcaaccctatgtccccttatgcggtcagcaaatacgcaggcgaactttattgcaaagttttccataacctttatggtttggaaaccgtttcgcttcgctactttaatgtctttggacctcgtcaagaccccaattccaaatatgcagccgttatcccaagctttataaaggcgatgctaaacgacaaaccaccgactatttttggcgacggcacacaatcacgtgactttacgtttattgacaatgtcgtttctgccaatttattagcagccaacgcccctaaactacaaggagaatcggtaaacatagggggaggcgccagcattgacctcaactccttggtagatgaaatcaatgtactcttaggcaaacaaattcaggcaagctatgggcctgaacggccaggcgacgtaaaacattcccttgccgatatccatcttgccgaaaagctcattgcctaccgtcctatcgtttcatttcgggaaggattaagacagacggtcgagtggtttaaac

SEQ ID NO: 6198 - DNA, 222 bp, Bacillus clausii
cctaattacagggggagctggctttattggctccaatattgccaaaacgcttgtggctaagggagaaaaagtcaaaattttagacaatttcaatacaggaaaaaaggacaacatcgctgaattcatagatgaaattgaagtcatcgatggcgactttacaaatgagaaaacggtccaatctgcgttaaagcaggtcgatgtggtttttcatcaaggagcgat

SEQ ID NO: 6199 - DNA, 525 bp, Bacillus clausii
atcgtttcaacaggcaggagtagacgctgtgctggcgaatcttgaagggccaattaacgagttggccgaagcggcaaaaggctgtgatgcaattgtttttactgcaggttctggcgggcacacaggcgcagataaaacgatgatgattgatttggatggcgcgattaaatcaatggaagctgcaaagcaagcaggcgtaagccgttttgtgattgtcagcgcgattggcgttcaccgccgtgagaaatggatggcctctgccccttattatagcgctgctaagtattatgcggatgaatggctaagagccagtgggcttgattatacgattattcgtccaggcggtttaacgaatgaaaggggaaagcagaaaatcaaagtcgcggcagaattacagcgtggtgacattcctcgtgaagacgtcgcgaatgcaatccttgccgtgttagatatggataatacgatcggcaagtcgttcgatttggttagcggggaagaagacattgaagctgctctttcttctct

SEQ ID NO: 6200 - DNA, 383 bp, Bacillus clausii
ttgaaaaaagtaattacgtacggaacgtttgatttgctccattggggccatattaatttactaaaacgggcgaaagatttaggtgactatttgattgtcgccatttcatctgacgaatttaatgcccttaaacaaaaagaagcgtaccacagttttgaaaaccgcaaaatgatccttgaagcgatccgttatgtggatgaagtcatccctgaaaacacatgggagcaaaaagtggaagacgtacaaaaatatgatatcgatgtctttgtcatgggagacgattggagaggcaaattcgatttcttaaaagagtattgcgaagtagtctatttgccgcgtactgctggtatttcgacgacaaaaattaagacggaattgctaga

SEQ ID NO: 6201 - DNA, 294 bp, Bacillus clausii
  misc_feature (1)...(294): n = A,T,C or G
attgggaaagaaaacaaatttggtcacaatgcagaatttcaaaggcgtttctatgaagggtgtttctgccattcattatagtgaaatgtttgntgttattggacgttacgtagatattgcggcggcatgtgtatgcggcattttgaggtttaatgatacagaacaacctcataaaatctcaggccaaactttcacagcnaaacattctaacgccgtatttataggggactatacccgcacaggcatcaataatgtatttttgccaggaaatanaatcggtagtaattccgcgtt

SEQ ID NO: 6202 - DNA, 762 bp, Bacillus clausii
  misc_feature (1)...(762): n = A,T,C or G
attgtttaagcaaccaagcattagattatgttattcatagttcgaatgggtttgataaaaggatttctggttctatgatacctgatcagttttatattgaaaacggcttgaatcaatttattgaatccggaaatcaaatcaaaagcgttattgctcaatataaagtatttcaactgttgtttccgtggagtattctcgatgccaataattatcatttgaatcgattagtcgccctccttccagaagagtctattagccccagtgcgaaaatcgaagcatctgcctctattaacgggaaattgaaggtgggggaaaactcctatattggaaaaaatgtaattattaacggaaatgtcattataggcgataatgttgtgatcgacaatggggccattctaaacggcaatatcctcattggagatcattcgtatgtaaaagattatgcaaagattgaggggccaacagtaattgggaaagaaaacaaatttggtcacaatgcagaattcaaaggcgtttctatgaagggtgtctctgccattcattatagtgaaatgtttggtgttattggacgttacgtagatattgcggcggcatgtgtatgcggcattttgaggtttaatgatacagaacaacctcataaaatctcaggccaaactttcacagcnaaacattctaacgccgtatttataggggactatacccgcacaggcatcaataatgtatttttgccaggaaatanaatcggtagtaattccgcgttat

SEQ ID NO: 6203 - DNA, 678 bp, Bacillus clausii
agtggcgattgcggcagttgcaattgccgacggcgacatttcctattcgaacttgccagagtccaatgacgagattggccggttaggtcggtcattcaatacaatgacgacccagttgagaaaattggttgctgatttgcagcaatctggcatcaatgtcctcgatcgggcctcggatttgtcagcagtagcagaagagacatcagcaacggcacaggagatgcttttagctgttaatgaaatcgggtcaggaacgcaagatcaagccatccaactggaaaaaacgaatgagcaagtcggggaattgaaccagtcgattcaatcaatcaacgagcaaaagcaaaaagtggttgaaacatccgttgagtcttccattgcttctgcaaaaggaagggaaatggtttcccacttggaacagtctcattccaattcccaccaagcatcagaagacattagcatcggcattactaaattatatgggaaaatccaagacatttcacgggtgacgcaagtaattaatggcatcgccgagcagacgaacctccttgctttaaatgcaagcattgaagcagcacaggcaggggaacatggcaatggatttgccgtcgttgctgcggaagtgcgcaagcttgcgaaacaggcgaatacgcgcacggctgaaataaaagaggtcatctc

SEQ ID NO: 6204 - DNA, 387 bp, Bacillus clausii
tcatttaccattcaccggggaacacagggaacggcctgtttacagaagcgattaaccgtgtcaaaaatggcgaacaagtatgggcgatcggcgttgataaagaccaatatgaagaaggcgtctatgagggcgaccaatccgttacacttacgtcgatgatcaaacgtgttgatacggcggtccaagatgtgacacagcaaacgatggacggcaacttccctggtggcgaaatccttgaatacggaattgaagatgatggaattgattacgcgacgactggcgataacttaagccctgaaatcatcgaaagcatggacgattacatgcagcaaattcttgacggtgagctggaagtgccaaaaaccgatgacgagtttaatgaatttg

SEQ ID NO: 6205 - DNA, 582 bp, Bacillus clausii
gggaagtggctgccaaagacgaagtcgtttacgccaacttgcttgctaacggctccttaaaagacatttatgtagtaaatggctttaatgtcgctacggaaggagacatcagcgattatggcgcttacgaacaagtcattaacttaacggacttgtctccaattgagcaattcgaggatggctggcaagtaactgctcctgcaggcatgttttattaccaaggcaatttgccagccgaaacggagctgccttggacatttgacatttcttactcattggacggccaatccattaacgggcaagagttgatcggcgaaagcggattggttgaaatcgccattgaggtcaaacagaacgaaaaagccgacacgaccttttttgaaaattatttgctgcaactgtccgtgcccctgcaaagcgatgtgtttcacaacatagaaccgccagacgccaccattgccaatgtaggcaaagacaaacaagcggcttttacaatcatgcctgaagaaagcgcctccttccgcctctctgcttgatgtggagcaatttgagttaatggcatcgaaatatcggcattgcccg

SEQ ID NO: 6206 - DNA, 336 bp, Bacillus clausii
tccacgcacctggcgggaaagattatattaaacggatcattggccttcctggcgaccatttgaaatatgaaaacgatacgctttatattaacggggaagaaacagcggaaccttatttaaactcgctgaaacagacgctttacggcgaccaattgcttactggcgattttacactggaagagttaatcggcgaagaggtaatccctgacgatcattattttatgatgggcgataatcgccgtttaagtaaagacagccgtgatattggtctcattccgaaatcagaaattatcggcaaagcgaacgtcattttttatccgtttgaacatataagca

SEQ ID NO: 6207 - DNA, 819 bp, Bacillus clausii
atgagactcacaggcttggcctctggccttgacattgaccaaatggtaaaagatttaatgagggcagagcgtatgcccgttgataaattggaaaaacaacggacggaaataggttggaaaacggatgcgtatagggaaatcaatttgaaaatgagaacattcaacgatttgatttttgatacagttttgcgcgcttcaaatatgaaaaagcgcactgtttcctcttcaaattcagacattgcgacagcaacagcttcctcatctgctggtaatgcttcttttacgttaaatgaagtcaggcagctggcgacttcagcgactgcgaaaagcaaaaatcttagcagtttcacagaaaaatcacaattgaaagagctggatataaacgacggggagtggattgaaggcaaattaaagcgcgaaactgcccaagtttccgatggcaaagtccagcttagcgaggcaccacagtttgctggagagagcatgctcattattaacggaaaatcgtacgccgtcgcagacagtccagacgatctcgcaaaaggggaggtctttataagcgatacaggtgaaattactttttccagtaccgataaagtcactggcaaggtgacagtcgagtatattcaagcagacagtgaagcgacagaacggtatttgagttcgtcggttgcgacaatcggtgcaaatggcgaaaaagtggagagttcgtttttctttaaagaatcggatacgatcggtacggtggtgacaaaactgcaaaatgccggcgcaaaggtaaacgccttttttgatgaatatagtggcgccctcgtcgta

SEQ ID NO: 6208 - DNA, 351 bp, Bacillus clausii
  misc_feature (1)...(351): n = A,T,C or G
ttcgcttaatttccgatatttccgagcaaacgaacttgctcgctttaaacgcttcgattgaagcagcacgagctggcgagcatggccgcggtttcgcggtcgttgccgatgaagtcaggaagctggcagaacaaacaaacgaagctgcccaaaacgtgcaggagcaaatacgcggcattcaaacagggacgatgagtgctggaaaagcgatgcaagcaggcaaaggcgaagtggcaaaaggggtcgaagtcattcaagatgcaggtgattcctttacagctatccagtcacatatggataaagtgcgcgaaaaaatcaatcaagncacaaatgaagcgaaacaaatgtcct

SEQ ID NO: 6209 - DNA, 1470 bp, Bacillus clausii
gaaagcaaaaaaaggtttagaggtgcagcgcgaaagcatcacgctagcatcgattacattccaaaactatttccgtatgtaccaaaagctcgcaggaatgacggggacggctaagacggaggaagaagagttccgcaatatttacggcatggacgtaatggtcattccgaccaataaaccggttgctcgggaagaccgccctgatttaatttataagacgatgcaagggaaattcaacgcagtcgtcagtgaaattgccgagcttcacaaaacggggcgccctgtgctagtaggtacagtcaacgttgaaacatctgaagttgtttccaaaatgttgacaagaaaacggattccacaccacgtcttaaatgcaaaaaaccatgagcgagaagcagaaattattgaaaaagctggccataaaggggccgtcacgatcgcaacgaacatggctggacgtggaacggacattaaacttggcccaggggttaaagagcttggcggcctccacgttcttggtacagagcgccatgagagccggcggattgacaaccaattgcgtggtcgtgctgggcgtcaaggggatgtaggttcttctcagttttatttgtcgatggaagatgagctgatgaggcggtttggctcagacaatatgaaagcgatgatggaaaagctaggcatggaagacgaccagcctattgaatcatcattggtttcaagggcggtggaaacagctcagaagcgggttgaaggcaataactttgatgctcgtaaacaagtgctccagtttgacgacgttatgcgtgagcaacgggagattatttacaaacaacggatggaagtgcttgaagccgataacttaaaaacaattgtcgaaaatatgatgaaggcgactgtagaacgtgtagttcaaacccattgccctgaatcgctcgttcaggaagaatgggatttggctgctgttgccacctatatcaacgggcaattgctgtctgaaaacggaattagtgagaaagagctgaaagggaaagagcaagaggaactgatcgagttgattaccgaaaaagtcctcgctgcataccatgcgaaagaagcagaagtctcttcagaacaaatgcgcgagtttgaaaaagtgatcatgctgcgcactgttgaccgcaagtggatgaaccacattgaccaaatggatcaattacgacaaggcatacatttgcgcgcttacggccaaaatgatccgttgcgtgagtatcgctttgaaggctttaatatgtttgaagcgatgatcgctgaaattgaagaagaagtatctatgtacgtgatgaaagctcaagtgcaacaaaaccttaagcgtgaggaagtagctgaaggaaaagcggtgaaaccgtcagccaatgggcaagaggacaaaaaagcgaaacggaaaccagtccgcaaagctgaaaacattggcagaaatgatccatgcatttgtgg

SEQ ID NO: 6210 - DNA, 693 bp, Bacillus clausii
atgatgatgcttggattacttcgaaaaatagtcggcgatccagcccaaaaacaattaaagaaaaacgaaaaaatcgtcgatcaagtcgaggcgctagcagatgaaatgaagcagctttctgacgaacaattaaagaacaaaacagctgaattcaaggcaaagctagaagaaggcgcttctcttaacgatatagtagttcctgcgcttgcagttgctcgtgaagctgcgggcagggtgttaaatgagtatccataccgcgtccagttgctcggtgcactggcgctgcaccaaggcaatattgccgaaatgaaaacaggggaagggaaaacgctcgtcggcacaattgccgtctatgtccaagccctggagggaaaaggcgttcatattgtaacggtcaataactacttagcccgccgcgacttagaaaactatgggcggatttttcaattcttagggttgacagtaggattgaatgaaaacggccttacgagagaagaaaaacaaaaagcatatgccgctgatgtgacgtacagcacaaataatgagcttgggtttgattatttgcgtgataacatggtgctttacaaagaacaaatggtgcaacggccgctccattttgcgttaatcgatgaagttgactcgattttaattgatgaagcacggacgccgcataattatttctggttctgttga

SEQ ID NO: 6211 - DNA, 657 bp, Bacillus clausii
tggattacttcgaaaaatagtcggcgatccagcccaaaaacaattaaagaaaaacgaaaaaatcgtcgatcaagtcgaggcgctagcagatgaaatgaagcagctttctgacgaacaattaaagaacaaaacagctgaattcaaggcaaagctagaagaaggcgcttctcttaacgatatagtagttcctgcgcttgcagttgctcgtgaagctgcgggcagggtgttaaatgagtatccataccgcgtccagttgctcggtgcactggcgctgcaccaaggcaatattgccgaaatgaaaacaggggaagggaaaacgctcgtcggcacaattgccgtctatgtccaagccctggagggaaaaggcgttcatattgtaacggtcaataactacttagcccgccgcgacttagaaaactatgggcggatttttcaattcttagggttgacagtaggattgaatgaaaacggccttacgagagaagaaaaacaaaaagcatatgccgctgatgtgacgtacagcacaaataatgagcttgggtttgattatttgcgtgataacatggtgctttacaaagaacaaatggtgcaacggccgctccattttgcgttaatcgatgaagttgactcgattttaattgatgaagcacggacgcc

SEQ ID NO: 6212 - DNA, 1263 bp, Bacillus clausii
  misc_feature (1)...(1263): n = A,T,C or G
gttgcaacaatttatggagctgcaaacagatagcgtccattacgctggtcgtacgatcaatgtaaaggaactctcagatgaacagcttgagcagcgccttgttgatttaacgaacattaacgagaatattttggaagtctatttagttggacagacaggcgaagcggtggcctataacagctcaactggatttggcgcagaagaagagctccaagaatcgtcatggtttaaacaggcgaatgccaggcaagtcgaggtgtcgattagcgaaccgattttgacagtcgaaggggaagaggagcacgtcgaagtcattatgggtacgttaactgctgactctacgaacgtccttggcattcgcattagcctaaaagagctgacagaccaaagtcaatgcagcaaaaatcggcagtaacaggctatatgtatttanccgnaccaattngggcgggattgtcaacacatccggattagggaaacaggtgaatttttgccggttaacttaatgcagcaatttgaagatgaaagcggacaattccaatctgaggaagacggcgttgtgcgggagctgaattacaacaaaattagctcaaccgactgggtgttagttgggacaatgttgccgaatgaggcaagccaaacagttcaaccaatcttgcagacgatgctaattgtcattgcagcgacattggtggttgggtgtgtcatcatttactttgtcgttcggtccgtcgttgcgcctctttccggattggctaaaatggcaaacgtgattaaaagcggcaatttaggtgcgaagtacgacggaaaggcacttgccaatgacgaaattggcgcccttgctgaagcgtttgacgatatgcggaattcacttattctgacattaagccatattcaagataaagctacttatttggcttcttcctctgaagaattgcaagcgagcactgagcaaaatatgcaggcaactgagcaaatcacactcgccgtccaagaggtttcttctggggttgacgcccaatcgtccagcatggaccaggggcggaaagcaaccacgtctgtgtcacagggcatttccgatattgtcttgtctgcatctagcgtgcaaacagcagttgaccaagcagctgcaatggtggacagtggacagaaaggtgtggaacgcagcgtttcgcaaatgaatgccattgatgcccacgtgtctgaacttgctagcacaattgagtcgctggaacagcaagcgaaaacaattggccaagtgat

SEQ ID NO: 6213 - DNA, 290 bp, Bacillus clausii
  misc_feature (1)...(290): n = A,T,C or G
ttgttgaatagagggtacgaaatggaccaagcattgtcgttcttggctgtccacgcctcaagggagttgcaggtgaaaattacaggtgtaaaaaaagatttgagagaagggaagacattgtggcaaagcatcgagccattctccttacctggagaagcacaatcatttggctatttctttgaagagcaaggtgagcttgcagtagggcttgtgtctgctgctcagttggctgaaaaaagagcttatacgaaaaancagctgcaaaagctactgcgttaccctattttctt

SEQ ID NO: 6214 - DNA, 771 bp, Bacillus clausii
atggttacacacttcgcttctcgacattgcctgctaaaccaagtgaaaggtttggctatacgcatttccccacgcacgactccttatacactccaatctctttccttatttgcttctgatacgcgaaagttcacgcaggttgcccattgccagaatggtcttggcctcttcacaggggcgacagggtcgggcaaaacgacgagcgtttatgcattgcttgattacgtgcagcaatcgagcacaaaaatgattgtaacaattgaagacccgattgaaaggccgattgatggcatggttcaaattgaaacaaatgaaaaagcaggcatcacttttgcaacagctttaaaagccgtgttgcgccacgaccctgacgtaattgtcattggggaaatccgtgatcgcaacacagcggaacttgctttgcaggcggcgacaacgggccatcttgtaattgccagcttacacgctgcgagtgcttcccttgcctttgcccgtctaacggagttaggcgtgaatgtacgcgttgaatgcgtccgtgcagtcattcaccaaaaattagcgaaaatcgtaagcaaaaacaaacgggtggcattttttgaatggttgcgaaaggattcgctatcaaaagaaggtggcgttcatgacatatcaggtgagacagaagcgcttagagcgattcgcaaagcgtgggcaattggagcgattgatcggcacacatttaacttgctaacagacaaagggatgacggaggtggaaagtgggtaccgttag

SEQ ID NO: 6215 - DNA, 513 bp, Bacillus clausii
tctatatgaactttgctgtcataacagcgcttgtgctaatcatcccagtgatcttgtaccaattatgggcatttgtttcaccgggattaaaagagaacgaacagaaagcgacgctcgcatacattccaattgcgttcctattgtttttggcaggcattgctttttcctattttattttactgccttttgtcatttcctttatggggcaaatggccgaccgcctcgaaataaatgagatgtatggaatcaatgaatacttttcatttttgttccaactgacaatcccttttgggcttttgtttcagcttccggtagttgtgatgtttttaacgaggctaggagtggtcacgccgacatttctgcggaaaatccgtaaatatgcgtattttgccttgcttgtgatcgctggtattattacgccccctgaattaacgtctcatttgtttgttactgtgccgatgcttattttatatgagatcagcattaccatttcggcgattacataccggaaat

SEQ ID NO: 6216 - DNA, 320 bp, Bacillus clausii
atgcgcgtaacacaaggcatgatgacggcgaactcgcttcgttattcccagagtagttatcaacggctttctactttatatgaccaaataagtgcacaaaagaaaattacccgcttttcccaagaccccgttgtggcagcgaaaagcatgcagcaccgtcaatcgctcgcacaaatggaacaatacaagcgaaatgtcaatgaagctcatagttggctaaatcaaggggatacctccttaaaggaagtatccagcattttaaaacgtgtacgcgaacttgccgtcactggctctactgatgggtatggcgaggaagaacg

SEQ ID NO: 6217 - DNA, 762 bp, Bacillus clausii
atgcaatggacggttggtgacagcaaccaaccatttacgtataacggtgcaggcggcggcgagttggttggattgcaaaaagcccatgaacgagtcggtcaagaacttgaagatataaaagcgttggcacaaacattcgctaaagaagtgaaccagatctatgcgtttgcttattctgaacagggtggattcgggcaagagttttttaccattcatcttgatgactcaggcgctttttctcacatcagtgtcaacagtgaattaagcaacaatccaaaagcattagcgacagcaaggtttaatgaagaaggaattaaaccagaataccaagacgagtttgcggaaaagtgggcagcttgggaaaacgataaagacaatgaagaggcatttcgtgatttgcttgcgtttttaaatgaggcggaccactatgttgatggcaaaatgattattgagggaaatgtcgatgtggcaaaagaaattagtcgtctagaggactctgccgctattatcggtaaatataaggatatgatgggcaagctcggtgtggaaacgaaagcgcagcgtgatctgacagaggcctctaacgcacgcctagccaatacagaatcaaaccggatggcagttagcggcgtttcccttgatgaagagatgtcgctgttgatccagtttcagcatgcttacaatgctgctgctagggccatgacagcgatggacgaaatgcttgaccagattattaatcgtttaggcgtcgttgggcgttaa

SEQ ID NO: 6218 - DNA, 396 bp, Bacillus clausii
gggaagagttggttcaggcgtacaagtgacaggcatcgacgggatacgcgaccaattgctagaccgccaataccgtgctgaagcgcatgtcgaaggtgccgctttcattcaatataaaatattggaacgtatggaagacctctataatgaagcgccttcagacacgactacgagcaggttatcagatcaattcgcgtctttttggaatggttggaaagaacttgcttccgggaaagatagccaagcggttttgctcgaacaagggaaagctgtcacggatgcatttactcatttgcaggactcttttcaaacagaaatggacatgttggagacggaagcagagttaacgactgctaaagtcaaccaaatccttgaacaactgcaatgcaacgaaca

SEQ ID NO: 6219 - DNA, 996 bp, Bacillus clausii
atatgtcgcccgtgcaagcgacgcagaggcatttttagaagaagaaacagaagcgcaacgcactttgttgcacacgtttcaagaaacaaaaacccatgtggaacaaacttatgtagggacgatagcaggaaactttatgaacgaaccgacgtcgtttcagaaccctcctgactacgatccaagggaacgtccttggtaccagctcgcaatggaacacacaggggaaacggttattacagatccatacatctccaattcatctggtgagccagtcgtcacaatcgccaaaacaacagcagatgaacacggcgtcgctgcccttaatttgcagttggacgcgataactgatttactatcgactgtttctatcggcgaaaaaggctacgtgtttattcttgaccagaataacgcctatgtttcccacccacatgaagagttaggaagcgaagcgagtgagtttttcttacagctgcaagacgcagaaaatggacaattggattacccttcagatacagacggtgaaaacttaatccttcactatacaacaaatgaccgtacaggctggaaaatagtctccgccatgtacgaaacagagattgaacgtgcagtagcgccaattttaaatacgactttatttgtcatttttctgtccttactaggcggcgccgtccttgtttacgttctgacacggtcgattgtctctcctatccacaggctcacgacagctgccgagaaaatgagtgaaggggacttggccgctacctttaaagtcgacaaaaaccaaaacgatgaaatcggcagattaggcaagtcatttgaaaaaatgcgcaatgccctagcaaccatgattgcccatattcaagacaaatcccaccaattgtctgcttctgctgaagaagtcatggccatctctggagaaaacacccgcgccaccgaacaaattgccaattcgatgcaagaagtggctaccggagtcgataaacaggctgtgagcgt

SEQ ID NO: 6220 - DNA, 405 bp, Bacillus clausii
  misc_feature (1)...(405): n = A,T,C or G
ttgccgcagtcgaacagttnaaaacatatgctcatattctcgattgccctatttatacagcatacaatgaatcagaattaatcgatttgtgcagccggcaaacggctgatcttgtcttagttgacacagctgggcgcaattatttgcatgagcaaatgcctgtggagctcattgattatatacggcagagcgcgtcttgccatttgttggttgcccttagtttggctgccaaagcagaagatgcacggcatatgcttatccgttttccaaaagagcttgtcaatggcctgatcttaacgaanttggatgaaacggcttcacttggaacactttgtgagcttttgtacagcgaggcgattccggttgcttgtgtgacgaccgggcaaaatgtgccagaagatattt

SEQ ID NO: 6221 - DNA, 315 bp, Bacillus clausii
cttaagagcgatttcgatcgaactaatcgagcaactatcggctatgcttgcttctgacccaccgcgctatattcaaatttctgggcataccgacaatgtgccgatgggaaacaacgaatttgattcgaactgggaattaagcagcgcccgcgcttacaatgtcatgaaactgtttttcgaatacgatcattttgagccggctcaactgtcatttgcaggctacggtgagtatcatccgatcgcttcaaacgagactgcagaaggaaggcaagccaaccgacgcgttgaagtccctcgttctcccgttggaaccaa

SEQ ID NO: 6222 - DNA, 270 bp, Bacillus clausii
acgaagcagaaatgcaaaacttagacatgctcttagacataccgctggaagttaaagtggaattgggacgtacgaaaaaaacgatccgtgaaattttgtcgattgcgcaaggatcgattattgaacttgataagttggcaggtgagccggtcgatgtgcttatcaatgacaagttgattgccaaaggcgaagtggtcgtaattgacgaaaactttggcgtgcggattacagacattgttagcaaaaaagaccgtcttacccacttgcgtt

SEQ ID NO: 6223 - DNA, 428 bp, Bacillus clausii
  misc_feature (1)...(428): n = A,T,C or G
atgagctttaatccgaaaaagtgaaatgtcgatttgacaaancaccgaaaacgtttttttatcggctcgggcttgtcaatagtccttggaattgtgttgttgctgacatttggtttaaatttaggcgttgattttgaaagtggttcaaatgtggaaatccaagcggatcagacattgacgcaagaacaattactggacgactttgcagcaatcaatgaatcgtacacgccgaatattacacttggaggcgagcaaagccaaagtgcgactgcccggtttacagtcgaactttccaaagatgaaattaccacgatccagacgtatttccaagacaaatacgggcattcgcctaacgtcagtacagtgtcgccccttgtcggccaggaactcgctcgcaatgcgattttgtctgtattgatcgcttcgat

SEQ ID NO: 6224 - DNA, 1298 bp, Bacillus clausii
atggttaaaaaaggcaaaattgtgcttttctttctcattattgcgttgtttgcttctggaattgcctattttgcaaagcctgttgtaaacgacgtcagccttgggcttgacttgcaaggcggctttgaagtgctctacgaagtggagccaatgaatgagggcgatgaaattaatcaggattcgcttttagcaacaacgactgcattgaatgaaagggtaaatacaattggcgtttcagaaccgaacatccaaattgaaggagaaaatcgcatccgtgtccagttagctggcgttgaagaccaagaaacagcacgtgacattttagcgactggcgcagaattgacgatccgtgacgtcgatgacaacgtgctacttgatggcagcgatttaacccaaaatggcgccagcgcatcggtacatccagaaaaaaatcagccgattgtgacgttgacgctaaatgatgcagacaaatttggcgaaatcacacgtgaaatttctgaacgtccactaggagagaatttgctcgtcatctggcttgactttgaggaaggcgacagctttgcagaagaatcaaaaaaacaagaccctaaatacatgtcagcagcgtccgttaatgcccctttacatacacgagacgtgatgattgaagggaactttacaactgaggaaacacgctttcttgctgaaatattaaatgcaggcgctttgcctgttgagttaaatgaaatctactctacatctgtcggtgcatcgctaggggaaaaagcgatgaaccaaacgatttttgctggctcccttggggttgggctgatctttttgtatatggttgtttactatcgctttccaggaatcatcgctgtcataacactaagcatttatacatttttggtgcttgtcgtctttaatgccatgaatgctgtgttaactttgccaggcattgccgcgctcgtgcttggggtgggcatggctgtcgatgcgaatatcattacttatgaacggattaaggaagagattaaatcagggaaatcgattttatctgcctttaaagtcggcagcagacgctcgtttgcaacgatttttgatgccaatattccacgttgattgcggcttggcgtcatggtttattttgggacgagctctgtgcaaggctttgcagtcatgctcattattagcattcttgtcagctttttaacggctgtctatggttccagggtgttgctaggcctctgggtaaacagcaaatttttaaataaacggcctggctggtttggcgtgaaaagaggtgaaattgatgagct

SEQ ID NO: 6225 - DNA, 521 bp, Bacillus clausii
  misc_feature (1)...(521): n = A,T,C or G
atgtgnataccaatcggaaaattggcgattaccgggattgcatcgtttttgttcttcctcgttctcttttttgtccttcaaggaaagggcagtgacggcagaggacntgagctgtttggctggacaagctataccatcttgtccaacagcatggagccgacattttccgccggagatgtggtcatcatgaaaaagaatgaggagcctagcattggcgatgttgtaacgtttatggctcctgaacggcgcttgttcacacaccggattattgagaagtttgaaagcaatggaaagacgtattataagacgcaaggcgataacaacaacgttgtagacgaagacccaatcgtaaaagaacaaattgtcggcacccatatgttcaccattcctaaagtgggtttagttgctgaaaaaatcaatcaaccaattggttatggtttgttgattgtcgtgccgattgctgggtatttgctgttatcgttctacgaaaccatccaaaaaaaacgtaaggaggcttcttg

SEQ ID NO: 6226 - DNA, 366 bp, Bacillus clausii
cgctaattatttctggttctgttgaacggaaaacaaaactttatggacaagccaatacatttgtgcgcgttttaaagcgcgatgctgattacacatacgatgaaaaaacaaaatctgtccagttgacggatgaaggtgtcaataaagcagagcgcgcgtttaacatcgacaacctttacgatcaaaagcatgtccaactgaaccatcatattaaccaatcgttaaaagcccatgtggccatgcaccgtgatgctgactatgtcgtagaagacggcgaagtcgtaatcgttgaccagtttacgggtcgtttaatgaaaggaaggcgttatagcgacggacttcaccaagcgctagaaagcaaaaaaa

SEQ ID NO: 6227 - DNA, 1299 bp, Bacillus clausii
aaaagctcattgatcatgttcacacactgtcccggtataagtggtatgggcaagttcgccatgccgcggggttgacgatttgaatcagctggccgagagcatttatcggtgaactgtgctatatctgggctagtccagatcaaaaagggactaaagtccgagctgaagtcgttggttttaaggacgaccgcattttgctcatgccgctagacgatacgaggcgaatcgcgcctgggagctatgtagaaggaacgggaaagccgttaaatgttgcgtgtggaccaagtttgattggccaaattgtcaatggcgtcggtgaaccatttttgcaaagcacggccttgggagatacagacgccaactattcaacagacaattcacctccaaacccgctagaaagaccgcgcatttccgaaattatgagcgttggtgtccgcgcaattgacgggctgttgacgatgggaaaagggcaaagagtgggcatttttgctggcagcggtgtagggaagagcacactcatgtcgatgattgccaaacagtcagatgcagatgtgaatgtgatcgctttaattggtgaacggggcagagaggtaaaagaatttgttgagcgcgacttaggagaggaagggctgaaaaagtcggtcgttgtcgtcgcaacatcagaccagccggcgttgttacgagtgaaaggagcgcaaacggctaccgccattgctgaatatttccgcgacaagggcaagaatgtcaatttaatgatggattcggtcacccggtttgcaatggcgcagcgcgaaattggcttggcaattggcgaaccaccgacgacaaaaggctaccctccttctgtttttgcgatgatgccgaagctgcttgaacggtcaggtacaaaccagtcaggctcgatcaccggtttatacaccgttcttgtagatggcgacgacatgaatgagcctattgcagatgccgtgcgagggattcttgacggacactttgtattggacaggcaactcgccaatcgtgggcagtatccagccgttaatgttttaaaaagcgttagcaggctaatgaaagatttggtggaaaacgagcaccttcatgcagcaaagctttttaaacagcgtttagcagattatgaacagtcggaagatttaatttccctgggagcttataaacagggcagttccaaagacattgacgctgccattcatgaccatccagctatgcttgactttcttaaacaagaagtcgaagaaagcgattcgtttgcagaaacgaaaacgaagcttatacaacttttta

SEQ ID NO: 6228 - DNA, 622 bp, Bacillus clausii
atggctgatgtgctgtctcaaggtgagattgatgcgctcctttctgctttgacgactggagaaatggatgccgaagagttattaaaactagagtcagagaagaaagttcgggtttatgattttaaacgagcgctacgcttttcaaaagaccaaattcggaacttatcccgcatccatgaaaattacgcgcggttgttgacaaccaatttatcggccaagctccgttcgcttgtgcaaatccaagtagcctctgtcgaacaggttccatacgaagagtatgtccgcagcataccgacaatgacatttttgaacgtgattgagcctataccattaaatggacgggtcttaattgaaattaatcctaatatcgcctacgccatgtttgaccgtgtacttggcggacatgggatgagctttaataaaattgataatttgacagaaattgagacgaaaattttatcagggctatttgaatcgatgctggcaagtttcgctgaaagcttggaccactgttattgaaatggaagccgatcaccgaaaacatttgaagtgaatccccatttttttgccagctcgtgttcacgaaacgaaacgggtgtttgtcattctcgctgttccacca

SEQ ID NO: 6229 - DNA, 763 bp, Bacillus clausii
atgcagcaatttgaagatgaaagcggacaattccaatctgaggaagacggcgttgtgcgggagctgaattacaacaaaattagctcaaccgactgggtgttagttgggacaatgttgccgaatgaggcaagccaaacagttcaaccaatcttgcagacgatgctaattgtcattgcagcgacattggtggttgggtgtgtcatcatttactttgtcgttcggtccgtcgttgcgcctctttccggattggctaaaatggcaaacgtgattaaaagcggcaatttaggtgcgaagtacgacggaaaggcacttgccaatgacgaaattggcgcccttgctgaagcgtttgacgatatgcggaattcacttattctgacattaagccatattcaagataaagctacttatttggcttcttcctctgaagaattgcaagcgagcactgagcaaaatatgcaggcaactgagcaaatcacactcgccgtccaagaggtttcttctggggttgacgcccaatcgtccagcatggaccaggggcggaaagcaaccacgtctgtgtcacagggcatttccgatattgtcttgtctgcatctagcgtgcaaacagcagttgaccaagcagctgcaatggtggacagtggacagaaaggtgtggaacgcagcgtttcgcaaatgaatgccattgatgcccacgtgtctgaacttgctagcacaattgagtcgctggaacagcaagcgaaaacaattggccaagtgattcgct

SEQ ID NO: 6230 - DNA, 399 bp, Bacillus clausii
  misc_feature (1)...(399): n = A,T,C or G
ctggcgacgagcttgtccaagcttcgagcgagattgaagctggtttaaatgaactgagcanctccttaagcgaagcaagcgcgccagaancagattttgcgtnagatgactcgttattcgccgcctttgacgaactgtcagcgggcatgagcgaagctgcggccagtttagaagaactaagcacccattacggcgaagcctntggggcgttnaaagcagcggtggantccatccctgagagcgatttancagaggaagacatccnatcnctgtncgaaancnaccctanctcagacacactcgcccaattagttgcttactatcnagcggggcatgaaattaaangcacctatgcngctgtaaaagaaggccttgacgccgtccaccctgttttacaag

SEQ ID NO: 6231 - DNA, 1306 bp, Bacillus clausii
atgtttaaggcgatctccaacatcttccgtgtgagagatttacgtcgaaaaatcgtctttacgcttctgatgcttattgtttttcgaatcggcgcattcatacccgtgccaggcacgaacagtgatgcgcttgagatgctttttggcggcgctaatgctttcgggtttctcgatacctttggcggcggcgcactaagcaacttctcgatttttgcaatggggatcatgccttacatcacagcctcgatcgttgttcagcttcttcaacttgatgtagtgccgaagtttgcagaatgggcgaaacagggcgaagctggtcggaaaaagctaacgcaagtaactcgatatggtacgattgttttagggtttgtccaagcgatcgccatgtcagtcggttttaattcaatgtatcaaggagcaggccctggcttgattgaaaatccatctgtgatgacgtacgtctatatcgccatcgtccttacagccggtacagcatttttaatgtggctaggggagcagattacagctcacggtgtagggaatggaatctcgctcattatctttgcaggtattgcagccggcgttccaaacatgctgaatgctttatatacatctgaaattgaaggcgcaggcgaccagttgtttttgagcatcgccaccgttgcattgctcgctttaatcgttttactgattatcattggcgtcatttacgtgcaccaagccttgcggaaaatacctgtccaatatgcgaagcgcgtcgtcaatcgcagccaagtaggcggacagtcaacgcatttgccgattaaagtgaacgctgcaggggtcattccggtcatctttgcctcagcattgttttattttccgtcaaccattgcttcatttgttgggccagaggacaaggcatgggcaagatggattgtggaacatttcgtgccgagttcatggatcggcggcagcatttttgttgtcttgattatcgcgtttacgtatttttacacatttgtacaggttaacccggaaaaaatggccgataatttgaaacggcaaggcgggtatatccctggcattcgtcctggtcaagcaacgcagtcttttatcacgaaaattttatatcggcttacgttcgttggcgctctattccttgcgaccatcgcaacgataccggttgtgtttattgcgctacttgacttgccgcagcaagtgcaaattggcggcacgggcttgttaatcatcgtcggcgttgcgctagatacgatgaaacaaatcgaagggcagctcattaaacgttcgtataaaggcttcatta

SEQ ID NO: 6232 - DNA, 2031 bp, Bacillus clausii
  misc_feature (1)...(2031): n = A,T,C or G
atgtttaaggcgatctccaacatcttccgtgtgagagatttacgtcgaaaaatcgtctttacgcttctgatgcttattgtttttcgaatcggcgcattcatacccgtgccaggcacgaacagtgatgcgcttgagatgctttttggcggcgctaatgctttcgggtttctcgatacctttggcggcggcgcactaagcaacttctcgatttttgcaatggggatcatgccttacatcacagcctcgatcgttgttcagcttcttcaacttgatgtagtgccgaagtttgcagaatgggcgaaacagggcgaagctggtcggaaaaagctaacgcaagtaactcgatatggtacgattgttttagggtttgtccaagcgatcgccatgtcagtcggttttaattcaatgtatcaaggagcaggccctggcttgattgaaaatccatctgtgatgacgtacgtctatatcgccatcgtccttacagccggtacagcatttttaatgtggctaggggagcagattacagctcacggtgtagggaatggaatctcgctcattatctttgcaggtattgcagccggcgttccaaacatgctgaatgctttatatacatctgaaattgaaggcgcaggcgaccagttgtttttgagcatcgccaccgttgcattgctcgctttaatcgttttactgattatcattggcgtcatttacgtgcaccaagccttgcggaaaatacctgtccaatatgcgaagcgcgtcgtcaatcgcagccaagtaggcggacagtcaacgcatttgccgattaaagtgaacgctgcaggggtcattccggtcatctttgcctcagcattgttttattttccgtcaaccattgcttcatttgttgggccagaggacaaggcatgggcaagatggattgtggaacatttcgtgccgagttcatggatcggcggcagcatttttgttgtcttgattatcgcgtttacgtatttttacacatttgtacaggttaacccggaaaaaatggccgataatttgaaacggcaaggcgggtatatccctggcattcgtcctggtcaagcaacgcagtcttttatcacgaaaattttatatcggcttacgttcgttggcgctctattccttgcgaccatcgcaacgataccggttgtgtttattgcgctacttgacttgccgcagcaagtgcaaattggcggcacgggcttgttaatcatcgtcggcgttgcgctagatacgatgaaacaaatcgaagggcagctcattaaacgttcgtataaaggcttcattaactanaaagaaggacgggcaggacaaaagccttacccgttcgtctttttgacttgcaggaaggggatcttaatgaatttaattttaatgggattgccaggcgccggcaaaggaacacaggcggagaaaattgtgaacgactatggcattccgcacatttctacaggcgatatgtttcgcgctgcgataaaaaacgaaacggagcttggcttgaaagcgaagtcgtttatagacgcaggtgatcttgtccctgacgaagtaacaattggaatagtcaaagagcgtttgtcggaagacgattgcgagaatggttttttgctcgatggttttcctcgtaccattgcccaggcggaagcgctggaaggcattctttcatccctcggccaacagcttgaccatgtgttgaatattgcggtcccgaaagaacttctgatggagcgtttaacggggcgccgcgtgtctcctacttcgggtaagacgtaccatattgtttataacccgccaaaagtagaaggcaaatgtgatattgacggcagcgatttaattcaacgcgacgacgacaagccggaaacagtcaaaagacgcctagaagtaaatgaaaagcaaacgaagccactcattgacttttatgaagcaaaaggctacttaagacaagtagacggcaaccaagacatgaacactgtgtatgctgagataaaagcgattctatcggagaagcgtgcatga

SEQ ID NO: 6233 - DNA, 525 bp, Bacillus clausii
  misc_feature (1)...(525): n = A,T,C or G
agaantcagagttttggggntgggtaaaggcgattgccattgcnntaattcttgcgnttgtagtccggacatttgtgatnnccngntttgangttcanggcgtctcaatggtgccgactgctcatgatggtgagcgttttattgtnaataaattaagttancaatttggcgagcctgancggtttgatctcattgtgttccangcnacggaggaagatngctanatcaaacgggtgattggcttaccaggcgataccattcgntttgagnacgacatnctttacattaatggcgagcaantcgaagagccttatttacaagaagcaaaagctgcttattcagggcccgcgtatacggaagattactcatttgaagaaaccgtcccagagaaccatgtttttgtaatgggtgacaaccgccctgctagcttagacagccgtgtcattggcccggttaatgaagatgaaatcatcggcaaagtcggattgcggttttggccggtgtctgaatttggctttatggatt

SEQ ID NO: 6234 - DNA, 456 bp, Bacillus clausii
  misc_feature (1)...(456): n = A,T,C or G
atgttttaaggcnaatctccaacatcttccgtgtgagagatttacgtcgaaaaatcgtctttacgcttctgatgcttattgtttttcgaatcggcgcattcatacccgtgccaggcacgaacagtgatgcgcttgagatgctttttggcggcgctaatgctttcgggtttctcgatacctttggcggcggcgcactaagcaacttctcgatttttgcaatggggatcatgccttacatcacagcctcgatcgttgttcagcttcttcaacttgatgtagtgccgaagtttgcagaatgggcgaaacagggcgaagctggtcggaaaaagctaacgcaagtaactcgatatggtacgaatgttttagggtttgtccaagcgatcgccatgtcagtcggttttaattcaatgtttcaanggancaggccctggcttgaattgaaaaatccatccgttg

SEQ ID NO: 6235 - DNA, 615 bp, Bacillus clausii
tggtatctgttacggcaagatattggattttaacccaagaacagcggattgaggatttggttgagccagttgacgaagaagaggtttttgggctggcaatcagtgttgaacgaattaatgaaatgtatgaaggaacaacaggcaatgaggaaggtgtcgctggtgtaggcgatgagattcccaattatactggcgcagcaggcggtggcgattctgaatcagagcgaactgaagagcggattaattatgaagttaaccggatccaccgggaaatcatcgaaagcccttatgaaatccgcgatttaggaattcaagtaatggtcaacccgccagaagggatgcaagcattgccgcctcagcaaacagctgacatcaccgctatgttagagacgattatccgtacgacattgccagatggtagcgaggaggaaggagaacaggatgttggtgaccgtgtagtggtgacatcaatgccattcgcacaaacggaaacgggagaggcggaacagccggcagcaacgatacctgtctggatttacgctgtagctgctggattagtcttgctgattatcatactagctgtcctgctataccggaaaagagaaccagctgact

SEQ ID NO: 6236 - DNA, 669 bp, Bacillus clausii
atgattgattccattgatatatacatggataaccccccaacttttgatagccaatatccaatccgttttctttctaagattgatatgcacagccatccaaaaaacaacgaagtaaatgaggccaatgaagtttggctaggagaacacgataaacatttaacagaagaggaaaaggtcgtctcttacatgtgcaaactgtattcggcaaaaggaacgttaaaagctatgttagtactgaacgtccgcgcccgtgattttgaagccttgtttgttgatagggaacatcaggcaaatcagcgcatgttagttggcaaaaatggagaagccgttatggtgcatgaaatggaagaagaagtaggaagaatcgtggctgaacaatcttttaaccaagatggaaatagagagcttgaccaggggctagctgtatggtcagcattagagcgtgccgactggtttcttgtcgaggtgacgccatggggagagctaacgaaaggggggaaacgaattacagctgtgcttatagcaattagcctagtagcgatcgcaggggcgctcctgtttgctttgtttctgtctacggcgttttcaaagccaattctccagctacgccaagggtttgtgcaatttggtaaatcacaaaaagtaaatgtgccaaatggctatcaaaat

SEQ ID NO: 6237 - DNA, 396 bp, Bacillus clausii
aacaatttaccgtatttgccgtaggtgaggaatggtatggaattgatattttgcacctttccgcaattgagctccttgacggcattcgtattgtcccaaatgctgaccctgccatcatgggcgtcgttaatattcgcggctccctgctcccggtagttgatctatgttatttgctgtatcagaaaaaaatcgaagcgaccgaaacgtgccgcttgcttgtgtgtgcggaaacacttgggtcatttgtcctggctgtgagtgaagcgagcgacatttgcgaaatcgatcttgcttcgattgaagagctgtctgatgccccttataaaaaggggataagccacgtggaggggaagcttgtaaccattctcgatgggacccagttggccaaggaaattg

SEQ ID NO: 6238 - DNA, 117 bp, Bacillus clausii
gaggactttctgtagggagtgtcgtattaattgcactggtcgcattgctaattttcgggccgaaaaagctgccggaactcggaaaagcagcgggaagcacattgcgtgagtttaaaa

SEQ ID NO: 6239 - DNA, 642 bp, Bacillus clausii
ggatggaagtgcttgaagccgataacttaaaaacaattgtcgaaaatatgatgaaggcgactgtagaacgtgtagttcaaacccattgccctgaatcgctcgttcaggaagaatgggatttggctgctgttgccacctatatcaacgggcaattgctgtctgaaaacggaattagtgagaaagagctgaaagggaaagagcaagaggaactgatcgagttgattaccgaaaaagtcctcgctgcataccatgcgaaagaagcagaagtctcttcagaacaaatgcgcgagtttgaaaaagtgatcatgctgcgcactgttgaccgcaagtggatgaaccacattgaccaaatggatcaattacgacaaggcatacatttgcgcgcttacggccaaaatgatccgttgcgtgagtatcgctttgaaggctttaatatgtttgaagcgatgatcgctgaaattgaagaagaagtatctatgtacgtgatgaaagctcaagtgcaacaaaaccttaagcgtgaggaagtagctgaaggaaaagcggtgaaaccgtcagccaatgggcaagaggacaaaaaagcgaaacggaaaccagtccgcaaagctgaaaacattggcagaaatgatccatgcatttgtggca

SEQ ID NO: 6240 - DNA, 158 bp, Bacillus clausii
ttgattttacgaatggcgagacaatggcgacaacggtccaaattgccttattgctaacggtgctgacgattgcgccaggaattttaattttgatgacatgcttcacccgcatcatcattgtgctagcctttgtacgacaagggctcgccactcaatcg

SEQ ID NO: 6241 - DNA, 645 bp, Bacillus clausii
  misc_feature (1)...(645): n = A,T,C or G
tgaggcgcaaacactcgccaacgtttacttggcattagacaatgacttggaaattttgcctgtaattaataanatcgacttgccaagcgcagagccagaacgtgtgaaaaaagaagtggaagacgtcattggccttgatgcttccgatgctgtactggcttctgccaaaaatggcatcggcattgaagacatcttggaacaggtcgttgagaaagtgcctgcccctgctggcgatccaacggcaccgcttaaagcgttaatatttgactcgctctatgatccataccgtggcgtcattgcttatatccgtatcgtcgagggcaccgttcgtccaggcgaaaaaattaggatgatgcaaacagggaaggaatttgaagtgaatgaagttggcgtattcacgccaaaagcagtcaaatgcgaagaattaactgtaggtgatgtaggctttttaacggcagcgatcaaaaatgtcagcgactctcgtgtcggcgacacgataacaagcgccgtcaatccagcaccagaggcattgcctggctatcgtcgaatgaatccgatggtctattgcgccctttatccaatcgatacaaacnattacaacgatctacgcgaggcgttggaacgcctcgagctgaatgatgcttc

SEQ ID NO: 6242 - DNA, 549 bp, Bacillus clausii
gcacgttacgtgaaacagggcgtgcgctcgattttgccttgaccgaagcggatctcttctataacattgagaccgtagcaggcacgaggctcacgcgcgacggtacgttttacttttctccacaagcagtgggcaacggcttggaactcgtaacgagcgacggcaaccgtgtgcttgacagcgacggagaggcgattgtcatgccaggggatacggtttccttggaatggagggacggcaatttgtttgcccaactcggcaacggaggcgaacagcaagttggttcttttgcgctgacacgcgtgctgcggccgcaaacacttgaatccgcaggcaacaatttgtatgttcttccggagcttccaggcgtttcagaagaagtggaggccgcagacgagcatatgaaacaaaacatgctcgaacaagccaatgtcgacttaggcttggaaatggctgaattgatggagacgcagcgcctattgcaatttcaagcgagggcttactcgtttgcagatgatatggctggtttagcgaacaacattcgccgtt

SEQ ID NO: 6243 - DNA, 393 bp, Bacillus clausii
gccaagttggcggtcgacgccaaggagtgcttgtatccattgaaacaggaaaagcgacccaatatgggattatcaatgtagaagaccgaggcaccatctttgtagaaccaggcacagaaatctacgaaggcatgattgttggcgagcatacacgggaaaatgacttgactgtcaacattacgaaaatgaagcagcagacaaatatccgttctgcgactaaagagcacacggtcacgatgaaacggccgcgcattttgacgctagaagaagcgcttgagtacttgaatgatgatgaatactgcgaaatgacgccccaatcgattcgcttgcgcaaaaaaatcttgaacaaatcagaacgggaacgggaagaaaaacggagaaaaatcgcttcaa

SEQ ID NO: 6244 - DNA, 261 bp, Bacillus clausii
  misc_feature (1)...(261): n = A,T,C or G
ccaatatgtcttttcatctggaagcgattctcggggaggtggggattaaggatgtacgggcgttacgtntacttggggcaaaaatgtgttggttgcgactgcggcagcaaaacagtctggtgacagaaaagattctgtttatgcttgaaggtgccattatcggcattcatgaagctgcgctcccggtggcacgccgccaggagcttgcagaatgggctgactctcttacgccgaaacaggagtttcctgcggaacttgagt

SEQ ID NO: 6245 - DNA, 449 bp, Bacillus clausii
  misc_feature (1)...(449): n = A,T,C or G
ttgatgaaaaaaacaggctggctaattgtactggcgagcatgctgttgtttttatctggctgctttagcgtcaatgagcccgttacggctgacagcgaagggatatggaattcgttttttgtgtatccgttatcacggctcattatcctaattgccggctgggtcagtagttatggctgggcgattattgttgtaaccgttctgtttcggatcgtgcttttgccgttaatggtcaagcagacgaagagcatgaaagcaatgcagcaactacagcccgaaatgcaaaagctccgtcaaaagtacagtgcaaaagataagaacacgcaaatgcagctaaatacagaaatgcanaagctgttttctgagcataaagtgaacccatttgccggctgtttgcctttgcttgtgcaaatgccnattttcttggccatttaccacgcaattattcg

SEQ ID NO: 6246 - DNA, 198 bp, Bacillus clausii
tacagccgcagctacgctttcacagctgcaagcaaagattgacacgatttccaacaatatggccaatgcggaaacaacgggctttaaacggcggtctgcttcgtttgcggatgtcttgacttcagagtatttgaaccaacctaatgaaaacaggcagacgccccatggcttgcgagtcggcacaggcgcaaagttagc

SEQ ID NO: 6247 - DNA, 252 bp, Bacillus clausii
tgacaacgccaatgagttagaacgggaaggagacggcttgtatatgctggaaaatggagagttgccaagcgcccacggcaatccagcaattgatttttccattcgccaggcagcgattgaacgcagcaacgttgacacagcgtcatcaatgaacgctatgcttagcgcttaccgattatttgaagcgaaccaaaaagtggtgcaggcatatgaccaaagtatggacaaagcagttaatgaggtaggacgttt

SEQ ID NO: 6248 - DNA, 269 bp, Bacillus clausii
atgagtttagaaatggttacgcacttagcccaaagcggtgtatggaccgtactgatcgttgctggtccgcttttggttgtagcgttggcgctcggtctgattgtaagtatattccaagcgacgacgcaaatccaggagcaaacactagcatttatccctaaaattgctggcgtgctgcttgcgctcgttttctttggcccgtggatgttgtcgcaactgactgagatggcgtatagcatttacaacaatttgtataggtttattggctg

SEQ ID NO: 6249 - DNA, 783 bp, Bacillus clausii
atggatgaatggctaacgctttatccggcttttttacttatatttattcgcgtcagctcttttttcgtcgtgctgccgcttttcaaccaccggacggtgcctgctccgctcaagctcggactatcggcgtttttggctgcaattctcgcagtatctctcgacgtgcctgagttagcactagatttgccatttttgcttcttgccttaaaggaatttgcgattggcattgctgctggactgatcgcttcgatgattctctatgctgtgcaagttgcgggcggtgtgattgatttccatttaggctttatgcttgccaatgtcgttgacccgcagaccggggcgcaaagcccgttgacaggaagttatttataccttttcgcgatgttatatttgctaattatagacggacaccatttgcttcttgatggcgtaatctacagttatcaatttgtccctcttgaccaactggcgcttccgtttgggagcgggcatgtcatggagcatgtggcgcaagtgatggtgatgctgtttgcgatggcagtgtcgatggctatgcctgtagttggtgcactctttttagttgatgtggccttaggcattatctcaagaaccgttccgcaaatgaatgtgtttgtcgtcgggattccaattaagatgttggcaggttttatcgtgtttgctatctatatcggcgtcttttttatgagcgtgaacgttttatttgaagaattattgcttgcgatgaggcgtctgctagaagggctaggtggtggtccgcaatga

SEQ ID NO: 6250 - DNA, 357 bp, Bacillus clausii
atgtgcgccaagctttatcacggcaaattacaacacaattgacaaacggcggaaacgaattattcgtcatcacgttagccgctgctgttgaaaagaaaattgctgatgcgattggccagaatgagaatggcagctttttggcacttgcgcctgctgattcacaagcgattttacaaaacacggccaaggaagtacaaaaagtggctgaacttggcagacaggccgtgattttatgttcgccggccgtacgaatgcacatgcgccaattaatcgagcgctatttgccccatgttcccgtcgtgtcttataacgaactggaaccggatgtggaagtccaaagcgtaggagtggttaatg

SEQ ID NO: 6251 - DNA, 500 bp, Bacillus clausii
taaaaggcgatgccattgctagcatcattattgtcatcattaatatgctcggcggcctcttgattggcatgatgcaaatgggcatggacatgaacacggcggccaatacatacacgcttctaacagtcggggacggcttggtcacgcaaataccggcattgcttatttctacagctacaggcgtcattgttaccaaggccgcttcagaaggaaacttaagcaccgatctgtcggggcaaattctcgcttacccgaagcttctttatgtaacggcagccactatttttctacttggtttagcaacgccgattacgaaagttgtcacgttttcgatcgcagggttgctcgcttttgcaggctaccgactgtcaaaagcaagcttggcaaaagcgaatttagaagaagcccttttagaagaagcgccacctgaagagccgtctggccctgagagcgtcgtccaacttttgcaaatggacccgattgaatttgagtttggctac

SEQ ID NO: 6252 - DNA, 702 bp, Bacillus clausii
acaagcagccgctggttctgtcaatacatctgtaaaactttccaaatcggatgacgagctacgggctttagggattgcttgcaatgacatgcttgccagcttaaagcaaatgacttcggacattgaggtgaactttgtcgaaaccgataagcgtgtcaaacagctcgctgatgctactgagcgatcttcgagccaaggcgagcaaattggtttgacgatggcagagatcgccagtggcgctgaagcctctgcaaaggcgattcaagaaacggcagcctccttagaagatacgacgcgtatggcaacagaaatgaaagcaaaagcagactcctcaaaaggccaggcggaagagatggttgctactctcgaagaaagccgcaaacggacagattcactcgtgaacggagtgggcgagctatccaaaaagcaagaggcgtctttgcagtctgttcgccgtttagaacagcaagcggcggaagtggaaacaatcgctagtttcgttggctcgatcgcaaaacagacgaatttgcttgctttaaatgcgtcaatagaggcatcaagggctggcgaacatggcaaaggctttgccgtagttgctaatgaagtgcgaaacctggcagatgagtgtgcccgcgctgtcgcttctataggggaattaattgctgccatccaagaagaaatgcagcagacggtggccgatat

SEQ ID NO: 6253 - DNA, 396 bp, Bacillus clausii; identical to SEQ ID NO: 6218

SEQ ID NO: 6254 - DNA, 381 bp, Bacillus clausii
tgattatagccggatgatggtcccgaatatggtgttgttgttttttgccattcctcttgtttttttgcgcgtgtgtgtcgtcccagtaccgttttcgttgcttagtgcaatcagtacagcaatgatgcttcttattctcgtagctgcgtgcctcaatggaagcatgggcggtggcgatttgaaattatttgtcgtgcttgcttttgtgctggggccaaagctgtttttgcctatgctcgcttgttctgcctgtttggctttattatttgtaggaacgaaaacggtagtaggaaaatttgtaccaaacacggcaatcccttttgcgccatttatcagtgcagcagcattgcttgtttattttgcggctgggatttgatcgtt

SEQ ID NO: 6255 - DNA, 336 bp, Bacillus clausii; identical to SEQ ID NO: 6206

SEQ ID NO: 6256 - DNA, 402 bp, Bacillus clausii
atgacaactcagtcgacccttctgccgtttcgccaatcccctcgtgaatgtgggcatacgagtcctttaattgggaaacgccgccggtatagtcgaccaacccttcgtgaaactggctatattggctggctacttcgtcgatgcctgcacttaattgggcaaagccttcgccgatgccaatcgtccccaacgcttcctggagcgagccggcgagttcatcgattccagcagcgatgtcctctaagcccgctttgctttcttctaaaacaggctggacggcgtcaaggccttcttttacagctgcataggtatagtttgactagaggggcgacagtgttttacaaaacagaacctttcgcctttatttatgcaaggacgattacttctgcaaaaggggtgtaa

SEQ ID NO: 6257 - DNA, 288 bp, Bacillus clausii
atggaagaaatcgatcatggcgccgaagagctggcggaagcaacagcagacgtgccagaacaaatgcaagccgaaatcgacgacatgctttcccagtatgacaaatccgatttcgaaccggtttccttcgtctcgccagaaaacaacgacgtcattgaaaacgtccaattcgtctttcaaacagagcgcctaacattgcctgaggaaacgcaaacggaagaagacaacaccgaagaaaacgtgagcttatggcaacgctttttgcagctgtttggcttaggggactaa

SEQ ID NO: 6258 - DNA, 698 bp, Bacillus clausii
  misc_feature (1)...(698): n = A,T,C or G
atgaaagcgagaaggtggattgcattaggagttggggcttttattttgttgttttcagtcattacatcgctatcgctagcgatgaatacatattcccaagccaattggctagcaggagcttatgacgaaagcgtagtgattcaggaaggagatccttctggttcaattgcccttttagaagtaaacggggcgatcattaatacaacaggcgattctctgttttctgctgaagggtacaatcactcaaactttatggatttattttaccaaacgatgagttccccagatgtggaagggattattattgcggttgattctcctggtggcggcgtattggaaagtgcggaaattcatgatgcggtcatcgaagcacaagaaaattacgggaagcccgtttacatttcaatgggttcgatggctgcttccggcgggtattacttggccgctcccgctgagcaaatttttgcttatccgcaaacgttaacggggtcaattggcgtgattatgagttcgttaaacatcaccgaattgcttgataaaatcggtgtcnaagaaacggtttacaaaaagcggcccattccaaagacatgatgagcggtactccgtccgcctactgaagaaagaagatgagattttgcnatccatttgtcgatgaatnctaccatgaattttgtcgaattcattgccaatgggcaggg

SEQ ID NO: 6259 - DNA, 303 bp, Bacillus clausii
aacgatttgcacggggatggccgcctcatttgcagctgttcttcttgtaggagggactaaagggaaacgctgcgctttacctcatgcagaagtcatgattcaccaaccccatggaggtatgaaagggcaagcgtctgatatggacatttacgcacagcggattttaaaacaacgcaaagaaattaacaacttcatcgcggaaaggactggacaaacgcctgacaaaatcgccaacgacagcgaacgtgactactttatgagcgctgcggaagcaaaagactatggcgtgatcgataacattct

SEQ ID NO: 6260 - DNA, 198 bp, Bacillus clausii
aaggccaagctgcagacatggaaatccatgcccgccgcatcattcaaatgcgcgaaaaactcaatcaaattatggcagaacgttctggtcaaccgtacgaacgaattgcaagagacactgaccgtgataacttcatgtcagccgaacaagcaaaagaatacggcttaatcgacaaagtgattgacacaccaacgaaat

SEQ ID NO: 6261 - DNA, 372 bp, Bacillus clausii
  misc_feature (1)...(372): n = A,T,C or G
tgttaaaggggctccaggatggcgaagctcccgaagaggctgggcaacaggaagtccatgaaggcgaatcccagccagaagaaacacngacggagcccccggatattaacgagtttttaactcccatggagcaagacacgatcggcgaaatcggcaatatttcctttggtagttcggcgactgcgttatcagcactgttgaatcaaaaagtcgaaattacgacaccggttgtatcggcagtcagctcagacatgttgcgccngctttttccacggccgaacgtcattgtccatgtcaaatacacagagggattcgaaggctcgaacttatttgtgattacgactgacgacgcagcgatcattgcatatctcc

SEQ ID NO: 6262 - DNA, 372 bp, Bacillus clausii
  misc_feature (1)...(372): n = A,T,C or G
tgcttggaggaaatggggaaaaccctgacccagaattgtcggagatgcatttaagtgcagtccaagaagcgatgaaccaaatgatgggctctgcctcaacgtcgangtagacgttantcaatcgtcgagtcgacntttcgccgcctaaagtggaagtgatcgaatttgatgaacagttgcggacggagtatgttcccgatggtgaagatttgattgcgattttgttttctcttcgcgntggcgatctgattgattcaaagttaatgcaacttattagcgttcctttcagcaaagattacgcaaacgccttgcttggcggcggcgccaccgaagaagcgccagtgcaagaggcacaaccgtcgcctgaacctg

SEQ ID NO: 6263 - DNA, 475 bp, Bacillus clausii
atgactaagggcgaaaccatctcaatcggagagtggaaaattgtcaaaggcgagggtgtcttacggacgtgcggcttaggctcttgtatcggcattgtcttgtatgatcaggaacgagtcatcgccggcatggtccatgtgatgctccctgattcgacgaaggcgcgaaaaggggcaaatccatggcgctatgcggatacagccatcgcctccttgcaggcagagttaaaaaagcagggcgctaggaaactttgcgcaaaaatggcggggggtgcacaaatgtttaaacacgcagtgaaacgtgaatttatgcaaatcggcgagcgcaacgcggcggctgccagagagacactcgcgcgcttaggcatcacacttgttgcagaagacacaggtggaacgaaggggcggacgatccaatacgacgtcaaaacaggcgaattggccgtccgtacggtccatcacgggcaaatgatac

SEQ ID NO: 6264 - DNA, 410 bp, Bacillus clausii
atgaagaagttactgattattggcgcaggcgtattagcgctgttcattgtactcatcattattcaaaccgttaataacaacaaccgtgtagcaaataacgacctgtatgataaagatgacttaaacgcggcaacaattgaccagctgaacgatgaaaattaccaaaacattattatgcctgatgcattggccgaaaaacttgaagcgggagaagatgcagttgtttactttttctctcctacttgccagtattgcaagaaagcaacaccaaaattaatggatgttgccggagaagaagacatccatattgaccaattcaatgtgctagagtacgatgattccgcttatggcattgaatatacgccaacgcttatttactttgaagacggcaaggaagtcaaccggattgt

SEQ ID NO: 6265 - DNA, 348 bp, Bacillus clausii
tcatccacttttggtccattagctgtggcttgtgttaagaggcaatgccaaatgtcaatgaatttcgtgaccaatacaaagacgagctaaatgtcattgctgtccatatgccgcggtctgaaaaagacttaaacattgatgagatcaaacaagttgccgatgagcatgggatcacgcaaccaatctttgtcgataatgaacataagctgacagatgcttttgaaaatgaatatgtgccggcttactatgtgttcgataaagatgggcagctgcgccactttcaagcagggggcggcggtatgaaaatgctgaccaaacgtgttaaccgagtactcggcattaaagaag

SEQ ID NO: 6266 - DNA, 1137 bp, Bacillus clausii
cgattgaaaaagcggttgccgatggagtagacgttttaaatttgtcacttggaaatacggtaaatggaccagattggccgactagccttgctttggatcgcgcagttgacaaaggcgtagtcgctgtgacttcaagtggcaacagcgggccgaatatgtggactgtcggttcacttgggacttcggcaaaagcgatctctgtcggtgcctcactcccgccagtggaaattccttatataacattgacgaatgaaaaggagcgccggcttgaattaacgccactcgttggcgcaaagccatggaagcttaagcgcgacattcccattgtcgaagcaggacatggacttgtttctgattataagggcgttgacgcaaaaggaaagctcgtcttagtaaaaagggggcgttctacttttgctgaaaaaatggagacagcacgaaaagcgggggcaactgggattttaatttacaataatttaaaaggaagttttgcagggggcgttatacagcccgttgacttaatcggggcaagcctaagcaaagaagacggcgaatggctgcttgaacaactggaccactcaaaaaaagaactgtccgtgcgcactggctatgaacaaaagcaagacttgctggcgtcatttagttccagggggccggttactgagacatgggaagtgaaaccagatctcgttgctccaggagtggcgatccagagtactgtaccgaaaggttatttaggcttaaatggaacgagcatggccagtccccatgtggcaggggcagcggctcttttgatccaacaacatccagactggaaccctgaacaagtaaaagcagctttaatgaacacaacgaagcgtttagtcgatgaagagggaagagagtacatgccccacgaacaaggcgctggaaggctgcaagtagacaaggcgcttgaaacgaagacgcttgtctacccgagttcgctaacgttcggcacttgggaaaaaaaagcaccacgtacaaaaagagagctaacgattacgattgaaaacatggaaagcaaagcgagagtgtaccatattgctccgccgctaggagagttggatggaattgagtgggaaacccctttttcggtaaccgttggtcccaacgaaa

SEQ ID NO: 6267 - DNA, 172 bp, Bacillus clausii
  misc_feature (1)...(172): n = A,T,C or G
ctgtgaaaaaacaagttgaaaacggccttttattcgcatgggtgacggccttgatcgcaatgcttggctcgctgtatttctctgaaattcgccagtttgaaccttgcgctctttgctggtatcagcggattttaatgtatcctctagttgtccttttagcgattggnatcat

SEQ ID NO: 6268 - DNA, 432 bp, Bacillus clausii
  misc_feature (1)...(432): n = A,T,C or G
tccatgtcatttccatttccattccgcctttaagagagcngatggaagatttgcctgagctcgtccaatcttttttacaggaatttgctcagcgctatgaaaaaccggtgcctaaattagatccagaagtactttacgcgcttaggactcaaaaatgggaaggaaacattcgccaattgcgaaatttaatcgaacgaattgtgattttgaacggcgaccacgaagggtccgttcattggtaccatttgcctgaatcgtaccaacagaaattgaaacacatgccgttggcttcaaaagacaagccaaaaaaagacgagcgaatggaaatcatcaatgcgctagaaaaaacgtatggcaacaaatcagctgccgcaaaactgttaggcatttcacgggcaacattatacaataaattaaagcactacaaattgt

SEQ ID NO: 6269 - DNA, 311 bp, Bacillus clausii
ttgtttcatatccagattgcccgcaataaacgaaagacggtttttttggtcgccctctttattgtttttgttctcttgatcggcgccgctattacgtacgtgcgtgccggcgattacgtaagcggcgctatttttgccgcggtcatcgccggaggctatacgatctttatgatttccacaagcaccaatgttgtcatgcgcatgaaccacgcccgtgagatcacttcatcaacggaacagccgtttttatggcacaccgtcgagggattagccattgcagcgcggatcccgatgccgcgaatttttattat

SEQ ID NO: 6270 - DNA, 798 bp, Bacillus clausii
agctgtttgcccgtttgatccatcaaatgagcaaccaagccaatggaccatttgttgcaattaattgtgctgccatgccggaaacgcttctcgaagccgagctgttcggctacgaagaaggggcctttactggcgcgcgacgaggcggggctgtagggaaattcgaacaagcaagtggcggtacgctttttttagatgaagcaggagaaatgtcgaatgcgttgcaagcaaagctgcttcgtgtgcttgagacgaaacaagttgaccgggttggcggctgccagccgatccaaaccgattttcggttaattgcagcgaccaatgctaatctggaccaattagtggccgagggcaagtttagaaaagatttgtattataggctagtggcgatcacactaaacatcccgccgttgcgtgaacgtaaagaagatattccttatttaattagcgcctttatggaccgttttgcacaggagtacgcgatgaaacgcaaacgattttgtgaagacgctttgcatgctttccttgaatacgattggcctggcaatgttcgtgagttggcgaatgcgatcgattatattatggcaatcggcgaagaggaagaagtgacaagtgatacactgcctccatttttgcaaaaccaggcaaagaatgaatcattaaaggcggcggcgaggcgttccgagaaggagcgaatcgagcaagcgatcgtattagcaaacggaaataaggcaaaagctgcaaaattgttaggcatccaccgtgcgacactgtaccgtaagctaaaagaacaagagt

SEQ ID NO: 6271 - DNA, 420 bp, Bacillus clausii
ccaccgatttttattggatgccacctggaacggcggccgtaatagcactggtacaatccaaacaggcaacttaactcattccatatcgatcccgaaagaaatgggcggacctgggatcggcacaaatccagacgaaatgctgctcggtgctgccgctacttgttttttgattacgtatgctgccatgcttgagcgggctcaaatcgaggtaaagtcattgacgcttcacgctgaggccgatgtggatgtgacgaataacatctttgaattccgagcaattcgccactttccaacagtggtattaaaagagcagacccaggtggagaaggcggaacgtttagcgtttaaagcagaatcttcttgcatgattacaaaagcagtcgcaggcaatgtcgccgtgtctgttacaccgaatgtgaa

SEQ ID NO: 6272 - DNA, 440 bp, Bacillus clausii
atgaacacaatccttgttactggatttgaagcatttttaacacatcaaaaaaatccaacggaagcacttgtacaaaagttggatggaaccgagatggacggcaccttaatgaaagggattgtgctgcctgtttcgtttgctcgagctgcggaaatgttgatcgaacaagcaacggcgatccgccctaatgcgattgtcatgcttgggctgggagcaggccgaaaacaggtgacgccagagcggattgctattaatgtgatggacgggccgccagataatgaaggagctgtgatgaccgatcaaccgatcaagcaagatggtcctgctgcttacttttcgacgcttcctattcgtaaaatagtcaatgaattaaatcgtgatggatgtccggcaaccatttccaatactgccgggacgtatgtatgcaatgatttaatgta

SEQ ID NO: 6273 - DNA, 281 bp, Bacillus clausii
ttgtctgtgtacgattattcggttaagacgagtgatggccaagaggtgtcattatcaacttacaaaggcaatgtattgctcattgtcaacactgccactaaatgcggctttgcttcacagtttgcagggcttgaaaaactgtacaatgactataaggaaaaaggcttttatgtgctcggctttcctagcaaccaatttttaaaccaggagccggttgccgacgaagacatggaacaggtgtgtaaaatcaattttggcgttacgttcccactgtttgcgaa

SEQ ID NO: 6274 - DNA, 140 bp, Bacillus clausii
atggaaacaagcactgagttgatggagcaagtccaagaagtacttgacaagcttcgtccgtttttgcttcgtgacggcggcgacgttgagctgatgacgtagaagatggccgtcgtaaaagttcgccttctaggggcatg

SEQ ID NO: 6275 - DNA, 1674 bp, Bacillus clausii
aagattcgcacgagcaatttaaagaaacattggcggatgtgctagatacgcccgagagtgcttcttcttatgtagaacgggaatatacgaccatttttaatggagtttctgtaaacttgccagctaacaaagtggaagagttgcttgaacgtgaaggcgtaaaagcaatttatagcaatgatgtggttgagttaattaagcctgtggaggaaaaggccattgatgagcctgtggaagcaatgatggtggacagcattcctttcctcggtgttcatgagctccatgagcaagggctgacaggagcaggtgtaaaagtcggcgttattgatacaggcattgactacgaacatcctgatttaaaagctgtatacaaaggcggttatgactttgttgacgatgatgacgacccaatggaagcgacttatgaggactggcaaaactcaggaatgccagaatttaatgcaaatggaaactcatactatacgagccatggcacacatgtctccggtacagtggcaggaacagcagaaaatgattcagaatatgctgtcactggcgtcgcccctgaagtcgatttgtatgcctatcgtgtcctcggcccgtatggctccggaacaacggctgatgtcattgctggcattgagcaatccgtaatggatggcatggatgtgatcaatctatcactcggaaacaatgccaacgatccaatagcaccgacgagcatagcaacaaacaatgctaccttggctggagtgacggttgtgacatcagctggaaacaatggccgtaatgggctcggcacagtaggcgctcctggggcagcagcattgcctatttctgtaggggcaagcaatgtttctcttacgatccctgaattttcgagtacgtatcaattaggagaggaagagctgacaggcgacctccgtgtcattgccgaatcgtttacaggcaacctagaggatttcagcaaccaaacgcttgagctagttgatgccgggcttggtaccgttgcagaatttgaacaagtagacgtaagcggaaaagtcgcttttgtaattcgtggcgaacttgcatttgttgataaaattgcaaacgctaaagcagcaggagcagaggcaatcattatttataacaatcttccaggggatggccataatccgatctatgctggtgccggccacaactatgtccctagtttttctttaacttatgaggacggagaggcgatcgcttcattattggaagacggggcaacagtaacatttggcgaaatgagtggaagcgtgacgaccggtgatttgctagccgattttagttcacgggggccggtcaactacacagcggcaattaaaccggaagttgttgcccctggggtcgatgtccattctaccgtaccaagctatatggcaggaccggagttcactggcgattatgagtttgcttatcgacgctcttcaggtacgtcgatggcctcccctcacgtggccggggttgcggcactcatgattcaagccaatccagaacagacacctgcggacatcaaaaccaaattaatgaatacggctgtaccaatgacagaggaatacaatgtgtttgaaataggggccggtcgaatcaacccggttgctgcgattgaatcaacagtcatgatccaggcatcaattgacagttacc

SEQ ID NO: 6276 - DNA, 580 bp, Bacillus clausii
atgacaagcacattgacgcctcgggaaattgtagagcggttgaaccaatacattgtcgggcaagacggggccaaacggtctgttgctgttgcactgcgcaatcgctatcgccgtacaaagcttgatccttccatgagggaggaaattactccgaaaaacattttaatgattggccctactggcgttgggaaaacagaaattgccagaaggcttgcaaaacttgtaggcgcgccgtttattaaggtggaggccacaaagtttacggaagtcggttatgtcggccgcgacgttgagtccatggtgcgcgatttggttgagtcaagtgttcgtcttgtcaaagaagagcgggtcgcactcgtgaaagacgaagcgaaagagctggctgacaaacggcttatcgaacttcttgtcccttccatgaaaaaggaaaccaattataaaaatccgtttgaaatgctctttagccagccggataaagaggatgaggaagacggagaagaggaactgacccgtgccaatttaaagaaaaaaatggcggaaaagctaaagcaaggcgagctggaagagcgcatcgttactg

SEQ ID NO: 6277 - DNA, 538 bp, Bacillus clausii
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcagtgccatggggaattagccgtgtgcaagccccagctgcccataaccgtggattgacaggttctggtgtaaaagttgctgtcctcgatacaggtatttccactcatccagacttaaatattcgtggtggcgctagctttgtaccaggggaaccatccactcaagatgggaatgggcatggcacgcatgtggccggac

SEQ ID NO: 6278 - DNA, 342 bp, Bacillus clausii
  misc_feature (1)...(342): n = A,T,C or G
gcccagaatttttaaaccgtatagacgaaattattgtgttccantctcttgagaaaaagcatgtgcgcaaaattattacaatgatggccgaccaactgaaagagcgactttcagagcaaggcatagactttgagctgacagaagaagcaaaggataaaatcactgatatcggttttgatccagaatacggggcacgcccattacgtcgggctttgcaaaaagaagtagaagaccgtttgtcagaggaactgttaaaaggcacgattgtcaaaggccaaaaagcggttatttatgtgaaagatggcaagcttatggtagaaggaaaagaaaaatcaagcattt

SEQ ID NO: 6279 - DNA, 229 bp, Bacillus clausii
atggcgaaacaaaaaacgaagtttgtctgccaagagtgcggctatgaatcggcaaaatggatgggcaaatgccctggttgccaaagctggaacacaatggtagaagaaagaaacatccttgaaaaacaaaaaaaccgtagctatgtaacttccagcggtacacggcaaaagccgcaaccgattacggcggtgcaaggagaaaaggaaccgcgtgttagcacgacaatgg

SEQ ID NO: 6280 - DNA, 486 bp, Bacillus clausii
ttcattgccaaaagacaccggttgctactgaagccaggcaatttatcctctcgcagtacttgcctttgtaggcgctgcagctctctatttcttaccggaatattggtttctgtgtttgtggtctgctttgttggcgggactaaaactggcgcttgatatccgttctgccattgccgaaaaaaacaagcctgcttttttcacggaagaagaaaaaggttgccgtgtcgtcggtgttcttcctggcagcccggcggaaaaaatgggcattgcgattggggaagaaattgcgaaagtaaatggccaacctgtccataatgaacaaacgatgtatcaagcattgcaaatcaatcccgtatactgcaagcttgaagtaaaagacctagcaggggaagcacggtttgtacacgggcctctttacagcggcgagcactaccagttaggggcgttgctcgtgcgccaggaagaacagctagcagattccattgt

SEQ ID NO: 6281 - DNA, 450 bp, Bacillus clausii
caaaactagaaaaagcaacatttgcaggcggttgtttttggtgtatggtaaaaccatttgactcctatgacgggattgaaacggtcacatcaggctatactggcgggcatacgataaacccgacatacaaagaggtatgcagtgaaacaaccggccattttgaagcggtacaaatcgtttatgatgctgctgtttttccatacagcaaacttctggaaattttctggcaacaaattgacccaactgatcctggaggccagttccatgaccgtggggattcctaccggacggctattttctaccataacgaaacacaaaagacagaagcggaacactcaaaaaaacaactagaacagagcggcaaatttagcaagcccatcgctacgctcatattgcctgcaaagcctttttatcctgcggaaggctatcaccaagattattcaaaaaaaa

SEQ ID NO: 6282 - DNA, 400 bp, Bacillus clausii
  misc_feature (1)...(400): n = A,T,C or G
atgaccaagccacaaaaagacgtgttacaaaaaaaattaacgccgatgcaatacttggnanctcacgaaaanggcacggaaccgccttttcaaaatgaatattatgaaacagaanaggaaggcatctatgtanacgttgtttcaggtaaaccgnttttttcttcaaaggataaatannacncaggctggggttggccaagcttcaccaaaccgatngatgaancaaaantcatcgaaaaagaagacnggacccattttatggngcgtncagaagtacggagtaaaaacgctgactcccatttggggcatgtctttccanatggcccagggccaaacggacttcgctactgcatcaactctgctgcattgcggttaattcctaaaacaaaactcaaagaag

SEQ ID NO: 6283 - DNA, 215 bp, Bacillus clausii
gctgaagaaatccagtttggcgaagtttccaccggtgctcataatgacttccaacgagcgacaagcatagcgcggaaaatggtaacggaatatggcatgagcgacaaattggggcctatgcaatttgggcaaagttctggcggtcaagttttcctaggaagagacatccaaaacgaccaaaattattcagatgcgattgctcatgaaattgattt

SEQ ID NO: 6284 - DNA, 381 bp, Bacillus clausii
aaagtacaacacgctatttcagatgaatgtaaagacgattagtgaagaggcaaaagcgattctgttccagcacgattggccgggaaatgcgcgagaacttgaacatacgattgaaggcacaatgaatttaattagtgatgaaacagagattcacatacacaacctgccgtttcgattacgcaatcgctatcagaaagaaggtaaagacacggaaacaggcaacgtgcctacaaaaacattacaagaaaaaatggcagagatcgaaaagctctatattttacaagcgttaagagaaaacaacaacaacgtttcccaaactgcaaaaattcttggcatgagcagacaaaatctccaatatcggctgaaaaagtttcacctttc

SEQ ID NO: 6285 - DNA, 311 bp, Bacillus clausii
aagagaccatttatgatgtgattattgcaggagcgggaccagctggcatgaccgcggctgtgtatacatcccgggctaacttaaatacactcatgcttgagcgtgggatgcccggcgggcaaatggcgaatacagaagacgtggaaaactaccctggttttgaccacattttagggccggatctttccaataaaatgtttgaacacgccaaaaaatttggcgctgcctatgcgtatggcgacattaaagaaattatcgatgaaggcgatacgaaacgggtgattgctggctcaaaagaataccgcgccaag

SEQ ID NO: 6286 - DNA, 258 bp, Bacillus clausii
aagccgacggtgtgtttgtatacatcggcatgctgccattaaatgaaagtgttcagaacttagggattaggaatgaggaaggctatattgtcacgaatgaggaaatggagacaaaagtgcctggcatatttgcagctggcgatgtacgggaaaaatcgctgcggcaaattgtcacagcaacaggcgacggctccattgctgcccaaaatgtccagcattatttagaaaacttggctgaagctgaaaaagtcgagaaat

SEQ ID NO: 6287 - DNA, 867 bp, Bacillus clausii
gtggcgattttggtggttttagcgacatttttgatatgttttttggcggcgaaggtgggcgccgcaatccaaatgcaccgcgccaaggggatgaccttcaatatacgatgacattggagtttaaagaagcggtatttggcaaggaaaccgaaattgaaatcccccgtgaggaaacatgcggtacgtgccatggatcaggagccaaacctggtacaaagccagatacttgttcccattgcggtgggtctggtcaactaaatgttgagcaaaacacgccatttggccgtgttgtcaatcgccgtgtttgtaactattgtgaaggaactggaaaaatcattaagcaaaaatgttctacatgcagcggcaaaggcaaagtgcggaaacgtaaaaaaatcaatattaaagtgccagcaggaattgataatggccaacaactccgtgtagctggacaaggtgaagctggtgcaaacgggggccctccaggcgacctttacgtcgtcttccaagtgaagccacatgaattttttgaacgtgatggagaagacatttattgtgaagtaccgctcacctttccccaagttgccctaggtgatgaaattgaagtgccaactttgactgggaaagttaaattaaaaattccagcaggcacgcaaacaggcactagtttccgtctgagaggaaaaggagtgccaaatgtgcatgggcgcggccaaggcgatcagcatgtgcaagtccgtgtcgtaacgcccaaaaatttaactgaaaatgaaaaagaattaatgcgtgaatttgccggtatgagcggcggaaggccagaggagcaaaatgacggattttttgacaaactgcgccgtgctttcaaaggcg

SEQ ID NO: 6288 - DNA, 1311 bp, Bacillus clausii
accgtataaaagcaattattaaaaagtactctgattttatccgctatccaatcaaaatgaatgtaacagtaagcaaaccaaaagaagacagtgaagacgaatatgcagagtaccaggaagagcaaacgattaacagcatggtgccgatttggcgcaaaaacaaaagtgagctaaaagacagcgattatgaacagttttatcaggacaagcgttacggttttgataagccccttgaacatattcatgtatcagtagatggcgctatccgttacaacgcgattttatttatcccagagcatacgccatttgattattactccaaggagtatgaaaaaggcttagagctttatgccaacggcgtgttgattatggaaaaatgcgcagagcttctacctgactacttcagttttgtgaaagggatggtcgattcagaagacctttcactcaatatttctagggaaatgctccagcatgaccggcaactaaagctgatcgctaaaaatattaagtcaaaaatcaagagccagctaaaaataatgctgaagaaagagcgggacaaatatgagaagttttataaagcgttcgggcgccaattaaaatttggcgtgtacaatgactttggtgcgaataaagaggacttgcaagacttgttgctcttctattcctcaacagagaaaaagctagtgtcgttaagcgattatgtatcgcggatgaaagaagggcaaacgtacatttattatgcgacgggcgagtcgaacgaacgaattgccaaactgccgcagacggaaatggtagctgaccaaggctatgaaattctctatttcactgaagatgtagacgagttcgcgatcaaaatgctccgttcttatgatgagaaagaatttatgtctgtctccagcgccgatttggatattgaaacagacgaaaagcaagaggaagacacgaacagcgaagagaacgaaaaactatttgagaaaatgaaaagcattttagatggaaaagtaaaagatgtgcgcacgtccaaacgtttaaaaagccatcctgtctttttagctgcagatggtgagattacgttagaaatggaaaaagttttacaagcaatgccagacaaccaaaatgtaaaagcggaaaaagtattggaaatcaacccaaaccatgacgtctttcattccttgaaacaagcatatgaagaagacgaagacaagttaaagctatataccaacttgctatacaaccaagcgctccttattgaagggctgcctcttgaagacccagtcgaattctcacaaaacatgtgcaaagtcatggttt

SEQ ID NO: 6289 - DNA, 876 bp, Bacillus clausii
  misc_feature (1)...(876): n = A,T,C or G
aaatgttccgttcgcggattgcggaacggccacctcgcttaccgaaagccgggttatgtcgggaagacgtagaaaacattttgctaaagcttgatccaagcggccgattatgatgtggaaaaggcttgaaaaaggcattatttacatcgatgaaattgacaaagttgcacgcaagtcagaaaacccatcgattacacgggatgtctctggtgaaggggtacaacaagcattgcttaaaattctagagggaacaacggcaagcgtccctcctcaaggcggccgcaagcatccacaccaagaatttattcaaattgatacaaccaatgtcctctttatttgtggaggggcgtttgatgggatcgaacaaatcattaaacggcgccttggaaagaaagtaattggttttggtaccgacgatgccaagcaagatgatttgaagccaggtgaatatttatcaaaagtgcttccagaagatttgctgcgctttggcttaatcccagagtttattggtcgtttgccaatcatttcaagcttgtcgccgcttgacacagatgcgctcgttgaaattttgacaaagccaaaaaatgcgcttgttaagcagtatcaaaaacttctagagcttgatgacgtggagcttgaatttaccgaagacgcgttgcgagaaattgccaataaagcaattgaacgtaaaacaggcgctcgcgggcttcgctccattattgaaggcatcatgctcgacgttatgttngatttgccgtcacgagaagatgcagtcaaatgcatcatccatggtgcatgtgtgacggatgacncaccgncgattttaaaatcagcagacggcactgaactaacattggataaaccgaaagaaagcgc

SEQ ID NO: 6290 - DNA, 480 bp, Bacillus clausii
taacacaggcgtcttaacaattgaagtcgaagcagataaagtcaatgatgctttagataaagcgtttaaaaaagtggtacagaaagtgaatgtccctggttttcgtaaaggaaaagtgcctcgtggcctatttgaaaaacagtttggcgttgaatcgctttaccaagacgcgattgacattctgttgccagaagcttacgcaaacgctgtcgatgaaacaggcatctatcctgtagatcggcctgaaatcgatgtagaaagcattggcaaaaacgaaccgcttatcgttaaagctaccgttacagtaaagcctgaagtcaagcttggtgattacaaaggccttgaagtggaagtgccgagcacagacgtaaccgatgaggatgtagaagctgagcttaaaaagctacaagaacaacatgcagaactcattgttattgaagatggtgaaatcacaaatggcgatacagctgtcattggatt

SEQ ID NO: 6291 - DNA, 612 bp, Bacillus clausii
atggatttcgtttatccaatcaccgtcttgctctatagtttgagcttaattggatattttatcgactttttgactaacaaccaaaaagccaaccgaattgccttttggttgcttttgtttgtgtggggtttacaaactgtctacttcgttatgcggatgtttgaattggaccgactccctttaattactccgtttgaagggctgtttttttatgcatggtcgattgtgaccgtttcgctcttcattaattggaaagtgaaaatggcctttttagtgttcgtcctgaatgtccttggttttgccgttatgtcaggcagcttattcgtcccttctggtgacgtgacacaagcaacgatggatttgcttgcctcggaactgcttgtcatgcatgttgtgtttattttgctttcctacacaggttttactgttgcggccgctgctgcagtgctctatttgcttgcgcaccagcttttgaagcgacggctatgggggaaagcggctcattcgcctagattcgctgccacaaacggagaagttttcatacttcgcatctgtggccagttttccgttttacttagtcggcgtcatctggggcgtcgtttggtcaattag

SEQ ID NO: 6292 - DNA, 494 bp, Bacillus clausii
atggatttcgtttatccaatcaccgtcttgctctatagtttgagcttaattggatattttatcgactttttgactaacaaccaaaaagccaaccgaattgccttttggttgcttttgtttgtgtggggtttacaaactgtctacttcgttatgcggatgtttgaattggaccgactccctttaattactccgtttgaagggctgtttttttatgcatggtcgattgtgaccgtttcgctcttcattaattggaaagtgaaaatggcctttttagtgttcgtcctgaatgtccttggttttgccgttatgtcaggcagcttattcgtcccttctggtgacgtgacacaagcaacgatggatttgcttgcctcggaactgcttgtcatgcatgttgtgtttattttgctttcctacacaggttttactgttgcggccgctgctgcagtgctctatttgcttgcgcaccagcttttgaagcgacggctatgggggaa

SEQ ID NO: 6293 - DNA, 1212 bp, Bacillus clausii
  misc_feature (1)...(1212): n = A,T,C or G
atcttttagaggtttttacatttcacgagaatgaacgcagtacacttgtccaagcattaaagacagggaaagtaacgaaggatgtcaaacaaacgtattttaataataaaggggaagaaatcacaaccattaacaatacctttccttttatcgaaaatggggaaattacagctgctgtggaaattgcgaaagatattacccagctggatcatgtcattaagaaaaacgtgctgcgaaaaagagaaagtcattatacctttgagcaaattatcggcaacagccaagcatttttagcagttgtacaagaagcaaaacgagccgcccgcacgtcgtcttctgtgctaatcgttggggaaacagggacggggaaagagttatttgcccaaagcattcactatgccagcccaagatcacacgccccttttctagcacagaattgcgcagcgatccctgaaaatttaatggaaagtttattatttggcacgaaaaaaggagcatttactggggcactggatacgccaggcttattcgagcaagctgatggcggaacgttgcttctggacgaaataaattctctcgatccagctctgcaagcgaaattattacgcgttattcaggaaaaaaccatccgtcgaatcggcgataccaaagacaaaaaagtcgatgttcgaattattgctacgattaatgaagatccgattagatatgattgcaaagaatcgcttacgcaaagatttgtactatcgcctcagtgtcgtcacttnatttaatcccgccattgcgcgaaagaaaagaagacattcttccacttatcgaggaattcattcacaaagtacaacacgctatttcagatgaatgtaaagacgattagtgaagaggcaaaagcgattctgttccagcacgattggccgggaaatgcgcgagaacttgaacatacgattgaaggcacaatgaatttaattagtgatgaaacagagattcacatacacaacctgccgtttcgattacgcaatcgctatcagaaagaaggtaaagacacggaaacaggcaacgtgcctacaaaaacattacaagaaaaaatggcagagatcgaaaagctctatattttacaagcgttaagagaaaacaacaacaacgtttcccaaactgcaaaaattcttggcatgagcagacaaaatctccaatatcggctgaaaaagtttcacctttcat

SEQ ID NO: 6294 - DNA, 446 bp, Bacillus clausii
  misc_feature (1)...(446): n = A,T,C or G
aggnaagcatcggtgtcatccatgatgtgtctgaattgaatcgcctatcgtcccagctacagcatgcacaaaaacggctggcaacattagaggcgacctattccttttccgaaattgtcggcacttcgaaagagatggcatttgcgattgaacaagcaaagcgcggcgcgaaaacgtcgtttcccattttgctgttaggggaaacaggtacagggaaagaattgtttgcccatgcgatacataacgaaagcgaacggaaagggcagccatttgtccgcgtaaattgtgcagcattgactgagacgctgcttgagtcagagctgtttggctatgaaacaaggtgctttctcaggagcattaaaatctgggaaaaaaagggttgtttgaaagaacagagcatgggcagcattttttttagacgaaaattggaagaaatgtctcctaat

SEQ ID NO: 6295 - DNA, 635 bp, Bacillus clausii
atggcccatgaggggacattattccttgatgaaatcaatgagatgccccgtagttttcagataaagcttctaagagtattgcaagaaaaggaagtccgtagagtaggagggacgaaaaacatccctgtcaacgtacgtattatctgtgcaaccaatcaaccaatggacgagctaatacgtcgtggaaaatttaaagaggatctttattaccgcatttctactttaacattggacttattgcctttacgagacagaaaagaagacattatccctctagctactgtttttttaactaaagaaatggaaagagaaaaccgttttttaaaaatcaaagatgccaaaagcgcacttcggccattactctcgatgagatgggatgggaatgcacgtgaactacaaaacttcatgaaaagattggtcattacttatcaaggaagtgtgattacagcagacggagttcatttgctattaaacaaagcgaaaaaaaagagcggagaagtaaccattccgatttcaacctctttcaaagaaatggaaagtcacctttgggcacaactatacagccaatttaatggaacaaaagaggaattctgcaaccactacaaaattagccaaaccactttatggcgaaaact

SEQ ID NO: 6296 - DNA, 1242 bp, Bacillus clausii
atgaaagaaattttagtaatagcaccgtttgatttaacagatgctcaaatcgttaaaatggaaaactctctaaaagaactcccttatcaattccgtttcatggaaacgttacttccttatgagaaaaacctcgacgccatatctccatcgaccagcgcgattgtttcaagaggcgggttaggtgaatttctccgaagccatacctctataccattcattaaaattcccgttaccccctatgatctgctccgttccattacttctgtatacaataaaggctatcaacggattcaggtcatgttttttgcaggaatatttaatgatatggattttattgaatgtgacttcggtgcattacaaattaaaatagaaagttatcgagaccaagcttatgcaaaagaacacattaaacagttaactaaaaggaaaacagtagatgccattatcggggaccggtttgctacggatgcaggtaatgaagcaactattccttcttttttagtgaaatcaggtgaagaagcacttgttttcgctgttgaacaagcgattgaaacattaaacattcaattagaagaagaagctaaaacaaaagaacttgattccattcttcaagttgtccctcaagcggttataaacgtagatgcaaatgacgacattaaaatgtttaatgaacaagctaagcatatttttccagaattgaaggaagcgttgcctgaatttaattacaccgatatctttaagagtaaggaattgcaagatcaacttaaagcccgaacgattcaacgaaacatcctgacacctattaacaatcaacaaatgctcgtaacgaccacccctattttttctaacgatatgtacgttggtgcgattcaagtattcgaaagactagcggactttcagaaacttgagatgaaaattcgaaaagaagtatacaaaaaaggacttacagcaaagcatacttttgcggatatcgtttgtgagaataaggaaatgaagagattggttagcgaagctgccgccttttcacgttcagaaggttctgtcttaatctatggagagacagggacaggcaaagaattatttgctcaaagcattcacaatgcaagcgatcgccatgcccaaccttttgtatcattaaactgtggggctttaaatgaaaacttacttgaaagtgaattatttggttatgaagatggtgcttttaccggcgcactaaaaggagggcgtgcagggctgatttga

SEQ ID NO: 6297 - DNA, 1145 bp, Bacillus clausii
atgaaagaaattttagtaatagcaccgtttgatttaacagatgctcaaatcgttaaaatggaaaactctctaaaagaactcccttatcaattccgtttcatggaaacgttacttccttatgagaaaaacctcgacgccatatctccatcgaccagcgcgattgtttcaagaggcgggttaggtgaatttctccgaagccatacctctataccattcattaaaattcccgttaccccctatgatctgctccgttccattacttctgtatacaataaaggctatcaacggattcaggtcatgttttttgcaggaatatttaatgatatggattttattgaatgtgacttcggtgcattacaaattaaaatagaaagttatcgagaccaagcttatgcaaaagaacacattaaacagttaactaaaaggaaaacagtagatgccattatcggggaccggtttgctacggatgcaggtaatgaagcaactattccttcttttttagtgaaatcaggtgaagaagcacttgttttcgctgttgaacaagcgattgaaacattaaacattcaattagaagaagaagctaaaacaaaagaacttgattccattcttcaagttgtccctcaagcggttataaacgtagatgcaaatgacgacattaaaatgtttaatgaacaagctaagcatatttttccagaattgaaggaagcgttgcctgaatttaattacaccgatatctttaagagtaaggaattgcaagatcaacttaaagcccgaacgattcaacgaaacatcctgacacctattaacaatcaacaaatgctcgtaacgaccacccctattttttctaacgatatgtacgttggtgcgattcaagtattcgaaagactagcggactttcagaaacttgagatgaaaattcgaaaagaagtatacaaaaaaggacttacagcaaagcatacttttgcggatatcgtttgtgagaataaggaaatgaagagattggttagcgaagctgccgccttttcacgttcagaaggttctgtcttaatctatggagagacagggacaggcaaagaattatttgctcaaagcattcacaatgcaagcgatcgccatgcccaaccttttgtatcattaaactgtgg

SEQ ID NO: 6298 - DNA, 369 bp, Bacillus clausii
  misc_feature (1)...(369): n = A,T,C or G
attattttattcgcgacttaagtgcttttacaggcaaccgtgttgtcgttatcggcggcggcgattcagctgttgactgggcgctcatgcttgagccaattgccaaagaagtcacgctcgtccatcgccgtgacgccttccgtgcccacgagcacagcgtcgatttgcttaaaaaatcgtctgtacgaattttgacgccctacgaaacggcngagcttcntggcgacgaaaacggcgtnnctgcggtaacattttcagaagtcanaggggatcagacagaaacgattgctgttgatgacgtgatcgtnaactttggcttcgtgtccacgctaggccctatcaaagagtgggggcttgaaatccgcaaat

SEQ ID NO: 6299 - DNA, 429 bp, Bacillus clausii
atggggcagttatccttttttgaatctgtaggaaaagctggaggatataaaatgatagataccactttaacagccattagtagctttttgctgcacccgcttttttacataggcattgctgcttttgcctttattggcgctgttcgcgttgcgaaagaaagagcttcttttcatacacgggtttacgccaaacgtgctgattttgtcctcagcctcttgcctggcttgcttgccggcctgatcgcaagcttcgtgcttattggctatggcttgacgctgaccactccagttttgctgcttgtagcagcggcaagcttgctattactactaactggccggatgcagctacaatcgcctgcttactacatccctttagcagcatttgcgctcgctttgttgccaagccttacgttaccaaacattggctag

SEQ ID NO: 6300 - DNA, 267 bp, Bacillus clausii
gagatcgcatcttcattgagcaaatccaatctgaggaaaaaactgcaagtgggattgttttgcctgattctgcaaaagaaaagccgcaagaaggcaaggttgttgctgtcggcactggtcgcgtaacagacaacggcgaaaaagtggcacttgaagtaaaagaaggcgattcaatcatcttctctaaatatgcaggtacagaagtgaagtatgaaggcacagaatacctcattcttcgcgagagcgatgtactagcgattattggct

SEQ ID NO: 6301 - DNA, 400 bp, Bacillus clausii
  misc_feature (1)...(400): n = A,T,C or G
atggctaaagatattcaatttagtgaagaagcgcgccgttccatgcttaaaggcgtagatactcttgcaaatgcagtaaaagtaacgcttgggcctaaagggcgcaacgttgttctagaaaagaaattcggttcaccactcatcacaaatgacggtgtgaccattgcaaaagaaatccaacttgaagatgcttttgaaaatatgggtgctaagctggttgctgaaatagccagcaaaacgaacgattttgctggtgacngaacacaactgccgacngtcctttgccccaagcaatgattcgcgaaggcttgaaaaacgtttcttccgggtgccaaccccatggggcatccgccaaaggaattgaaaaaagccacggctgctngcagtttaaagaaacttt

SEQ ID NO: 6302 - DNA, 603 bp, Bacillus clausii
gaaaaacatttgtccgtgccggttatttttggaaaaaggggcttctggcagtggcgagtcagaggcagatttggtattgcttgatgaaacgcatattcaattgacagcgcttcaacgggccgcggatgttctttcacgccttgatgcacttatcgggctcgaagaagtgaagcgagaagtaaaaaaactgactgcgtacgcgaaagtaaaagaagcacggcgtgacatcggtttagccgtaccgcttatgccgctccatacagtgttttcaggggctcctggcacagggaaaacgacagtagccaggctttatgcggaagcactaaaccaaattggtttgttgaaaaagggccatgtagtcgaagtttctcgcagcgatctcgttagcgggtttgtagggcagacggcattgaaaacagagagagtgattgaagatgcccttggcggcgttttgtttattgatgaagcgtattctctggcgcaaggcggcgcgaatgactatggcaaggaagcgttgaccgcattaacgcaagcaatgacgacccatgaagccaacttagttgtcgtctttgctggctatggcaaagaaatggcgcagctgtt

SEQ ID NO: 6303 - DNA, 525 bp, Bacillus clausii
  misc_feature (1)...(525): n = A,T,C or G
gcgcagcaaaagtcgttgtaacaaaagaaaccncancgattgttgaaggtgctggcgacccagaacaaatttctggccgcgtcaaccaattgaaagcgcaagtagaagaaacgacttctgaatttgataaagaaaaactacaagagcgtcttgctaaacttgctggcggcgtcgctgttcttaaagtaggcgcagctactgaaacagaaatgaaagaacgcaagcttcgcattgaagacgccctaaactctacacgtgctgctgtagaagaaggcatcgttgctggtggcggtacagcacttgtcaacgtgatcaaagcagttaaagcagttgacgctacaggtgacgaagcaacaggcgtaaacattgtgctccgcgctcttgaagagccagttcgccaaattgcccacaatgctggtcttgaaggctctatcattgtagagaagcttaaatctgaagaggttggcgttggctacaatgcggctacaggcgaatatgtgaacatggttgaaacgggcttcttga

SEQ ID NO: 6304 - DNA, 792 bp, Bacillus clausii
  misc_feature (1)...(792): n = A,T,C or G
aatgcacggctgcgtttatgcgtgtcgcaaaaacaaagggagtggcantatttattgtcggccatgttacaaagcaaggctccattgccggtccaaagctgctcgagcatatggttgactctgttctctattttgaaggagagcggcaccacagttaccgcatattgcgtgcagtgaaaaaccgatttggctccaccaatgaaatgggcatctttgaaatgaaacagcttggcttagaggaagtgaaaaacccatcggaaatctttttggaagaacgttctcaaggagcagctggctctgtcgttgtcgcttccatggaaggcacaaggcctgttctcgtagaattacaagcgctcatttcgcctatgggttttggcaatcctcgcagaatggccacagggcttgaccataaccgtgtctctcttttaatggccgtcttggaaaagcgggcgggcatgctcttgcaaaaccaagatgcttatttaaaaatactgggaagccgttaagttagacgaaccaagcgatcgatttggcgaattgctcttagcattgcttcnagtttccgagcccagccaccagacccgatggatgtagcgattggcgaagtagggttgacgggggaaatccgccgcgtctctagaattgaccaacgcgttaatgaagccgcgaaactaggctttaaacgtgtcatcatacctgaaaaaaccaaaggcggctggactgcgccagcaggcatcgaagtgattggcgtgcagacgctcgaacaagcgattgaagttgttttagggaggt

SEQ ID NO: 6305 - DNA, 648 bp, Bacillus clausii
  misc_feature (1)...(648): n = A,T,C or G
gcttaaagcaacaaagcaagtgttccatatgattttttaaagncattccagggacagggaaaacgacagttgctcgcattgttgtttcttttnaacacgaaatgaacgtgctctcaaaggnccacttattggaaatggagcgtgctgatttagttggcgaatacattggccatacggcgcaaaagacgcgggaagtgctgaagcaggcaagcggtggcgtgctttttattgatgaagcntattcgttgtcacgaggtggggaaaaagacttcggcaaggaagcgatcgatacgttggtgaaggggatggaaaacaacgccaatgacttcgtgcttattatcgccggctattcaaaagaaatggattactttctgtcattaaaccctggcttgccttcaaggtttccgatttcaattacgtttcctaattataacgttgacgagttgatggaaatgttaatcgggatggcaaaagaacgagattacatgctgtcggaggaggctttgcaagaatgccgtgagcatattcgcaaagtcgcgtctgaacaggaaagaacatttagcaatgggcgctacattcgcaatatggtcgaagaggcaatccgccagcaagcggtacggattttaaaacaaaacgattatacaaaaa

SEQ ID NO: 6306 - DNA, 696 bp, Bacillus clausii
  misc_feature (1)...(696): n = A,T,C or G
agatttatctggcgttacgcaaacgcaaatttcgttgccatttattactgctgatgcaacaggtcctaagcacttagagttaacattgactcgtgcgaaattcgatgagttgtctgctgaccttgtagaacggacgcttggcccaacacgccgtgcgctctccgatgctggtctgtccgcatcggacatcgacaaagtcgtccttgttggtggatagactcgtatcccggctgaacaagaggcaatcaaaaaggtggcgggcaaagaccttcataaaggcgtcaaccctgacgaagtagtagcgcttggggctgcagtgcaagcaggtgtcttgactggtgatgttaaagacgttgtgcttcttgacgtaacaccattgtcccttggaattgagacgatgggcggcgtattcacaaaactaatcgaacgcaacacgacaattcctacgtcaaaatcacaagtgttttcaacagctgctgacaatcagccatccgttgatattcatgtgcttcaaggggaacgggaaatggctgccgacaacaaaacgcttggccgtttccagttaacagacatcccgccagcaccacggggagttccgcaaattgaagtgacatttgatattgacgctaacggcattgtcaatgttaaggcgaaagatnttggaaccnacaaagaacaatngattacaatcacgtc

SEQ ID NO: 6307 - DNA, 480 bp, Bacillus clausii
aaaacgggctgatcgttcatttgaagtgacgacgacaaaaggaacacttgaagcgaagcatgtgattgtggccacaggctattatgattctcctaatatgatgggaataccaggtgaagataaaagccatgtgatgcactattttaaagaagcccatccttatttcgaccatgatgtggttgttataggcggcaaaaattcggctgttgatgcagcgcttgagttagaaaaagcgggtgcccgcgtcactatgctttatcggggcagcgattattcagcaagcgtaaagccgtggattttgccagagctcgtgtcccttgtgcggaatgaaaaggtcaaaatggtctttcatgctgatgtgtatgagattacggatagccacgtacactaccggatagggaaacaagagcacaaagctaaagcgcagtttgtgtttgcgatgaccggctaccatcctgatcactcttttattcgcagtct

SEQ ID NO: 6308 - DNA, 222 bp, Bacillus clausii
aacaagtagtgcttgccggtggagtcgctgctaataaggggctgcgcaaagcactgacagaagcgtttgccaacaaagacgtaacgttgttggttccgccactatcattatgtacggacaatgccgcgatgatcggcgcttgtgcccacagcatgtggttacatggcatttctgggaatatggctatgaatgcacggcccggactgccgctttcctcatttt

SEQ ID NO: 6309 - DNA, 750 bp, Bacillus clausii
  misc_feature (1)...(750): n = A,T,C or G
ggacggcacccgcgttccagctacgcttgtaggccaagatgaaataacagacttagctgtccttgaaatcgatggcgaaaacgtcacaaccgttgccgagttcggcaattccgatgaattaagcgtcggcgaaccagcgattgcgataggcaacccgcttggccttgaatttgccggcagcgtcacacaaggcattatcagcgcgacagaacggagcattccagtcgatttaagcggcaatggccaaattgattggaatgcagaagtactgcaaacggacgcagcgattaatcccggcaacagtggcggtgcacttattaacattaacggcgaagtcatcgggattaactcgatgaaaatttccggcggtgcagaaggattaggctttgcgatcccttcttccatcgtgcagccaaccatcagcgacttagaacagtacggcgaagtgcgacgcccaacactcggcatcactttgcgctcgctcaatgaactgccaagttccgctctccaaggaacgttgaacttgcctgaagacgtgacagaaggcatcgtcatcgtcggcgtccaaaacggcagcgctgcagccgatgcaggcctgcaagaacgagacgtcatcgtcgaaattgacggcaaagcgattgaaaaccctcaagagttgcgcaaactcttatacgctgaacgctncatcggcgacaccatttccgtcacactctaccgtgacggtgacaaacaaacaatcgatgtcaccct

SEQ ID NO: 6310 - DNA, 750 bp, Bacillus clausii
  misc_feature (1)...(750): n = A,T,C or G
acggcacccgcgttccagctacgcttgtaggccaagatgaaataacagacttagctgtccttgaaatcgatggcgaaaacgtcacaaccgttgccgagttcggcaattccgatgaattaagcgtcggcgaaccagcgattgcgataggcaacccgcttggccttgaatttgccggcagcgtcacacaaggcattatcagcgcgacagaacggagcattccagtcgatttaagcggcaatggccaaattgattggaatgcagaagtactgcaaacggacgcagcgattaatcccggcaacagtggcggtgcacttattaacattaacggcgaagtcatcgggattaactcgatgaaaatttccggcggtgcagaaggattaggctttgcgatcccttcttccatcgtgcagccaaccatcagcgacttagaacagtacggcgaagtgcgacgcccaacactcggcatcactttgcgctcgctcaatgaactgccaagttccgctctccaaggaacgttgaacttgcctgaagacgtgacagaaggcatcgtcatcgtcggcgtccaaaacggcagcgctgcagccgatgcaggcctgcaagaacgagacgtcatcgtcgaaattgacggcaaagcgattgaaaaccctcaagagttgcgcaaactcttatacgctgaacgctncatcggcgacaccatttccgtcacactctaccgtgacggtgacaaacaaacaatcgatgtcacccttg

SEQ ID NO: 6311 - DNA, 396 bp, Bacillus clausii
ttgtttacacatcatccgcaacagcacaaggcggacgtgaagggcatgttaaatcagatgatgcaacgattgacttagaccttgtcaaaccaggttcgaaaaaggaaggctcaaatccagagcaattgtttgcagctgggtatgcttcctgttttgacggcgcattgaacttaatggcagagaaagcgaaaaaagaaattgactcgaccacaaccgcccatatctctctcgttaaagacccatctgacggagggtttcaaataggcgccgaacttgaagtagtagtcaaaggcgtatctgaggaagaagcacaggaacttgtcgaaaaagcacatgagttttgcccttattcaaaagcaacacgtggtaacatccaagtgaagctgactgcgaaag

SEQ ID NO: 6312 - DNA, 1112 bp, Bacillus clausii
gtgagcaaacgagattactatgaagtgcttggcgtagaccggaatgcttcagtagaagaagtaaaaaaagcatatcgaaaactagcgcgaaaatatcaccctgatgtcaacaaggaagaggacgctgaggcgaaattcaaggaagtaaaagaagcctatgatacattgagcgatccccaaaagaaagcccgttatgaccagtttggccatgcagatccaaaccaagggtttggaggagccggcgcaagtggcgattttggtggttttagcgacatttttgatatgttttttggcggcggaggtgggcgccgcaatccaaatgcaccgcgccaaggggatgaccttcaatatacgatgacattggagtttaaagaagcggtatttggcaaggaaaccgaaattgaaatcccccgtgaggaaacatgcggtacgtgccatggatcaggagccaaacctggtacaaagccagatacttgttcccattgcggtgggtctggtcaactaaatgttgagcaaaacacgccatttggccgtgttgtcaatcgccgtgtttgtaactattgtgaaggaactggaaaaatcattaagcaaaaatgttctacatgcagcggcaaaggcaaagtgcggaaacgtaaaaaaatcaatattaaagtgccagcaggaattgataatggccaacaactccgtgtagctggacaaggtgaagctggtgcaaacgggggccctccaggcgacctttacgtcgtcttccaagtgaagccacatgaattttttgaacgtgatggagaagacatttattgtgaagtaccgctcacctttccccaagttgccataggtgatgaaattgaagtgccaactttgactgggaaagttaaattaaaaattccagcaggcacgcaaacaggcactagtttccgtctgagaggaaaaggagtgccaaatgtgcatgggcgcggccaaggcgatcagcatgtgcaagtccgtgtcgtaacgcccaaaaatttaactgaaaatgaaaaagaattaatgcgtgaatttgccggtatgagcggcggaaggccagaggagcaaaatgacgggttttttgacaaactgcgccgtgctttcaaagg

SEQ ID NO: 6313 - DNA, 1778 bp, Bacillus clausii
  misc_feature (1)...(1778): n = A,T,C or G
atgagcaaaattattggtattgacttagggacaacaaactcttgtgtggccgaaatggagggcggtgaagccaccgttatcccaaacccagaaggcaaccggacaacgccttctgtagtcgcttttaaagatggtgagcgtctcgttggggaagtggcaaagcgccaagcgatcactaacccaaatacggtcatttccattaaacgccatatgggtactgattacaaagtagatattgaagggaaaagttactcccctcaagaaatttcagcgattattttgcaaaagttaaaagccgatgcagaagcatatcttggcgagaaagttaccaaagcggtcattaccgtgccagcttattttaatgactcccaacgccaagcgacaaaagacgcgggcaaaattgctggccttgaagtggaccgtatcgtcaatgagccgacagctgctgctcttgcatatgggcttgaaaaagaagatgaccaaacaattttgggttatgaccttggcggtggaacattcgacgtttccatcctagagctagganacggcttcttcgaagtaaaagccacttctggcgacaacaaactangcggcgatgattttgatgaantgatcatggatcatcttgtagcanagtttanaaaagaaaatggcatcgacttgtcgcangataaaatggcgatgcaacgcttaaaagatgcttgccgagaaagcgaaaaagatttatctggcgttacgcaaacgcaaatttcgttgccatttattactgctgatgcaacaggtcctaagcacttagagttaacattgactcgtgcgaaattcgatgagttgtctgctgaccttgtagaacggacgcttggcccaacacgccgtgcgctctccgatgctggtctgtccgcatcggacatcgacaaagtcgtccttgttggtggatagactcgtatcccggctgaacaagaggcaatcaaaaaggtggcgggcaaagaccttcataaaggcgtcaaccctgacgaagtagtagcgcttggggctgcagtgcaagcaggtgtcttgactggtgatgttaaagacgttgtgcttcttgacgtaacaccattgtcccttggaattgagacgatgggcggcgtattcacaaaactaatcgaacgcaacacgacaattcctacgtcaaaatcacaagtgttttcaacagctgctgacaatcagccatccgttgatattcatgtgcttcaaggggaacgggaaatggctgccgacaacaaaacgcttggccgtttccagttaacagacatcccgccagcaccacggggagttccgcaaattgaagtgacatttgatattgacgctaacggcattgtcaatgttaaggcgaaagatcttggaaccaacaaagaacaatcgattacaatcacgtcttcttcaggcctatcagaagaagaaattgataaaatggtacaagaagccgaagcaaatgctgaagcggacaaaaagcgtcgcgagcaagtagaattgcgtaacgaagcagatcagctcgtcttttcgactgaaaaaacgttaaaagatttaggcgacaatgttgatcaagcagaaaaagacaaagccgaagcggcgaaagacaagttgaaaaaagcacttgaagccgacaacacagacgacattaaagctgccaaggacgaacttcaagaaatcgtcactgctttgacgacaaagttgtatgagcaagcggcacaagctcaacaagacagcggcaaaggaaggggaggaaaggaaggaggcaa

SEQ ID NO: 6314 - DNA, 567 bp, Bacillus clausii
  misc_feature (1)...(567): n = A,T,C or G
agaacgaggnaactgcaaacagaagaaacagaacaaacaaaagtagaagacggccacggcgtattccgctgagcaagaagagactgaaaacaatagcggaagtgaagttgaagaacaagaagagccagaggttcaccctcttgaaatagagctaaatgaattaaaagaccgtctcgctcgcgttcgtgctgattatgaaaattttcgccgtcgcacgaaagaggagaaagaggcgcaggcaaaataccgcgcccaaggctttattgaaaaattgctccctgcacttgataacttcgaacgcgctttgttggtcgaacctaaacatgaagaagcaaaacaattgctccaaggaatggaaatggtgtaccgccnngtataacaagcattaanacaagaaggggtagaaccgattcctacagaaggtgagctgttcgacccacatctccaccaagcagtaatgcaagtgggagaggaaggctatgagccgaaccaaattgttgaggaacttcaaaaagggtacaaactaaaagaccgagtgattcgtcactcaatggtgaaagtaaatca

SEQ ID NO: 6315 - DNA, 900 bp, Bacillus clausii
  misc_feature (1)...(900): n = A,T,C or G
aaaatgagtggaagaaaaagcaaggtcaagaaaacacggaagtattggttgaggatattgcccaagttgtttctagctggacaggaattcctgtttccaaactagcggaagaggaaacggaacgcttgttgaaaatggaagagattctccatgagcgtgtcgttggccaagaagaagctgttaaatccatttcgaaagcgattcgccgtgcccgcgctggattaaaagatccaaagcggccaataggatcagganagttccttggtccaactggtgttggtaaaactgagcttgcccgggctgtagcagaaacgttatttggcgatgaagatgctgtcattcggattgacatgtctgagtatatggaaaaacatgcaacaagccggctagttggctcacctccaggttatgtcggccacgaagagggtgggcaattaacggaaaaaatccgtaagaaagccatactctgttatactgcttgatgaaatcgaaaaggcgcacccagatgtatttaacttgcttttgcaagtattggaagatgggcgtttaacggattcaaaaggacggactgtcgatttccgtaatacagccgtcatcatgacatccaatgtngggtgcttcccagcnttaaacgcaacaagtatctcggctttacgattgaatcggaagggcaagagtacaaagacatgaaagaccgtgtcatgtctgaaactgaaaaacagcttccgcccagaaatttttaaaccgttattagaccgaaaattatttggtgtttccacttctccttggaagaaaaaaaaagccattgnttgccggccaaaattattacaatgatggccgaccaactganagagcgactttcagagctaggcatagactttgagctgacngaanaaagca

SEQ ID NO: 6316 - DNA, 1041 bp, Bacillus clausii
tcttcggactgttttactacaagttaggcttgcacgaactgtatagttcgtggtggtatattgctttaattgtcgcacttggcatctccattattgttgccagcattgaccgtggcgttcccttgtataaagcgttaaagtcgcaacgggtaacgcgccataagcattttatgacaaggcagcgtttattttcaaagacagcaatcgcgccttcagaagcggagcgagcgattgctgaagcggcagaaaggctgaaacagaaacgctaccgcattcgtgtcgaaaatgggaacgtacttgcggaaaaaaaccgctttgcccgttggggcccgtacgtcaaccatttaggcttaattttgtttttgatcggttgtttgctccgctacattccgggcatgtacgtggacacgcaaatgtgggtccgtgaaggagaacaaagccctataccagaaacagatggttactttattgaaaaccgtgggtttaagttggagctatacgacgaaaatgatgagcgctttcaagatgcatttgcatcaagcaatgcagtcgttcctgagacgtttgaaaccgatgccgttctttataaacggcaagaatcaggaattgtcggagagagtggcgagcttgaacaggtgcaagaaaagaagattcgtgtcaacgatccgctcaaatttgattcattttccctttaccaaatggattatcgcttaaatgagttgcatgaaatgacgtttacattggaacataaagacactggcgatacatttggcgaactaaccgttaatttacttaaccctgaggaattttatgatcttggtgacggatatgccgttgaacttgctgattattatcctgattttcatataaataacaataaggaaccagctacacgttcaagtgtgccgaataacccatactttgtttttaagatgtatacacctgataccccagatggtgaaacaagtatggtcggtatccaacaaaatttagaaccgttaggggaaaataaatataaaatgacatttgtcgatgtcgatt

SEQ ID NO: 6317 - DNA, 210 bp, Bacillus clausii
cgatcttgctgcccctggagaaaatattccgagcacatacaaagacaaccaatatgccgtattgtcaggaacatcaatggcttctccacacgttgccgggcttgccgccttattgcgttcagcgaatccagacttaaacaacgatcaaattggcgacatcattcttggcgcatgcgaccagcttggcgatggcgactataacgtctatta

SEQ ID NO: 6318 - DNA, 1056 bp, Bacillus clausii
atgaaaaaacctgcaatatggggaatcgcactggctgcccttgcaattgctggcatggtttttacaagccaagtcgaacaaagccagccacatacagccgttttcgattcacaccagcctaaaagtcgtgtccactctacttcaaaagaccggttaatggcagaagacttggcaaaaacaacaacgcttttcatctcctccctatccggccaattagaaaaatgggccaatacccagggagagagcctgacggatgattttcaacaagaactaaatgaacatccttatatctctggcttttccgttttggatgaaaaaggttcgccgcttttagctgccggtacgatctcaaccatcgatacaagcctgttgatccatcaagataacggcatgcattattcgaatccttataacaaaaacggcaacacttttatgcttatgggcaaggacaaagacgacggacaacgtattataggggaaatcgacctcagctttatccaatcctatctggctaaaacagcagcgatcgctgacagttccggaacgttttttgtcaatggaagcgacccaaatgtccaattctcttccgttgatgaacttccagacgagctggaagctcaggcagtccctggactaggatggaatatttacgtcaaatctgaagacaatgtggccatacagtcctttcacgaaaaccaagcagtcgtgaaattgccgccgcaaataaatggaaacgaatgggcgcagacaaaaggatatgaactgctagccgacaaccacccttattatattgtgaaggacgggaacaaagcgcttcagccactgatcgaagatttgcagcaagatgaaaccgtgttgtttgccgagccaaactatgccttttcgaatcaagtccgtacagtagaaaagaaagtggagccaaacgacgaatatttcaagccataccaatggaacttaaacaaatccacgcagacgaaggctggaatttcgccaatggcaccgatacgaccattgcaatcattgatacgggtgtggatcctaatcatccagatttaa

SEQ ID NO: 6319 - DNA, 939 bp, Bacillus clausii
aatcgcactggctgcccttgcaattgctggcatggtttttacaagccaagtcgaacaaagccagccacatacagccgttttcgattcacaccagcctaaaagtcgtgtccactctacttcaaaagaccggttaatggcagaagacttggcaaaaacaacaacgcttttcatctcctccctatccggccaattagaaaaatgggccaatacccagggagagagcctgacggatgattttcaacaagaactaaatgaacatccttatatctctggcttttccgttttggatgaaaaaggttcgccgcttttagctgccggtacgatctcaaccatcgatacaagcctgttgatccatcaagataacggcatgcattattcgaatccttataacaaaaacggcaacacttttatgcttatgggcaaggacaaagacgacggacaacgtattataggggaaatcgacctcagctttatccaatcctatctggctaaaacagcagcgatcgctgacagttccggaacgttttttgtcaatggaagcgacccaaatgtccaattctcttccgttgatgaacttccagacgagctggaagctcaggcagtccctggactaggatggaatatttacgtcaaatctgaagacaatgtggccatacagtcctttcacgaaaaccaagcagtcgtgaaattgccgccgcaaataaatggaaacgaatgggcgcagacaaaaggatatgaactgctagccgacaaccacccttattatattgtgaaggacgggaacaaagcgcttcagccactgatcgaagatttgcagcaagatgaaaccgtgttgtttgccgagccaaactatgccttttcgaatcaagtccgtacagtagaaaagaaagtggagccaaacgacgaatatttcaagccataccaatggaacttaaacaa

SEQ ID NO: 6320 - DNA, 304 bp, Bacillus clausii
atgatttttggacggtttactgaacgagcccagaaagtattagcgctatcgcaagaagaggcaattcgtttaagccaccataatattggcactgaacatatattgctcggactaatccgcgagggtgaagggattgcagcgaaagctctgcaacagcttggacttggctccgaaaaattgcaaaaagaagtagaaaccctagtgggaaaagggcaagaagggcaaaaaagcattcatagtacgcctcattatacgccaagagcaaagaaagtgattgagctgtctatggatgaagcaaggaaag

SEQ ID NO: 6321 - DNA, 447 bp, Bacillus clausii
  misc_feature (1)...(447): n = A,T,C or G
acaaccaacctccagaagaagaacgatttgaagaagagccgccacttgaggcgtttatggaagaagagccgcccccaaaaacaagacctcttcgaaaagcggttgttatgacagtagcagctgttgtcgcgttggctatgcttgtgcaaggaagtgcctttttgtttcagcatttcagtttagacgcactccgctttacgagcgaaagccaacaattggaaaaggaaggtgattttgaaccatttaaagaagcggtcgttgctgtgcaaacagacagaggccacgggacaggnttcatcatttcagaaagtggcgacgtgctcaccaatgaacacgtgattcgtggagcttcgtccatttatgtccatttgccagatggagagcgttacgaggcgactgagacgaaaacagacgaaacgaatgatttagccatgttggcgcntgaag

SEQ ID NO: 6322 - DNA, 150 bp, Bacillus clausii
  misc_feature (1)...(150): n = A,T,C or G
agcaaatgctgaagcggacaaaaagcgtcgcgagcaagtagaattgcgtaacgaagcagatcagctcgtcttttcgactgaaaanacgttaaaagatttaggcgacaatgttgatcaagcagaaaaagacaaagccgaagcggcgaaaga

SEQ ID NO: 6323 - DNA, 329 bp, Bacillus clausii
tcgataagctggagacacaaacgttcgaatatgatgaggaagcccgtgaacctgtttatcgggtacatcgggcactccagaataatgtgtatgcctataaaaatgcaggcattgcttttgctcgcatcccggtttttgatgattcaagcattatgtacatgcagtgtgtgttggcgacaagccctctagaaatggaaaacttcctgcaaacgttacggaaccggctgtggcataaaagtcggaacgaagtgcttgtgtttaaagaagggatggacgggtttgttcaagaacagcaacctgtaacgcgggctatttctcgggaagaggtg

SEQ ID NO: 6324 - DNA, 1287 bp, Bacillus clausii
atattactgttcagcctgaacgttctgttttagttgttacaggacagtttgcagggcaaacagatggcgaaaatttcaccacaacgattctgaattcagatattacagcagaccttctctctaatatagaaggcgtcgaattgacggttgaaccagaagaagaacaaagcaactggttgtcaaccatcattatgatcgcgccgtttttactaatctttctgatcatcatttttctcatgagttctgcccaaggcggtggcggcggtggcggtaaccgcgtcatgaactttggcaaaagcaaagcgaaaatggttagcgatgagaagaaaaaggcgaagtttaaagacgtcgccggtgctgacgaagagaagcaggagcttgtcgaggtcgtcgagtttttaaaagacccgcgcaagtttgccgcgattggggcgcggattcctaaaggggtgctgcttgtcggtcctccaggtacagggaaaacgcttcttgcccgagctgttgccggggaagcaggcgtgccgtttttctcaattagtggttctgatttcgtcgaaatgtttgttggggttggggcttcccgtgtgcgtgatttatttgagaacgctaaaaagaattccccgtgtattatttttattgatgaaattgacgcagttgggcgccagcgtggcgcagggcttggcggcggccatgatgaacgtgagcaaacgttgaaccaattgcttgtggaaatggacggttttagcgcaaatgaaggcatcatcatcattgctgctacaaaccgtgctgatatccttgatccagccctccttcgtccaggtcgttttgacaggcaaattcaagtgaacgcccctgatgttaaagggcgtgaagaagtgctcaaagtccatgcgagaaacaagccacttagtgaggaagtaaagcttgatctcattgctattcggacgcctggtttttccggcgcagatcttgaaaacttgttgaatgaagcagcgcttgtggcagcaagaaacgacaaaaaagaaattggcatggaacatattgaagaggcaattgaccgtgtcattgcgggaccagctaaaaaaagccgcgttatttccgaaaaagaaaagaacattgtggcgtggcatgaagctgggcatactgttgttggcgtcaagttggaaagcgccgacatggtccacaaagtaacgattgtccctcgtggaatggcaggcggttacgcgatgatgctgccaaaagaagaccgttattttatgacaaagcctgactgcttgataaaattgt

SEQ ID NO: 6325 - DNA, 878 bp, Bacillus clausii
ttgcaagaacagaaagacatgtttgatctaaccattatcggcggcggtcctgctggattattcgctgccttttatgcaggaatgcgcaaaatgaaagtaaaagtgatcgaaagcatgcctcaacttggcggacagctttcggccctttatcctgataaatacatttacgatgttgctggatttccaaaagtaaaagcgcaggacttggttgaccaactgactgcccaagcgcaacagtttcagccagaaattgttttagaagaagcggtgcaaacgcttgaaaagcaagaagatgaaacgtttgtgttgaccactgatgccaatatccattatacaaaagcggtattgattacggccggagctggcgcattcgccccgcgtaagctccaagtcgaaaaagccgacttctacgaagacaaaaacatccattattttattcgcgacttaagtgcttttacaggcaaacgtgttgtcgttatcggcggcggcgattcagctgttgactgggcgctcatgcttgagccaattgccaaagaagtcacgctcgtccatcgccgtgacgccttccgtgcccacgagcacagcgtcgatttgcttaaaaaatcgtctgtacgaattttgacgccctacgaaacggcagagcttcatggcgacgaaaacggcgtaactgcggtaacattttcagaagtcaaaggggatcagacagaaacgattgctgttgatgacgtgatcgtaaactttggcttcgtgtccacgctaggccctatcaaagagtgggggcttgaaatccgcaaaaatgcgattccagtaaacaccaaaatggagacaaacatttctggcgtttatgccgctggcgatgtcagcacgtatgacggcaa

SEQ ID NO: 6326 - DNA, 435 bp, Bacillus clausii
atgaaaaaaggaagcattgaatttgaaaacggtgaaaagattgtcatcgaattttatgaggacgccgcgcctggtactgtagaaaatttcgaaacgctggccaataaaggattttacaatggtcttacattccaccgtgtgatccctggatttgttgcccaagggggagatccgaatggaaatggaacaggtggtccaggctatacgataaaatgcgagacagaaggcaacccacataaacatgttccgggggcgctttcaatggcacacgccggcctagacacaggtggcagccaattctttatcgtccatgagcctcaaccccatcttgatggtgtgcacacggtgttcgggcaagttgtagaaggactagacagtgtgtaccgcatcaaacaaggcgatgttatgttagaagtgaaagtttgggaagaataa

SEQ ID NO: 6327 - DNA, 486 bp, Bacillus clausii; identical to SEQ ID NO: 6280

SEQ ID NO: 6328 - DNA, 638 bp, Bacillus clausii
atgaaaaagttggtattagcagcagtaggtgctgtcagcttaaccgtctttgctggttgtagcgatgacagcgaaaacgcagtagtagaaattgatggggaaacagctctcacgaaaaatgatctatatgattcttttaaagagacgcagcaagcccaacagcagtttgtcaaccaaatgagtacagcattgctaacacgtgctagtgaggatatggacattagcgatgatgaaataaatgaaatgatcgaagatttaaaatccgattataatgtggagtctgatgaagacttagtcaacttctttacgaattccggctatccgcttgatgatattgatcaattaaaagaagaacttattgtgcctgaaatcgccatgaagcaacttagcgcagaaggcgtagatacgtcagacgaaacccttcaaacttattttgaagaaaaccaagaacaatttgaacagattacagcgcgccatattcttgtagaagatgaagaaacagcaaatgaagttaaagaccgcttaaacgacggcgaagactttgctgagttggccgaagaatattctaccgacacgcaatcggctgccaatggcggcgaccttgggacatttgaccgagagcaaatggtgcctgaatt

SEQ ID NO: 6329 - DNA, 620 bp, Bacillus clausii
gtggctaaattgattccagttgttgaactgtttgggccgaccattcaaggagaaggaatggtgatcggacagaagacgatgtttgtgcgtacaggcggatgtgattaccgttgtcactggtgtgattctgcttttacatgggatggcagcgaaaagagtgaaccgttgtctgcagaaggaattatagagcgccttaattcacttagtgaaaatgggtatagccatgtcaccatttccggcggaaatccagcgcttcataaaggcataggtgaactggtggcattgctcaatgagaagggcgttgccacagcgatcgaaacacaaggaaccatctttcaatgttggatcaatcgcgtcgatgaagtgacagttagtccgaaaccgccaagttcaggaatggagacagattggacaaagctcgatttgtttttgcaacaattacaagcaccggcggtaagcttaaaggttgtcgtgtttgatgatgccgactatcaatacgcaaagcgtgtgcataagcgctatccaacagtgcctttttacttgcaaacgggcaatgaagattttgctaaaaaagaggatccacgctttctggagaaacgaatgggcgcttacgaagctct

SEQ ID NO: 6330 - DNA, 2291 bp, Bacillus clausii
atgggtgaaattcgttcggaacgacgtgttccgctccttcctttgcgtggtgtgcttatttttccaggcacgatcatgcacttagacgttggacgcgaaaaatctgtcaaagcgttagaggaagcgaaaagcaatggccatcacttatttttggccacccaaaaagaaacgacgttagatgaccctcaacaagaggatttgtataaaataggaacatttgcgaaaataaaccaagcgtcaaaattgtcaaacggcactgtcagaatccaagtggaagggatccaacgaggagaaatcacttcttttaaagattatggcgatgtcttagttgtcgatgtgtccttatttgaagtaaaacgggaaggcgatattgaatcagaagcattgatgcgcacgcttttatcgatgtatgagcaatttgccaaacaatcgaaacgagcttcacaagaaacggttaattcccttagagaaacaacagaccctgaattgttttcggacatcgttgctgcgaacttaacgttgaaactaacgcaaaagcaagaattgcttgagttgattgatgtcaacaaaaggctccataaactgattgaacgattaggcaatgaacaagaagtgcttggtcttgaacggaaaattggccagcgcgtcaaaaaggctatggagaaaacgcaaaaagaatattacttgcgtgagcaaatgaaggcgattcagaaggaattaggcgaccgtgaagggcgaacgggggagattgccgagctccgtgaaaaaattgatgcagctggcatgcctgaacatgtgtatgaaaaagcgatcaaagaactaggtcgatatgaaaaaatgccagccaatgcgggggaaagctcgattttaagaacgtatttggattggctcatccaacttccatggaaaaacgaaacagaagatgagcttgacgtcggtcgcgccgaagcgattttgaatgaagaccattacggacttgataaagtgaaagagcgcgttcttgagtatttggccgtgcgccaactgacaaaaagcatgaaaggtccgattctgtgcttagccggaccacctggagtcggcaaaacgtcactggcccgttccattgcccgctcattaaaccgggagtttgtacgtatgtcactaggtggcgtacgtgacgaagcagaaattcgcggccaccgccgcacatacgtcggggcgatgccaggccgtctcatccaaggaatgaaacgagcagggacgatcaatccagtatttctcctcgatgaaatcgataagatggcccaagattttaggggcgatccagcatctgctttgcttgaagtgttagaccctgaacaaaacagtacatttagcgaccattaccttgaagaagcttatgacctttcgaaggtgatgtttgtgacaacggcaaataatattggcacaatccctgggcctctgcttgaccgaatggaaatcatctcaatcccaggctataccgagctggaaaagttagagattgcccaaagctacttgttgccgaaacaagtgagcgagcacgggttgaaaaagagtacgtttcaagcaagacctgaagccattaaaaaggtaatccgctactatactcgagaagcaggtgtgcgcggtcttgaacggcagctggcaacgctatgccgcaaagcggcgaaaatgattgtgatgaatgaaagaaagcgtgtcgtccttacggaaaaaatggtggaaacgatgctaggcaaaccgcgttttcgctatgggatggcggaagtggaagaccaagttggcgcggcgactggccttgcttatacatctgctggcgggacaacgctggcaattgaggtttctgcagttcctggaaaaggcaagctgacgctaacgggcaaacttggtgatgtcatgaaggaatcggcccaagcagccttcagctatatccggtcacggtctgaagagcttgagattgatcctgggtttaatgaaaagacagacatacacatccacgtacctgaaggggcgactccgaaagatggcccttcagcagggattacaatggcgacagcacttatatctgcactgactggaagaaaagtcgaccgcgaagtcggcatgactggcgagattacattgcgtggcccgagtgttgccgattggcggcttaaaagaaaaagcaatgagtgctcatcgggctggcattaggacgatcattattccgaaagacaatgaaacgggatgtcgatgatatttccagaaagtgtcagaaaagggaattaaacattgttttctgtctcccattt

SEQ ID NO: 6331 - DNA, 843 bp, Bacillus clausii
attgcgaaaagagccgcttgataaagcgggcatggcgttaacagacgatgcagccaaaaaggttgctgactatgctaccaatggccgggaaacggtcaatgtcgtccaaattgcggtaggagccgcccgagcagataaacgcacttccattgaaaagcacgatattgaatgggttctccattcgagccaaatgtcgccacggccagaacggcgcatccacgaacagcctgctgttggcctcgtcaatggcttggcagtaacagggccaaatagcggcgcccttctggaaattgaagtgcttgtacaagagcgggcagggaatggtacgctgacgatcacaggaattgccgaagaagaacagtccggttcgcaaatgcgttcaattaaacgaaaaagcatggcccggtcgtccgttgaaaatgtcattacggttttgaagcggaaagggctgccgactagcgactacgatattcatgtcaatttcccagggggtacgcctgttgatggcccgtctgcagggattgccattgccactggcatttattcgggtattaaacaaacggctgtttcaaacgaagttgcgatgacaggggaattaagtgttcatgggaaagttcgaccgattggcggcgtaattgcaaaagtgaaggcggcaaagcaagctggagccaaacggattattattccgaaagaaaatgaacaagcgctcttgaaaacaatagaaggcattaccattcatcccgtgaaaacgtttgatgaagtccttgagcttgcgctcgtagaggaaaaaattgaaacagaggcgattccagcgtctgcaatgggatacgatccttctccaat

SEQ ID NO: 6332 - DNA, 321 bp, Bacillus clausii
gggacttgataaagtgaaagagcgcgttcttgagtatttggccgtgcgccaactgacaaaaagcatgaaaggtccgattctgtgcttagccggaccacctggagtcggcaaaacgtcactggcccgttccattgcccgctcattaaaccgggagtttgtacgtatgtcactaggtggcgtacgtgacgaagcagaaattcgcggccaccgccgcacatacgtcggggcgatgccaggccgtctcatccaaggaatgaaacgagcagggacgatcaatccagtatttctcctcgatgaaatcgataagatggcccaagattt

SEQ ID NO: 6333 - DNA, 348 bp, Bacillus clausii
ctgttgatggcccgtctgcagggattgccattgccactggcatttattcgggtattaaacaaacggctgtttcaaacgaagttgcgatgacaggggaattaagtgttcatgggaaagttcgaccgattggcggcgtaattgcaaaagtgaaggcggcaaagcaagctggagccaaacggattattattccgaaagaaaatgaacaagcgctcttgaaaacaatagaaggcattaccattcatcccgtgaaaacgtttgatgaagtccttgagcttgcgctcgtagaggaaaaaattgaaacagaggcgattccagcgtctgcaatgggatacgatccttctccaatct

SEQ ID NO: 6334 - DNA, 816 bp, Bacillus clausii
atggatttcgtttatccaatcaccgtcttgctctatagtttgagcttaattggatattttatcgactttttgactaacaaccaaaaagccaaccgaattgccttttggttgcttttgtttgtgtggggtttacaaactgtctacttcgttatgcggatgtttgaattggaccgactccctttaattactccgtttgaagggctgtttttttatgcatggtcgattgtgaccgtttcgctcttcattaattggaaagtgaaaatggcctttttagtgttcgtcctgaatgtccttggttttgccgttatgtcaggcagcttattcgtcccttctggtgacgtgacacaagcaacgatggatttgcttgcctcggaactgcttgtcatgcatgttgtgtttattttgctttcctacacaggttttactgttgcggccgctgctgcagtgctctatttgcttgcgcaccagcttttgaagcgacggctatggggaaagcggctcattcgcctagattcgctgccacaaacggagaagttttcatacttcgcatctgtggccagttttccgttttacttagtcggcgtcatctggggcgtcgtttggtcaattagccaatatgaccatatttggtggacggatgcaaaaacgatttggtcattgtgcgttcttgccgcttacgggctttatttttatttgcggcttgcaattgtcggaaaaggctatcggtcgatttggcttaatataggcgctttcgccgttttgctcgttaactatattgttagcggtcgttatacagattttcacacatggttataa

SEQ ID NO: 6335 - DNA, 538 bp, Bacillus clausii; identical to SEQ ID NO: 6277

SEQ ID NO: 6336 - DNA, 472 bp, Bacillus clausii
ttgtctgtgtacgattattcggttaagacgagtgatggccaagaggtgtcattatcaacttacaaaggcaatgtattgctcattgtcaacactgccactaaatgcggctttgcttcacagtttgcagggcttgaaaaactgtacaatgactataaggaaaaaggcttttatgtgctcggctttcctagcaaccaatttttaaaccaggagccggttgccgacgaagacatggaacaggtgtgtaaaatcaattttggcgttacgttcccactgtttgcgaaaacagatgtgaaaggcaaacatgccaacccgttgttcaactatttgaaagcggccaaaaagggaatgttgagcgaagagattaaatggaacttcacgaaatttctcgtcaatcgaaaaggcgaagtcattaagcgttatgcgcctgccacaaaaccggaaacgattgaagcagatgtcatcgaagaactga

SEQ ID NO: 6337 - DNA, 486 bp, Bacillus clausii
cattgccaaaagacaccggttgctactgaagccaggcaatttatcctctcgcagtacttgcctttgtaggcgctgcagctctctatttcttaccggaatattggtttctgtgtttgtggtctgctttgttggcgggactaaaactggcgcttgatatccgttctgccattgccgaaaaaaacaagcctgcttttttcacggaagaagaaaaaggttgccgtgtcgtcggtgttcttcctggcagcccggcggaaaaaatgggcattgcgattggggaagaaattgcgaaagtaaatggccaacctgtccataatgaacaaacgatgtatcaagcattgcaaatcaatcccgtatactgcaagcttgaagtaaaagacctagcaggggaagcacggtttgtacacgggcctctttacagcggcgagcactaccagttaggggcgttgctcgtgcgccaggaagaacagctagcagattccattgtgt

SEQ ID NO: 6338 - DNA, 936 bp, Bacillus clausii
  misc_feature (1)...(936): n = A,T,C or G
caatgattacggggccaagcgggttatttgaatacggcttgtatcggccgatgccaagcggcangtatgccaggaaattttngcggttatcctagccaggctacccaaaaagaaatgggctacggttnatacgttcccaaacccagggttaaggagtcgttttccagaacaaaatcaacttcatttgcaaaactacacggaaagtgaattgctggatatagctgaaacgatagcgctggaaaacgactttattttcaccgaacaagccttaaaaaaagtatcagcggaaattgaacgggcaaaaatggaccagtcgtttggcaatgctcgtgttgtcgaaaacattgtccgtgccgttatttttgaaaaaggggcttctggcagtggcgagtcagaggcagatttggtattgcttgatgaaacgcatattcaattgacagcgcttcaacgggccgcggatgttctttcacgccttgatgcacttatcgggctcgaagaagtgaagcgagaagtaaaaaaactgactgcgtacgcgaaagtaaaagaagcacggcgtgacatcggtttagccgtaccgcttatgccgctccatacagtgttttcaggggctcctggcacagggaaaacgacagtagccaggctttatgcggaagcactaaaccaaattggtttgttgaaaaagggccatgtagtcgaagtttctcgcagcgatctcgttagcgggtttgtagggcagacggcattgaaaacagagagagtgattgaagatgcccttggcggcgttttgtttattgatgaagcgtattctctggcgcaaggcggcgcgaatgactatggcaaggaagcgttgaccgcattaacgcaagcaatgacgacccatgaagccaacttagttgtcgtctttgctggctatggcaaagaaatggcgcagctgtt

SEQ ID NO: 6339 - DNA, 1065 bp, Bacillus clausii
  misc_feature (1)...(1065): n = A,T,C or G
aaaatgagtggaagaaaaagcaaggtcaagaaaacacggaagtattggttgaggatattgcccaagttgtttctagctggacaggaattcctgtttccaaactagcggaagaggaaacggaacgcttgttgaaaatggaagagattctccatgagcgtgtcgttggccaagaagaagctgttaaatccatttcgaaagcgattcgccgtgcccgcgctggattaaaagatccaaagcggccaataggatcagganagttccttggtccaactggtgttggtaaaactgagcttgcccgggctgtagcagaaacgttatttggcgatgaagatgctgtcattcggattgacatgtctgagtatatggaaaaacatgcaacaagccggctagttggctcacctccaggttatgtcggccacgaagagggtgggcaattaacggaaaaaatccgtagaaagccatactctgttatactgcttgatgaaatcgaaaaggcgcacccagatgtatttaacttgcttttgcaagtattggaagatgggcgtttaacggattcaaaaggacggactgtcgatttccgtaatacagccgtcatcatgacatccaatgtgggtgcttcccagcttaaacgcaacaagtatctcggctttacgattgaatcggaagggcaagagtacaaagacatgaaagaccgtgtcatgtctgaactgaaaaacagcttccgcccagaatttttaaaccgtatagacgaaattattgtgttccactctcttgagaaaaagcatgtgcgcaaaattattacaatgatggccgaccaactgaaagagcgactttcagagcaaggcatagactttgagctgacagaagaagcaaaggataaaatcactgatatcggttttgatccagaatacggggcacgcccattacgtcgggctttgcaaaaagaagtagaagaccgtttgtcagaggaactgttaaaaggcacgattgtcaaaggccaaaaagcggttatttatgtgaaagatggcaagcttatggtagaaggaaaagaaaaatcaagcattt

SEQ ID NO: 6340 - DNA, 1372 bp, Bacillus clausii
  misc_feature (1)...(1372): n = A,T,C or G
atggcgaaacaaaaaacgaagtttgtctgccaagagtgcggctatgaatcggcaaaatggatgggcaaatgccctggttgccaaagctggaacacaatggtagaagaaagaaacatccttgaaaaacaaaaaaaccgtagctatgtaacttccagcggtacacggcaaaagccgcaaccgattacggcggtgcaaggagaaaaggaaccgcgtgttagcacgacaatggcagaactggaccgtgtccttggcgggggaatcgttccaggttcactcgttttagttggcggcgatccgggtatcggaaaatcaacgttgctcttacaattatcagcgaagctggcaaacgcaaacgaacgagtactctatatttctggagaagaatcagttaaacaaacgaaattaagggctgaccgccttgaattagcatcagagcagctatacgtattagcagaaacagacattgctttaattgaaggggctatagatgaagtccagccgtctttggtcattattgattcgatccaaaccgtttaccaggacgagattacgtctgctccaggaagcgttgctcaagtgcgggaatgcacggctgcgtttatgcgtgtcgcaaaaacaaagggagtggcantatttattgtcggccatgttacaaagcaaggctccattgccggtccaaagctgctcgagcatatggttgactctgttctctattttgaaggagagcggcaccacagttaccgcatattgcgtgcagtgaaaaaccgatttggctccaccaatgaaatgggcatctttgaaatgaaacagcttggcttagaggaagtgaaaaacccatcggaaatctttttggaagaacgttctcaaggagcagctggctctgtcgttgtcgcttccatggaaggcacaaggcctgttctcgtagaattacaagcgctcatttcgcctatgggttttggcaatcctcgcagaatggccacagggcttgaccataaccgtgtctctcttttaatggccgtcttggaaaagcgggcgggcatgctcttgcaaaaccaagatgcttatttaaaagtagctggaggcgtaaagttagacgaaccagcgatcgatttggcgattgctcttagcattgcttcaagtttccgagcccagccaccagacccgatggatgtagcgattggcgaagtagggttgacgggggaaatccgccgcgtctctagaattgaccaacgcgttaatgaagccgcgaaactaggctttaaacgtgtcatcatacctgaaaaaaccaaaggcggctggactgcgccagcaggcatcgaagtgattggcgtgcagacgctcgaacaagcgattgaagttgttttagggaggt

SEQ ID NO: 6341 - DNA, 267 bp, Bacillus clausii; identical to SEQ ID NO: 6300

SEQ ID NO: 6342 - DNA, 565 bp, Bacillus clausii
atggctaaagatattcaatttagtgaagaagcgcgccgttccatgcttaaaggcgtagatactcttgcaaatgcagtaaaagtaacgcttgggcctaaagggcgcaacgttgttctagaaaagaaattcggttcaccactcatcacaaatgacggtgtgacgattgcaaaagaaatcgaacttgaagatgcttttgaaaatatgggtgctaagctggttgctgaagtagcaagcaaaacgaacgatattgctggtgacggaacaccacctccgacagtcctttcccccacactatttctcgcaaactcttaaaacacttctccccctgctaccccccccatcatccacccaccaattgaattaacaacagccactgctgctaacaatcttaaaacactttcaaaaccaattgaaggcagagagtccattgctcaagttgcggcgatttcttctgctgatgaagaagtagggcaaatcatcgcggaagcaatggaacgtgtcggcaacgatggcgttattacaattgaagaatcaaaaggattctcaacagaacttgaagtagtaa

SEQ ID NO: 6343 - DNA, 531 bp, Bacillus clausii
cttgtcaacaagcgaagtcgttgtcggttcccttgttggggctggccttgcgtaccaagctctttattggcagtacttgcttgtgattgtgagcttttggattgtcattccgtttgctgcgttttttctcgcactcggggctggaaaaacgatcaaaaagtatcaagcccatttgccctttttgcgtggcgatggaaaatggcataagcctctcaccttcattttaatcgcttgtggttgccttgaagctttttcagctggaatgaacaatgtggccaatgctgtcggccctcttgtcggggtaggggcgctagatgtgacaacggctgttattgctggtggattttttgttgcccttggcgcccttttactcggcggaaaagtgctcgagaccaatggcaaacacattactagtctttcgctgctgcaaggaagtacagtctcgtttactggtggagcgcttgtcatcattgcttcgatttttgggcttcctgtgcctctgacgcaaattacgacagcggccattgtcgg

SEQ ID NO: 6344 - DNA, 579 bp, Bacillus clausii
catcacaaacgagattgcactcgatggttttgctctctctgacttggagttacttggcattggcggttttacgccgctaactggctttttaaacgaagacgattaccattctgttgtcaagtcaatgagattagcgaatggagcgccttggagcattccgatttcactgcctgtttccgccgaccaggcttctaccttgcgtgttggcgaacgtgcaaagctcgtttacaacaatgacatttacggcgtcattgaaatcgaatcaatttatacgcctgataagaaagtcgaagctcaggaagtataccgtacgacggatgaagcccaccctggggtagcaaagatgtatgcacgtcctcccgtttatgtaggcgggccgattgtattgacaaaacgtgtcaattatgaacgctttgcttcttactatatcgatccaatcgatacgcggcggatttttgctgaaaagggctggaagacggtcgttggcttccagacgcgaaatccggtgcaccgcgcccatgaatacattcaaaaagcagctctggaaacggttgacggactgttcttgaacccacttgt

SEQ ID NO: 6345 - DNA, 125 bp, Bacillus clausii
catattaaacggataaatgagggcaaatgttctggttcggcggggattgtttttgtcgacattattagcaacctagaacgaattggcgaccattcggtcaacattgcccaatcggtaattggcga

SEQ ID NO: 6346 - DNA, 717 bp, Bacillus clausii
tcgctgtactggcctatatcgttacgaagcttgttcctggagatgaacttgctttagattacaaaccaaaacatttagatccgatctttatcggaaactcgccagcaattgctttaggacaagccaaacaagaaattctccatatggccgattactcgaaaaagggattagagcaagcgattcgctatatggaaacaggcgaaaagaaggacgccgagttggcacttcagtatgaacaagcaattaacaatttagaccgcgagatcaccgactatttggttaaagtgtcggcacgttccttgtcgcctgctgattccaatctccattcaacgctattaaatgtcgtcagggatatcgaacggattggcgaccatatggaaaacattgttgaattgaaagattatcaaaaagcgaataaagtgaaaatgagcgatattgccttaaatgacttaaacgagatgttcaaattaacgtattcgacattagaagaagcaatggattcccttgaacgggatgatcttgataaagcacatgacgttttaaaacatgaagatttaattgatagcatggaaagaaagctaagaaaacaacatattaaacggataaatgagggcaaatgttctggttcggcggggattgtttttgtcgacattattagcaacctagaacgaattggcgaccattcggtcaacattgcccaatcggtaattggcgatt

SEQ ID NO: 6347 - DNA, 385 bp, Bacillus clausii
atggcttacaaactaccagaattgccttacgcggcaaatgcacttgaaccgcatattgatgaggcgacaatgaacattcaccacggaaaacaccacaatacgtatgtaacaaacttaaatgctgcattggaaggacatgcagcacttgcagagaagagcattgaagatttggttgcaaacttggatgctgttccagaaaacatccgcacagcggtccgcaacaatggcggaggccatgcaaaccacacattcttctggcaaattttaagtccaaatggcggcggtgagccgactggcgctcttgcagaagacattaaatcaactttcggcagcgttgaagaattcaaaaacaaatttgcagacgcagcaaaaggacgctttggtt

SEQ ID NO: 6348 - DNA, 222 bp, Bacillus clausii
caggatgggcttggctagttgtcaataacggcaatttagaaattacaagcacgcctaaccaagatacaccattgtctgaagggaaaacgcctatcctcggacttgacgtctgggagcacgcttactacttgaactaccaaaaccgtcgcccagactacattgcagctttctggaacgtcgtcaattgggacgaggttagcaaacgttacgaagcagcaaaat

SEQ ID NO: 6349 - DNA, 275 bp, Bacillus clausii
ttgttagcggttattttcgcttcattgatctttattatgacgctcgcgttggttatttggcagcctcgtaacttgaatattggttggtcggcatgtgggggagctattctcgcgttattatttggcgttgtttcatttgccgatgtggttgaagtgacggggatcgtgtggaatgccacgttgacatttattgcaattattattatttctttaatccttgatgagatcggtttctttgaatgggccgccttacgtatgaccaaggcagcgaaagg

SEQ ID NO: 6350 - DNA, 477 bp, Bacillus clausii
ataggcagctagcactggcgatgctgcggacagggctgtttgggtttggcggcggcccgtcagtcatgccactgtttcgggtggaagctgttgatacgtataaatggatggacaatgaagaatttggcgagacgctggcgattgctaatacgttgccaggaccagtggcaacgaaaatggcagcctatttaggttatcgattgaagggctggactggcgcttgctgggcaacgttgtggcacattttgcctacgagtgtagcgatggtgttgcttttttcgcttgttgatgccattagtggctctgaagtggttgctggcatgataggtgcagttacacctgttatcgctgttttgctcgcgcaaatggcgtatgattttggcaagaaggcggttaaaggtttcggctgggtttttggcattctcacttttctcattgcctttgccgctttgcaagggtttgacgtccaccctggct

SEQ ID NO: 6351 - DNA, 471 bp, Bacillus clausii
agcaaatttcacggcgtgttgcagcagtggcaaaggaactaggcattgaaacattgctaaagcgggatgtgagccgcttatcaggtggtcaaaagcaacgagttgcccttgggggtgtgctagcacctgacccagacattctcgttctcgatgaagccacttccatgctagatccggctgggcaaagggaatggctttcgctattaaagaaactccatcgcaaaggcaagaccatcttgtccattacccacgatccagaagaactgctctttgcagaccgtgttttagcgcttaaagagggccgtttggtttttgatggcacaccggcccagctattttttacccacgaccaagtagaacagctcgatatcgcgcttccttttttatatgagctccaagctgaattgcacaagcgcggtgcggcgataggcaattcccaaacggaagaggagctattgcaggcattatgga

SEQ ID NO: 6352 - DNA, 339 bp, Bacillus clausii
ttgccgggcataatgatccaggtggagggttcattggcggattaatggctgcctgtgcctttatccttaatatatgtcgtttttgaccgtaaaaaaagcccacgaagcaatcaagattttcatttgtgccatttattgcggttggcttgttgcttgacaattgccgtaggttttattggcatcctgtttggacaggcttatttggaacaatttttcgactacttccatttccccttttttggaaagtcgaattaacgaccgcattgcctttcgacttaggtatcttttttgtagtcgtagcaatggcaatggttgtaaccctaacgattgcggaggata

SEQ ID NO: 6353 - DNA, 301 bp, Bacillus clausii
  misc_feature (1)...(301): n = A,T,C or G
atggaaattttaatgtttatcgtcatcggcgtttttttcgcgatcggcacttatcttctgctagcacggagcttgctacgtgtgattgtgtcgttaatgattctttcacacggcgcccatttgctgcttttgacgatggctggcctaaatgctgaagctccaccacttgagcatatggcagacggcggctacacagacccgctcccgcaagcgcttattttgacagcgcntgtcattagttttggaatcactgcctttcttgttgtgcttggctaccggacgtacaaagtgcataacaccg

SEQ ID NO: 6354 - DNA, 528 bp, Bacillus clausii
agacccgcgtatttggtttgacgtaaacatgtggcaacaggcgattgacgccgccgttgaacaattaaaggaaatagcgccaagcgaagccgattattttgaacaaaacaagcaagattattttgcagagttagatgagctatatacattttcggtcgagaagttaggcgaaattcctgaagagcagcggattttagtaacagcccatgacgcgttccaatattttgggcgtatgaataacatagaagtggtcggcttgcaaggtttaagcacagaagacgaggttggcatttctgatattcaatcaacgattgatacaattgttgaaaagcaagtgcctgctgtatttgtagaaagcagtgtcaatgattcttcgatacaggctgtgattgaaggcgctggagaagctggcgttgatattgaattagggggcacgctttattctgacgcaatgggagaagcagggacagaggaaggcacatatattgggatgtaccgacacaatgtcgaaaccatttatgatgcgct

SEQ ID NO: 6355 - DNA, 396 bp, Bacillus clausii
ccgatgctttcatttacaacggtgcaagtctagaagcttttgccgataagattacttctgccgttgaagaccacgatgttgttacattagaggcttctgctgccacagatctaattgctaattcacacgaccacgaccatgggcatgatcacgggaacgaacatgatgatgggcatgatcatgacgaccataatcatgaagctgaggatgagcatgatcaccacaaccatgaaggggaagatggacatgaccatgaccaccatgacaatgaaggagaagcaggggatatcgctacagccacaattgacgggcttgccgaccattaccactctggcgacacagttgaattaacagcacaatctcctgaaaacagtgaccattggcattggtataccc

SEQ ID NO: 6356 - DNA, 546 bp, Bacillus clausii
acgaccaccatgtcattgccgaaagcgagccggtaacgattcaaattgacgatcatgaggaggaaggcggctcacacgatggccatcatcatggagaccaagatccccacgtctggcttgacccaattcgttcaattgagatggcagaagcgattaaagacatgctcgttgagctaaagcctgaacaagaagcctattttaatgacaactttgaaacattgaaggcgcagttcgaagagcttgatacacagatgcaagaaatggttaacgatgcttcagtcgatacattcattgtttctcatgctggttacggctattgggaagaacgttatggcattaaacaaatcgggatagcaggcatttcctcgacagatgaaccatcgcaaacccaacttgttgaaacagtagaaacagcaaaagaacttggtttacattacgtagtctttgagccgaatattacgccttccgttgctaaagtggtgcaagaccatcttggcgcagaagcactgacgattcatccccttgaagcccttacacaagaggatg

SEQ ID NO: 6357 - DNA, 264 bp, Bacillus clausii
  misc_feature (1)...(264): n = A,T,C or G
aggactaagnttcgataccatttatcggaacctctccctttttgctgagattggcttgctggaaacgacagagctggatggggaaaagcgttttcgattcaattgtgggacgtccgaccatcaccaccatcttatctgcttagagtgtgggaaaacggngcnttttcacnattggccnangggccaagtcgctngcaaaacgatttccccatttccatgttacgggacataaattgaaatatacggcatgtgcnaacaatgcca

SEQ ID NO: 6358 - DNA, 483 bp, Bacillus clausii
  misc_feature (1)...(483): n = A,T,C or G
tttgttgcccgcgttcttgatggcaatcattggcattcaagtgttaatcgaggcaggaacgactcttctgagcgcaaatgaancagaagcacctagcatggtcgctgcatggacagcggcaggaggcactgtcatcatgttttttgtctatcgctacaataaacagctcgctgaaaagatcaatagccaagctctcgctgctgccgctcaagacaataaaaacgatgcactcgtcagttttggggcgcttatcggcattatcgcttcccatttccatttaggctggcttgattcattgactgcgttgctgattggcctcattatttgctatacagcttggacgatttttagagatgccacccactcattaaccgatggctttgatgaaaagatgcttgaagggtacagaaatacaattgaggaaaatgagcaagtccatctattgaaaatggtaaaagcacgccaagttggcagctctgttta

SEQ ID NO: 6359 - DNA, 185 bp, Bacillus clausii
atgtttaatttgttgctctcaattgctttagtaatactaagccttgcggcgctcctttgtttcgtccgtgcccttcttggaccaaccaatcacgaccgcattgtggccctagataccgttggcatcttactaattggctttgtcggcatcttaatgatccttcaagacacacgcgcctataccga

SEQ ID NO: 6360 - DNA, 297 bp, Bacillus clausii
gctaatgggtgtgtttgccaaagaattgacgattgccaacctggatgttgccaaaattgtcatcagccctaaaatgaacattgctcctgggatcattgccgtgccaactgaactggagacgagggcggagaaaactttgtttgccgtcatgatgacattgactccaggaacgatgtcgattgagttttcagaagacggtcgctacatttttgtccatgccttaaatgccgaagacaaagatgggctggttaagcaagcaaaagatacatttgaggctggcattttggaggtgacccg

SEQ ID NO: 6361 - DNA, 813 bp, Bacillus clausii
attggttctccttatgacgggaatcgctgttcgctcgctgagtgcaaccatttctttgtttgcaggcactgttttacttggcctctcgattgcggtgtgcaacgtgctcattccaagtctagttaaacgggacttttctaataacgttgggctaatgacagggatttacgcagtgtcgatgaatttatgcggtgcgatcgcatctggcatcagcgttccgctcgcccgtaatctcggtttcggttggaatggcgcatttggagtttggggcatactcgctttgatcgccgcactattctggttccctagagtccgtgggagtcacacatcagctgtggtcacaacgcctggtggagtggtaaggcgaagcctgtggcgttcaccactggcatggacaattaccctttttatgggaatgcagtctctccttttctatgttttgatcacttggctgcctgaaatgatgacaagccgggggttgagtgaagatagcgctggttggatgctatcgctgtttcaaatggctacgcttcccgtatcctttatcgtgccaatccttgcaggacgcatgaagaaccaacatttactggtcaccataatggctgttttgttttttgtttcattaggcggcttttatttcggcaatcaagcacttatttcgttatggacgattttactcggaattgccggtggatgtgcgtttagtttggctatgatttttttaagtttgcggacgaaagatgcctacgatgcagcgtctttatccggtatgtcccaatctgttggctatttgttggcggcaacagggccgat

SEQ ID NO: 6362 - DNA, 924 bp, Bacillus clausii
atgaaaaaaaagcttttgttatcatcattattgctcatttgtgcggttggctgccaatcggacgaagacaagacagaggcccacgaagaacagccagaggggcaatcgtatacagtaacggatgacagaggtgaagacattacatttgaaaaaatcccagaaacggttgtttctcttgctccgagcaatacagaaattttgtttgaacttggtgtaggagaaaacgtgattggtgtcactgaatttgatttttatcctgaagaagcaaatgaaatcgaaaaagtgtctgactcacaaacaattgatgctgaacgaattattgaattgaatcctgatgttgtcattggctatacgataggggctcctgatacgcttgatcctttagaagacgcagggattcccgtgtttgtgattcactcagccgcaaactttgaagatgtgtacagtgatattgaacaaattgcagaagtgatgggcgtaacagaaagaggcgaagaaatcgtaacaaacatccaagcgcaaatggaggaagtggcgaccaaagtcgctgaagcggaagaaaaggatgtgtattttgaaatcagcccatctccagacatttatacaacaggagccaatacgttccagcaagaaatcattgaagctgctggcttaaacaatgtgtttgctgatgaagaaggctggcttaaaatagacgaagagcaggtgattgaccgcaacccggacttgattgcaacaacggtcacctatacggaagacccagtcggcgagatcaaaggccgcgctggctggggaggcattgcagctgtcgaaaatgaggaaatttatttgcttgaagcggacatcatggaccgccctggtcctcgtatcggggaggcggtcgagcatttggcacaaatcgcatacccagagaaattcgagtaa

SEQ ID NO: 6363 - DNA, 424 bp, Bacillus clausii
atggctaatcgaggcttatcggaagcaattgatgcgcttaaaagcacacgagtgcgtatgacaccgcagcgccacgcgattttggagtttttgtatgaatcaatgacacaccctacagcggatgaaatttataaagcattagaagggcgcttcccgaatatgagcgtagcgactgtatataacaatctgcgtgtttttaaggaagttggcattgtaaaagagttatcgtatggcgacgcttcaagccgttttgattgcgtgacaagcaaccattaccatgtcatttgcacgcaatgcggtaaaattgttgacttccattatcctggactagatgaagtggaaacccttgcagagcatgtgacaggttttgaagttgacaatcatcgcatggaaatttacggcgtatgcccagattgcaaaaaag

SEQ ID NO: 6364 - DNA, 305 bp, Bacillus clausii
  misc_feature (1)...(305): n = A,T,C or G
atgatttcgtatgaagggtggattctaataaccggagccctcgttggcattacatgcggcatcgtcggcgcctatttaattttgcggcggatggcgatgatggccgacgccatcagtcataccgttttgcttggcattgtcatcgcatttctcattacccaaagcttagaaggcgttcatatgctcattggcgcgattggcgcagggatattgaccacatttcttgttcaatggttccattccaaaggggtcgaacatgacgcttcaattggcgttgtgtttncgtcgctattcgctctaggggt

SEQ ID NO: 6365 - DNA, 315 bp, Bacillus clausii
  misc_feature (1)...(315): n = A,T,C or G
atggnttgggtgtatgtgattgtggctggtttgttagagatgtttggtttggcgatgatgaaccgttttaagctcgaaaaaaagctgttgccattggtgttgcttgtcattggtttttcggcgagtttcttccttttgtcactcgcaatggaaacattgcctatgggcacagtttatgctgtgtggacgggaataggggcttttggaggagcggcaatcggcatgtttgtttatggcgaaccgaaaaccgcttcaaggatttttttcattttcctaatattaggttcggtcattgctttaaaagcagttagttaa

SEQ ID NO: 6366 - DNA, 804 bp, Bacillus clausii
tgtaacgcctaaatggctttatgacaggcttggcgaagtcatcgtccttgatgctcgttttgatttatttgatgaaaagaagggaaaacaggcttatcatgcagaacatttgccaggcgctctatttatcgatatgtccgaagaaatggcggacaaatgcatccaaggggcagggcgccatccgctgccatctccagaggacatggcccagatgtttgccaaaaaaggcatatcaaaagacagcaaagtcgttatttacgatgaccaaaatggaggaatagcggcagcgcgcgcatggtggatgcttgaatttctaggcaacaacaacgccgctattcttgacggtgggattcaggcttggaagaacagtggctacccgacaacggatgaggtgaagcttccagatgaggcgcgatttgagccgcatgtgaaggaagattggctagttacagccgaacaagtgaaaaataagttgggaagcgctgttttggttgactctcgctctagagaacgttatcaaggggaacaggaaccacttgacccaaaagccgggcatattccaggcgcactcaattttccgtggagcggcgtgctgcgccaggacggaaactggaagagcaccgaggagctagtgcagcattttgccgccctccctcgtgatcaggaagtaattgtctactgcggctcaggcatttccgcatgtccaaatgtgcttgcattaaagcgggcaggctttaaacaggtgacactatatgcaggaagttggagcgattggtcttcacgtagcggttatccagtagagac

SEQ ID NO: 6367 - DNA, 1623 bp, Bacillus clausii
atggatgaatcaaaaaagtcgccttcgtttggaaccaatgtaacggggcaaggcgatgcgcttgatcagcgcaaagccgcaaatgaaaaggacgatacattaaccacccgtcaagggcatcccgtgaaagacaatcaaaatgtacgcactgtcggcaaccgcgggcctatgacgttagagaattacgattttttggagaaaattagccatttcgaccgggagcgtattcccgaacgagttgtccatgcccgcggtgcaggagcacacggctattttcaatcgtatggaaaagtaggagatgaaccaatttccaaatacacaagagcaaaagtgtttacaaacacggaagtgaaaacgcctgtatttgtccggttttcatctgttatacatggcatccattcccccgaaacacttcgtgatccccgcggctttgcggtgaaattttacacagaagacggcaactgggacttagttggaaataacttgaagattttcttcattcgcgatccgctaaaatttccagatatggtccatgcgtttaaaccggatccagtaacgaaccggcaaagcatggaacggttttttgattttgtctcgcaaagcccagaatcgacccatatgatcacgtttgtgttctccccgtggggcattccggcaaactaccggaatatgcaaggatcgggtgttcatgcgtataaatgggtcaacgaggaagggaaagcgatgcttgtcaaataccattgggagcctgtacaaggaatcaaaaacttgacccaaaaagaagcagagcaaattcaaggaaaaaacttcaaccacgcgacgcaagatttgtatgaagcaattgaaaaaggcgattaccctgaatgggaactttatgtgcaattgatggaggacggcgaacatccagagcttgacttcgatcctcttgacccgactaagctttggtataaagaccagtttccttggcacaaagtcggcaagatggtgctcaacaaaaatccagaaaattattttgcggaagtggaacaagccgcctttggtactggcgtccttgtcgatggccttgacttttccgatgacaaactgttgcaaggacgcacgttctcctattcggacacgcagcgttaccgcgttggcccgaactatttgcaactgccaatcaatgccccgaaaaaacgggtagcgaccaaccaacgagatgggcaaatgacataccatgtcgatagtcctccaggaatcaatccgcacgttaactatgagccatctgtacttaatggtttaaaggaagcagaaaaagtcggcccagaccacacgccgcacgtatcaggcgaagtgaaatatgaagcgatcagccgcccgaacaacttcggccaagcaggggaaacgtatcgccgcttttccgattgggaacgggatgagctaatcgccaatttagctaatgccctggcggatgtcgataaaaggatccaaaagcaaatgatcgagaatgtgacagaagcggaccgcgactacggcaagcgtctagaagaagcgatcaaacgtgttcaagaaagcgtagacgacaaagaaggacatgcggtcaaggaagcggaacaagaaggaatgccatctgatccttattaa

SEQ ID NO: 6368 - DNA, 519 bp, Bacillus clausii
atgaaatggtatagcatgaagtcagaggaagtggagtacaaaacaaatacagatatagcgaaaggattgacagacaaaaatgtcaaaaagcgcctcagcacctatggcccaaacaaactaaaagaagcgccacgaccatcagcgttggccacgtttctggcgcaatttaaagactttatggtgcttgttttgttggctgcgacgctcgtatctggtctgattggcgaagtgctcgacgcgattacaattatgtgcattgtgttgctaaatgggattctcggttttgtccaagagcgcaaagccgaaaaatcacttgatgccttaaaagagctgtcagcacctaaggtggatgtcctgcgcaatggcgaatgggggcaagttccttcagctgaagttgtccctggtgatgtgatcaaaataggggccggcgaccgggttggcgctgatatacgcttgatccacgtagctggcttgcgcattgatgaagcctcgctcactggcgagtccgtccctgtccac

SEQ ID NO: 6369 - DNA, 429 bp, Bacillus clausii
  misc_feature (1)...(429): n = A,T,C or G
acaacttggccgtgtcattggcttttgcgagccccaacaaatcattgatgttgctgaaaaattaattncgattcaacgggattatggcaaccgttccgttcggaagtatgcccgatttaagtacacgattgaccgccatggtctggactggttaaaaaatgagctgcatgctcgccttggctgggagcttggagaagcgcgcccttttcagttcgatcataatggtgatcggtatggctggaccaaaggagtaaaaggacgttggcatttgacgttatttatccaaaatggccggattcaagatacagatgattatcaactaatgactggcttgcgcgagattgccaagattcatacaggggaatttcgtttgactggcaatctnnntgtaattattagcaacgtaacggcagcgaagaaaaaagcgat

SEQ ID NO: 6370 - DNA, 336 bp, Bacillus clausii
ccggtaccaagatggagtagcgccatggatcgtgcccctcttgttactcatttcttggcaatttatgagcgtttacggtttgttctcccatttacttgcaagcccattggaggtcgtccaagcagcgtggcggatgattgcgaatggggaactggttagccacatggcaaccagtttttatcgagcgttagcaggctttatcataggcggcgggcttggccttttgctaggcattgccaatggcttatccccattttcaagtaagtatttagatagtacaattcaaatgttgcggaatgtgccaaaccttgcactaattccacttgtcgtcattta

SEQ ID NO: 6371 - DNA, 456 bp, Bacillus clausii
ctgttgttaccgactttgccttattgaatccccaacttgatcaaaggcaactgtttgcaattgtggcggcattagagaatcgttcgcaacatcctttggcttctgccatcgtcgccaaggcagaagacgaacaactgccttatcacgattatatggttgagaacgtcacggcgctcacgggcaaaggcattacaggaacagtcaatggaaaaacgtattacgttggcagtccgaagctgttccaagaacggttgccgacttgggacataacgccatttgcgcaaaacatcaaaagcttgcaacaacaagggaaaaacagcgatgctggtcgggacagaaacggagttgctcgcccatcgtcgctgtcgcagatgaagtgcgcccatcaagcaaaagaagtgattcgtaaacttcatgaagcaggcatagcgaagacagtaatgcttacaggaaata

SEQ ID NO: 6372 - DNA, 626 bp, Bacillus clausii
tgaaaattagccatgtggaaaagacatttgccaaaggcaaaaacgatacactccacgttttaaatgatattgacatgacgattaacgaaggcgacttcgtttcgcttctcggcccttcaggctgcggaaaatcgacgattctcaacttaattgctgggcttgactcgccgacgagcggcgacgtgttcgtcaatgggaagcaagtaaacaaacctggcaacgaccgtgttgttgttttccaagaagcaggtttgtttccatggatgaatgtgcttgaaaatgttgcgtatggactaaaattaaaaggcttttccaatcaagaaagtgcagaaaaggcacgtgaaggtttgaaaatggtgcatcttggcaacttttccactgcttatccccatgagctatctggaggaatgaagcaacgtgtcgcgattgcacgggcgcttgtgatggatcctgatattttgctcatggatgaaccttttgccgctcttgatgagcaaacgagaatggtcctccataaagaactgttggaaatatgggcagagacaggcaaaacgattttattcattactcataatatccgcgaagcggtcatgctttccaatcgaattgtgttaatgggaacaaga

SEQ ID NO: 6373 - DNA, 338 bp, Bacillus clausii
cgcgggattgccaccggctcgtttgagcggggcggcgttatgaaaacagtgaagcgggaacttggtacaggcattatgcttggcattacatgcatgattgtccttatgggcattattagtttgttttacaaagggaatttcttgcttgcttttattgtcggcatctcccttttctttgccttaagcgtcgcggccgtcattggcgctaccgtccctatcattatcaacaagctgaaaatcgaccctgccgttgcgtccggcccgttcattaccacaatgaacgacatcgtcagtttgctgatttattttacagtcgcgacgacattgattgacaaact

SEQ ID NO: 6374 - DNA, 420 bp, Bacillus clausii
agtcgtaaaagtcaagcttgccgattttgcatttgcggtcgattcaattttagcggccgtcgcccttgccgtcacattgccagcgaccaattggccaaacattggccaactagacggagcacagtttgctgttgtcctaagtggtgggatcatcggcattgtgattatgcggtttgcagcaggcaaatttattaaattgcttgaatggcggcctagccttgaaacagccgcttatttaatcgttggctgggttggcgtaaaacttcttgtttatacgcttgcccatcctgatttgcacattttaccagaacatttcccagaatcttcgctatggaaaacgatcttctggaccgtatttgctgggattgtccttatcgcttggttcaagtcgtcaaaggatttgaaaaaggcttctctaca

SEQ ID NO: 6375 - DNA, 282 bp, Bacillus clausii
tttagaaatccgggggccaacattgctatggaaagtcatttttccagcttcctttccttccattgccaacgggcttcatatcgcagtcggcacggcatggatttttctggtagcaggcgaaatggtaggagcccagtccggtttaggctatttaatcattgattcccgaaacgcccttgatttagattttgtcgtggcaggtattgtttttattggcttgttaggtttggcacttgataagggcgtgggctctattgaacgggcaatcttaaaacagtgggg

SEQ ID NO: 6376 - DNA, 341 bp, Bacillus clausii
atggaaactatgatgtctctattggtcggcgtgcttgttacggtcgccacttatttaatcctttccaaaagcttgctccgtgtgattttgggcactgccattatgtcccacgctgttcacttgctcattatgattatgggcggcttttcgggagactcaagcgccccgttgcttggggaggaagcgacttcttacacagacgcactccctcaggcgctaattttaaccgcaattgtcattagctttggcgtaacggcgcttttcttagtactggcctatcggacgtatcgggacttaggcacggatgatcttacaaagttaaggggactcgatgatgatga

SEQ ID NO: 6377 - DNA, 410 bp, Bacillus clausii
ttgaaggcaaatgatgtcattttacggacagtgacgaaagtggccgttttcatcattttaacgtacggcgttcatttatttttagccgggcattacgaacctggcggcggctttgtcgggggactcgtcctctcttccgcatttgtgctgatgtacttggcatttgatatcgaaaccgtgcaaagaggcatgccgatcgattttaaaatggttgcaggggcaggggctttcctctctgtggccacgggggcggcgtcaattgcctttggtgttccgtttcttactcaagaagaagcccatctaactttgccgatttttggtgatgtggcgtttgcgtctgtcatcttgtttgaagcaggtgtcgcactcgctgttattggcactgtcattactattattctgagtataag

SEQ ID NO: 6378 - DNA, 387 bp, Bacillus clausii
cgtgctccaaaaaacaggtatttatgaaatgagttccaatgcaacctttagagaaacgcttgcgtttctaattgttcgagataatgcccaccaaaatgcatttgcgaaagcacttgaaacacttggcgtagaatggggcaaattattccctattccaaattacgacattaataaatatccagaatgccgaaaatttgttgacatgggctaccataacgtccagttcaacttcaggttagacgaaacaagaattggagagattcttcaagggaagtctccaagcagaaacgaaggcgcgttttcagtcactcctcctccagaaggcttccctgttccacaacttcctgaaatgcctaatgaacacagccctggaattagtgatttaaa

SEQ ID NO: 6379 - DNA, 447 bp, Bacillus clausii
tcgaacagctgctggcgcttgtcaagctagaaggacttgaaaagcgccgcccatcagagctttctggcggccagcgccaacgagtcgcccttgcccgggcgctggcgattaagcctgaagtgctgttgcttgatgagccatttggcgcccttgatgcccaagtgcggaaagaactaaggcgctggctaaggacgttgcacaaagaaacagggattacgactgtgtttgtcacacacgaccaagaagaagcgctagatgttgcagataaaattgtcgtgatgaataaaggcgagattgaacaggctggcacgccaacggaagtatatgaggagccaaacagcccgttcgtttacgaattcctaggcaatgcctatcccgtttaaaggcattagcccaatctgggaaattagccgttgccggcgccaagtgggagcttactgcaaccga

SEQ ID NO: 6380 - DNA, 1166 bp, Bacillus clausii
  misc_feature (1)...(1166): n = A,T,C or G
ttgaagattaaagcgcaagtggccatggtgatgaatttagacaaatgcattggttgccatacttgcagcgtgacttgcaagagtacgtggaccaaccgaccaggggccgagtatatatggttcaacaatgtggagacaaaaccggggatcggatacccagttcgttgggaggatcaggagcaatacaaagggggttggacacttaagaacggcaagctggaactgaaatctggcagcaagttgtccaaaatcgccctcggcagcatttttcacaatcctgacatgccggaaatgaaggattactatgaaccgtggacttataactatgaacatctgacaaacgccggggagaaaaagcatcagccggtagcccgtccgaagtcggcagtgaccggggacacgatcgacctagagtggggacctaattgggaggatgatctcgcgggaggccacgtaacgggcccccgcgatccgaatatcgaaaagatcgaagaagagatcaagttcaactttgagcaaacgtttatgatgtatttgccacggttgtgcgaacactgtctcaatccgagctgtgtcgcttcctgcccgtcaggggcgatgtataagcgcgatgaggatggaattgtgctagttgaccaggaagcttgccggggctggcggtactgtatgacaggctgtccttacaaaaaagtgtatttcaattggaaaacgaataaagcggagaaatgtacattttgctttccaagaatcgaagccggtttgccgactgtctgctctgaaacgtgtactggacggatccgctatctcggcgtgctgctctacgacgccgaccgtgttcaagaagcggcttccgtagcgaatgagcaggatttgtaccaggctcagtgtgatttgtttctcgacccgaacgatccggccgttatcgagcaggcccgggcggacgggcttctcgaggaatggatcgaagcggcacagcagtcgcctgtgtataagctggcgattgaatacaagctggcatttccacttcatccagagtaccggacgctgccaatggtctggtatgtaccgncgcttcaagcccgatcatgaatctattttgaaggcaagggattcaatcgggaaacccagatttaaatatttcctgcgatccgaaggaagattgcgcc

SEQ ID NO: 6381 - DNA, 831 bp, Bacillus clausii
tatttgcacggacaagcccggagaataaattacggcttgtcaagtcgctgcaaaagcaagggcatatttgcgcaatgacaggagacggtgtcaatgatgcggccgccttaaagcgggctgatattggggtagcgatgggcatcaaaggcacagaagtgacaaaggatgcagcaaagatggtccttgccgacgacaatttccaaacgattgtccatgctgttgaagaaggacgccgcgtctacgacaatgtcaaaaaaacgattctcttcattttgccgacgaatggagcaggggggattttaattgtcgcaagtatttttctcggcatgtcgatgccgcttacccctgtgcaaatcctttgggtcaatatggttgtcgctattaccgtttcccttggccttgcttttgaacaattggaaccaggcgctatgcaacgcccgcctcgagatccaaaagcaaagttgctttccccctattatcttttccggattacagccgtttcggctatgattggcattggcacgctttggatgaatcattttatgcaaacgagaggctacgaaggcagcacgctacaaacgattattttgcaaatgtttgtcatggcgcaacttttttacatgttcaactgccgcagcgaattggactttgcctttaaccgcagcttctttcaaaacaaagttgcatttggtgtcgcctttctcttgcttttattgcagcttgccttaacgtacattccgtttatgaatacggtcttccaaacaacaccactaaccgtcgggcagtgggcgattccgattttaatgggtttgtttgtgttcactgtcgtag

SEQ ID NO: 6382 - DNA, 915 bp, Bacillus clausii
  misc_feature (1)...(915): n = A,T,C or G
aacctacccacaacttggccgtgtcattggcttttgcgagccccaacaaatcattgatgttgctgaaaaattaattncgattcaacgggattatggcaaccgttccgttcggaagtatgcccgatttaagtacacgattgaccgccatggtctggactggttaaaaaatgagctgcatgctcgccttggctgggagcttggagaagcgcgcccttttcagttcgatcataatggtgatcggtatggctggaccaaaggagtaaaaggacgttggcatttgacgttatttatccaaaatggccggattcaagatacagatgattatcaactaatgactggcttgcgcgagattgccaagattcatacaggggaatttcgtttgactggcaatctnnntgtaattattagcaacgtaacggcagcgaagaaaaaagcgattcaagctattgtcgaaacatatcggcttacagatggccaacatgtctcagcattgcgtcggaactcgatggcttgcgttgcttttccgacatgtggcttagcaatggctgaatcagaacggtacttgccttcgctcattgacaaactggagtttatcctcgatgaggcgggcatccgcgacgaagacatcgtcatccgcatggctggctgtcctaatggctgctcacgtgctgcattagccgaaatcggttttattggcaaagcgccaggtaagtataacctttatcttggcgggggatttgctggggagcgcttgagcaaaatgtacaaagaaaatatcggcgaggcggaaatcttagaaacattggaaccaatcttatttgcttatgcgaaagaacgagaagaaggcgagcattttggcgattttgtcatccgcaaaggctatgtaaaagcagtcgagtcgggaaccgatttcca

SEQ ID NO: 6383 - DNA, 705 bp, Bacillus clausii
taatggaacggccctttaatacaggtagaattgacggggcacccgtcttaattgaactcgctatgaaagcccatgagaaaggcattgatttaaaagcagttgcgttagggcacaaagatggcaatgcggtagttgtcggagatgatattcaaaaaacggaggatttagtcggcaaaacagtagcgatccctcatactttgtcttcccacaatatattactggacgatatgctgcaggcctcgaaccttgcctatgaagcggtcaatgttgtggaattgcctcctccagaaatgccttccgccttaagcgaggggcgcatatccggttatattgtggcagagccttttggcgcgttgggggttcatttaaatgcagggcacgtgctttatcagtccgaagagctttggcccgattcgctatgctgcgcccttgtattaaggcaggatttccttgaaacatatccggagcttgcgcaaaaactcatcacaaattatgccaaaggagggcttgccctcgaagagcatagccattatgacgtccatatggattatctaaatatagatgaagacgtattggagctatctctagaatggatttcttatgatgatttaatgattgaggaacaagactatgaacttcttaggcgacgcatgctggagttaggattgtcagaggatccccctgcttatgaagattttatcgata

SEQ ID NO: 6384 - DNA, 600 bp, Bacillus clausii
  misc_feature (1)...(600): n = A,T,C or G
caactgggtcggcaacagagctcggtaaaatcaatgaagcgattgccgctgttgaatacacacagaccccgctcttgcgccaaattgccgcgtttggaaaaacgattgctttttttgtcgttggcgtcgccatcgtgatgtttttatttggctacctattccggggctttcctgcgggggaattgcttttatcggtcattgccttggcagtcgccgcgattccagaagggttgcctgccattttatcgatcattcttgctgtcggtgtcaaacggatggctagacgaaacgcgattatacgcagccttccttctgttgaaacgctcggctctgtgtctgtcatctgttctgataagacgggaacgttaacaaaaaatgaaatgacggtaacaaccgtagaaacgacagcagccagttacacagttacaggaacgggctatgcccctgagggcgagattgcccctaacgctgaaacaggcaatgaagcgagcactgtgctagaagcgctttcttgcttgcgtacaaacatggcaacggatgccaggtttgcgtcaangccgaacgaccggtcattgggaccgattggaccggcgacccaac

SEQ ID NO: 6385 - DNA, 867 bp, Bacillus clausii
tgcgtcgatgttccttgtcttagtcgcgattttagttgggtcatctgcctatatggccggcgatttgcttggtacgtctatgggcatctcgacgcttacggggatatcgccaaacgtgcttgcgcctcttttcggaatcgtcatcttagcgttaggcttgagcggtagctataagcttgtcgaaaaactaatgattgtccttgttgtgattatgagcatcacctttgtaacgacgatggttgtcgccaaacctcctttaggcgcattgttccaaggagcatttataccaacggttcctgaccaatcgattattatgattattgccttaattgggacaacggttgtgccgtataatttattccttcattcggaaaacgtgattgagcgttggaacaagcccgcccatttagcagactcccgctgggatattgtcatttcgattagcgtaggcggcttgattactgcggctattctcattacgtctgctacaatgatgcaaggcatggaagtgaaaaatgtgtcagacttgtctgtccaattagaaccgcttttaggcagttgggcgctcgtgtttacgagcattggtttattcgccgctggttttacttcagcgcttgcctctccacttggtgcggcgattaccgctagcagcattttaaaatggtcagggggaatgcgtgacacacgctttaaaatcgtctttgctgcggtcatcttattcggagttgtgtcatcgagcctcgggttcgagccactcgacgtcctcctgtttgcccaagcattaaatgggatattgcttccttttgtttccattatgttgctgatcattatgaacaacaaaaaccgcctcggcaactatgtgaattc

SEQ ID NO: 6386 - DNA, 867 bp, Bacillus clausii; identical to SEQ ID NO: 6385

SEQ ID NO: 6387 - DNA, 567 bp, Bacillus clausii
tatgtagtgagttcttgcatatccccgtgtctattattgcaggactgattgcgttgatctttatagtgatagctagaagaagccctgctgttcaaacccggtctatattgaaaggcgcgccttggaacattgtttttttctccattgggatgtatgttgtcgtgttcggtttacaaaatgtcggtttaactaatctgctcgctttgggacttgagaggaccgcggagcaaggtgtttttgctgctacaatgggaatggggtttgttgccgctgttttaagttcgatgatgaacaacatgccaacggtaatgattaatgcgattgccattgatacgacgagcgcgactggattaatgaaggaagcgatggtttacgcgaatgtgattggttccgatttagggccgaaaataacacccattggttcactcgccacattattgtggctccatgtgttgacacaaaaaggtgtaaaaatctcatggggtacttattttaagactggtatagtcattacactgcctgtgttgttgataacgttattaggtttatacctctggttaatgatca

SEQ ID NO: 6388 - DNA, 414 bp, Bacillus clausii
ccctcggcctcgtgtttgctacggttgtggttattggcctattcatccattggctgattccgtccataccattgcctgccgcatttgcacttgctgcgattctgtcaccgacagacgtcgtcgctgtcagttcgattgccaaacgagtccacatgccaaaagggttaatgcgcctccttgaaggcgaaggcttaatgaatgatgcttccggccttgtcgcttttaaatttgctgttgcagctaccgttacaggtatattttcggttagtgaagcatccgtaagcttcttgttgattgcactcggagggcttggattaggcgtgctgttttcttttatgctcatcggcctaaaaatgggcgttcgccgctttggcatggaagatatcacaacgcatatgattattcaaattatac

SEQ ID NO: 6389 - DNA, 288 bp, Bacillus clausii
  misc_feature (1)...(288): n = A,T,C or G
tgggcttcgtctcgaaggagagtggcaacagcaagcagcggcgcnttcttaaagatgtcggcttggatggtcgcggcaatgagtggccggctgtactatctggtgggcagaaacaacgcgttgccttagcccgtgcccttgcaggcggaccgaaactgctgttactcgacgaacctcttggagccttagacgcacttacccgaatggagatgcagcagttggttgaaaggctgtggctcatacaccgatttacagcgttgctcgtcacccacgatgtcagcgaaagca

SEQ ID NO: 6390 - DNA, 729 bp, Bacillus clausii
taaaccccatcctagtgcaagatacgcctggagctggcgtgaagggccgatttgatgatggagaatggcgggtaggccaggctgcctttgtaggtgagcaggaagcggaacattttcaaaatggagtagcgaagaagctagcggctgaaggaaaaacggttgtgttcattcaagacactaacggcattgccggtgtgctggcgcttagggatgaaatccgcccagaaacgcttgctgcaatgaacgcattacaaaaacaggggattcaacttgtgatgttgacaggtgatggagaggaaacggcgcaagcaattgcagaacaaagcggggtggaccgttatgtgtcccgttgtatgccagacaagaaagcggaggaaattaagcgtatacgccaagaaatagggactgtcgctatggtcggtgacggcattaacgatgcccctgctttagcagcggctgatttaggagtcgcgatgggcggcggcagcgatgtagcgttagaaacagctgatatggtcttaatgaagaatgaattgcccaacatcgctgacgcaatcaaacggtcaaaaaaaatgaaccgtattgtgaagcaaaacattgttttttcgattgccgttgtccttttgctcgtgctttccaactttatgcaagtgttggatttgccactcggtgtcatcggccatgaaggaagtacgattttagtcattttaaatggccttcgtttgctaa

SEQ ID NO: 6391 - DNA, 738 bp, Bacillus clausii
gttgagaaagatggcaatctttggcctttcgtttgggattgcggtagggttggcgggttgcaatgaccctggcgcggcagcagagaaaggcgaaacggtgacaattggctaccagaaaggagcgttaacgctgtctcttaaagaagatgaggcgttcgcgaggacaatggctgacttgggttactcccttgaatgggcagaatttaatacaggcagctccacgcttgaagcattagggagcgggagtacagaccttgccaatgccggggatacgccttcgatttatgccattgccaacaggcagccgatccattacatcgccgctacagataatgccccttacagtgaaggcattttagtccaccccaattcaggcatcgatcgcgtggaagatttggaagggaagcggatcgcctttaaccgagcatcaatcgcccaatatttgttgtataaagcattagactcggttgggctaacttttgcagatatagagcctgtgtatctagggccagcagatgcacatttggcctttgaacaagggaatgtcgatgcatgggtcacgtgggatccgtatttagccgtatctgaagaaaaaggcaatcatgtcattgcgacggcggacggccttgcttcctatcgatccttttactttgccaacagtgattttgccgatcaacatccagaagcggtacaggcgtatgtcgaagctttgcaacgggtaggcactacgattgaaag

SEQ ID NO: 6392 - DNA, 579 bp, Bacillus clausii
gacggccagtgaattcgagctcgccctgccatccattgtcgtcggtttgtttggtttgctcgtatttgtacagctaactggttggagttactcgattttaggcggtgcgcttgcgctgacggtgtttaacttgccagtaatggtccgtgtggtcgaggatgcgattacgagcgtgccgagagagcaaaaagaagcaagcctggccctcggcattacccagtgggatacgattcggaccgtgattttgccagcggcgtttcctgggattttgactggtgtaattttgtcggcagggcgcgtgtttggcgaagcagcagcgttgttgtttacgtcaggcgtcacgacgccacggcttgactggatgaatttgaatcctttctcggaaacatcgccattaaacgtattccgtcctgctgaaacactcgctgttcacatttggaaaatcaatacgcaaggcttgattccagacgcgcgggaagtagcagacggggctgcgcttgtgctgattttcgctgtgttgctattcaatttgttggcccgtttgcttgggcgctacgtgcaccggaaactgacggcatc

SEQ ID NO: 6393 - DNA, 822 bp, Bacillus clausii
atgtggtccttttgtgtttttttaaaggatttgagcgtagcgaaaaatccttttctttcttatcttgataataagggtaactattgccgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcgccctgccatccattgtcgtcggtttgtttggtttgctcgtatttgtacagctaactggttggagttactcgattttaggcggtgcgcttgcgctgacggtgtttaacttgccagtaatggtccgtgtggtcgaggatgcgattacgagcgtgccgagagagcaaaaagaagcaagcctggccctcggcattacccagtgggatacgattcggaccgtgattttgccagcggcgtttcctgggattttgactggtgtaattttgtcggcagggcgcgtgtttggcgaagcagcagcgttgttgtttacgtcaggcgtcacgacgccacggcttgactggatgaatttgaatcctttctcggaaacatcgccattaaacgtattccgtcctgctgaaacactcgctgttcacatttggaaaatcaatacgcaaggcttgattccagacgcgcgggaagtagcagacggggctgcgcttgtgctgattttcgctgtgttgctattcaatttgttggcccgtttgcttgggcgctacgtgcaccggaaactgacggcatcgaaataa

SEQ ID NO: 6394 - DNA, 336 bp, Bacillus clausii
  misc_feature (1)...(336): n = A,T,C or G
ttggcncagcgattgcctgccttcttttggcggcatgtggccaaaatacggacaaagaaacggtgcgtgttgccgaagtgactcggtctgtcttctacgcccctttttatctcgcaatcgccgaaggctattttgccgataacgggattgacatcgaactgactacgacttggcgaggcgataaaacgatgacttcccttttatctgacggggcggaaatcgctctagtggggtcagaaacatccatttatgtcgcttnccaggaagctgctgatccggcgattaactntgcagcattgacgcanacagatggaacctttctcgttgccgagaaga

SEQ ID NO: 6395 - DNA, 301 bp, Bacillus clausii
ctggaccaaaatgccgacttgttcgtccgctttagcgcagccctttatgaaggacaaaaacaaatccaatcacagtctcctgaagaaacggctaaagcgattgagcccttttttgaagacacccctattgccattttagcaagttcagtcgaacgctataaagagcaaggctcttatgcagaagatcctgttttaacagaagaagcgtgggcacagttgcttgaaatcatggaagaagcaggagagctaccggaaccgattccctttagtgaacttgtcaatgatgaaattagcaaacaag

SEQ ID NO: 6396 - DNA, 238 bp, Bacillus clausii
atggcatccttacgcattgaccgactttctttcacttacgtcaacgaatcaggtgcttttcaagcattaaaagatgtttcccttgaagtaaaagaaggggaatttgtctcattcattggccccagtggttgcggcaaaacaacgatcctttcgatcattgcaggattgctggaacagaccgaaggatcgctgtctcttgataccgccaataatggccaaattggctatatgctgcaac

SEQ ID NO: 6397 - DNA, 354 bp, Bacillus clausii
  misc_feature (1)...(354): n = A,T,C or G
aaaaacgggtagcgaccaaccaacgagatgggcaaatgacataccatgtcgatagtcctccaggaatcaatccgcacgttaactatgagccatctgtacttaatggtttaaaggaagcagaaaaagtcggcccagaccacacgccgcacgtatcaggcgaagtgaaatatgaagcgatcagccgcccgaacaacttcggccaagcaggggaaacgtatcgccgcttttccgattgggaacgggatgagctaatcgccaatttagctaatgccctggcggatgtcgataaaaggatccaaaagcaantgatcgaaaatgtgacaaaagcggaccgcgactacggcaagcgtctaa

SEQ ID NO: 6398 - DNA, 672 bp, Bacillus clausii
gtgatagcgcgattgaaattgttggattggcggatcactatcatacaggagatgtggttacactcgttgctcagcttgaagaagaggtagattacgatcattggcactggtatacacgtatgagtgaaaatgatgaatgggaagctgtatctggtcaaggaaccgaccactttgagtataaaacgactggagaaagcttcgaagtacgggcagtcctttttgatgacgatcatcatacgtacgcagaatcagagccagtatccgtcatcattgatgatcacgaatcacacgatccgcatatttggctagaccctgtattggcacaagagcaagttaatatcatccgcgatgccctgattgaggcagatccagacggacaagcgatttatgaggaaaatgcagaagccttcaataaagagcttcaagcattacatgaggactttcaagctgctcttgaagacgcagaaagccgcgtttttgtcgtacaacaccaagcatttggataccttgcgcaacgttatcagttagaacaagttgcgattggcggtttatctacagaagtagaaccaagtccatcgcgcattgctgaaattggaaaactcgtggaagaacataatgtgcccgttatttattatcaacaaggggccaattcatccattgccgaaacagtcg

SEQ ID NO: 6399 - DNA, 696 bp, Bacillus clausii
gcggctttgcggtgaaattttacacagaagacggcaactgggacttagttggaaataacttgaagattttcttcattcgcgatccgctaaaatttccagatatggtccatgcgtttaaaccggatccagtaacgaaccggcaaagcatggaacggttttttgattttgtctcgcaaagcccagaatcgacccatatgatcacgtttgtgttctccccgtggggcattccggcaaactaccggaatatgcaaggatcgggtgttcatgcgtataaatgggtcaacgaggaagggaaagcgatgcttgtcaaataccattgggagcctgtacaaggaatcaaaaacttgacccaaaaagaagcagagcaaattcaaggaaaaaacttcaaccacgcgacgcaagatttgtatgaagcaattgaaaaaggcgattaccctgaatgggaactttatgtgcaattgatggaggacggcgaacatccagagcttgacttcgatcctcttgacccgactaagctttggtataaagaccagtttccttggcacaaagtcggcaagatggtgctcaacaaaaatccagaaaattattttgcggaagtggaacaagccgcctttggtactggcgtccttgtcgatggccttgacttttccgatgacaaactgttgcaaggacgcacgttctcctattcggacacgc

SEQ ID NO: 6400 - DNA, 324 bp, Bacillus clausii
gactatggaggatgtcggttcgttgtttgaaccaaacttcgagttgattcacagcatggagccagacgtcattttcatttctggccgtgcgtctgagaattatgaagaattaagtgaaattgcgccaacggtttatatggccgttgacaacgaaaactttatggaatcgtttgaaaccaatatgcggacgctgggcgatatttttgaagcgcaagacgaagtagaagagcagcttgcaggcatccatgaaacgatcgacaacgtcaaagagcgggccgacaacacagataaaaatgccttgattttgtctgctgatgaagggtc

SEQ ID NO: 6401 - DNA, 429 bp, Bacillus clausii
ggagtttcaagctgcccatgattatatggcgatggctgcctactgccaccatattagttacaatggcttcgccgattacttccttaagcaagcagaggaagagcgggaacacggcatgaaagtgtatgattatttaaatgacaaaggccaaaaagctgtctttgaggcgatccaagccccaaaagccgattatggttcaacttggttcgcccacattttgaaggcaagcgcttggcccaaagagcgggaagtgacgaaaagctattataaaggtgtaccagatcgcccaagaaagaacaagaataccaaacgctttctttcttaaactggttcctcgacgaacaagtggaggaagaggccacatttgaaacgcatattgattatttgaaccgcatcaaaagatgatgccaatgctctttatatttatga

SEQ ID NO: 6402 - DNA, 807 bp, Bacillus clausii
gctggctggctaatttaggaaagcaagattttgccggttcgacagtcgttcacttgacgggtgcaatggccgctctagcagctacattgattttaaagccacgtcttggcaagtatgacaaaaatggcaaagtcaatgacttgtttggccataaccaagtgtataccgcccttggcgtgttgattttgtgggtcggttggtttgggtttaacgctggttcgactggcggcgtcgctgatgcgttctttggttatgtagcactaaatacacagcttgcggctggagctggcaccattgcagcactgtttcttgtttgggcacttaatggaaaggccgacgtgccgacgacattaaacggaacgctcgccggccttgttgccatcactgcttcctgtgcattcgttgcgccgtgggctgcagtccttataggtgtcattggcggattaattgtcgtcgttagcatgaacatgtttgataaacttaaaattgacgatcctatttttgcattaagcgttcacggtgttgctggtgtatggggaactctatcaaacggactatttgcaacgcctgaattagcagaaatgaacggtggtctgcctgggttgttttatggcggtggtttcgaacagcttggcgtccaactattaagcgtggtggtttgcggtgtgtttgcttttgtcgcttcttacgtattgttgttaataacaaaagggcttctcggcggaaacttgcgcgttacagaagaagaagaaattctagggctccatatgaattaacacggttcttacgggtaacctgaaactgttc

SEQ ID NO: 6403 - DNA, 768 bp, Bacillus clausii
  misc_feature (1)...(768): n = A,T,C or G
tcctgatggcttttcgcaaggctatacaaacaattaccgtttatacaaggaagatggcgagcctatttgggacgaacgcaacatgctgcgcgccttcgtgcaaacgcactcggcaaatgcagaagtgaccgattcagccgcagcaggcactgctttagcaaccggggaaaaaacgaataatggcatgatcggcgtaacccctgatggacaaacattgtcgacaattcttgactcggcgaaagaaaacggcaagcgcacaggacttgtggcgacatcaacgattacacacgcgacgcctgccgcttttgctgttagcgtagagtcacggaacagctacacagaaatcgcctcgcaaatggtcgcaaacgatcatatcgatttaatgcttggcggtggccggacggaatttgtgcctgaagaccaaggcggtattcgcgaagatggcgttgatttaataagcgaagcagaagaaaaagggtttgcatttgtagagacagcgcggcaattagcgaactggaatggcgaagaggatcgcctgcttggcttgtttgctgaagaagcgctgtcgccggcagctaataaacggaccgacgagcctagtttaggggaaatgaccgaaaaagcaattgagttcttatcaaaagaggacaatgggtttttcttaatggtagaaggcagccaaattgactgggctggacacgccaatgacgcctattacgccatgacggatacggccgcttttgaagaatctctccaatcngcggtcga

SEQ ID NO: 6404 - DNA, 324 bp, Bacillus clausii
  misc_feature (1)...(324): n = A,T,C or G
actttaatgcggttgttgtcggtgcagggttttcgggtttgtatatacttcatcgtttacgtgaaactggtttatccgtccgggtttatgaagctggtgacgatatcgggggcacgtggtactggaatcgttatcccggagcccgttgcgacattgaaagcatctattataactacacgttttccgaagaactgcttcatgagtggacatggtcatcaaggtatgcagatcagccggaaatcttacgttatctcaactatgtcgcggataagttcgatctgcgctgtgatatccaattagggacgaagattatcgcaanccaat

SEQ ID NO: 6405 - DNA, 201 bp, Bacillus clausii
  misc_feature (1)...(201): n = A,T,C or G
aanctagcaatggcacgcaggtgtcggcaaaatacttcatcacagcggtaggctgtctatctgtaccaaacatgccgaaattcaagggcctagacactttccaaggcgagatgtaccataccggacgttggccgcatgagaaggtaagctttgcaggtaagcgggtcggcgtgattgggacaagttcgacaggcacccaan

SEQ ID NO: 6406 - DNA, 1026 bp, Bacillus clausii
  misc_feature (1)...(1026): n = A,T,C or G
tcccgattattgcccaagaggcggagcatcttaccgtttttcaacgcacaccgcagtacatctctccagccaaaaattattcctacgatacggagttcatacgggaaaccgtagaaaactaccaggaaattaaggaacggatgcgtgactctatgcacggtgtacctttccacgctcgtgatcagtcggcgctgcaagattcgccagaagtacgccagcttgtatatgaggcagcgtgggaggatggcaggcttttatcgatgttgtacagctataacgatttgcttgttaatgcaaaagcgaatgaaacaatcaagatacgtcaaattgtacgggatcctgaagtagcaaagaaactaatgccgtcgttctattacgcaacgaaacgaccggttatagacaaccattactttgaaacctttaaccgtgacaatgtctctttagttgatgtcaggtcagccccaattgaagagattacctcaacggggattcggacagtggaagcaatgtatgaattggacatgattgtatgtgcaactggatttgatgccatgacagggcccttattcaaaatggatatccgncggtaagtctggaatcntcgttaaaggnaaaaatgggaagagggagcaagattaaggacataccttggaatcgcagtcgctgattttcctaatctttttatgattacaggccctcagagtccttctgtgataggcaatatgttggtttccattgangcagcacgttgnaatggatttccgattgtattgnaatatcttcgcagtaacggtattgaagccttggaagcaacggtggaagcggaagaaggttggaagcaagcattgtcaggnaaattgctgattctacgttggnntaacaaagacggactcctnggntacatgggggcgaacatcgnntaggntaagccaagggggttcttggcttatctgggaggagtcggcaattaccgtcaaatatgtgatcgtgttgcagccaaagactatgagggattttcaatgattc

SEQ ID NO: 6407 - DNA, 210 bp, Bacillus clausii
aaaaacagccattcttgttaacgcatgatattggcgaagcgattgcaatgagcgaccggatcgttttgttcacccaaaagcccggccgtgtcgcacaaattttttctgttccacaagcattaagacaactttctccttttgaggcccgaaaccatccagaattcaacaatcaatttcagctcatttggaaggagttggaacgacttgaca

SEQ ID NO: 6408 - DNA, 500 bp, Bacillus clausii
tgcaccaacgctacatgactacccgtcaaaaggaaaaacggttcattcgcctcacacagctagcgattgtatttgctcttgtaattggttgggaaacagcctcacgtttagcattaatcgacccgctgctatttagcatgccctcacgaatcgtcagtttgctttatgagcatatcgtcgccggaacgctatggctccataccggggtgacaatgtttgaaacggttcttggctttctcctaggcaccgttgctgggacgttattggcagctttgctttggtggtcgaaaaagttggctgaaatccttgacccatttttagtcatattaaattccatgccaaaaattacgattggcccgattttgattgttgggcttgggccaaacatgacttctgtcattgctatgggcatgctcgtttccgtcatcattacaacaatggttgtttacacagcatttaaagaagtagatgacaactatttgaaagtactgcaaacattt

SEQ ID NO: 6409 - DNA, 435 bp, Bacillus clausii
tagcgattgtttggtttggcttaggcaatgcatcgattttgtttattgttacaatcggagctacttggacaatgacagtaagcgccagcaccggctttaaaaacgtgcccagcttgtatttgaatgtagcacggacgcttggctcatcaggggctcatctcgtacggactgttgtgttgcccgcttctgtcccgcacttgatttccggtttgcggatggcctgggctttcgcttggcgggcaattatggctggtgagctgctaggtggttcaggcgggttagggtatttgcttaatatggggcgctcgctccagcaaatggatctcgtcttgtcggtcatgatcatcatcggtatcattggcacgttaatggataatctcgtgtttttacgcgctgaacgatctgttcagaaaaagtggggcttgaagccaagtc

SEQ ID NO: 6410 - DNA, 942 bp, Bacillus clausii
gcgcgtttgcctgcgtggcagcgcttgccttagcaggatgcggccaaggcgcaacagaaggggaagttcggattggttattttccgaatctcacccacattgctaccattattgcgttggaaaatggctattttgatgaagaatttggcgaggagacgacgattcaaacgatgactgttccagacggcagcgcttttatggaggcaatgtcgacaaatgagattgacatcggcacagtcgggccagggccagcaatgaatacgtatacgtccaatcccgcccattcgattattgctggtgcagtcaatggcggagctgtgttaatggtccgtgaagatgctggtgtggagacagtcgctgatttagctggggaacgggtagcagtgccgacacttggttcgacgcaggatgtcatgctccgtaaagcattagcggatgcaggggttgataccgaggaggtagaactcattccacaagcgccggcggatacgtcgacgttgtttaaccaaggggacgtggcagcggcagcgacccaggaaccgtggggcagctatttggaggaacaaacatgggctcgctttttgttggacgctgatgcgtttgcgtggggagaggaatctaccaacacggttgttgtagcgacgcatgattttctcgatgtcaatgaagagttagcacgggcctatttgcgcgcgcacaaaaaagcggttgagtttgtccaagagcaacctcaagaagcagccggcatttttgtcagccatatcaaggaagaaacggggaacgagctgaacattgcagaaatagagcaatcaatggagccgttgttcccaaccgttgacgtttatgaacaagttttgcaagagatggccgaaattgcccatgaggcaggcaatatgagttcaactgatattgacggattggttgatttaagctatctagaaa

SEQ ID NO: 6411 - DNA, 876 bp, Bacillus clausii
tggttctccttatgacgggaatcgctgttcgctcgctgagtgcaaccatttctttgtttgcaggcactgttttacttggcctctcgattgcggtgtgcaacgtgctcattccaagtctagttaaacgggacttttctaataacgttgggctaatgacagggatttacgcagtgtcgatgaatttatgcggtgcgatcgcatctggcatcagcgttccgctcgcccgtaatctcggtttcggttggaatggcgcacttggagtttggggcatactcgctttgatcgccgcactattctggttccctagagtccgtgggagtcacacatcagctgtggtcacaacgcctggtggagtggtaaggcgaagcctgtggcgttcaccactggcatggacaattaccctttttatgggaatgcagtctctccttttctatgttttgatcacttggctgcctgaaatgatgacaagccgggggttgagtgaagatagcgctggttggatgctatcgctgtttcaaatggctacgcttcccgtatcctttatcgtgccaatccttgcaggacgcatgaagaaccaacatttactggtcaccataatggctgttttgttttttgtttcattaggcggcttttatttcggcaatcaagcacttatttcgttatggacgattttactcggaattgccggtggatgtgcgtttagtttggctatgatttttttaagtttgcggacgaaagatgcctacgatgcagcgtctttatccggtatgtcccaatctgttggctatttgttggcggcaacagggccgatcttgttcggtttccttcatgatgtgacagcaggctggaacttgccactagtgctgatgttatcgt

SEQ ID NO: 6412 - DNA, 312 bp, Bacillus clausii
ggaaattgccttcaccgcaggtttgcctatcaaaacgatgtctatattgtttaacgtgttaacaggggtaacgattgcaatcattatgccaatagtcggcgctttactcgtttcagccattatcgtcttacctgctgcgatttcgatgcggttaagcaaaagctttaatggtgttattttcattggaatcgtgattgccttaattggcatgttgagtggtttagtcgcttcgtatgaattaggtacaccaccaggagcttctatcatattaatcttcatgatcctttttgctgcgactgcactgattaaaca

SEQ ID NO: 6413 - DNA, 308 bp, Bacillus clausii
atggagatgtttttccatggattcatgcaaagagctttccaagcctcactcctaatctcattcattgcaccattgttaggcttgtttttaatattacgtagacagtctctaatggcggatactctatcacatgtatccttagcgggtgtagcactaggtttgctaattggcgtcaatccaaagtggaccaattttttagttgttgcggtaattggtatcatgcttgaaaatttgcgagtggtgtatcgcacgtattcggaaatttcgattgcgattttaatgtcagtcggcatggctctagccctatt

SEQ ID NO: 6414 - DNA, 481 bp, Bacillus clausii
  misc_feature (1)...(481): n = A,T,C or G
atgcattatattgaactaaaaaatctcgcctttcagtatgaaaatgaaccggtgttagaaaatatttcatttgaagtagatgcagaaaatttcgtgatgcttaccggaggaattggtgccgcaaagacgactttgttgcgtaatattttaggtttgctgaaaccatcaaaagggancgtccgcatttcaccaaaaaatcgttttggcgagaaactcatgatcggatatgtttcacagcaggtcgcctccttnaacgctggatttccaagtactgttcttgaaacttgtgctatccggccgctatcaaaggggaaaatggtttaaaagattanatcaagaagacaaanaagcatgtgcggcgctcactagaaatcagtgggaatgtgggatatgcgcaataaaaaaataggagaattatctggcgggcaaaaacagcggatttcgattgcacgtgtatttgcaacagaccctgatttgtttg

SEQ ID NO: 6415 - DNA, 740 bp, Bacillus clausii
  misc_feature (1)...(740): n = A,T,C or G
atgcaagcgttagctgaacaaacggaaacaaagaacgtgtatgatgttcttgattttaatctttggtacggcaacaatcaggcactaaaaaacatttcgctgcaattaaaggaaaagcatgtgacggcgatcatcggcccttctggttgcggcaaatcaacgtttatcaaaacattaaacttaatgtctcgtttaaatcccgatatccgcatggctggtgagttgaattttcgtggcgaaaatttgttgacaacttcgatggatttggcagagctacgaaaagcggtcggcatggttttccaaaagccgaatccctttccaaagtcgatttatgaaaatgtggcgtatgggccacggattcatggaattcgcaagaaaaaagaacttgatgagattgtcgaatcaagcttgaaaggcgcgtttttatgggaggaagtcaaagatagactgaataaaaacgcactatcgttatcaggcggtcagcagcaacggctttgcattgcccgggcgctagcgacaaagcctgaggtgttgctaatggatgaaccgacaagtgcccttgacccgatttccacgacgaaagtagaagaactgattacatcgttgcgtgattctaatacaatcggcattgttacacacaacatgcagcaggctgcgcgaatttcagacgagacngcattcttttacatgggcgaactggttgaaattggcccgacacancgaattttttccaaccctga

SEQ ID NO: 6416 - DNA, 1065 bp, Bacillus clausii
  misc_feature (1)...(1065): n = A,T,C or G
gctatatactcgccattaccgcttctttgcttttgttgcnctacatatggcttgcattgttttggaaaaagatcaagccactgctttcctttcaagaagaaccagaagaaaagcatcgtgccattgcgctcctaacgttttctggcgtacgtggcgccgtcacgctggcaggggcattcacaatcccttacatcgccgccgacggttccccgtttccagaacgggacttgctgctgttccttgccgccggcaccattcttgtgacagtgttgcttgcaagcatcttgctgccgttattagccaaaaaaccagaacttcaagaagccgaccaacagcttagctttacacgggcgcttgagcagttgacccaagaggcaagagtgattttggctgataaatcccattctcatgacaaacaaacactgcgccgtttacagcgcgaatatgaccgtattgtcatcccgctgctccatgatgccaataccaatcacaccttgatagcgccagaccgcaagaaagagctttttctgttgttcaaagcgttgcaacatgagcatgatttgcttgaagcaacacttgaagatcccacattaacagaagcgatggaaaaacggctacgcgcaagagcgcaaaacattggtcaaatcctaagtgtccgctcgccacttgctttcttacgtttcggttcaaaacattttatcgacagaatgttaaacaaagcgaacaaaaatcgcctatccattgaggaaaagaaccgtctctatttgatttacacacgcctctttgctgacattatcaaaaaactcgacgaacaaatgacgacaaaaaacgagtctgtcactaaacgagtcatccatttttacagaattcagcttaaccgccttgatcatgtgcacttgaacaacgatgaaaagctctataaggaaatgctcggattgcattacgagattatggaagagatgcgccgctctttgcaaacccttttccaaaacaatgacctttctcgtgaaacgacacaaaagctgcgccgttacttaaactatatcgaggccaatgtaaccgaag

SEQ ID NO: 6417 - DNA, 1189 bp, Bacillus clausii
ttgagtagccgtacaatttcatcaaataaacaagcaagccgaggcactgactttaatgcggttgttgtcggtgcagggttttcgggtttgtatatacttcatcgtttacgtgaaactggtttatccgtccgggtttatgaagctggtgacgatatcgggggcacgtggtactggaatcgttatcccggagcccgttgcgacattgaaagcatctattataactacacgttttccgaagaactgcttcatgagtggacatggtcatcaaggtatgcagatcagccggaaatcttacgttatctcaactatgtcgcggataagttcgatctgcgctgtgatatccaattagggacgaagattatcgcagccaattatgatgatcaaacccatagatggaatatccaaactagcaatggcacgcaggtgtcggcaaaatacttcatcacagcggtaggctgtctatctgtaccaaacatgccgaaattcaagggcctagacactttccaaggcgagatgtaccataccggacgttggccgcatgagaaggtaagctttgcaggtaagcgggtcggcgtgattgggacaagttcgacaggcacccaatgtatcccgattattgcccaagaggcggagcatcttaccgtttttcaacgcacaccgcagtacatctctccagccaaaaattattcctacgatacggagttcatacgggaaaccgtagaaaactaccaggaaattaaggaacggatgcgtgactctatgcacggtgtacctttccacgctcgtgatcagtcggcgctgcaagattcgccagaagtacgccagcttgtatatgaggcagcgtgggaggatggcaggcttttatcgatgttgtacagctataacgatttgcttgttaatgcaaaagcgaatgaaacaatcaagatacgtcaaattgtacgggatcctgaagtagcaaagaaactaatgccgtcgttctattacgcaacgaaacgaccggttatagacaaccattactttgaaacctttaaccgtgacaatgtctctttagttgatgtcaggtcagccccaattgaagagattacctcaacggggattcggacagtggaagcaatgtatgaattggacatgattgtatgtgcaactggatttgatgccatgacagggcccttattcaaaatggatatcc

SEQ ID NO: 6418 - DNA, 432 bp, Bacillus clausii
  misc_feature (1)...(432): n = A,T,C or G
gcaaaaggtttgaancgagagccaaaggaagaacaagcaaagcgatttctactttattaggattgcaggcgaaaacggcacgagtaatccgtaacggcagtgaagtcgagttgccgattgaagaantaaaggcaggcgatgaacttgtcattcgcccgggagaaaaaattcccgtcgacggctacgtanaaagcggtgcctcttccgtcgatgaatcgatgattacaggataatcgctcccagtcagcaaggaagcagacgatctgctgatcggagcaacgctaaacaancaagggtcgctgcgaatgattgccacaaaagtcggcaaagatacagcacttgcgcaaatngtcaaagtggttgaagaggcgcaagggtcnaaagcggatatncaacgtattgctgaatagagtgtcnggcntttttgtccct

SEQ ID NO: 6419 - DNA, 471 bp, Bacillus clausii
  misc_feature (1)...(471): n = A,T,C or G
caaaacgtggagccaacacatattaatcattgtcgcttttttgtttntaggtgcttttttattactcccgcttatcgtcatttttgcaggggcgttttcacaagggctaacggtgtttttggcagcgattactgagcctgccgcacgttcagcgattcagcttacactgcttgtgaccgtgattaccgtgccgttgcaactgttgttcggcttgtcggcagcgtggctactaacaaagttccgttttcgtggaaggcagttgctcatcaccttaattgaagttccttttgctgtgtcgccagttattgccggtctagtgtttattttgttatatggtgttccacggcttttttggcgaatggcttcaagcacaaggtttccaaatcattttccgccgtccccaggcattgtgctggccacgatgtttgtgacattgccttttattgcaagggaactcattccgttaatgga

SEQ ID NO: 6420 - DNA, 1037 bp, Bacillus clausii
atgatggagtatgatgtagtcgttattggtggcggccaagcaggcctggcagttggttactatttgaaaaagcaaaagcgaccatttcttatagtagatgagcaaaacgaggcaggcgattcgtggcgaaaacggtatgattcccttgttttgtttacaccaaggtgttacagcagcttgcctggtcttgcctttagcggcgatccaaacggttatccgacaaaagatgaaatggccgactatttatggacgtataaagaaacgtttcagctaccagttgcttacaagacaaaggtagaaaggctagagaaaaagcgtgatcgctttaaggtttggactacaagtgaggggaaaacgtatgatgccaagcaagtcattatcgccacaggtgcctttcacacgccttttatcccaccgcttgccaacagcatccatcctggaattgcccaattgcatgcttccgattacaaggggctagaacaaatcgttgctggtcccattttgattgttggtgctggcaatacaggagtgcaaatagcggctgaattagtggagcaccacgatgtcatactggcttgtggaaacaagccgaacgttttgccccagtcggtctttggaaaaaatctattttggtggtttgataggcttggcctttcgaaggcaacgatcaactctgtactcggaaagtggctgcaaaaaagagatccaattatcgggaacgattttcatacagtaagaaaaagggcgaaattaaaaggacgcttaataaacgtgactggttcaaaggcttattttgcggaaggttctcctgtttctgttcaaacgattatttgggcaacaggatatagaaatgattattcatggattgatattgatggtgttttcgatcaggagcaaaaaccaattcacgttagaggtgtgacaaatgtaaacggcttgttttttgtaggcctaagttggcaatataaacgaggttctgcccttgtcaaaggagtgggggaagatgctgcatacattgttagccaactgtcaaaaca

SEQ ID NO: 6421 - DNA, 1164 bp, Bacillus clausii
atgaagacgttaatgacggtggctgttattggcggtgccatcattggcgaatggggagaagtcgcagtcgttgtgattttattcgccattagcgaagcgctcgaacgattttcgatggaccgggcgagaaagtcgattcagtcgttaatggacattgccccaaatgaagcactcataaagcggaatggccaagagttcactgttcatgttggtgatattgtcgttggcgacatcatgattgtgaaacctggccagaaaatcgcaatggatggaatagtggtgcatggccattcttctgtaaaccaagcagcgattacaggagaatcggttcctgtggaaaaggcggttgatgacgaggtttttgctggcacgttaaatgaagaagggctgcttgaaatcaaagttacaaagttagtcgaggacacgacgatttcaaaaattatccaccttgtcgaagaagcacagggtgaacgggctccggcacaagcgtttgtcgataaatttgctaagtattatacaccgattattatggtggtcgctgcccttgttgcaatcattcccccgttatttacgggagggaattggagtacttgggtttaccaagggttagctgttcttgttgttggctgcccatgcgcattggtcatttccacgccaatttcgattgtctctgcgattggcaatgctgctaaaaaaggggtgcttgtcaaaggtggcgtttatttagaagaaatggcttcactaaaagcaattgcatttgacaaaacagggacattgacgaaaggtattcctggtgttaccgactttgccttattgaatccccaacttgatcaaaggcaactgtttgcaattgtggcggcattagagaatcgttcgcaacatcctttggcttctgccatcgtcgccaaggcagaagacgaacaactgccttatcacgattatatggttgagaacgtcacggcgctcacgggcaaaggcattacaggaacagtcaatggaaaaacgtattacgttggcagtccgaagctgttccaagaacggttgccgacttgggacataacgccatttgcgcaaaacatcaaaagcttgcaacaacaagggaaaaacagcgatgctggtcgggacagaaacggagttgctcgccatcgtcgctgtcgcagatga

SEQ ID NO: 6422 - DNA, 1404 bp, Bacillus clausii
cgtctacggtgaggcaacgatagaagcgctggaggaagcaggtgcatttgaacagctaaaagtgacaaaggagccgagccggcggcagccttttcaatatacacaaattcctttttataaaaaacaccgctcgattcttttatcggtcttattgcttgtgtttggctacgtgtttcaatttaaatatggcgagtcgaatatcggaacggtcggtttgtttttaacagcaattcttgccggtggctttcctttgctaaaaacgggaattcgtaatgtagcgcggcttgaatttaatatgaagacgttaatgacggtggctgttattggcggtgccatcattggcgaatggggagaagtcgcagtcgttgtgattttattcgccattagcgaagcgctcgaacgattttcgatggaccgggcgagaaagtcgattcagtcgttaatggacattgccccaaatgaagcactcataaagcggaatggccaagagttcactgttcatgttggtgatattgtcgttggcgacatcatgattgtgaaacctggccagaaaatcgcaatggatggaatagtggtgcatggccattcttctgtaaaccaagcagcgattacaggagaatcggttcctgtggaaaaggcggttgatgacgaggtttttgctggcacgttaaatgaagaagggctgcttgaaatcaaagttacaaagttagtcgaggacacgacgatttcaaaaattatccaccttgtcgaagaagcacagggtgaacgggctccggcacaagcgtttgtcgataaatttgctaagtattatacaccgattattatggtggtcgctgcccttgttgcaatcattcccccgttatttacgggagggaattggagtacttgggtttaccaagggttagctgttcttgttgttggctgcccatgcgcattggtcatttccacgccaatttcgattgtctctgcgattggcaatgctgctaaaaaaggggtgcttgtcaaaggtggcgtttatttagaagaaatggcttcactaaaagcaattgcatttgacaaaacagggacattgacgaaaggtattcctggtgttaccgactttgccttattgaatccccaacttgatcaaaggcaactgtttgcaattgtggcggcattagagaatcgttcgcaacatcctttggcttctgccatcgtcgccaaggcagaagacgaacaactgccttatcacgattatatggttgagaacgtcacggcgctcacgggcaaaggcattacaggaacagtcaatggaaaaacgtattacgttggcagtccgaagctgttccaagaacggttgccgacttgggacataacgccatttgcgcaaaacatcaaaagcttgcaacaacaagggaaaaacag

SEQ ID NO: 6423 - DNA, 177 bp, Bacillus clausii
caaaaaaacgatgcgcaacattaaacaaaatttttcttttcccctttttttacaattcggcggcaataccaattgcggcggctggactcctcgccccatgggtagcaggagcagcgatggccttttcgtctgtatccgttgtcgcaaatgccctgcggttacaacgaatccgtatgc

SEQ ID NO: 6424 - DNA, 393 bp, Bacillus clausii
gatattgccgggatttggcttaagctttgggtttacaatgctctatttgagcttagtggtgctcattccattagctgcgttgctgttgtttacagtccacaacggttgggaaacgttttggaatgccgtgaatgacccccgcgtgttcgccgcatttcccattaagcttctcggctgccttgatggcagcattagtcaatggcgtgtttgggctattagtggcatgggtgatggcacgctattcgtttttcccgggaaacgaattgatggatggcatgatcgattttgccgtttggcttaaccgaacaagcaataacaaggcatcgcttttaacaaagccctctataccggaaaaatggctgggattggggtccttggctttgcaccctttgg

SEQ ID NO: 6425 - DNA, 174 bp, Bacillus clausii
agacagccgacattgccctaatgggcgatgacttagtgaatcttccctttacagtgaagctgatccgcaaaacattgaacatcattaaagcaaacattgcttttgcaattgctattaaactagcggcattgctcctcgttgtcccaagatggctaaccctttggataaccattc

SEQ ID NO: 6426 - DNA, 162 bp, Bacillus clausii
  misc_feature (1)...(162): n = A,T,C or G
tgactttaacaaacggggatgtanctgattttttgacgcctaaccgcagattaaataaactgcttgaacaaggccccttttcgtatacgtactatgagttccaaggcaatcatacgtggacatattggcagaaggatttgcctcgggcactacaaacagtgt

SEQ ID NO: 6427 - DNA, 573 bp, Bacillus clausii
  misc_feature (1)...(573): n = A,T,C or G
tttctttcctggaccggcaagcagtcaagtaggtatagggattggtattaaccgcgcaggtacattaggaggaattgtttcatttattggctttactcttccttcagtccttgctttaattggatttgcattgttcgtcggcaagtttggcgttggcgaaatgggacttatccacgggctgaaaatcgttgccgtancggtggtggcacatgcgattctcggtatggcgaaaaacttgactcctgacttgcgccgcaaaatgatttgtttgtttgccttgcttgccgttttgcttgtaccctctgcatttgtgcaagtggtcgttattttgctggcaggtttgctcggctattttatgtttgcaaatgagagtaacacgaaccaggagcgttccgtagcctttccattatcgaaaacagtcggagtcgtttccctttccttgtttttcattttgcttgttggtttgccaatgttggcaacggcaatgccctctcaatggctagccatggtcgattcgttttaccgtgcaggttctttagtgtttggcggtggccatgtcgtcttgccactatt

SEQ ID NO: 6428 - DNA, 336 bp, Bacillus clausii
gtacgcattttattgttggccgcgaccatgcaggtgtcggcaattattatggtacttatgacgcacaagagatttttaaagagtttgaagaaggcgagcttggcattaagccgttgttttttggacatagtttttattgcaaagcttgcggcaacatggcttcgcaaaaaacatgtccgcatgattctgagcaccacgttattttatcagggacaaaagtgcggcaaatgttaaaagaaggcgtgcttcctccacaagaattcagccgcaaagaagtggttgaagtgttgatgcgcggatagggcgatagaaaaatagagaaagagggagcggcaa

SEQ ID NO: 6429 - DNA, 678 bp, Bacillus clausii
  misc_feature (1)...(678): n = A,T,C or G
ctttggcggtctattgccacttaggctattttcacgaagaatatgtaagaagacgaaaaatggcttgatgaagaaaagtatncggacctcgttgcattatgccagtttctttcctggaccggcaagcagtcaagtaggtatagggattggtattaaccgcgcaggtacattaggaggaattgtttcatttattggctttactcttccttcagtccttgctttaattggatttgcattgttcgtcggcaagtttggcgttggcgaaatgggacttatccacgggctgaaaatcgttgccgtancggtggtggcacatgcgattctcggtatggcgaaaaacttgactcctgacttgcgccgcaaaatgatttgtttgtttgccttgcttgccgttttgcttgtaccctctgcatttgtgcaagtggtcgttattttgctggcaggtttgctcggctattttatgtttgcaaatgagagtaacacgaaccaggagcgttccgtagcctttccattatcgaaaacagtcggagtcgtttccctttccttgtttttcattttgcttgttggtttgccaatgttggcaacggcaatgccctctcaatggctagccatggtcgattcgttttaccgtgcaggttctttagtgtttggcggtggccatgtcgtcttgccactatt

SEQ ID NO: 6430 - DNA, 282 bp, Bacillus clausii
gattagcgcaatcggcattatccgccttcctgatgtttatacaaggtcccatgccggcacaaaaagtgcaacgcttgccgttttgctgacactgacgggttgctttatctatttttggcttgcagacgcttatattagcattcgccttatactcggcattgtatttgtgttcttgacggcgccggtggcgggacatttgattacgcgtgcagcataccgatctaaagtgccgcttacggaagaaagcgtagaagatgaactgaaggaagttttaaacaaaga

SEQ ID NO: 6431 - DNA, 375 bp, Bacillus clausii
tactggcatttttgctgatgctggcgccaatcattacatggtgtctctcgcggccgataagatgaacgcgcctctacatgagttgttattcagaggcattctctgcaattggatcgtttgcctcgcgatttggacttccctccgagcggaaggcgatattgccaaactttttctcatttttgtgctcatttttgcctttattgcatctggtttcgaacatagtgtagccaacatgtctcttcttggtatggccctgttccatggcggcagtgatatggtcacaattagcggatttttttataatttgattcctgttacgatcggcaatgtcattggcggcgctctgtttgtcgctggtgcttatgtagccattag

SEQ ID NO: 6432 - DNA, 345 bp, Bacillus clausii
acagcttttgctaaacattttgattgcctttctgtgggtactattgcaagatgaggaccagttttatttttcaacattttttgccggctatttagtggggatcggcattctttatgtgatgcgccgtttcttttttaacgaattttatttgcataggctgtttgcggtagtgaaactgttgatcattttcatccgtgagctcttttactcgagcgtggtgctcatcaagcaaattttaagcccaaaactaaaaatcaccccgggaatttttacgtatcgaaccgagttaaaaagtgatgtagagataaccgccttagcacttttgcttacgttgacgcctggttc

SEQ ID NO: 6433 - DNA, 534 bp, Bacillus clausii
tatttgcacggacaagcccggagaataaattacggcttgtcaagtcgctgcaaaagcaagggcatatttgcgcaatgacaggagacggtgtcaatgatgcggccgccttaaagcgggctgatattggggtagcgatgggcatcaaaggcacagaagtgacaaaggatgcagcaaagatggtccttgccgacgacaatttccaaacgattgtccatgctgttgaagaaggacgccgcgtctacgacaatgtcaaaaaaacgattctcttcattttgccgacgaatggagcaggggggattttaattgtcgcaagtatttttctcggcatgtcgatgccgcttacccctgtgcaaatcctttgggtcaatatggttgtcgctattaccgtttcccttggccttgcttttgaacaattggaaccaggcgctatgcaacgcccgcctcgagatccaaaagcaaagttgctttccccctattatcttttccggattacagccgtttcggctatgattggcattggcacgctttggatga

SEQ ID NO: 6434 - DNA, 474 bp, Bacillus clausii
tcaatggcatgcgacgacaattgacaatgtagaaagtgtgttacatacaaatcaaacgactggtttagaaacaaaagaagcaaatcggcgcttgcgtgaatatggacggaatgagttgccagagagaaaaaaagactcagaactgaaaaagtttattcgccattttaacgatgtgttaatttatgttcttcttgctgccgcccttattactgctttgctcggccattacatcgatacaagcgtcatcctccttgttacgatcattaatgcttttattggctatattcaagagagccaggcggaaaaagcgctatctggcattaaagcgatgcttagcttaagtgcgattgtccgccgcaatggcgagcgccttgaaattgaagcggcggaagtcgttgttggtgacgtcgttgtcttaagtgctggcgataaagtgccagccgatattcgtttaatagaagcacacaaccttcg

SEQ ID NO: 6435 - DNA, 732 bp, Bacillus clausii
atgcaacgagagacttgtacgaagcgattgaacgtggcgattatccagagtgggatttatatgtacaaatccttgatccagccgatttggacaatttcgattttcatccacttgatgcaacgaaagattggcttgaggaagacattccttctcaactagtagggacgatgacgctaaaccgcaaccctgagaatgtctttgctgagacggagcaagttggctttaaccctggaaatcttgtccctggctttgagccatcggaagacaaaatgcttcaaggccgcatcttctcgtattcagatacacaacgataccgtgtcggtgcgaattacttggatctcccaattaactgcccatttgcgcaaaaggcaaacaatacaagagatggggcaatgccgatcggccagcaaacaaaccggatcaattatgaaccgaaccgttatcaagatacgccgaaagaagcggaaggctatgaagactaccgtgcgcctattaatggcacgattggacgaattgcgattgaaaagaaaaacaactttggccaagcgggcaaaatttatcgaaactatccaaaaagtgtccaagacacgcttattaaagacattgcaaatgatctaaaacaagttgctccagaaacggcgctccgagccatttgcaacttttaccgtgctgatgaagactacggacaacgccttgcggatgccattggaatggacatctctgaatacgtga

SEQ ID NO: 6436 - DNA, 462 bp, Bacillus clausii
gacgattaacagataatcaaggacatccaatttatgacaaccaaaactcgcgtacagctggccaacatggcccaactttgttagaagactaccacttggtagaaaagctcgcccattttgaccgtgaacggattccagaacgggttgtccatgcgcggggggctggtgcccatggcgtatttaaagtgaaaaacaatatgaagcgctatacaaaagcaaactttctttctgaagatgggaaagaaacacctgtttttgtccgcttctcaacggtcatacacggcggtacttctccagagacgcttcgcgatccacggggattttccgttaagttttatacagaagaaggaaattatgattttgtcggcaacaacttgcctgttttcttcatccgtgacgcgattaaatttccggatgtgatccattctttaaagccagatccacgtacgaatatccaaaacc

SEQ ID NO: 6437 - DNA, 438 bp, Bacillus clausii
taactttcaatgggtcctcgttagtgcgattttgctcggtgtcgcatcaggcatgttcggcacgctagcttactggaaaaagcaaagcttaatgagcgatgctttgtctcacgcagcattgccaggcgttgtcattgcctttatgatcattcaagagaaacagttgctgtttttgattgtcggcgccgctttaagtgccttactaggcgcttggctcatttatgcgatccggtctgcgacacgtataaaggaagatgcggcaatgggcattattttgtccgtcttttttggcggcgggattgtgttgttaacgattgttaaccgcactgctggcggcaaccaaagcggacttgatacatttatttttggccaggcggcgagcatggtgcgccaagacgtgtacacaatggcggcgctggcggcagcggttattttgct

SEQ ID NO: 6438 - DNA, 470 bp, Bacillus clausii
atgggcgcaatgtcagtgctatcatccattaactttcaatgggtcctcgttagtgcgattttgctcggtgtcgcatcaggcatgttcggcacgctagcttactggaaaaagcaaagcttaatgagcgatgctttgtctcacgcagcattgccaggcgttgtcattgcctttatgatcattcaagagaaacagttgctgtttttgattgtcggcgccgctttaagtgccttactaggcgcttggctcatttatgcgatccggtctgcgacacgtataaaggaagatgcggcaatgggcattattttgtccgtcttttttggcggcgggattgtgttgttaacgattgttaaccgcactgctggcggcaaccaaagcggacttgatacatttatttttggccaggcggcgagcatggtgcgccaagacgtgtacacaatggcggcgctggcggcagcggttattttgctaat

SEQ ID NO: 6439 - DNA, 240 bp, Bacillus clausii
  misc_feature (1)...(240): n = A,T,C or G
ggcgatgctcatttacgcgccgaggtcccaccggttagaaattcttcaggcggaaaagcaccaaaacctttcccaanaagaccaagtgccgctgttggtattggatgtatgggaacacgcctactatttaaagtatcaaaatgagcgtaaagcgtatattgaggcatggtggaatgttgtgaactggaaggaagctgaaaatcgttaccgccaggcctcgcagttaaaatgggtgcccta

SEQ ID NO: 6440 - DNA, 546 bp, Bacillus clausii
  misc_feature (1)...(546): n = A,T,C or G
tggagcagccgactgctggagaagtgtacatcccaaacggagacattgtccgcatgatgtttcaagaagggcgcctgctcccttggaagactgtcttgcaaaatgtcatgttaggattgaagcatgagcggaaacgaaaggcgctggaagcaatcaaaagtgtacagctggaaggcaaagaaaatgattggccccgggcattgtcaggtgggcagaaacaacgtgtcgctttggcccgtacccttgtccactcccctcatgtcttgcttttagatgaaccgttaggagcacttgacgcattaacaagacgtgaaatgcagcaattaatagaaaaaatatggctacagcgtggctttagtgtagtccttgttacacacgatattgacgaggcagtcacattagcggataaggtgtatgtgattgaaaacggaagcatcgctaacacatatgatattaatcttccacgcccaagaaaacgatcctcttacgaatttgncgaaacagcagaagaaattttaaaccgggtgataggtgtaaatgcaacta

SEQ ID NO: 6441 - DNA, 176 bp, Bacillus clausii
atgagtaaacactggatattcattgttgtggccgcttgttttgagatcggctgggtcatcgggctgaaacatgcctcaacgattatggaatggggtttaaccgtagtggcgatacttgcaagctttgtcctgctaattgccgctacagcaaggctgcctgttgcgaccgcctatgc

SEQ ID NO: 6442 - DNA, 627 bp, Bacillus clausii
tgatggtgccaatggcacttgccattacagcgcaagtcgtcgaaacactaaaagggcaaaaagaagggcgcgagctgcctaaatttgagaaagcaatgctttttggcgtcggctatgctggcacgattggtggttttgcaactttaattggaacgccgccgacgattatttttgccggccaagtgagagagctgtttggcattgaagtctcgtttgcttcatggatgctgtttgccacgccattaatgcttgttgttttactatttacatggttttatttaggcagaattgcctttaaaacaaaaatcaaagagctgccaggcgggagagaagtgattcaatccgaaagaagcaagcttggccgcatttcttatgaagaaggcatcgtcgcttgcgtgtttgcctttgccgcctttatgtggatcactaaagatttcttctggagcggcgataacgcaatgattttccaacttccagggatttcagatggcatggtggcgatcatggcaaccatgttcttgttcttaattcctggaaaagcaagcgctcgcattcttgattgggccgattcaagagacattccatggggcgtgttgctcttgtttggcggcggtttggcgattgcag

SEQ ID NO: 6443 - DNA, 316 bp, Bacillus clausii
atggtcacactacttacatcccctagttgtacatcttgtagaaaagcgaaagcatggttggaagagcatgatattccttttgaagagcgtaatatctttgcatctccactctctgttgaagaagtaaaacaggttgtgcgcatgacagaagatggcacagatgaaatcatttcaacacgttctaaagttttccaagaactggacgtagaacttgaatcattgcctttacaaaaattgtttacgattattagcgacaatcctggtctgcttcgccgtccgattatcttcgatgaaaaacgtttacaagtaggataca

SEQ ID NO: 6444 - DNA, 567 bp, Bacillus clausii
ggtttttaacaccgacagaaggacaagtgtttgtggcaaacaaacctgtccaaacgccaaacaaaaaagctgtcatgctctttcagaattacggcctgcttccatggcggaccgttttaaaaaatgttgaaattggactggaatccatgtcgttgtctaaaaaagaccgggaagaaagggcaagatcttatttaaaaatagtagggttggatcaacaccgccatcagtttccaaagcaattatcagggggcatgaaacagcgggtggcaatcgccagagcacttgcgattcaacctgaattgattttaatggatgaaccttttgctgcgctagatgcctttaaccgttattttttgcaggacgaattattgcgaattcaagaacaagcaaaaacgacgattttgctagtgactcatgatattgatgaagccgtttatttatcggatcgaattgtcattttagataaacaccctgggcggatcaagacaatcataccaattgagcttggacgcccaagagaccggagccacagtgattttcaaacatataggcggcggatttttgaat

SEQ ID NO: 6445 - DNA, 1091 bp, Bacillus clausii
atgatcaataagctgcagctgccgctgcaaacgatgaatctggtactggggtttatggtgtgggtaatcatctcggcgctgttgccctttatacaggaagatatcgcgattcccgccgatcggattgctattttgaccgcgattcctgttgtccttggatctgttctacggattcccctcggctattacgccaacgtcgtgggcgcgcggatggtatttatcactagttttattttgctattgttcccggtctattttatcagcatcgcgacaagttttacccatctcgtgattggagggttgtttcttggcatcggaggggccgtgttttcggtaggcgtcacctcgttacccaaataccatgcgaaggaaaagttagggctagtaaatggtatctatggaatgggcaatttggggacagcaatcacaacatttgccgcgccagtcgttgctacccagatcggctggtcagctaccgttcaactatacttaattctgctgctgctatttgttgccctaaacgccgttttcggcgaccgcaaagaaacgaaagtcaaaaccccaattatggagcagatcaaaggtgtatataaaaatgacaaactatggtatttctcactgttttattttattacgttcggctcctttgtggccttcactgtctatttgccaaattttttggtcagtcatttcgaactgccgaaagtggatgcaggactgcggaccgcaggcttcatcttgattgcaacgtttctccgccccatgggagggtggcttgccgataaatttaagcctttgtttttgctaatgggggtgtttatcggtttgacattggctgcggtggtgctggcgttttccccatcactcgctttgtatacggttggatgtctgacgatagctgtttgtgcaggtcttggcaacggcattatttttaagttggtgccgttttattttaataaacaagcaggcattgtcaatggaatcgtatcgatgatgggcggtctgggcggatttttcccgccgttgatgctctcgttcatccattcagtgacaggccaatactcgattggattcatggctttatcacaggt

SEQ ID NO: 6446 - DNA, 543 bp, Bacillus clausii
gcagcctgctgtggaattgctcgttggcatcccgtctgtcgtatatggttttatcggtttatccgtcattgttccgtttatacgcgaccatgtcggtggccaagggtttggcctcctatcagcaatgattgtattatcgatcatgattcttccaactgtgacaagtatatcaaccgatgcactgcgttcgattcctggcggtttgcgtgaatcgtcattggcgcttggagccacacgctggcaaacgatctaccgggtactcattccagctgctggaccgatgttgcttacagcagttgtcctgggaatggcacgtgcatttggcgaagcattggccgtacagatggtcattggcaactcgcgaacaattgcagagtcgttaattgattccacagcgacgttgacgaccatcattacattgaatatgggacatactgtaccaggaagcattgacaacaatgtcctttggtcacttggcttgattttgctcgttatgtcctatctgtttattattcttgtgcggttcttgtcatctaggaggaa

SEQ ID NO: 6447 - DNA, 549 bp, Bacillus clausii
ggcccaacgcatgcttatcatcgccgaccaaaatcgcgtccaaaaccatatgagtggccttgttttgcttatgaggcagcttttgctacttgctcttgcgatcgagtgtgttggagggcttgtactcggtacttattatttgcgctactttgacacatggactgaggcttatgttcaaggattttttgctgcgttgagtgcattcactaacgctggctttgatttaaccgggcagtcactccaaccgtttgccggcgacgcagttgtccagcttgtgatgatcttgttgatcatagccggctcgattggttttcctgttcttgtagagtgcagggagtttttattaaagcggaaatcgggattccgttttagcttgtttacaaaattgaccgtttccacttattttctcgttttcgccgtcggtacacttggcatttggctgttcgattcgtttggagcttttgctggcttgccatggtttgaacagtttggccattccttgttccaatcggcaacaacaagaagtgcagggttatcaacgatagatat

SEQ ID NO: 6448 - DNA, 491 bp, Bacillus clausii
ctgtattcgattgctagcagctaccgtgcaaatgaagacgaagtccatttaactgttggcgctgtccgctatgacgctcatggacgtcaacgggcaggtgtttgctctgtacaatgtgctgagcgcaaagcgccaggggagacattgccaatttttattcagcgcaacccgaattttcgtttgcctgagaatgggagcacaccgattttaatggtcggtccaggaacaggagtagccccttttcgagcctttttggaagaacgggaagagacgggggcagaggggcccgcttggctattttttggagatcagcatttttcgactgactttctataccaaaccgattggcagcgctggatgaaagaaggcgtactaacgaaaatggatgtcgctttctcacgtgaccaggacgaaaaagtctatgtgcagcacaaaatgttagaaaaagcagatgaagtgttccaatggctagaggatggcgctgttattta

SEQ ID NO: 6449 - DNA, 243 bp, Bacillus clausii
ctgaagaacggggcattgatatggatgaaattaatgcgctccaatacgctggtgtagatgtgaacaagtttttaactggttttgaaaatgtaacggaaagcgtcaaccacagtgttgatatggttgttaaccacccgctcttgccaaaggatgtgcgggttcacggcctagtcatcaatcctgaaacaggaaagcttgatttgctacaacgtgatttgcaaaaaggggcaaacgccaaggagc

SEQ ID NO: 6450 - DNA, 162 bp, Bacillus clausii
cgctgcgattttagggttagttggagctggaggcattggacttttatacaaacaggcaattggcttttacaattttgaccaagtattggcgttaatcctttatacatttttagttgtattgctaatcgattttattagcttaaaaattcgggagcgtctcat

SEQ ID NO: 6451 - DNA, 231 bp, Bacillus clausii
  misc_feature (1)...(231): n = A,T,C or G
aacgtgacagcggcatacgttnacttgctttaattgnggaagtcgcctctgcctttgggacttgnggcctaacaatgggggagactggctccctttcctatccaagccaaatcattttaatgtgcttaatgtttattggcagagtagggattgtcgctatgctgttctcatttaaaaagaaacatacgaaaagccattaccattatccgacagaaccagtcattatcggct

SEQ ID NO: 6452 - DNA, 186 bp, Bacillus clausii
tttagaaattacaagcacgcctaaccaagatacaccattgtctgaagggaaaacgcctatcctcggacttgacgtctgggagcacgcttactacttgaactaccaaaaccgtcgcccagactacattgcagctttctggaacgtcgtcaattgggacgaggttagcaaacgttacgaagcagcaaa

SEQ ID NO: 6453 - DNA, 687 bp, Bacillus clausii
ttacgaatttacttcttattgttagtacgcatggggaaggcgaaccgccagataacgccattgctttccacgaatttctgcttgggcgcaaggcgccgaaattgtcggatttgcatttttcagtgcttgctttaggggactcatcttatgaatttttctgtcaaacaggcaaagagttggaccagcgcttagaggagcttggaggaacgcgcttgtatcctcgtgttgattgtgacattgattttgacgaggatgcagccgaatggatgcaaggtgttcttgctggccttgaaaaagcaacgggtatatcgtcagcagcgagttccacagctccgctatcaacagaaacgacggctactgtttacagccgcacaaatccttataaagcagaaatacttgaaaatatcaatttaaatggccgtggttcaaacaaggagacgcgccacttggagctttctcttgaagggtcgggattcacatttgagcctggcgactctgttggtatttttccggaaaatgacagcgatttggctgatcagttgattgccgaaatgggttggaacggtgatgagtcggtgccaattggcaagcaaggcgatgtgttgccgttgcgggaggcgctaatccgtcatttcgaaataacggttttaacaaagcctctacttgaaaaagcgtcgctcctttccc

SEQ ID NO: 6454 - DNA, 516 bp, Bacillus clausii
gcttataacggatatggcaaccgaattgcaacacggtgcagcaattgagatcgatcagctctacaagcaatttggcaataaaaacgttcttcaaggcatagatgcaaccatacatggaggcgaatttgttgctgtagtagggaaaagcggctgcggcaagagcacattgttgcggcacgtggcagggcttgagacggcgacttcaggagaagtgaggcagaatggagaacggatcgacggcatcaatcagcaagcacgcctcatgttccaagagtcgcgccttttgccgtggcaaaatgtgctaaccaatgttggcgttgggcttcgtctcgaaggagagtggcaacagcaagcagcggcgcttcttaaagatgtcggcttggatggtcgcggcaatgagtggccggctgtactatctggtgggcagaaacaacgcgttgccttagcccgtgcccttgcaggcggaccgaaactgctgttactcgacgaacctcttggagccttagacgcacttac

SEQ ID NO: 6455 - DNA, 729 bp, Bacillus clausii
gttaaaccccatcctagtgcaagatacgcctggagctggcgtgaagggccgatttgatgatggagaatggcgggtaggccaggctgcctttgtaggtgagcaggaagcggaacattttcaaaatggagtagcgaagaagctagcggctgaaggaaaaacggttgtgttcattcaagacactaacggcattgccggtgtgctggcgcttagggatgaaatccgcccagaaacgcttgctgcaatgaacgcattacaaaaacaggggattcaacttgtgatgttgacaggtgatggagaggaaacggcgcaggcaattgcagaacaaagcggggtggaccgttatgtgtcccgttgtatgccagacaagaaagcggaggaaattaagcgtatacgccaagaaatagggactgtcgctatggtcggtgacggcattaacgatgcccctgctttagcagcggctgatttaggagtcgcgatgggcggcggcagcgatgtagcgttagaaacagctgatatggtcttaatgaagaatgaattgcccaacatcgctgacgcaatcaaacggtcaaaaaaaatgaaccgtattgtgaagcaaaacattgttttttcgattgccgttgtccttttgctcgtgctttccaactttatgcaagtgttggatttgccactcggtgtcatcggccatgaaggaagtacgattttagtcattttaaatggccttcgtttgct

SEQ ID NO: 6456 - DNA, 1091 bp, Bacillus clausii; identical to SEQ ID NO: 6445

SEQ ID NO: 6457 - DNA, 432 bp, Bacillus clausii
tctcagaaaaaaggcctcaaagcgtagaaaccaccagatgaatatgggagtttcaagctgcccatgattatatggcgatggctgcctactgccaccatattagttacaatggcttcgccgattacttccttaagcaagcagaggaagagcgggaacacggcatgaaagtgtatgattatttaaatgacaaaggccaaaaagctgtctttgaggcgatccaagccccaaaagccgattatggttcactcgtcgccacatttgaggcagcgctggcccaagagcgggaagtgacgaaaagctattataaggtgtaccagatcgcccaagaagaacaagaataccaaacgctttctttcttaaactggttcctcgacgaacaagtggaggaagaagccacatttgaaacgcatattgattatttgaaccgcatca

SEQ ID NO: 6458 - DNA, 1189 bp, Bacillus clausii; identical to SEQ ID NO: 6417

SEQ ID NO: 6459 - DNA, 723 bp, Bacillus clausii
  misc_feature (1)...(723): n = A,T,C or G
atgccgaaattcaagggcctagacactttccaaggcgagatgtaccataccggacgttggccgcatgagaaggtaagctttgcaggtaagcgggtcggcgtgattgggacaagttcgacaggcacccaatgtatcccgattattgcccaagaggcggagcatcttaccgtttttcaacgcacaccgcagtacatctctccagccaaaaattattcctacgatacggagttcatacgggaaaccgtagaaaactaccaggaaattaaggaacggatgcgtgactctatgcacggtgtacctttccacgctcgtgatcagtcggcgctgcaagattcgccagaagtacgccagcttgtatatgaggcagcgtgggaggatggcaggcttttatcgatgttgtacagctataacgatttgcttgttaatgcaaaagcgaatgaaacaatcaagatacgtcaaattgtacgggatcctgaagtagcaaagaaactaatgccgtcgttctattacgcaacgaaacgaccggttatagacaaccattactttgaaacctttaaccgtgacaatgtctctttagttgatgtcaggtcagccccaattgaagagattacctcaacggggattcggacagtggaagcaatgtatgaattggacatgattgtatgtgcaactggatttgatgccatgacagggcccttattcaaaatggatatccgncggtaa

SEQ ID NO: 6460 - DNA, 829 bp, Bacillus clausii
atggagatgtttttccatggattcatgcaaagagctttccaagcctcactcctaatctcattcattgcaccattgttaggcttgtttttaatattacgtagacagtctctaatggcggatactctatcacatgtatccttagcgggtgtagcactaggtttgctaattggcgtcaatccaacgtggaccaatcttttagtcgttgcggtaattgctatcatgcttgaatatttgcgagtggtgtatcgcacgtattcggaaatttcgattgcgattttaatgtcagtcggcatggctctagccctatttctgatggggttaaatgatggtggggctactttaagtatgaaccaatttttatttggctccattgtcaccattagtaagcagcaagtatggatgttgttcatcctaacgattttgattagtctcctctatttcgttttccgcaaacctatgtatattttgacattcgacgaggaaattgccttcaccgcaggtttgcctatcaaaacgatgtctatattgtttaacgtgttaacaggggtaacgattgcaatcattatgccaatagtcggcgctttactcgtttcagccattatcgtcttacctgctgcgatttcgatgcggttaagcaaaagctttaatggtgttattttcattggaatcgtgattgccttaattggcatgttgagtggtttagtcgcttcgtatgaattaggtacaccaccaggagcttctatcatattaatcttcatgatcctttttgctgcgactgcactgattaaacagattttgcgtcacactaaattagagaaacgatttaaat

SEQ ID NO: 6461 - DNA, 216 bp, Bacillus clausii
  misc_feature (1)...(216): n = A,T,C or G
aaattattttacacattcgccttcctcgagtgctgctggcgcttttcgttggcgcctgtttagctgtagctggtgctgcttttcaagggctgttgcggaatcnactngcngancctnatncgttaggcgtttcctccggagctgnacttggagcagtagccgtgctattctttcaattggcctttttcggagcgtggacattgccgcttgtcgcaa

SEQ ID NO: 6462 - DNA, 549 bp, Bacillus clausii
  misc_feature (1)...(549): n = A,T,C or G
ttgcagggatcattgccagtgcttttttaggggcaggcctttcgctaatgattgcgatgtctcaagatgagctacggnaagtcatcaattggttgatgggcagcgttgcgatgagaggctgggcccatattggcttattgctgccgctttttgtgggcgggttcacattgttgtttttttgtaggaatgagttgaatgcctttatgtatggagaagaaacggcncagcatttaggcgttcatgtggtncagaaaaaatacatcgtccttattgccgcaactattttaacaggaagtgccgttgccgtctcgggtncaattggcttcgttgggcttgttgncccccatatgtgccgaacgctttttgggancgactattcacacttgctccctctggcagccatcgttggcggcagttttttagtggtatgcgacatggcagcccgtgtcgtcgttnctcctgcanaactaccaattggtgttgtaaccgcgctcattggtgccccaacctttgcntggatnctatatagaanccagcnagcgaaaagga

SEQ ID NO: 6463 - DNA, 567 bp, Bacillus clausii
atggggcgggctaattgccctttgcaaggtgttgtttatataaatagcggcttttcgttaaatggctgtttcgtccaatacgaaaacccagaagaacggaagctgaatcattcgactttttcttggctgcatgccgttttaatggataaaaagttttctaaaaccagcaaaatgctggtttttttgtttacccgcttgatcgtccatggtatgataatgattatcaataccatcaaaaacgacggatcgaacgttaaagggaaaaaacgtaaaatgagcacacatgctaaggaagcacaacaagatttagaaaaagcgaaggcacgttctaagccgttagcggcagtaagcgtcctcgttattggattggggtttcttgtgtttgcgcttgttctctccatttcttatggggcagcgcaaatagattttaaaaccgtttggcaggcggttttctcttttgaacccggattgaccgaacatcaaattatccaagagatccgccttccccgggctttaggggcggcgctagtcggcagttttcttgctgtctcaggcgctatcatgcaa

SEQ ID NO: 6464 - DNA, 226 bp, Bacillus clausii
  misc_feature (1)...(226): n = A,T,C or G
atgaaaataagatatttactccctttgcttttgattttatcgtttgcatctttatttattggcgtacaggatatatcgccacttgatttgtttcgtctagacgatgaaancgngctancactcgtcattanccgtatcccncgtctattaagngtgtngattgtcggngttagtttaagcgttngcggnttnantatgcagcagctnacccaaaacaaatttgttt

SEQ ID NO: 6465 - DNA, 954 bp, Bacillus clausii
atgcagcctaaatggatctatttattactcggcgctttgttagcagcattgattggtacttttttgtttattgacatcgctcctggagcgtgggactatgcgttgccaagacgaggaagaagcgttgtggcgattatcattgtcggcggggcaattgctagctctaccttgttttttcaaacaatcacaaacaaccgaatcctgacgccaagcattattggccttgattctttatacatgcttattcaaacgttgcttgtttttttgtttgggacgatcggtcttgtcgcgataaacaaatatgtgaactttggtctatccattgtctttatggtgttgttcgctgtcttgttatatgccttgatgttcaaaaaagaagggcaaaatctatactttttgctgcttgtcggcattgtatttggcacattgttttcaagcctatcgacgtttctgcaagtcatgattgatccaaatgaatttttgacgatccagaatcggatgtttgctagttttagcaacatcaatgttgatttgctttggctttctatcgtgattctagcagcaactgttctttacatttggccgtatttgagatatttggatgccatttcccttggacgcgatcaggcgattaacttaggcgttccttacgataaggcgattagaaagtttttagttgtcattgctttgcttgtttctgtttcaacagctcttgtcggcccggtgttgtttttaggcctacttgtcgcgaacgttgcaagagagcttatgccaacctataagcacacccatttagcgattacatcagttctagtttcaagcattgccttggttggcgggacgttgctcgtcgagcgcgtgttcacttactcggctccgctgagcgttatcattaactttgttggcggaatttacttcatttacttgctcttaagggggacgaaatcgacatga

SEQ ID NO: 6466 - DNA, 933 bp, Bacillus clausii
tctatttattactcggcgctttgttagcagcattgattggtacttttttgtttattgacatcgctcctggagcgtgggactatgcgttgccaagacgaggaagaagcgttgtggcgattatcattgtcggcggggcaattgctagctctaccttgttttttcaaacaatcacaaacaaccgaatcctgacgccaagcattattggccttgattctttatacatgcttattcaaacgttgcttgtttttttgtttgggacgatcggtcttgtcgcgataaacaaatatgtgaactttggtctatccattgtctttatggtgttgttcgctgtcttgttatatgccttgatgttcaaaaaagaagggcaaaatctatactttttgctgcttgtcggcattgtatttggcacattgttttcaagcctatcgacgtttctgcaagtcatgattgatccaaatgaatttttgacgatccagaatcggatgtttgctagttttagcaacatcaatgttgatttgctttggctttctatcgtgattctagcagcaactgttctttacatttggccgtatttgagatatttggatgccatttcccttggacgcgatcaggcgattaacttaggcgttccttacgataaggcgattagaaagtttttagttgtcattgctttgcttgtttctgtttcaacagctcttgtcggcccggtgttgtttttaggcctacttgtcgcgaacgttgcaagagagcttatgccaacctataagcacacccatttagcgattacatcagttctagtttcaagcattgccttggttggcgggacgttgctcgtcgagcgcgtgttcacttactcggctccgctgagcgttatcattaactttgttggcggaatttacttcatttacttgctcttaagggggacgaaatcga

SEQ ID NO: 6467 - DNA, 344 bp, Bacillus clausii
tagaagtgtcaaatgtcagcaaccaatccgccggaaaaagagtcgtcaacgacgtctcggtcaacgtcagaaaaggaacaattacatcgtttattggccccaatggtgccggaaaaagtacgttgatctcgatgatcagccgcttgtcgaaaaaagatgaaggcactattttgattgaaagacctccgcttgaatcctatcacagcaaggaactggcaaagaaagtgtcgattttaaaacaggcaaacaacatcaacatccgtttgaccattcgcgaacttgtcagctttggccgctttccgtattcacaaaaccggctaacgcaaaaggattggacttatgtc

SEQ ID NO: 6468 - DNA, 357 bp, Bacillus clausii
cggtgacggtgcttagcctcggcgaagatgtagcgcgagggcttggccagcggatttttcttgttaagacgctcggtgttgtagctgtcttgttattgacaggcgccggtgtggcagtcgcaggatcgattggatttgtcggcttagtgatcccccatattactagaggcttagttggcgtcgactaccgttatattattccatgctctgctgtattaggagcattgcttttagtgctggcggacttagccgctaggttggtaaatgccccctatgaaacgccagtcggtgcaatgaccgcgttaatcggcgtaccgtttttcctttaccttgcaaggcgtgaagggagggggcttt

SEQ ID NO: 6469 - DNA, 585 bp, Bacillus clausii
attaaaaaagagagattgtcaatgacttgcatttgcaaattccagatggaaaaattacgacgattgtcgggccgaacggctgtggcaaatcgacgattttaaaaacgatttcccgtattctccaagcttccagaggagccgtttatttagacgggaaatcgattcataaacagtcaacaaaagaaatcgccaaaaagatggcggtattgccacagtctcctgaagcgccaagcgggctaaccgtttctgagctggttgcatatgggcgttatcctcatcagcgcgggtttggccaattgaaggaccatgaccgctccatgatcgactgggcgttagaacaaaccaatatgagcgaatacgcggaccggccaatcgaggccctttctggcggccagcgccagcgtgtatggattgcaatggcccttgcacaagaaacggatattcttttgcttgatgagccaacgacttatttggacttggcccatcaactcgaagtgctgcaagtattggaacgactaaacaaagaacaacagcgtacgatcgtgatggtcatccatgatttaaaccatgcagcacgctttgccc

SEQ ID NO: 6470 - DNA, 693 bp, Bacillus clausii
gcgcaggtcttgctgtttctggcgcgattttacaaagcatttcccaaaatgaactggctgatccaggtattttggggatcaatacaggtgcaggcctcgctgttgtcttatttatcttttttgtacaaggttctttaacgggccttggcagtgcaaaccttttggtgatgccgttatttgcgctaagcggtgcgctgcttgctgctttcctcatttatatactggcttggaaaaaaggcattacgccagtgcggttagtgttggtggggattggtttaaatgcagcatttagcgccttgctgatcgtgattcaattgcggatggaaccgaatgattttatgcaggcaacgatttggttaacagggaacatttggggaacgacgtggccccacgtatgggcagtcttgccatggatcatccttttgattccgattacgctttttaaagcgagaacgctaaatgttttacaaatcggcactcagtcggcggtgtcattaggcgtcccgatagagaaagaacggcgaacgcttcttgtcttagctgttagccttgctgctgtgtccgtagctgttggcggtggcatttcctttttaggtttagtcgctccccatattgcacgtcgcctcgtcgggcccgaaacaccaagtgcttatcccggctgcggccttaatgggggcattggattttgcttac

SEQ ID NO: 6471 - DNA, 305 bp, Bacillus clausii
gtggaagcgggtagaaaagtgtttgtcgctaaccgaaatgagctggcggtcggtttaggcaagaaagttgaaatcgaagggagggagcttgctttatttatgcaagaggatgggtccgttcgtattcttgacaacaaatgtcctcataaaggcggacccctatcggagggcatcgttagtgggaattatgtttattgtccgctgcatgattggaaaatttgcatgaaaacgggcagcgcgcaaggtggagatcaaggaaatgtagcttgttttactgtggaagttgaaggagacgatatttatgt

SEQ ID NO: 6472 - DNA, 307 bp, Bacillus clausii
gtggaagcgggtagaaaagtgtttgtcgctaaccgaaatgagctggcggtcggtttaggcaagaaagttgaaatcgaagggagggagcttgctttatttatgcaagaggatgggtccgttcgtattcttgacaacaaatgtcctcataaaggcggacccctatcggagggcatcgttagtgggaattatgtttattgtccgctgcatgattggaaaatttgcatgaaaacgggcagcgcgcaaggtggagatcaaggaaatgtagcttgttttactgtggaagttgaaggagacgatatttatgtgt

SEQ ID NO: 6473 - DNA, 305 bp, Bacillus clausii; identical to SEQ ID NO: 6471

SEQ ID NO: 6474 - DNA, 575 bp, Bacillus clausii
ccgattgaacaagccgtagaaaatttggacggcgtatcggccgtgaactcgtcttcttttgaaaacttcgcttcgattcaaattgagtatgaatttagcaaggaaatggatgaggctgaaacagaggcaaaagaggcgattgagcaacttgaatttgcagatggggttgaagaaccaactgtatcccgtattaacttcggtgcttttcctattttaacgttgagcgtttctgaggaaggcgcatcgttgacggagctaactgagcgtgttgagcaagacatcattcctgagctagagggtttgcctggaattgaatctgtaaccgctgcaggccaagaaacaaaagaagtgcagattacttttgaggaagaggcgcttaccgaacatggcctagacgcagaaaccgttacacaattgttggaagcatcatcgatgcgattcccgttagggctttatacattttcaggtgaagaacagtccgttgtcatcgacggcaaagtgactacacttgatgatttgcggaatttgcagcttccgtccatccctgccggtggtggttctccggaaatgggaca

SEQ ID NO: 6475 - DNA, 929 bp, Bacillus clausii
atgagcagagcaattttgaattccgaatggtacaacggttctgttaaaactgcttggagtcgctatttaaggaatgaggagatcttgcaaactgatttgagaagtgagattgctcattcatgggaaacatctaaagatttaggggttaatccgtttcaaagccgaataaacgaagtcataaacgatcagacgcttgccatccgattgaaacataataagcagttgttgtcttacgcatccccgcgcattcagcagctccttgatttatttgatgattcgaagacggtcctatctattgctgataaagatggaacgattctgaaatctgtaggggaaaaaaacgttttaaaaagagcagagaagcgctatatttttgcagggggcacttggaccgagaagtctgcaggcacaaatgcagtggggatggttctgagaacgaagcaatcgtctcaagtcttgttttctgagcatttttgtgaaaatgtacacgattggtactgtgttgcttttcctatcttaactccttttacgaaagaattactaggcattgtgaatctcgcaggcaatgcaagtgatggtcatcgccattcaattggttatgcactggctgaagcgaaaaatatgggtctatcggtcgagcgccattttttcgaatatgctttacagcatcagctatttttacacacagcactggaaaagatggatcacatcgtgttgtctgaggatttaagcgatcaaattcttacccgaaatgagatagcgaatcgaagtgaacggtttcaaaacgagacgtccatagccagctttcctgaattaaaagcattagtggataacgttcggacaaatggccagcaaatcgtaaatgaacaaattcaagacggatcaacaaataaacgctatcaagtttccatttacccagttcgttttca

SEQ ID NO: 6476 - DNA, 585 bp, Bacillus clausii
actacatgttcccgatcatgctaggtacggtattctttgcttttacatttgcgacaaacaatattattcgttcggaaggaaacgctcggtttgcgatggtgacaatggtcattccggccattctgaatatcattctcgaccccattttcatttttgctctcgatatgggcgttaaaggggcaggcgtcgccacggttgttgcccaaggagcggtgagcttctttattttgcggtattacgctaaaggtgaaagttcgttgcgcctcagttggacaagcgtgtctctgccggtttctgtcgtaaaggaaattttgtctgtcggctttcctgcatttgtccaacaagcatcagggagtttgatgatgatcgccatcaacgcgatgctcattcaacatggaagcgatatgcacgtcggtgtatttggcatcatccagcggattatgatgtttacggtgatgccaatgattggcgttatgcaaggaatgatgccgattgtcggttacaattatggagccaaacaatttgcgcgaatgcgtgagaccatttggctgacattaaaagtcgtggtcgcctgttcgattggcc

SEQ ID NO: 6477 - DNA, 702 bp, Bacillus clausii
ggacattgagaatatttctgcgacgctgaactcgtccattgtgcaaatcatttcaagtgtcgtcacctttattggcattctagctgtcatgttatacttgtcgcccttgcttacagtgatcactttattcattgtgccattaatggttttaggaatgcgttggattacaaagcgaacaaaagtgttttttaaagagcagcaaaaaagcttaggacagcttaacggctattcggaagaaaccattgctggccaatcggtcgttaaaactttttcacgtgaagacacgattatagaagcgtttgaggaacataatggcgcgatgcgtcatgctggtttctgggcgcaagtctattctggttttatcccaaaactaatgaatgtgttgaacaatctcagttttgccgttattgccgggattggtgggtttcttgctgttcatggagcggctggggtaacggttggtgtgattgtcgtgtttgtcgagtattcccgtcagtttacacggccgctaaacgatcttgccaatcagtttaatgcggttttatcagcgctagccggtgcggagcgtgtatttgcggtaatcgatgaggagcctgaagcggatcaagcaggcgctatcacggtcaagcaaatagagggaaatgtctcgtttcaaaatgtctgtttatcctatggcgctacagaaacgctcaaaaatgtctc

SEQ ID NO: 6478 - DNA, 162 bp, Bacillus clausii
  misc_feature (1)...(162): n = A,T,C or G
catggagcaaaaccggacaacgattgccattgcccatcgcctgtngacgattaagcacgctgaccgaattttggttctccaccaaggagaaattgcggaacaaggttcccacgaggagttgctgagcaaaaaagggctttattataaaatgtatttgctaca

SEQ ID NO: 6479 - DNA, 510 bp, Bacillus clausii
cccttatctgagaagacacaagcatcattcctaaaaacctatcttatatcccgtcgctccagcaaaacgaagtcaaacggatacgaaacttaaagctttctgggacgacggacgagtacggcaggcctctccttttgctcaataataaactatggagtgacccggttgaggaaaaaccttgtttaggaacgacggaaatatggtcattcgttaatgtcaccaacgtcccccatcccatgcatatccacttagtccaatttcaactcttggaccatcgggcgtttaacgttgagctgtacaatgaaaatggccaaatcgaattgattgggccgaccattccgcctaaaatcaatgagcgaggctggaaagacacaatcactgcccctgcaggtcaaatcactcgcgtcattgcccgatttgcgccgttttccgggtacttcgtgtggcactgccacattctcgagcatgaagactatgatatgatgcgccctttcgttgtgattgacccga

SEQ ID NO: 6480 - DNA, 278 bp, Bacillus clausii
  misc_feature (1)...(278): n = A,T,C or G
atgacgcttgnaattnagcaagtgngcnaacggttcaaccaacatgttgccgtcgacgggatttccgttagcgttgananaggcaatatgttcgggatgcttggcgcgaatggggctggaannacaacgacatttcgaatgattttaggattgctcgagccnncggaagggtcgattacttgggaaaacnagcaactttcttataaaaanncccntttgattggctacttgcctgaagaacgggggctgnacccaaaacttactgtccgcgatngact

SEQ ID NO: 6481 - DNA, 500 bp, Bacillus clausii
ttttagatttgttttttccgattgtcgtccaatggttcattaacacgcttttgccacaacaagagtgggacaaggtcgtctgggtttcaggggggctgttgctcacctatttaatcagcgcgtacttacagtacaatgtcaattttcttgggcataaactcgggattcacattgagacggacatgcgccaagacttgtttgaaagcatccagcgccaatcgttccgttattttgacaatacgaaaactggccatattattagccgcattacaaatgacctgtttgacattggcgaattagcgcaccatggcccagaggacttatttattgcgttaatgacgtttgtaggtgcttttggcattatgttttatgtgaacccgacgctggctattgtagcactcgtatttgtaccgttcctgattgccttgattacttataccaatattaaaatgaatcaggcatggtcgaaaatgtatgcggaaattggcgatgtcaatgcc

SEQ ID NO: 6482 - DNA, 424 bp, Bacillus clausii
  misc_feature (1)...(424): n = A,T,C or G
atgcgggtttttgtcgnttgaaactggttttttaaaaagcatgggcgcgcttatgcgagcggaatcgcagtgcttgccgtcgtctctnttttatcgctcattccccctcgtgtgattggggaagttgtcgatcagattgccgacgcgagcttaacaccgnctgcattggtaaacgatgtcggctcgnttctagggatcgcngttgtntnatacatattgcgtgttttgtggcgtttacncatttttgggacgtcgctaaagntagctgggcaaattcgntgngattagtatcggcattttacgaacatgcctgcttncttntaccataagcggacaacgggggacttgatggccgtatncacaaacgacgtgcgcgcggtccaagcgactgctggggaaggcgtgttaacaatagtagacgcgt

SEQ ID NO: 6483 - DNA, 282 bp, Bacillus clausii
ggtttacttgaagacaatcaaaaggtatttggtgtttgtaaaaccataccgcaaagaaattattggaacgattttaattgggttgctgaaatttggcatcccgctgttattcccgcttgcgatgatgtacattattgacgatgttcttctcaatgaagagttgtctaccgctgaacaatcttcacaactttattggattattggcggcatggcgtttttgtttatcgtcttgcggccgccaattgaatactataggcagtattttgcccaatggatcggcca

SEQ ID NO: 6484 - DNA, 687 bp, Bacillus clausii
tatccaatcaggagatctttacgtcgctaatggcaagatttcagcaattggccgccatttgaatgttccagctggcacaaaagaagtcgaggcaaaagggatggttatgacgccaggactcattgatatccacacccatgtcggcatctgggctgaagtgacagaggacgtaaacgacgccaatgaatattctgaaccgtttacccctctcatggaggcaacggacggcattcatttagaccacttttccttccaagatgccgtgcgtggcggcgtcaccactgtacaaacaggggctggaagcgccaacccgattggcggcatttggtcgattttgaaaacagccggcggtacattagaagaacgactcttaataaaacgaagcgggttgaaaggcgctctaggcgaaaacccaaaaaatgtattcgggcaaacataccgtaaaaagccattcacacgtatggcagttgcttcgattatccgcaatggcttcttgaaagctttgccttatcggcacctggcaaaagaggaactcagtgttgatttccaagagctgtggccgtttattgaagtattaaatggcagcatgccgctccgcctccactgccatcgtgccgccgacattgcgactgcccttcgcatagccgatgaatttggcgtcaagctccatctcgagcatgcgacaga

SEQ ID NO: 6485 - DNA, 687 bp, Bacillus clausii
tcactggcgcaagcgacaaaccaaaagtaggagaggacttatctgaaattggcgtcattgaacgggggagtgtcatcgttgagggagagaagattgcctttgccggtacagacgcagatgctcgtcattacttgcaaaaacgttctgggaaggtgaaaacaattgaggcgagggggaagctcctcacgcctggactcgtcgaccctcatacacatctcgtctttgccggcagccgtgaacaagaattgacgatgcgtttgaaaggcaagtcatatatgagcattttacaggcaggcggcggcattttaagcacaacgaaaagcacgagagcagccactgctgaccagttggcccaggagtcgcggctacggcttgaccgttttttgcagcacggggtgacgaccgttgaggcgaaaagcggctacgggttagcgacagacgctgaactaaaacagctacgtgtcgctcaacaattaaacaataaccacccagtagatgtcgtctcgacttttatgggggcgcatgccattccgccagagtggaaacaggaccctgatgcgtttgttaaattagttgcacaagaaatgattccccaagtcccacctgaaaacttagctgagttttgtgatgtcttttgcgaagagggcgtctttacgggcgcccaatcgcaatacatttggaggaagg

SEQ ID NO: 6486 - DNA, 356 bp, Bacillus clausii
  misc_feature (1)...(356): n = A,T,C or G
aaccggttttgcatgatgtgtcttttactgtaaacaagcaagaaattgtcggcttaatcgggttaaatggtgctgggaaaagtaccaccatcaaacatgttttaggattaatggacccgatgagtggagacgtgagaataaatggacttgcttttgccgatgatgccgacacatatagacgctcttttgcctacatacccgaaacgccgctcctgtatgatgagttaacattgtgggagcacttgcgtttaacgagtgtcgcttatggaatcgatgacagcgtttttgaagaaagggctgagaggctgttaaacgaatttaatatggcgaaaatgaaaaaatggnatccgaaccat

SEQ ID NO: 6487 - DNA, 792 bp, Bacillus clausii
aaggtttcactgaagtccttgatccagaagtagatattgaggacaagccagacgctaaagtggcgcctgtgctcaatggcgatattgaattccacaatgtcacgttcagttatgaaaccaatcggccggttcttaacgatctcaatctctttatcccggctggaaaaacggtcgcctttgttggtccgtctggcgctgggaaaacaacgattagctcgctcattccgcgcttttacgatgtagacagtggcgctattaccattaatggcaccgacattcgcgacatgacgaagaagtccttgcgttcgcaaattggcattgtccagcaagatgtctttttatttagcggcacactaaaagaaaacatccgctatggcaaactggatgcaagcgacgaagacatttaccgcgccgccaagttggcgaatttggacgggctcatcgaatcgctgccggaaggctatgaaacgcaaatcggccagcgcggcttgaagttgtctggtggacagaaacagcggattgcgattgcgcgcacattcttaaaaaatccgcctatcttgattttagacgaggcgacttctgcattagatacagaaacagaagcgcttattcaagaatcattgcaagagttggcggcagaccggacaacgcttgttatcgcccaccgactagcaacgatccgccatgccgaccatattgtcgtcgtcacgaaagacggcattgccgagcaagggaattacgaagaactagtcgccaaaaatggcgtgtttgcgactttaaacaatgtccagt

SEQ ID NO: 6488 - DNA, 162 bp, Bacillus clausii
ttgcgagcatttattgcattggccgtaactatgccaaccatgcgaaagaattaggaaacgaagtgccgacggaaccgttgttatttggcaaacctaaaagcgcagctgtgttggctgacggaaggacgcttctttatccaagtgacaaaggggccatccatt

SEQ ID NO: 6489 - DNA, 294 bp, Bacillus clausii
aaaggctcggcattgccattgctcttttgaatcagccgaaattgctcatccttgacgagccgacgaacggattggacccacttggcatccaagaattaagggagctgattacgtcttttccgcaaaagggcatgaccgtcattttatcaagccacattttgtcggaagtccaattaatggcagaccacattggcatcataagcgaagggcgcctcggctaccaagacagcatcaaaggcgaagatgacttagaaaggctgtttatggaagttgtaaaaacaaacaggaggaaat

SEQ ID NO: 6490 - DNA, 417 bp, Bacillus clausii
cttacgggacataaaaggagaaatcgtctttaaagatgtcgagttttcttacgacggcaaacgtcgggcattaaacggcgttgacctcacctttcatgccggcacgacagtcgctcttgtcggccataccggttctggcaagtctacgattgtcaacttgatgagccgtttttatgatccaacttcaggggaaatttacttagatggcgttgatttaaaagacattcgtcttgccgatttgcgcaaacatgtcagttacgtcctccaagacacatttattttcgcaggcacaatcatggataacattcgctttggcaatccttcagcaacagacgaagaaattatagcagcagcaaaagcaattggagcccattcctttattgaaaagttggaacaaggctaccaaactgaagtcga

SEQ ID NO: 6491 - DNA, 399 bp, Bacillus clausii
  misc_feature (1)...(399): n = A,T,C or G
aagaacaatcgctcccgaagaaatcgatgcgattatttttgtgtcctcgtcaggtatggcaacgccatcgatagacgctcgcatcatgaacaaactgccttttcgtcctgaaacaaaacggttgcctatttggggacttggctgcgcgggaggagctgcgggcttaagccgtgcttacgactattgcctcgcccacccgaaaacagcggttttagtcgtctgcgccgagctatgcggactaactttccaaaaagaagaccaatcgaaaagcaatttaatcggcacgtcgctctttgctgatggcgtcgcatgtgcccttgtcgctgggcaagcctcgccactgctcgcagacgccgnccaagcctatcgcccagtaatccgtgcgacccaatcggtact

SEQ ID NO: 6492 - DNA, 1800 bp, Bacillus clausii
aggcaagaaggaaaactcgttttcactattcaactgaggaaattattgaaaaaccctttaactggaaacaaatgacgcgtctattttcgtttttggcgccttacgcaaaaagcctgttgccaaaaacgatttttgttatgctgctggcgacggcagtgcggctgattgttccaatatttatcggcgtattcgctgtcgacaggctggaaaaagggttagcgaccaccgctgatatggtgctttatgcaggcattgttttaagcttgtatctattcgcctatatagccaatcttttccgtatccgctggacgaatcagcttggccagcatgttatttttgacattcgcaaaaagctgtttgaccatatccagcatttgtcccatcggttttatgaccagcgttcagctggctcgattcttgtaagagtaatcaatgatgtcaattctctccaagatttgtttacaaacggcgttattaatttattgatggatgcggtcatgctcgttgggattgtcgtcatattattttcgctcagcccagaacttgcggttgtcattctcatcgttttgccgattatgttttttatttctacgaaactgcgccggcaaattcgccgcgcttggcaaaccgtgcgtttgcgccaatctaggctgaattcccatttgaatgagagcattcaaggaattcgcgtgacacaagcctatgcacaagaacatgaaaacatggatttctttgacgaagtgaacagccaaaactatgagagctggccgcccaggctaacacgcatgaacgcattgttccggccggtttgttgaaatggcaagcgcactggaggagcgatattgatttggtatggcgcgtttttgatccaaagtgatgctagtacattagaattaggtgtgtttgtatcttttgctttttacattggcatgttttgggagccaatttcccgtttagggcaagtgtacaaccagcttcttgtcggtatggcttcgagcgagcggatttttgaatttcttgatgaaaagccgaatgtcgaagataagctagatgcgaagccgcttacggacataaaaggagaaatcgtctttaaagatgtcgagttttcttacgacggcaaacgtcgggcattaaacggcgttgacctcacctttcatgccggcacgacagtcgctcttgtcggccataccggttctggcaagtctacgattgtcaacttgatgagccgtttttatgatccaacttcaggggaaatttacttagatggcgttgatttaaaagacattcgtcttgccgatttgcgcaaacatgtcagttacgtcctccaagacacatttattttcgcaggcacaatcatggataacattcgctttggcaatccttcagcaacagacgaagaaattatagcagcagcaaaagcaattggagcccattcctttattgaaaagttggaacaaggctaccaaactgaagtcgaagaacaagggaatgtgctatctgtaggagaacggcaattactttcctttgcccgggcgttaattgccgatccgcgcattttaattttggatgaggctaccgctagcattgatacagaaaccgaagtgaaaatccaaaacgggcttaaaacgctgttggcaggcagaacggcgatcatgattgcccatcgcctctcaacgattcgtgatgccgacaacatcattgtccttgaacatggcaatgtgattgaacaaggtacccatgaccagctgatggaaaagaaagggacctattttggacttgtcaagtcccaatatgccgcaa

SEQ ID NO: 6493 - DNA, 222 bp, Bacillus clausii
tagacatgcttttaagggagcttaatgttcagacactcattttgacaggagtggttggcaatatgtgcgtcgaatttacggccaatgatgcctatatgcgcgattatcagctgcttatccctaaagacggttttgcctgctttacaaaagaagagtacgacgcttcattaaaccatttcaccacggttttgaaggcggatgtggcttccacaaaagaactgc

SEQ ID NO: 6494 - DNA, 315 bp, Bacillus clausii
ggttttgcccaatcggtccgtttcttgtcacaaaagaagacattgctgatccgcaaaacttagcgcttgagacaagagtcaacggcgaaatcaaacagcaatcaaatacagccgatatgatcttcacatgtgccgagattatcagttatgtatcccgccactttacattaaaaccaggggatattgtccttactggcacgcctgaaggagtcattcttggcctacctgaagcagagcggcgttatttgcaacctggagacaccgtttccgttcatattgaccgattagggacattaacaaacaagctcgtgaaag

SEQ ID NO: 6495 - DNA, 235 bp, Bacillus clausii
atgaaagcgattgtaaacgggctcgtatggacaggcattgcgaatcagccagctgtccccggaacggttttggtggaaggcgcctgcataaaagaagttgggatcgatgttgtattgccagagggggttgaaaagatcgacgcgaaagggggctgggtgactccaggcttaattgacgtacatacccacttaggcgtccacacacaagggcttggcaatgatggccatgatttta

SEQ ID NO: 6496 - DNA, 708 bp, Bacillus clausii
aaggaagataaaattgaagccaacctcaagcgagccaattgatcttttttccgatcaatttcaccagcagccctatacgtattacaaagatattcgggaacaaacgggatttgcgaaagtcatgctgccttatggaatcccagcttggatggctttccattacgatgtggcggaagcggtgttaaaggacgagcgctttattaaagatgcacgtactgtttttccggatgaggcgttggacgaacaaatgctgccgataagcaagagcatgctatttgtcgatcctccagaccataagcggcttaggagccttattcaaaaagggtttaccccaaagcggatttccaggctaaaaagcaggatcgatgatatcgcgatggaacaagcgcgccggattaagcaaaaaaagcgctttgaccttgtcgaagaatatgcttttccaatcccgatcatcgtcatttgcgagctgctcggtatccttgattctgaccgcgataaattccaatattggtcaaagttaatcgttgatcttgataacgatggatacggcgagtctactacagtacagaagggcatggacgactttattgcttacttgcaaacgttgattcatgcccggcgccaagacccgcgagaagacctcttatctgatttaatccgcgccgaggaagatggtgaccggttaacgacaaatgaactttatggcgt

SEQ ID NO: 6497 - DNA, 831 bp, Bacillus clausii
ttttaacgacgcccgcaaatctggggttaccactgtacaaattttaccaggaagcgccaatgtgattggtggcgaaacatgcatcttaaaaacggctggccgtactgttgctgatatgactgttaaagcaccttcggcaatgaaagccgcactcggggaaaacccaaagcgtgtccatgggggaaaaggacgagcgccagtaacgcgtatgggagtggctgccgtttttaggcaagcgttaatgaacgcccaagactatgctgaacgaaagcgtgctggaaaattagaaaaacgggatttgggaatggagcagcttgtgcctgttatcgaagggaaacggccgatgcgtgtccatgcccatcgtgcagatgacatgatgaccgttttacggattgccgatgagttttcgctgcggcttacaattgaacatgcgacagagggccatcttattgctgaagagctagcgaacagtggcgtccgctttaccattggtccaacgttctcttctcgctcgaaacaagagcttgccaacaaaagttgggagacgattcaagtgtttgccgaaaaaaatgtgcctttttcgataacgacagaccaccccgttattccgattgaacatttgttaacgactgccgcatttgctttaaaatacggaattagcgagcaacggatgttggaagcgattactgtacgggcggcagaacatctcgatatcgacgaccgtcttggcacgattgaagcaggcaaagatgcggatcttgttatttggagcggtccgccattgcaagcgggtacggttgtaagagaaacgtttataaatggggaatcagt

SEQ ID NO: 6498 - DNA, 213 bp, Bacillus clausii
  misc_feature (1)...(213): n = A,T,C or G
ggttttggtggaaggcgcctgcataaaagaagttgggatcgatgttgtattgccagagggggttgaaaagatcgacgcgaaagggggctgggtgactccaggcttaattgacgtacatacccacttaggcgtccacacacaagggcttggcaatgatggccatgattttatgaaacaacngctgcatgcacccctgaagtccgggcgatcgat

SEQ ID NO: 6499 - DNA, 669 bp, Bacillus clausii
atggagggtgaaaaaatgataaagatagagaatttagacttagtgactagagaaaaacttctttataatggcaatgctgagctgaaaagaggttttatttatgggttatcagcacgaaatggttctggaaaaacgacattgttgcggacaatagcaggaatccgcagcgaaacaaaaggatcgatttattacatttctaatcatgaaatctattctttgccagaattaaaacggaaactgttttactatgaaagttcagaatggtttgatcctaacttgacaggctttgattatttaacattcattcaaagagaatggtctaataaaaatgcatgtatagatgatgtggtagattattgggaaatgaatcaatatattaaaatccctatcaaaacgtattcgcttggcatgaaacagcgggtattattaggtctgtatgaggttagtggcgcagaatactggttaatggacgaaccgacaattggattagatacaaatagcattgaaaagtttgaaaagttgttagcacgagagaaaggcaagaataaagcaattctcttctcatcacatcaagatgatcgtatttataaagtttgtgattacatttatgagttaggcaacggctctttagttatgagagaggcaagtcaaaaaggagaaaatcgatga

SEQ ID NO: 6500 - DNA, 638 bp, Bacillus clausii
gtgaatcgaacggatgaatgcagcgattcagttaaaaaaggttagaaaaacgtacggaaaaaaaataaaagcggttcaagatttgtcattaacaatagcagaaggaagcatttatgccttgctaggaccgaatggttccggcaaatcaacaacgtttcgcatcctgaccaccttggcatcggctgatcaaggggaaatccactattttggctctcccaaaatcaataaacaaatgattggatgtgtcgcccaaaactcaggcgtcgacccgacagcaacaggaagggaaaacttaatgctgcaaggcagaatttacggcctgcctaagaaggcgctcaaagaaagagtaaatgagctgcttactgtctttcatttgcaagaggccgccgatcgactgagcaaacattactctggtggaatgaaaagaaagctggatctcgcaatggggattattcatcgcccgaagctgctttttcttgatgaaccgactaccggacttgaccccgaatctcgcgcggagctgtggcaaatgatcaaacagttgcaaagcgatgctggcatgacggttttgctgaccactcattatatggaagaagccgacgatctagctgaccggatcgcatttatgaatgaaggca

SEQ ID NO: 6501 - DNA, 656 bp, Bacillus clausii
atgccattagtcgatatgccgttgcgcgagttgttagcttatgaaggagtaaaccctaaaccagcagacattgaccaatactggaaccgggccaaaacggaaattgaagcgattgaccccgaagtcactcttgccgaagctcctttccagtgttcgtttgcaaactgttaccatttctattatcgaagcgctggaaatgcgaaaatccatgcgaaatacgtacagccaaaaacagcggagaaaacgccagcagtatttatgttccatgggtatggggggcgttcagctgaatggagcagcttgttaaattatgtagcggcgggcttttctgttttctatatggatgtccgtggacaaggaggcgcttcagaggatcctggaggcgtaagggggaatacatataggggccacattattcgcggacttgatgccgggccagacgcgtttttttaccgcagcgtttttttggacacagtccaattggttcgtgctgctaaaacattgcctcacatcgataaaacacagcttatggcaacagggtggtcgcaaggcggcgccttaacgcttgcctgtgctgcccttgtccctgaaataaagcgcctcgcaccagtatacccgtttttaagcgattacaagcgagtgtggcaaatggattt

SEQ ID NO: 6502 - DNA, 696 bp, Bacillus clausii
cttgtctcagttgaagaagggacatctttcatcaacgattacaagaagggatgggcaaatttatgcggaagcatcggcaaaaattttgtctgatgatgtagctggcgtctccacaacggttttaaatgaaattgaggaattagagtttcctgaaggggttgacgttcaagtcggaggcgtaaccgctgatatcgaagagtcatttacacagttaggaattgccatgcttgttgcgattgcgatcgtttactttgtgttagtcgtaacttttggcggtggacttgcaccatttgcgattctattctcactgccatttattgtgattggcgcccttgttggcttgtttgtgacaggggaaaccattagcatttctgtgttgattggaatattgatgttaatcggtattgtcgtcaccaatgcaattgttctgattgaccgtgtgatccataaggaaaaagaaggcctttccacgagagacgcacttttggaagcgggaaccgttcggctgcgtccaattttgatgactgccctcgttacgattggcgcgttgattccacttgcaatcggtgctgaaggaggcgggctcatttcgaaagggctaggcattaccgtcattggcggtttgacaagctcgactttgctcactttggtcatcgttccaattgtttacgaactgttaatgaaaatgcgcgggaa

SEQ ID NO: 6503 - DNA, 390 bp, Bacillus clausii
  misc_feature (1)...(390): n = A,T,C or G
cggcacatggactgggcaagacattgcgactggaggcgtatggtctagtgaatttncggtaacggtgtttggcgattcggaagaagacatcgagccggcagttgaggacatcaaagcgcttctagaggagcacnatgacttggccgatcccgaaacgtctattgctgaccgctatcaagagtacacgctgaaagtcgatcaagaacgatcgantgaattaggtttgacaacagcacagcttggtatggctctgtaccaggtcgatgaccataacgccgttacgacagtggaagcagatggggaagagcttgatgtggtgattgcgacaaatgaggaagagtatggctcccttgaagagctaactgacgttgaagtggaaacgcaacttgg

SEQ ID NO: 6504 - DNA, 470 bp, Bacillus clausii
atgaaatttgtccgatttactgtaaatgcaaagacaagccaaggcgttcttgaacacgaaacaattaaagccattcaaggcgatttgttcgctgagtggcgttttacaggcgaaacgtatccagtagaggatgtaaaatggcttgctcctcttgtgcccaatcacattattgggattggcgccaactatgtcgccaaagtggaagatcgtccagacacgttgcccgatatccctgtatttttctttaagccgtcttcttctgtcattgggcctgaggatccgatcgtgatcccaggctcaaacgagcaggtgaagtttgaatctgaattagccgtcgtgatcgggaaggaagcgaaaaatatcgacgagtcggacgtgttggactacgtttttggctatacgattggcaatgacgtaacagcgccgcaatattttcatgaagctggccattggatgatcggcaaatcatt

SEQ ID NO: 6505 - DNA, 447 bp, Bacillus clausii
tttcaaaggctccattggtgaaaacatccgctacggtcgccttgaggcatcggatcaagaagtggaagaagcggctaagttggcaaatgctcatgggtttatttcccacttgccaaatggatacgatacgatgcttttgcaagatggcagcggcattagccaagggcaaaaacagttattgtcgattgcccgagcgctgcttgctaacccgtcgattctgattttggatgaagcgacatccagtattgatacggtgacggaaatgaagatccaagaagcgttaaaacggttgatgcatgggcgtacaagctttgtcattgcccaccgcttaaatacgattgaagccgctgaccaaattcttgttttgcagggaggagaggtcaccgaggtaggaagccaccatgaactgatggcgacaaaagggttttattacgagatgcaacaaac

SEQ ID NO: 6506 - DNA, 870 bp, Bacillus clausii
aagcgaggaggcgaagcgtttttttcgggaaagcaacaatctgatggaccggacggtaaaagcttttcgcctaatggaattaacattgcctgttttgctgtttttaatgaacggctcgattttgcttgtgctttggtttggaagcattgacattggtaatggtgcgacccaagttggcgatgttgtggcgattgtcaattatgcaacgcgaattacttctgctttaaccgttttttcgatgattatcatcgtcttttcccgggctagagcctcggcaacgcgaattgaggaagtgctgctagaacctgatgacgaactgaaggaaagcgaggaaaagcctgagcccccggctatgaaaggggagctgcgctttgagcatgtatcgttttcttatgcagagggggctccctttgtgttgaaaaacatcgatttcgctgtaaaggcgaatgaaacagttgccgtcctcggggaaacaggctctggaaagtctactttattccagctcatcccaaaactttatgaaccgaccaaaggaacggttcgcattgatggaacgcctgttacggcgtggcaagttcaaaagctgcgcaggcaaattggctatgtcccgcaagcggtccgattgttctccgggacgatccgcgaaaacattgcctggggctttccagaagcatccgctgaagaaatagaagcagttgctaaagtagcgcaaattcatgaggcgattgtacgtttgccagatgggtacgacacgattgttggccagcaaggcgtcaacttgtcaggaggtcaaaaacagcggatttccattgcccgtgccctgctaggcaagccgaaaatgttgcttcttgacgacagcacaagcgccct

SEQ ID NO: 6507 - DNA, 456 bp, Bacillus clausii
  misc_feature (1)...(456): n = A,T,C or G
gaaaagaagctgaaaacgtagatggagtacttgcgcctgctggcacactcagctnccaaggcgtttcctttggttacactgctgacaagccaattttaaaagaggtagattttgatgctcctatcggcaaggtcaccgcttttgtagggccaagtggagcagggaagacgacattgttttcattgattgaacgtttttatgtgccagacgacggcacgatccaatataagggtcattccatccatcgcctccctttgcatgagtggcggcaaaagattgcctatgtttcccaagactcgccgatcatggcaggcacgatccgctccaatttggtttatgggctgacggatgttcctgaatagaacatgacggcagcggttcggcatgcaaatttagagtcgtttattgcttcccttccagacagatacgatacggaagtatgaaaacgaagcgtcc

SEQ ID NO: 6508 - DNA, 839 bp, Bacillus clausii
atgacgcttgaaattaagcaagtgcgcaaacggttcaaccaacatgttgccgtcgacgggatttccgttagcgttgaaaaaggcaatatgttcgggatgcttggcgcgaatggggctggaaaaacaacgacatttcgaatgattttaggattgctcgagcccccggaagggtcgattacttgggaaaacaagcaactttcttataaaaagccccctttgattggctacttgcctgaagaacgggggctggacccaaaacttactgtccgcgatcaacttacgtacttagggaaattaaaaggaatgaaagtgcaagagatccacaaagagatcaagcaatggcttaaacgatttcaagtggaagaatacgaaacaaagaaagtggaagaactgtcgaaaggaaaccaacaaaagatccaatttgttgcagcagtgctccataagccagagctgttaattttagacgaaccgtttagcggccttgatccagtaaactccgacatgttgaaaaacgctgtccgttatttgcaggaacttggcacgacgattgtgttttcaagccaccaaatgcgcaatgtcgaggaaatgtgcgaagacattattatgctaaagcgtgggaaagcggtgctgcaaggcagtctgactgatattaaacggagctatggcataaaaaatgtctcgattcatgctgattatgatttgtcgtttttagcttctgatcctcatgtgactaatttgacgccaattaaaaatggcgttatcgcccgggttgaaaatgaagaagcggcaaaagccgtgttcgctcgcgttgccgaaaaaggctttgttcgcaaatttga

SEQ ID NO: 6509 - DNA, 650 bp, Bacillus clausii
atgatcatatgtacggagatcgaaaagcgggtggacgctcgtttttcaacgggtccgatttcctttcaggttgaacgaggaaccgttacggctctcgtagggaaaaatggctcaggaaaaagcacgattttacggatgatatctggcatggtacatcccgatgcagggacaatcgaacggtttcgccaacaagtgggagagagggagtggaaaaatcagctcgcctttattccacaaacaagcaaatcgtttgaaaagtacacgctttctcatttagccgccatataccggattggctttcaaacttggaacgaacagcggtttttgcagcttgtggagcagtaccgtctgccgctcaataaacaaataagccaattttccgggggtatgcagagagtcgcacttgccgttttagcactttccagaaactctaaagtgctcattatggatgagccttttgcaggcgtcgatattgaatcacaagaatggcttcgtaacgaatggcttcagtacttggaagaagacccagaaagggcgattgtcttttcgagtcacgtgcctgatgaaatcaaagatttagccgattttattatttgcgtgcaagacggcaaacagacaggctactatgaaaaagacacgttgctgagcag

SEQ ID NO: 6510 - DNA, 438 bp, Bacillus clausii
  misc_feature (1)...(438): n = A,T,C or G
agaaaaagaagccgtccgtcgaggcgttntaagaagtatcggaaaacggcacatggactgggcaagacattgcgactggaggcgtatggtctagtgaatttncggtaacggtgtttggcgattcggaagaagacatcgagccggcagttgaggacatcaaagcgcttctagaggagcacnatgacttggccgatcccgaaacgtctattgctgaccgctatcaagagtacacgctgaaagtcgatcaagaacgatcgantgaattaggtttgacaacagcacagcttggtatggctctgtaccaggtcgatgaccataacgccgttacgacagtggaagcagatggggaagagcttgatgtggtgattgcgacaaatgaggaagagtatggctcccttgaagagctaactgacgttgaagtggaaacncaacttggta

SEQ ID NO: 6511 - DNA, 939 bp, Bacillus clausii
cgctgtttgtgctaaatggcagcttagagctcggggcaatgagcgcttttgtcctttatatggaacggctatacggtccgttacggcgtcttgtcaattcatcgacaacgttaacacagtccattgcttcgatggaccgcgtttttgagtttattgatgagaaatatgatattacagacaaagaaggagcagacgtgttgactgatgtcaaaggagctgtaacatttgaacatgtgacattttcctacgacaatgaagcggcaccggcactgcaagatatccatttaaacattccagcagggcagacggttgcccttgttggcatgagcggtggagggaaaagcacgctcgtcagcctgataccgaggttttacgatgttacaaaaggccggattctgattgacggcaaagacattcgtgacctcgtcgtgagaagtttgcgcgacaatattggcatggttctgcaagataatatcctgtttagcgacagcgtgaaatcgaacattaaaattggaaagcctgatgcaacagatgaagaagtcattcaggcagcaaaagcagccaacgcccatgaatttatttgcaagctggaaaatggctatgataccgaagttggcgaacggggagtcaaactatctggagggcaaaagcagcgcattgccattgcccgcgtatttttaaaaaatccacctgtgctcatttttgacgaagcaacgtcagcgctcgatttggaaagcgaacattttatccaagaagcactagaaaagctggcccgagaccggacaacgtttatcgttgcacatcgtttgtcaaccattacgaatgccgatacgattgtggttatagacgacggaaaagtagtcgaacaaggcactcataaagaattaatggaaaagcaaggttcctattacaaactatacagcgtccaagaattggaag

SEQ ID NO: 6512 - DNA, 639 bp, Bacillus clausii
atgttcaaaaatgggattcagattcagatcggattaggagattatttaaaaggcgtcgccttcttttgtccccattttgattgggagtatgcaatgaaccttgttgaacggtttaaactgcctattgattcgccgatgaatgaattatcacgggggatgcaatctgccgcccatgtcataatcggactagcaagccgggctccgattacgatctttgacgaagcttatttaggaatggacgcgccggctcgggacattttctataaagaagtgctcaatgaatatatggaacatccgagaacgatcatcctgtccacacaccttatttctgaagtggcttcgatgctagaagacgtcctcattctacatcaaggttccctcatgctccatgatcgtacagagtcattgttgtctaggggaacgacaattacgggcgataccgcagcggttgatggatttacacgaggaaagaaagtactaaatgaacagacactaggacagacaaaatcggcgatggtctacggagagttaactgaaacagagagatcacaggccgaacgacaaggtttgcaaattggcccagttgctttgcaagaactatttatccatttgacaggggaggaggggcataatgaataa

SEQ ID NO: 6513 - DNA, 969 bp, Bacillus clausii
tgttggttgttatcattatagctagttattggattagttttatttggatgcagcaactgtttggcggcgcttttattttggaacggaaattgcgttcccgttttatgcgccatttgtttgcgatggatccgccgtttttcgagaagcggaaaacaggcgatttgcttgctcgtggaacgaatgacatgaaggccatttcgatgactgctggattcggcattctgacattgttggattcggtcttatttatggggatcttgcttgctgcgatggttcttttgattgattggcgtctgacgctggcggccgttgcgccgttgccgctgattgcgttagtcgtcacgattttagggagtatgatccattcccgtttttcaaaagcacaagaagcgttcggtgatttgaacaaccgtgtgcttgaatcggtggcaggcatgcgcgttatccgggcttttcggagcgagcgtcgtgacgagaaattatttgccgaaaagagcaacgacgtatacaagcggtacatgcaagtggctcgtgttgagtcgttttttgaccctgttgtcaatatggtcgttggcttaagttatgtgatcggtcttggctacggtgcttatttggtgttccaccaacaagtgacgcttggacaaatcgttacatttaacatgtacttagggatgttgatttggccaatgtttgcaattggtgaattggttaacattatgcaacgtggtggtgcttcttatgaccgtgtcaacgatacgttaacggttgaaaaagcggttcaagcgccggatgtgcctgttgaaggccttggccaccatttgccgatccgatatgaaaaagtcagcttttcatacccaggcgcaaaaggaaatcagttggaaagcatctctctgacaatcaacaaaggggaaacgattggaattgtcggaaagaccgggagcggcaagtcgacgcttgtgaaacaattaa

SEQ ID NO: 6514 - DNA, 951 bp, Bacillus clausii
atgcagcaactgtttggcggcgcttttattttggaacggaaattgcgttcccgttttatgcgccatttgtttgcgatggatccgccgtttttcgagaagcggaaaacaggcgatttgcttgctcgtggaacgaatgacatgaaggccatttcgatgactgctggattcggcattctgacattgttggattcggtcttatttatggggatcttgcttgctgcgatggttcttttgattgattggcgtctgacgctggcggccgttgcgccgttgccgctgattgcgttagtcgtcacgattttagggagtatgatccattcccgtttttcaaaagcacaagaagcgttcggtgatttgaacaaccgtgtgcttgaatcggtggcaggcatgcgcgttatccgggcttttcggagcgagcgtcgtgacgagaaattatttgccgaaaagagcaacgacgtatacaagcggtacatgcaagtggctcgtgttgagtcgttttttgaccctgttgtcaatatggtcgttggcttaagttatgtgatcggtcttggctacggtgcttatttggtgttccaccaacaagtgacgcttggacaaatcgttacatttaacatgtacttagggatgttgatttggccaatgtttgcaattggtgaattggttaacattatgcaacgtggtggtgcttcttatgaccgtgtcaacgatacgttaacggttgaaaaagcggttcaagcgccggatgtgcctgttgaaggccttggccaccatttgccgatccgatatgaaaaagtcagcttttcatacccaggcgcaaaaggaaatcagttggaaagcatctctctgacaatcaacaaaggggaaacgattggaattgtcggaaagaccgggagcggcaagtcgacgcttgtgaaacaattaaatgaagtattatccaggactaagcggtga

SEQ ID NO: 6515 - DNA, 570 bp, Bacillus clausii
tttaaaaggcgtcgccttcttttgtccccattttgattgggagtatgcaatgaaccttgttgaacggtttaaactgcctattgattcgccgatgaatgaattatcacgggggatgcaatctgccgcccatgtcataatcggactagcaagccgggctccgattacgatctttgacgaagcttatttaggaatggacgcgccggctcgggacattttctataaagaagtgctcaatgaatatatggaacatccgagaacgatcatcctgtccacacaccttatttctgaagtggcttcgatgctagaagacgtcctcattctacatcaaggttccctcatgctccatgatcgtacagagtcattgttgtctaggggaacgacaattacgggcgataccgcagcggttgatggatttacacgaggaaagaaagtactaaatgaacagacactaggacagacaaaatcggcgatggtctacggagagttaactgaaacagagagatcacaggccgaacgacaaggtttgcaaattggcccagttgctttgcaagaactatttatccatttgac

SEQ ID NO: 6516 - DNA, 612 bp, Bacillus clausii
cgttgtcgacttccgaagtgcttgcgttttattcgccggaaatcccgcttattatcaactggttgttgctttacctagggattgtgtttgtcgcttccttcttccgctacggccaaagttactatttaaagaaagcagcgcaccgcattatccagcggatgcgggttgatgtatttggccagctttcccgagtacctgtacgcttttttgaccatcagcctgctgggaaaattgttgcccgcattacgaatgacaccgaagcaattcgtgagttgtatatgaccgtgctcgccatctttttctcaagcggcatctacattgccggcatttatgttgctttgtttatccttgattggcgtttggcgctaatggcgcttgtgctattgccgattttgtatgcttggtttaaagtgtaccgtaaatttgctgcaggctataaccggaaaatccgcgccaaaaatgcggaaattaacgctgcaatgaacgaagcagtccaaggcatgagcattatccaagcatttcgccaagaaccaaaaacagaagccgcgtttgaaaagttaaacgaagagcattatacgtatcaagcaaaactgcttaaactcaattcattaa

SEQ ID NO: 6517 - DNA, 660 bp, Bacillus clausii
  misc_feature (1)...(660): n = A,T,C or G
tgtttgtggggttgatttggtggattancggtggaacagcaggttttttaacacttggcgtgctgtatgcgtttgtggattatatcaatcgtctgtttgagccagttaaccaaattattaatcagcttgctaatttggagcaagcccgtgcagctggtacacgggtatttgaattaatggatgaagaaggaagagacgtggatgatagtgaaattccgcgttttaaaggtgaagtagcgttcacggatgtccgtttttcttacaaagacggcgagcctgtcctgaaaggcctgtcgtttcgcgcaaagcctggcgatacggttgcccttgtcggccatacagggtctggaaaaagttcgattatcaacttgctgttccgcttctatgatccgcagactgggacgatttcgatcgatggtgtcaatacgaaaacactatcgccccaagcaatgcgggcacatatgggcattgttctccaagaaccatacttgttctcaggcaccattgccgaaaatatcgcctatgggcggcctgacgcgacacgggctgaaattgaggaagccgttcgccttgttggcggagaggacgtgtttgccaaactgacgaatggcttagatgaagaagtatcggaaaagggcagtactttatcaagtggacagc

SEQ ID NO: 6518 - DNA, 947 bp, Bacillus clausii
atggcaatggcgactggtgctgaatatttaaagcgaattgcccaactagaaagcacaatttggattgatggtgaatgcgtaaaagggaaaagcacagaacatcctgcttttcagaaagtcttagaagcaaaagcaagcttgtacgatatggtgctggacgatgcccatgcagatattttgcaagcaagcgacaaaaacgctaatttttcttttgaaatcccacgcacaaaagcagatttgacgaagcgcagaaaagcaactcaattgtgggcgcaatcaactttaggcgtactaggccgttctcctgaatacgtgaatacaatgattgcgattatggcaggggcaaaagatttctttgccgaagatggaaaagagtatggggaaagcatacaatccatttatgaacgagctgtaaagaacgactacacatttacgcacacatttgtgaatccttcgattagcaggaaaccattttatcctgacggagaaagcgtcgagcagccagttgctgcaaagattgtcgaggaaaacgaaaaaggagtcgtgatagacggagcccggcttttggcgacacaaggggggattaccgacgaactgttggtccttccatcagctgcatttgtcgatagcgattatttgtttggctgcaccgtcccttcagatgcagaggggctcatatttttaagtaggccttctttcgggaaagaaacgcaatttgactaccctttatctgctactcttgaagagggcgatgcagttgtcgtgttcgaccatgtctttatcccgtgggaacgggtatttatgtatagaaatgaatggctaatgagccagctctttgcgagaacaggcattgaagcatttttgctgtatcaagcggcgaacaggcaaatcgttaaaacggagtggctgctcggcattgcccaagcgcttgtcgatacactgaatat

SEQ ID NO: 6519 - DNA, 456 bp, Bacillus clausii
acccgcaagaacggggaaagtttgatccacacgaagaaaaattacagcattttgtccaagaagtcaggcgcttctatccattttttccttttgtgcctgcgcgaccaatcaaggattttacgtggaatggctacccatttaagaaaggcacattagtgcttctcgatttatatgggaccaatcatcatccgcagctttgggacaatcccgaacagtttcggccagatcgctttgcgacatggaacaaaagcccgtttgccttcattcctcaaggtggaggcgatcgcaatactggacatcgttgcgcaggcgaatggatcacaatcgagattatgaaagaaagtttggattttcttgtcaatcgaatcgattataccgtgcctgaacaagatttacgttttcgctttaacgaaatgcccgctttgccccatagccagtttgtgatgacgaatgtcc

SEQ ID NO: 6520 - DNA, 537 bp, Bacillus clausii
  misc_feature (1)...(537): n = A,T,C or G
gaaagctttgcttgttattgattatacgtatgattttattgccgatgagggagctttaacggtaggggcgccagggcaagcaattgaagacgcgattgtagacaaagtcgaggcgttccaccgggccggtgatttagtcgtctatgccgttgatgtgcacgaacaaaacgatcaatgccacccggaaacagcgctttttccgccccataacatccgtggcacgaaagggcgcgaactgtatggaaaggtcggcactcaatatgagcggataaagggagagaaccatgtcatatggcttgataaaacacgctactctgcttttgtcggaaccaatcttgatttggtattgcgggaacgaggcattacggatgtccatcttgttggcgacgtcaccgatatttgcgtgcttcatacagccgtttatgcatattccctcggctacaaattaacgatctataaagacggcgttgctagtttcgatgcatctggccatgagtgggcantgcgcccctttcagcaagcattgggagcaanaat

SEQ ID NO: 6521 - DNA, 702 bp, Bacillus clausii
  misc_feature (1)...(702): n = A,T,C or G
gtcaggcagagcgctgctgaaattttcntactcccttttacaggaccaaccgaatcaccattatacccttaactggtttacaagatcgccaggttttttccaactagaggaatcaaagattgggcaagagcttttttcgcctgattttgtttcctattttcatgaacttccctatgaaacaaggaaggacaccctttcactgctcgggcatttgcgcaatggcgtgcaagctaaaacactccacaacatttatgacctattgtaccaccgcagcattgccaaaaaagcttcgcctgctttaatacgcgccaatatggaagtgacaacgattgagaaaaaaggaccacggagctatcaagtgatgggagaacaaacacaacaggggcagacgttagcttacaagacagaaaaagtcatttgggcaacaggctataagccgaatgtcccccgctggttggaagcaatgcacactgagctggaaatggaaggcgagagcgagtttaaactaacacgtaatgcagaactcctttttaaaggtgcgcgcaaaaaccggatgttttccttaacgaatctcgaacatgcgttagggacaagtgccaccaatctggctttatcggttgaacggaangcccggattgtaaatganctatgtggcaatgaggtattccaagtaagcccaggatctgnttttcaacaatttgg

SEQ ID NO: 6522 - DNA, 465 bp, Bacillus clausii
agagctcaacaaatcgcttgggaaaaagccgattataaaaaacatgtcattccaattggaacggggagcgatttatggctttttaggacctaatggatcagggaagactaccacaatccgcatgattgtttccttgattgcccctgactcaggagatgtggaaatagaagggaaatcagtgcgtacaaaccgtgaagaggcgttggcacatatcggcgccattgtcgaagatccagatttgtacggctacttaacaggacgacaaaatctcgagcactttgcacgatgagcgctactcctgtttcaaaagaacggattgatgaggtggtcgcgcttgtagagctagaaggggcgatgcgaaaaaaagtcaaatcttattcactcggtatgaagcaacggcttggcattgccgtctccttgcttcacaagccatccgtccttattcttgatgagccgacaaacgga

SEQ ID NO: 6523 - DNA, 611 bp, Bacillus clausii
ttaacacttggcgtgctgtatgcgtttgtggattatatcaatcgtctgtttgagccagttaaccaaattattaatcagcttgctaatttggagcaagcccgtgcagctggtacacgggtatttgaattaatggatgaagaaggaagagacgtggatgatagtgaaattccgcgttttaaaggtgaagtagcgttcacggatgtccgtttttcttacaaagacggcgagcctgtcctgaaaggcctgtcgtttcgcgcaaagcctggcgatacggttgcccttgtcggccatacagggtctggaaaaagttcgattatcaacttgctgttccgcttctatgatccgcagactgggacgatttcgatcgatggtgtcaatacgaaaacactatcgccccaagcaatgcgggcacatatgggcattgttctccaagaaccatacttgttctcaggcaccattgccgaaaatatcgcctatgggcggcctgacgcgacacgggctgaaattgaggaagccgttcgccttgttggcggagaggacgtgtttgccaaactgacgaatggcttagatgaagaagtatcggaaaagggcagtactttatcaagtggaca

SEQ ID NO: 6524 - DNA, 624 bp, Bacillus clausii
  misc_feature (1)...(624): n = A,T,C or G
tgtaacgggattcattggtgccaatggagctggtaaatcaacagtgttaaaaataatgatgaatttattaaagcctgatgccggggaagttaaggtttttgggctcgactataaaacgcatgagaaggcgatcaaggaccggattggatttgtttatgatgcgaatgttttttttgaagggctgaacttaaaagatataaagcgcattgtggcgccagcttacaaacgctgggatgacacgtcgttttatcaatatgttaaccaattcgaattacctcttaataaagcgataaagacattctcgaaaggaatgcaaatgaaggcttcattggcgatcgcgctatcccatcatgcagagctgatcattatggatgagccaacagcaggcttagaccctatttttaggcgggagctgttggatcttttacaagaattgatgattgacggcaatcggacgattttcttttctacccatataacgactgatttggatcggatcgctgattatatcgcttttatacgaagagggaaattggtatttaataagtcgatccacgatatcgctgaaaattatgcccttgttaaaggaaganacgaactattggatagggacacagaaaaggc

SEQ ID NO: 6525 - DNA, 483 bp, Bacillus clausii
  misc_feature (1)...(483): n = A,T,C or G
agatgcaacaaaagaagtgtttaagccaattctatcctccacgattgtgacancggttgtgttcctgccgctcgggcttgtcgaaggaatggttggagagttgttccttccgtttggcttaacggtgattttcgctttatttgcctctttgcttgttgctattactgttgtgccgatgatggcaaattcgctctttaaaaatggcgcacctgaaaaacataaaaagcaagaagaaaagccagggaagttggcatctggctaccggcgtctactggaagcggctcttaaccataaaatcatcacttcgcttatcgctgttgccctgttagtaggcagcttgttccttacaccttttgtcggtgtaagctttctgccagaggaagaagagaagcttgtttttgccacttattcgcctaatgcagggacaacgtttgaagatgcagaaaacgacgtcaatgcagccgaggaagtgctccttgacag

SEQ ID NO: 6526 - DNA, 501 bp, Bacillus clausii
taccggagggggatattctccttgatggccattcggtccgggcttatcaacttagctgcattaaagacgcatttggccttgtgccccaagaacattttcttttctcagcgaccattgctgaaaacgttgctttcgcgaagccagaagcgtcaatggcagaaattgtcgctgtctgtaagctagcgcaagtccatgaagatattctccgtttccctgctggttatgacaccattgttggagagcggggcgtgaccctttctggcgggcaaaagcagcgtatttccattgcacggacgctgttaagcgacccaactttgctcgtacttgacgatgccctgtcagctgtcgatgcgaaaacagaggaagcgattttacaagcacttcaaacagaaaaacgggaacggacgattatcatgacggcccaccgcttaagtgcgattagccacgcctcccttattctagtgcttgcagatggaaaggttagccaatcaggcactcatg

SEQ ID NO: 6527 - DNA, 459 bp, Bacillus clausii
atgtttcgtgtattgaagcaattggcctggttttttaaagaacaaaaaaaacggtacactgtagcggttgtattgctacttgttgtcagcgttgttgatttgatgcccgctttattaattggggaagcggtggacgcgttccagcgcggtgcattgtcttattcgtatgcttttagcttgatagcgctgttggttgttatcattatagctagttattggattagttttatttggatgcagcaactgtttggcggcgcttttattttggaacggaaattgcgttcccgttttatgcgccatttgtttgcgatggatccgccgtttttcgagaagcggaaaacaggcgatttgcttgctcgtggaacgaatgacatgaaggccatttcgatgactgctggattcggcattctgacattgttggattcggtcttatttatggggatcttgcttgctgcgatg

SEQ ID NO: 6528 - DNA, 839 bp, Bacillus clausii; identical to SEQ ID NO: 6508

SEQ ID NO: 6529 - DNA, 524 bp, Bacillus clausii
acggggaattagcgaatgaactagttgatttatttgaactgccgcgccacaaaaaaatccgcaagttttcaaaagggatgcagacgttgacgaaaattgtcatcggcttagcctcgaaaacccctgtcacaattatggatgaaccaacgaatgggctagatgctgacatgcgaaagcttttctatgaagttctgttagaaacgtatgaagaccatccacgtatgtttctgttatctacccatcatatcgatgaattaaagcctttgtgcgaaaaaattgcgattgtcgatcagaaaacgatcattcgttatgaagaaaccgaaatgttaacggtgcaaggcattttgttgactggggagagagcggccattgaggaactaacggcagggtataacattttagaggaacgcactcttggaaatgtcgtgaatgtcatgcttgatgattccttttctgaaacatgggcagagcgggctaaagcagctcatgtaaatattgaaaaggcatcgcttcaagattacctt

SEQ ID NO: 6530 - DNA, 522 bp, Bacillus clausii
actacatgttcccgatcatgctaggtacggtattctttgcttttacatttgcgacaaacaatattattcgttcggaaggaaacgctcggtttgcgatggtgacaatggtcattccggccattctgaatatcattctcgaccccattttcatttttgctctcgatatgggcgttaaaggggcaggcgtcgccacggttgttgcccaaggagcggtgagcttctttattttgcggtattacgctaaaggtgaaagttcgttgcgcctcagttggacaagcgtgtctctgccggtttctgtcgtaaaggaaattttgtctgtcggctttcctgcatttgtccaacaagcatcagggagtttgatgatgatcgccatcaacgcgatgctcattcaacatggaagcgatatgcacgtcggtgtatttggcatcatccagcggattatgatgtttacggtgatgccaatgattggcgttatgcaaggaatgatgccgattgtcggttacaattatggagccaaacaat

SEQ ID NO: 6531 - DNA, 438 bp, Bacillus clausii
  misc_feature (1)...(438): n = A,T,C or G
acatacagatggcgttatgacaggacgtgagcagcgagccgttttttggcggcttatccgttacgccggcccgcataagaagcggttcatgctggcccttgctattatgatggtggctgccggagcggaactgctgcaaccgattttgattgcccgctttattgacggttatttaacgccgcaattgtttgaactgaaaccactgttagcgcttgcgttcttgtatgtagggctattagtagcggctgtgattggccagtatgttcaaagcgtccttttttggcgaattgcgctaaacattgtccaagcattacggctcgatgtattcgcccacgtacaaaagctagggctgtctttttttgaccgcatgcctggtggcgctcttatttcacggantacaaccgacaccgaagccatcaaggaactatatgttagcgt

SEQ ID NO: 6532 - DNA, 636 bp, Bacillus clausii
atgattaaacgttttttttcctattatgtaccgcataaaaagttgttttttattgactttttcagcgccattgtcgtcgctgttttagatttgttttttccgattgtcgtccaatggttcattaacacgcttttgccacaacaagagtgggacaaggtcgtctgggtttcaggggggctgttgctcacctatttaatcagcgcgtacttacagtacaatgtcaattttcttgggcataaactcgggattcacattgagacggacatgcgccaagacttgtttgaaagcatccagcgccaatcgttccgttattttgacaatacgaaaactggccatattattagccgcattacaaatgacctgtttgacattggcgaattagcgcaccatggcccagaggacttatttattgcgttaatgacgtttgtaggtgcttttggcattatgttttatgtgaacccgacgctggctattgtagcactcgtatttgtaccgttcctgattgccttgattacttataccaatattaaaatgaatcaggcatggtcgaaaatgtatgcggaaattggcgatgtcaatgcccgtgtagaagacagcgtttctggcatgcgtgttgtccaatcgtttacgaacgaa

SEQ ID NO: 6533 - DNA, 443 bp, Bacillus clausii
atgcgggtttttgtcgacttaaactggttttttaaaaagcattggcgcgcttatgcgagcggaatcgcagtgcttgccgtcgtctcttttttatcgctcattccccctcgtgtgattggggaagttgtcgatcagattgccgacgcgagcttaacaccgtctgcattggtaaacgatgtcggcttgattctagggattgctgttgttttatacatattgcgtgttttgtggcgtttactcatttttgggacgtcgctaaagttagctgggcaaattcgcttcgattagtatcggcattttacgaacatgcctgcttccttttaccataagcggacaacgggggacttgatggccgtatccacaaacgacgtgcgcgcggtccaagcgactgctggggaaggcgtgttaacaatagtagacgcgtgcttgcttggtgggatggt

SEQ ID NO: 6534 - DNA, 461 bp, Bacillus clausii
atgattttatatgtatttgatatgggtgttcgggaaattgcttttggtacgattttggcggcaacactagggttgcttgtgctcacttcccacttttttacgaaaaaaagcaatcttaaacttgttaaatttagatttgaaaagcctttaatggtcaaagcgtttacgtttggcttcccaagttttctcgctgaagtaggcatttctgtatttacgatttcacataacattatgtttgcccgtttagcgggcacagtgggcgtagcggctttttctgttttaaattatgttcatggcgtcatgttgcttatgttcttaggaatgggatcggcgattcagccgatcatcagctacttccacggagcagaggaagccgcgaaaaaacgggcgattatgcgaattgctataaggactgcttttatcgctggggcggcttgcttcttaattggccaagtggcagc

SEQ ID NO: 6535 - DNA, 1480 bp, Bacillus clausii
atggaacatgaactagccggctcattgggagctagacgattttggtcgatggtcaaaccttttttgccgaaggtggcttggctcgttcttgcagttgttcttgtcattggtgaaacaagcctgtcgctcattgtcccgctattgacgatgaatttcgtggacgaaatgaatgcagttggcttaaacggccaaacggtgtttttgcttgcgtctgtgtttttagcacaacttgtgatgtccggttttgccctttatacgatgatgtacattggccagaaagtcgtgttcgcgctaaggaaagaagcttggcaacggatgctgcacttgcctgttcctttttttgacaggcactcgtctggggaattgatgagccggatgaccaatgatacgcttgtcataaaagattttctaacgatgcagttaatcccgtttttttcgggcattgtttcgattattggctcgatcgtcttgcttcttgcgattgactggaaaatgacgttgatgatgcttactgttgttccggcttcgcttcttgtaatgattccattaggccgcagtatgtataaggtgtcgaagtctttacaagatgaaacagcctcttttcaaggcgatttaggccgcgttctatcagatatccgccttgtcaaggcgtcccttgctgaaggagtcgaacagaaagtcggcctctcgcgtatggcaaaactgtttcgctttgggatgcgtgaagggaagattatggctgtcattcaaccattgatgatgagcgccatgctcattatgctcgttgtgattttcggctacggaggcatgagggtttcggcagggacgctgtcggcgggagctcttgttgccatcattttttacttatttcaaattgcgatgccttttacacaaatggccagctttttcactcaatttcaaaaggcgcttggcgcaagtgaacgccttgagacgattttgcgagctgagccggaaaagaatgctgaaaacgtagatggagcagttgcgcctgctggcacactcagcttccaaggcgtttcctttggttacactgctgacaagccaattttaaaagaggtagattttgatgctcctatcggcaaggtcaccgcttttgtagggccaagtggagcagggaagacgacattgttttcattgattgaacgtttttatgtgccagacgacggcacgatccaatataagggtcattccatccatcgcctccctttgcatgagtggcggcaaaagattgcctatgtttcccaagactcgccgatcatggcaggcacgatccgctccaatttggtttatgggctgacggatgttcctgaatagaacatgacggcagcggttcggcatgcaaatttagagtcgtttattgcttcccttccagacagatacgatacggaagtaggagagcgaggcgtccgtctatcaggtggacaacggcaacgccttgcgatcgcccgggcgatgatcc

SEQ ID NO: 6536 - DNA, 766 bp, Bacillus clausii
atgatcgattttgacaatttcgaggagtaccatgaccctctattatatgatcaagaaaatggccaacacgaaagcgaaattccattcttattaaaatgggcagccaagcaaaaggggcttatcattgacttggcatgtggaacagggagagcaacaattccattggctgaaaaagggtttgcgctagtaagtgtcgatgtccataaagggatgctaaacgaggcaagaagaaaagcagcccgcttgccaattgaatgggtcgagcaagactgtacaaacttgaatctgccgctaaaaagcaaattaatttattgtgttggccattcgtttcaacattttctaacaaacgaggcccaaaatcagctgcttgcttctgtcaataggcatttgcatagcggcggcgtgttcatttttgatacacggtttccgagtcaggaagaattgcttcagccctgcacggaggagtattggcggacatacgtagatagggaaacgagctttacagtcgatgtttatacggtcagtgagtacgacgcgctcaagcaaatccaacattatacgacgataagaaagtacaaaaacaacgttggcgctatcatcaaggagaaacgaagccatattcgtttgcgctacacgtttccgcaagaaatggaacgtcttttaacggcgtatggttttgaaatcattcatgtttataaagactgggacgagacggttataacaaacgatagtagtgaagtggtcttcgtctgtaaaaaaagagagc

SEQ ID NO: 6537 - DNA, 537 bp, Bacillus clausii
aagtcgcagcgatgatgaaagaagcgattggccgctttcattcaattgatattttagtgaacaatgccggcattacgcgcgataacttgctaatgagaatgaaagaagacgattgggatgccgtcattgataccaacttaaaaggggtgttccattgcgcgaaagcagtcagccggcaaatgatgaaacaacgtgctggcagaatcatcaatgtctcgtctgtcgttggcgtaatgggtaacgctgggcaagcgaattatgttgccgccaaagcaggtgtcattggcttgactaagtctttggcgcgggaattggcagggcgaggcattcttgtcaatgcggtggcgcccggctttattacgacagatatgacagatgagctagcaagcgaaacaaaggaacagctgcttaaacaaatcccattggcgaagcttggtgaaccagaggatatcgctcgtgttgttcggtttttggcaagcgatgacgccgcttacttaaccggccaaacaatccacgttgacggcggcatggtcatgc

SEQ ID NO: 6538 - DNA, 179 bp, Bacillus clausii
atgttaacaggaaaaacggccgttgtaacaggcgcttcacgtggaattggcaaagcgatcgcccttgaacttgctgccaaaggggcgaatatcgtcgtcaattatgcaggaaatcgagaccgtgctgaagaagtagtcgccaacattaaagcgcttggccaagaggcgtttgcgtatcg

SEQ ID NO: 6539 - DNA, 516 bp, Bacillus clausii
ttgatattgtctttgccaatgctggcataaacggtaccgtcacatcaatcgaagcgtttgagccggaagaatgggaccaaacgttgcgagtcaatttaacaggcacttttttaagcgtcaaatacgccattccacttatgaaaaaacatggcggaagcatcattatgaccagttcggttaacggcactcgtgtcttttccaacttcggtatgtctgcttacagcgcctcaaaagcaggaatcgccgcttttgccaagatggccgcgctagaacttgccaactatggcatacgcgtcaatgtcatttgtccaggcgcgattcgcacacatatcgatgaacggacataccgccatgaggaagcgctcacaccgattacaattcataaaaaaagcgagccatttccgacacctcctggcacgcccgagcaagtcgctgacaccgtcctttatttagcatcagacggcgctaaacatgtgagcggcgcagaaatcgtgattgacggggcgcagacattgc

SEQ ID NO: 6540 - DNA, 381 bp, Bacillus clausii
acgcggcggttcggtaatcaatatttcatccatgtctgctccatcaccgatgacgaaagttccagcctatagcgctgcaaaagcgggcattaacaattttactcagtggctcgccgttcattttgctgactcaggcattcgggccaattccatcgcccctggcttctttctaactgagcaaaaccgcgctttattaacaaagccagacggttcgctaacggagcgggccgaaaaaatcattgcccacacaccacagcgccgtttcggcaaacctgaagatttgcttggaacacttttgtggcttgccgatgaagacgcttcgcggtttgtgacaggcgttacgatccccgttgatggaggatttatggcgtattcaggcgt

SEQ ID NO: 6541 - DNA, 354 bp, Bacillus clausii
  misc_feature (1)...(354): n = A,T,C or G
cgaagatgtatgcattgtcggaaaagaacggcaaacgctttacaaatataaggaggcagtcccgtttttttatcatccaaatgcgtcgtttatccgttacaaacagtggaagaaannaggaacggatcctttaatcgacgctgccgccttgagcacgggcgatgaagtccttgatgctacacttggcatgggtgcagatgcggtaatggctgctcttgctgtcggcagaacaggaacagtaacggggcttgaagcgagcaagtcaattgctcatatcgtcgcaaccggcttaaaagagtggcaggaaggggatgaaatgtttttgcaggcattacggcgagtaaacgttgtgaa

SEQ ID NO: 6542 - DNA, 801 bp, Bacillus clausii
atggaaatggcattaacaaataaaacggctttagtgacaggatcgacgagaggcatcggaaaagcgattgccctggagcttgccaaagaaggggttcacgtcctcattaacggacggaaccaggaagcggtccaacaaacggtagaggagatcaaatcgaaatttccatccacctcgcctcaaaatgcagcgggtgatctcactaataaagagcaaatggaaacgctatgtcagcagttcccgagcatcgacattctcgttaacaatatgggcatctatgaaatcaagcaatatgaacatgccgatgaccaagtgtgggaaacgtatttccgcacaaatgtgctggctgccaaccagttagtgcgattttatttgccgacaatgctgagccaaaacttcggccgaatccttttcatcgcaagcgaagaggccgtcatgccttcaggacttatgcctcaatatgccgcgactaaatcgatgctgctgtcattggcaaagaacgtgtccaaattaacagcaggtgccgaagtgacagtcaatactatcctgccaggtcctacgctatcggaaaatgtagctcaaatcattgaaggcctgttcatggaggaggaaccgtcgttgtccttttccgaaaaagaaaaaaaatttatggcctccaatttgcctcagtccgaaattcagcgcttcatcaggccagaggagatcggcagactcgcagcttttatgtgcagccctcacgcctcagccttcaaaggctccccgattaggatggacggtggaattgtgccgacgattttttaa

SEQ ID NO: 6543 - DNA, 351 bp, Bacillus clausii
  misc_feature (1)...(351): n = A,T,C or G
agctgttgtcgccgggggcggccaaaatttaggagaacatattagctggcgattagcagaagaaggctatcatgtcgttgtcgctgatctgcaagggagcagggcggaagccgtcgccgaaaagattgctaatcanacgggaagcaaaacacttggaattggctttgacgctacggtagaagacgaggttgcttatgtcatggagacggccgccaacacgttcggatctcttgatttgctcgtntacaacgcaggcgtggcccgcagcgccaaaattgatcatttcccgacaaaagattggcaaatggcactagacgtcaatttgacaggctatttttactgcgccagaga

SEQ ID NO: 6544 - DNA, 810 bp, Bacillus clausii
atgcgaactaactctaatcaattcttaaaccaacagtacggaaattcatcaaaacttgatgctcgaataagattacataaagaatatagcaccaatcgtatagactggcatgaatgggtgtttgacaatattcaatttgatgatgagagtaacattatagaatttggttgcggatcaggatacttatggacggaaaatttaatgaaaattagagaaaactggagtattatactaactgatttttctaaagggatggttagtcaagcgcaacgaaatattcctgaaaaacaaaatataacttttggagaaatggatattcaagctacgcatttggagcattccctatttgatattgttatagcgaatcatatgttatatcacgttccaaacatagaaacagctttaaaagaggttcaaagaatattgaaacctaatggtcttttttatgctgcgactaatggtaatagtcatatgaaagagatttatcattttgttaaagaatttgattcctcattaccgttcattaaaccggtccattcaacgtattttggtcttgagaatggggaaaaagcattacgcagctcttttaatcgtgttcagttattgaagtacgaatctaacttacgagttacgaatgttcacgatttggctgattatatcttttcgatagatacaggacttgaagatgctttaaacaagcaaggcagatatgatcaatttattagtttcttagaaagtaagaaaaacacacaaggatatatccatattagtaaagactcaggaatgtatgttgtaagtgaaccttattaa

SEQ ID NO: 6545 - DNA, 728 bp, Bacillus clausii
atgaggcatgcattgattacggccgggacgaaagggctgggcttacaagtggtggaaggattgctggaagcggggtacagtgtaacggttacttatttcagtgacaaggaaaaggctgaaacactccaacaaaagtgggcccataaaaaattgcagcttgtccaagcggatgtaacgaagaaagaggacttgcaaatggcggcagcacaagccctttccttcgctggcagaatcgatttgtgtatccataatgccggtccttacgtgtttgaaaaaaagaagcttatggattatagcgaagccgaatgggcatatatgatcgatggcaacttgaattcagcgttttacttgctccagcaagtcatccccgttatgcggaaacaatcatttggacgcattgttttttacggttttcaaggcgccaatagtgcgcctggatggatttaccgatccgcttatgcggccgcgaaagtcggacttgtttcgcttatgaaaacgatttccatcgaagaggcagggcatggcattactgccaatatggtgtgccctggcaatattatgggtgaaatgaaagaatcgacgattcaagaggcacgagagcgaaacgacagtgatacgccgattggacgctctgggacaggggaagatattgccagaacggtattgtttttatgtgaagatgatgctgatatggtaacaggaacggtggttgaagtaactggtggagt

SEQ ID NO: 6546 - DNA, 885 bp, Bacillus clausii
atgaccgataagtccgatgataacagattgaaaagtaaatggaatgacattaaaatgaaaccaaatcaccgaaggggaaggagaggcatggttatggatttaaacgtcaaaggcacatcggtacttgtgtttgcttcaagcaaaggaattggtcgggcgattgctggcgaatttgcggcagaaggagcgagcgttgtgcttgctagccgtgatatcgccgcattggagacagtagtgggagaaatacaggcgcatacaggaaatccccaaattgcgtgttgccgctgcgatatgactagggcagaagatattgaggcagcgctgtcttttgcaaacgaaaaacacggggctatcgatgtcttaattaacaattctggaggtccgccggctgggggaatcgaccagtttgaagatagcgactggcaaaatgcttacgaattaaacttactaagctacgtgcgcgccatccgtggcgtgctgccgtacatgagggcgcaaggcggcggccatatattgaatgtcacgtcttcgtcgataaaacagtcacttgacaatttgctgttgtcaaatacgttccgcgcgggggtactaggccttgccaaaagcctagcgcaagagttggctaaagacaacattctcattaatacgttaggtccaggacgcattgccacggaccgggttgaaagcctcgaccgtttagccgcaaaagaaaagcaaatgccatacgaagacgtaaaacaggcttcagaaaaaagcatccctcttgggcgttacggcaaaccagaggagtttgccaagcatgccgtttttctctgctctggagccaatacgtatgtgactggacaagcgtttctcgtcgacggcggattagtgaaagccttgtaa

SEQ ID NO: 6547 - DNA, 864 bp, Bacillus clausii
atccccaatatccatactatggaaaaatcacacgttacgaagacattccactggcggctccagaacaaaggcaattaaagcaccctggcgttgaacggttaatggtaccaaaacccattattgaaaacccaaatgtacaaggaagcggaaaattaacagggaaaacggcaatcattactggtggcgacagtggcatcggcgctgcggcagcaattgcctttgccaaagaaggtgcagatgtagtaattagctatttggatgaacatgaagatgcccagcgcacgaaaaagcggattgaaaaattggggcaaccttgtttgcttttgcctggcgacgtcagtgaaaagcagatgtgtgaaacaattgttgccaaaacgatcgaagcatttgggaaaatcgatattctttgcaataacgtccgcattcaatttccacaacactccatcgtccatattactgatgaacaatttgaccatacatttaaagtcaatttttattcccacttttatttaacgcgcgcagcccttccacatttaaaggcaggcagttctattattggaacgacatcggtcgttacctatgtcggagagcctcagcttgtagattatacggcgacaaaaggggcgattgtcggatggacccgtgcacttgccaaacaaattggcgataaagggatccgcgtaaacgccgtcgctccagggaaaatatggacaccgctcattcccgctagtttctccgctgacaataatgcccttccaggggacaatgtctttaaccgggtagggcagccatttgaattagcgcctacttacgtctatttggcatctgatgattcccggtttgtgacagggcaagttctccatg

SEQ ID NO: 6548 - DNA, 672 bp, Bacillus clausii
gacttgccgaggcgggtgctaacatcattggagcaggcattagcgagataacggaaacaaaacaaaaagtagaggaactcggcgggcgcttttatgggataaaagccgatttatctcagcctgatggggcaaaagaattagccgctaaagttttggaacatgttgaaagcgttgacatattggtcaataatgccggcatcattaagcgggctgatgcaaacttgttggatgatgcagcttggcgggaagtgctgcacgtcaatttggatgctgtatttacgttgtctcgggaaattggcgcacatatgcttgaaaagggatcaggatcgatcattaacgtggcctcgatgctgtcgttccaaggcggattgcgcgttgccgcctatacagcaagcaaacatgccgttgccggtttgacgaaagcacttgccaatgagtgggccaaaaaaggggtgcgcgtcaatgcgattgccccagggtatatggtaacagacaatacagaagggattcgtacagatgaaagccgttatgcttacattagctcgcgaattccgaaaggcgaatgggggctccctgatgatttgaaaggtcctgttgtttttctcgcatcggaggcgtcaaactatgtgaatggccatattctagcagtcgatggcggttggttaagtgcat

SEQ ID NO: 6549 - DNA, 713 bp, Bacillus clausii
atgcaatcaatcaaaggaaaagtggcgcttattacaggagctggacgtggaattggccgtgctgcagccgaggcttttgcgaaagaaggagtccatgttggtcttgttggccgtacgctagaaaaccttcagaaggctcaaaaggatttggcacaatacgaggtgaaaacagcgctcgcaaccgcagatgttgccaatttaacttctatttctgcagcagtggcagcgattcgtgaggagcttggggccatcgatatcctcgtaaacaacgcgggtatttcaaagtttggcggatttatggatttaactccagaagaatggaccgatattatcgatgtgaatgtgaaagggtatattacacaacgcgtgcagtattacctggaaatgatcgagcgaaattcaggtgacattcattaacatttcctccatgcaggtcaaaaaggtgcgccggttacgagtgcctatacagcctctaaagcagcagtgattggccttagtgaatcattaatgatggaagttcgcaaaaaaaatattcgtgtgaccactctcacaccaagtacagtagcgacagatatggcgaaggatttgaacttaacggatggcaatcccgataaagtgatgcaaccagaggatttagcagacttcatggtcgctcaactcaagcttcatcctcgtgtcgttctaaagcatgccgggctttggtctaacaatcc

SEQ ID NO: 6550 - DNA, 225 bp, Bacillus clausii
  misc_feature (1)...(225): n = A,T,C or G
ggggnaagctcctttaagtgtcgtacacgaactgactttttttgttcggcaacaagatggacggtatgaacggctggaagaagcacattttgagcggacctatacagtagaaacgtataaaaaaatgctgaaacaggctggatttaccgatctaaacgtgaccgcggattttacaaatgaaccaccgacaagcaagagtgaacggctgtttttctcttgtcgaaa

SEQ ID NO: 6551 - DNA, 675 bp, Bacillus clausii
aagtacagtccttaattgaaagaattgagaaagaacatggaaggttagatatacttgtaaatgatatttggggaggtgaatatcttgttgatgggaatacgagagtatgggagcattcgcttgaaaaaggcttaagaatgcttcgcttagcgattgatactcatttgattacgagccactacgcattaccattgctcatcaaaaacgaaggtggacttgtcatagaaatgaccgatggcacaaaagagtataataatgagaactatcgcttaccaatgttttatgatctagcgaaaacctcagtcatccgtatggcagaagggctcgcacacgaattagtacagcatcattgcacagctgtctccttaaccccaggctggatgcgatccgaaattatgcttgatcattatggtgtcaaggaagaaaactggcttgacgctactaagaaagaacctcatttcgtcatctcagaaacgccacgttatgtgggtcgagctgttgccccccttgctggagatctcgaagtctcacgttggaacggtcaatctctgtcaagcggaaagcttgcacaggtttatggtttcactgatcttgatggttctcagccagattgttggcgctatatcgtggaagtgcaggatgctggcaaacaagcagatgctaccggctatcgtt

SEQ ID NO: 6552 - DNA, 708 bp, Bacillus clausii
agcgcattttaataacaggggcaactggaggaatcgggcaagcaacggcagcgatccttgcacaagaggcgtctgagctttatatccactactcggaaaacatcgaggcagccaacgccttagtggccgccgttccttgtccttgtgttgccatcaaagccgatttgtctagcgcggatggcgctgccacacttgcaaagcaattacctgccgtgcctaatgtgtttgtcgattgtgctggcagcgctgcacctgcgctcttgcaagacgttggcgacgatattcttgaagcacaaatgcatgtgcacttgcttagcccgatcaaactagtacgatcctttttgccggaaatgctaagaaaacgcgatggcgtgatcgtgctcacatcatccatttgggggctcacaggagcaagcatggaaagcatctatgctgcagcaaaaagcggtttaaatgggtttgttaaaagcatggcaaaagaaacggccatgagcggcatacgcattaatgctgttgctcctggagcaatcgatacaaacatgcttagaggctacagcgaggctgattttcgtctgcttgctgaagtcattccgtacggcaggcttgggacagccgaggaagtcgcagaggcgattgcctttttggccagcgataaggcatcgtacatacatggccaaattctttctgtcaatggcggttggtactgtt

SEQ ID NO: 6553 - DNA, 353 bp, Bacillus clausii
  misc_feature (1)...(353): n = A,T,C or G
atggaaaaaaagcgagttgtcgttactggtggagctaccggaatagggaaagcgatngctctcgcatttgcacaaaaaggggcgctcgtttttatccttgataaggaagaggcgctttttcaaaaatggagtgaaaaagcggacaacattgtgttcattctaacggatgtcaaagaagagcgcgatataaaggctgcttttgccaccattgcctcccagtctggacctgtggacatattaatcaacaacgcaggaatttcgtcatttacgccattattagaattgagcgtggaagaatgggacaatgtcttgaatacgaacttgcgcagcgtttttcttgcctcaaaagaagc

SEQ ID NO: 6554 - DNA, 477 bp, Bacillus clausii
aacggctcgacaaagtggccggtagcaacttatcgattatccaaagtgaccagacattcgcttattcgattgatgcggtgttgcttggccgctttgcttatgtgcccatccaaaaggggcgtattcttgatttatgcagcggaaatggcattgtcggtctcgttctgtcagctcgcacgaaagcattgatcgatttggttgaagtccaagcgcccttgcatgatatggcagagcggacgatacgcgtgaatcaactagaaaaacaggtgacttcgctatgttttgatttaaaagacacgaaaaacaaacttgcccatagctcgtatgatacggttacatgcaatcctccttattttcaacttggaggaaacaagcaagtaaaagaacagcgtgccctctcccttgctcgccatgagcttgcctgcacgttggcggacgttgtccaagcaggcagttatgcattgaaatatggcggca

SEQ ID NO: 6555 - DNA, 408 bp, Bacillus clausii
tgcccaaacagttggaaagcgctggattgctgacgatacaaaagggtcgatcatcaacattgtcgccacctatgcatggacaggcggcccaggagtcgtccattcagccagcgccaaagcgggcgtcctagcgatgacgaaaacgttggccgtcgaatggggaagccagtatgggatacgggtcaatgcgattgcacccggcccgattgaaaacacaggcggcgtagaaaaactgcttcaagatgagcatgctcatgctaaagcggtaaaaagcatcccccttaaccgctttggcaaggcgacagaagtggccaaacttgcttcgtatttgttgtctccagatggggcttacattaacggcacttgtatcacgattgatgggggtcaacacattggccagtctggctt

SEQ ID NO: 6556 - DNA, 504 bp, Bacillus clausii
  misc_feature (1)...(504): n = A,T,C or G
atggnncnggnccatannnctgagtcgtnaanangcngctgggaacttttatgtccagctgagactgcccaaacagttggaaagcgctggattgctgacgatacaaaagggtcgatcatcaacattgtcgccacctatgcatggacaggcggcccaggagtcgtccattcagccagcgccaaagcgggcgtcctagcgatgacgaaaacgttggccgtcgaatggggaagccagtatgggatacgggtcaatgcgattgcacccggcccgattgaaaacacaggcggcgtagaaaaactgcttcaagatgagcatgctcatgctaaagcggtaaaaagcatcccccttaaccgctttggcaaggcgacagaagtggccaaacttgcttcgtatttgttgtctccagatggggcttacattaacggcacttgtatcacgattgatgggggtcaacacattggccagtctggctttcaaacgggcgctgccacatttcgcacgtaa

SEQ ID NO: 6557 - DNA, 339 bp, Bacillus clausii
gcatgagtcattaaaggggaaagtcgctgttgtgactggcggaagcggcattctttgccgggcaatggcaaaagaacttgccatacatggcatgaaagtcgcgattctaaatcggacgaaagaaaaaggcgaggcagttgcccaggaaattagggaacaaggcgggaaggcgatagcgctagcttgtgatgtgcttaatgaagagcaggtccaacaagcggcctctacggtcaaggaagagtttggcccttgtgatttgcttataaatggtgctggtggaaaccatccagacgccattactgacaaggaaacttatgaggaaggcgatttggaaaacga

SEQ ID NO: 6558 - DNA, 744 bp, Bacillus clausii
atgttaacaggaaaaacggccgttgtaacaggcgcttcacgtggaattggcaaagcgatcgcccttgaacttgctgccaaaggggcgaatatcgtcgtcaattatgcaggaaatcgagaccgtgctgaagaagtagtcgccaacattaaagcgcttggccaagaggcgtttgcgtatcaggctgacgttgcctccaaaagggaagtcgcagcgatgatgaaagaagcgattggccgctttcattcaattgatattttagtgaacaatgccggcattacgcgcgataacttgctaatgagaatgaaagaagacgattgggatgccgtcattgataccaacttaaaaggggtgttccattgcgcgaaagcagtcagccggcaaatgatgaaacaacgtgctggcagaatcatcaatgtctcgtctgtcgttggcgtaatgggtaacgctgggcaagcgaattatgttgccgccaaagcaggtgtcattggcttgactaagtctttggcgcgggaattggcagggcgaggcattcttgtcaatgcggtggcgcccggctttattacgacagatatgacagatgagctagcaagcgaaacaaaggaacagctgcttaaacaaatcccattggcgaagcttggtgaaccagaggatatcgctcgtgttgttcggtttttggcaagcgatgacgccgcttacttaaccggccaaacaatccacgttgacggcggcatggtcatgccttaa

SEQ ID NO: 6559 - DNA, 708 bp, Bacillus clausii; identical to SEQ ID NO: 6552

SEQ ID NO: 6560 - DNA, 801 bp, Bacillus clausii
ggctcaactgatccatgaaaatcggaacgagttaaacggcgtatttacactgattttccaaccagctgaagagggagtaagaggggcgaaagcgatcgttgaaaaaggctggcttgatcatgctgactatttcctcgctggtcatattatgggtcaaccccttggcacggtcgtacctggcgtagcttctgcattagcgacaacgaagctaaatgtcacgtttacaggaaaatcggcccatgcaggaggcaacccagaagaaggcaggaatgcattgttagccgcagcacaggctaccgttcaacttcacagcatccctccacactcacaaggggcaacacgtttaaatgttggcacgtttcacgctggcagcggtagaaacattattgctgaccgggcagagcttgaactggaaacaaggggtgagacgacggcgcttaatgtttatatggctgaaaacgccaaacgaatcatccgtcatacagcagaggcatggggcgtcgactatacgctcgatctagtcggagaagggatttcagccaagtctgatcccgagtggctagaaattgtcaagcgagcgcttgcagcgagcgatctagttcaagaagttagtgaccgctatgaagcaattggaggttccgaagatgcgacattcatgatggaacgtgtcaaacaacgaggagggcttgctacttacttgctttacggcagcactctagcggaaaagcaccaccacccattgtttgattacgatgaacgggtgttggaaatcgcagttgacagtttatggcgcctaacagc

SEQ ID NO: 6561 - DNA, 495 bp, Bacillus clausii
tgctgtcatcatgggtggtgaaggcgcgaaaggcaccgttctttcgattgcgattgccggaaaaggccagcaccaagacgcaggcgcgaaagtaacgcatcttgcgccaaactgttcatcaacgattgtatcaaaatcgatttccaaacaaggcggcaaagtcacataccgcggcatttgccactttggccgcaaatcagacggctcgaaatcaaaaattgagtgtgacacactcattatggataaccagtccacatcagatacaatcccgtacaatgaaattttgaacaacaacatcacacttgaacacgaagcgacggtttccaaagtgtccgaagaccagcttttctacttgatgagccgcggcgtttctgaagaagaagcaaccgaaatgatcgtcatgggcttcatcgagccattcacaaaagaactgccaatggaatacgcagtcgaaatgaaccgcttgattaagttcgagatggaaggctcgattgg

SEQ ID NO: 6562 - DNA, 297 bp, Bacillus clausii
attttcaaaactgggtagcgaactattatgagaaacgaggctgggctgatttaggcatctttattcgcatggggtttttatcggaagagacaggagagcttgcccgtgcgatccgggcgctggaaattggccgtgacaggccagatgaaacagttgcgaccatagaagagaaccgccgccagcttgccgaggaattaggggatgtgcttggcaatattagcatgattgccagccattacgaccttactttggaacatgtatttgcggctcaccaaaaaaagctaagcagacgctacg

SEQ ID NO: 6563 - DNA, 648 bp, Bacillus clausii
gccataacattatcggcactacaagcgtcgctgcagccattgccttaggggaacaactccatgaatcaggtgggcgtgtcgtcgttctcggtacaccagctgaagaaggcggcgacaacggcagcgcgaaaggcagctttgtccgtgaagggctcttagctggcatcgacgctgcactgatgatccaccctagcggagagacacgagtatcaggccgttctctcgctgtcgaccctgtcgattatgtgttccatggcaagccagctcatgctgccggtgcgcctgaaaaaggcattaacgccctagatggtgtcattcagctttttaatggcattaatgcattgcgccagcatgtgaccgatgatgtgcgcattcacggcatcattcctgacggaggcgacgccgctaatattgtccctgactatgcacgggcacgcttttacgttcgcgccaatacacgtccaaaaacagacatcatccgccaaaaaatcgatgcgattgcccaaggggctgcccttgctacaggggcaactcttgaaattgtcgagttccaaaacaaagtcgacgacctgctgccaaacgatgtcttaaatgaacagtttggttccattttcaaagagctaggcgaagacgttcagacagacgaac

SEQ ID NO: 6564 - DNA, 348 bp, Bacillus clausii
atgtacaaattgattgcgattgatatggatgggacgttgttgaatgaccatcatgaagtgacaccggaagtgaaaaaggcgcttttagacgcgcgccaagcgggggcgacaatcgttctttgtacagggcgtcctttaggtggtgtcactcgctatttgcaggagttggaattgaaccaaaaaggcgactatgtgatcgcctacaatggggcgcttgtacaagatacacatacaaatcaagtcgttgtttcacatacgcttcgctataacgatttagtcgagttagacgaactggcaaaaacgttaaatacgccaatgcattattttgacgataagcggctttacact

SEQ ID NO: 6565 - DNA, 270 bp, Bacillus clausii
cagaattagcttaggctacccaacgattgaagaagagctggaacttttagggcgtgttgagcagaagcatccaattgaggatctagaagcggtcgtgacacttgatgaaatttccgctttgcagcaagaagtcaaaaacatttacatcgatgggtatgtcaaagagtatttagtaaacatcgtccatgccaccagaacaagcggaaagattgaactaggcgcaagtcctcgcgcttccattgcactgatgcggacaagccaagcttatgc

SEQ ID NO: 6566 - DNA, 429 bp, Bacillus clausii
taaaatagatgagatcattgaaaatgttgaaaaagtgatgattggcaaacgagcggaaatccgtcttagtcttgtcgccttgcttgcaggggggcatgtgcttcttgaagatgtgcctggtgttggcaaaaccgtttttgttaaagcaatggcgaaaacaattaacggctcgttcaagcgaattcagtttactcccgacttactgccgtcggatgtgacgggcgtatcgatttacaatcaaaacaagcaagcgtttgagtttcgtcctggcccagttatggcgaatgtcgtgcttgccgatgaaattaaccgtacgtcgcctaaaacccaatcggctttgctggaggcactagaagaaggaaacgtcaccgttgacggagagacgatggtcatccattcgcctttttttgtaatggcgactcaagaacc

SEQ ID NO: 6567 - DNA, 302 bp, Bacillus clausii
ctgtttacggatacggcatgggtgttcatgcgttatttgagaggcttgctccgctccccttttgtattgatcataaccgtggtacagccaatgttgtggatgattttgtttggccatgtcttttccagcatagggagtattcctggttttgctgccagctcttatatcgattatcttgggccagggattgtgatgatgagcacgatgatggctggagcctacagcggcatgggcgtcctgagcgactacaaagatggagtgcttgaccggatgttgatttcaccgataagccgtctcgcttt

SEQ ID NO: 6568 - DNA, 408 bp, Bacillus clausii
  misc_feature (1)...(408): n = A,T,C or G
acgataatgaaacagttgctgatgtgagcttaaaagagcaatacggcctgtcattaggagatcgtataacattagcaggcaacgagaaagaattgacaatcgttggttttacagaagatgcaaagttcactgtatcgccagttttatacacgtcaatcagtgctaaccaagaaattcgttttgatcagccagaaacagtcgatgaggcgcctattaatgcaattgtgacgagggggcaactgaatgacacgcctgatgagttagaaacagtaaatatcgccactttcatcaatgaacttcctggttacagtgcacaagtactaacgtttgggtttatgattggatntctcattatcattgccgccattgttattggcatatttgnttatgtcctgactatgcaaaagt

SEQ ID NO: 6569 - DNA, 600 bp, Bacillus clausii
  misc_feature (1)...(600): n = A,T,C or G
ctgaaancaatgaaggaaatgcctcatccgaagaccctcaatttctaaatcttttaactggtggcacaagcgggacttattatccacttggaggagaaatggccacttttatttccgacggcactggcgtcgaaacaacggcccaatcatctaatgcttcagccgaaaacgtagcgcaattaagcagtggcgacgcagagattgcgtttgtgcagacagacgtaatgtccaatgcggttgaaggcgtcaattcttttgaaggggagcctgttgacaatgtgcttgcgctcggctcgctatacccggaaaccattcaaattgtcaccactgccgattcaggcattgagagtgtcgaagaccttgccggcaaatcggtatctgttggagctccaggatcaggtacatatgtaaatgctgaacagatcctcgagattcacggcatgagcatggatgacattaatcaacagcctttaagctttgatgaatcgacgagcggcatacaagacggcaacattgacgcagcctttattactgccggaacgcccacaggggctgtcgaaggattatcggcgacaaatgaagtcgcgattgtgccaattg

SEQ ID NO: 6570 - DNA, 144 bp, Bacillus clausii
  misc_feature (1)...(144): n = A,T,C or G
ttgtcacttacggaaaagacccataagtaaaaggggaattgtggnatggcaaatgctatgtattcgatgagcggctaacggtgccgattaaccacgtagcgccaactgtagtcngaaaagattactttgactgaaaaccgtgtg

SEQ ID NO: 6571 - DNA, 387 bp, Bacillus clausii
  misc_feature (1)...(387): n = A,T,C or G
acacatctgtcttttatgcatgggttcacggaaagattgctgatgcccctaagttaaatgtaacctatgccgatattgaccgcaccaactactgggcgattgatcagacggggcctgaagtcatgaaaatttcttatgctgcgttgccgtatgtactcgaccattatagtctagtgccgagcggaggcgctcttggtcgtgggtgcggacctcttgtgttaacgaaagaacagcaagaagcagctgttcttgaagggaaaacggttgctgtgccaagtgaccgctcaactgcatacttattgntccgtctctggactgaacaaaatttgcctaataataacatctttataaaagtgatgccatttgaccgtataatgcctgcagtcg

SEQ ID NO: 6572 - DNA, 423 bp, Bacillus clausii
gattgggtgtctatgtatacatggctttactggggatccgtgggaagtacagcctattgccgatgaactggcaaagcagcctggctggcttgtttatacgcctgtattgcctggccacggccaaggaagtttgcgggagttaaagcatgtgacatacaaacagtgggtatttgctgtggaagtagcggctgaagaaatgagaaaacggtgcgaccgcctttatgtgattggtttttcaatgggtggaatgcttgccagttacatagcagcccgttttcctgtcgacaagcttgtactgttaaacgctgctgcctactatatgaatccgaaacagtttgtaaaagacatgttctctgccattcgctaccacctgactggcgaacaagaaggcgatgagctgattgaacctttatgaaaggaaat

SEQ ID NO: 6573 - DNA, 411 bp, Bacillus clausii
tctttcggataaagacattgcgccactcatcatttctgccgataaagtggctcatgtacaaatgaacaaccctttgcagcatgccctacttgtgttaataaaatcaggttatacagccattccagttctcgatgcctcctaccgccttcgtggtttaatcagcaaatcgctcatcctagatgcgatgcttggtgatgaagattttgaactcgaaaggctatctacattaacagtaaacaatgtgatggcaaaagatgtgccatgtatccgccctgatgccccattttcaaaagcgctttctttattaatcaaccattcgtttttatgtgtcgtggatgaagaacaagctttttctggcattttgacaagacgctcaacacttgccctaattagcaaataccttcaccaaca

SEQ ID NO: 6574 - DNA, 420 bp, Bacillus clausii
  misc_feature (1)...(420): n = A,T,C or G
agtcttaaaagatcaaaatgtgtattttgaagtgtatacgaatgaaggcgtttattccgacgattttgaagcgggccttgccgtagtagtcgatgtcttaaaatcgacaggcgcgaaattgtctgagcaagaaatcatgacattngccnagcatngttttgacaacggctcaatcaaattgatcgattgttacgagaanctgctngaaganggagccgttgtgcttaaactccttgctttttcactcaatgcagancggcttatgagtgctagagacaggctagagttagacaanagccttgcngtcagcgcttctgcagcagacaatcttgaaattaccgatgtgaatgcccaaaaaggcattgcagtcttgcgattagcacaatcgctaggcttttctccgaaagatgtgntggcagt

SEQ ID NO: 6575 - DNA, 684 bp, Bacillus clausii
aagtgttgcaaactgtcattatgggacatgcgcgcctctatgaagtgatgaaagaaaaagacgccatttatatgaaagctgatttttcagacgaagatggcatgaaagcagctgagcttgaaggcgaatttgcagaattaaacggttgggaagctgagtcagatgcagccgttctattaaaagggcttggcattggcgaagaccagcatcataaaacgttgtctgagcttgctgaatcagacaaagtcaaagtgcttctggcacaagcgctatttggcaagccggatgtacttttactggacgagccgacaaacggcctcgatttaaaagcgattcaatggttggaagattttcttattaattttgagaatacggtcattgtcgtttcccatgaccgccatttcttaaacaatgtctgcacgcatattgccgatctggactacggcaaaattgagctgtacgttggaaactatgacttttggtatgaatcgagccaattggccttaaaaatggcacaagaccaaaacaaaaagaaagaagaaaaaatcaaagagcttgagaactttatcgctcgctttagcgcaaatgcctccaaatccaaacaggcgacttcgcgtaaaaagcaattagaaaaaatcacccttgacgacattaaaccttcctcgcgcaaatacccatacatcc

SEQ ID NO: 6576 - DNA, 253 bp, Bacillus clausii
  misc_feature (1)...(253): n = A,T,C or G
atggctgcttcaaagctcatgcaaggaacgaaagtattgaccgtggcgacgctaacgtcaaaattgattggttttgtttatgtcattccttttacggcacttgttggtttacaagggaatgccctctatcaaaatggctatacaccgtattcgattttacttacattatcgacgcttggcntgcctgttgccatgtctaagtatgnttcaaaataccacgctctaggcgattatgaaacagcgcaccgcttgt

SEQ ID NO: 6577 - DNA, 146 bp, Bacillus clausii
atgtctgtaccaaaccttaagattgagaatttacatgtctctattgacgataaggaaattcttaaagatttcaaccttgagatcaacggcggagaaatccacgcgatcatgggaccaaacggaacagggaaatcaacgcttgcttc

SEQ ID NO: 6578 - DNA, 174 bp, Bacillus clausii
  misc_feature (1)...(174): n = A,T,C or G
gctatgtcgaaatgatcgataccgaaagcgctacgatcattttgnacaatgttggcacagacgacaaacagntaaagtggtatgaacattcgacccacgtgattacactcggtgaggagaaagaacagcttcatgaagacatacttgagtttttaaatcacttagattggtcaa

SEQ ID NO: 6579 - DNA, 617 bp, Bacillus clausii
aagaaggatttgacgtttgatgatgttctcttggtgccggctaagtcggaagtgttgccaagagatgtttcagttgccacgaaattaagcgagaatgtgaaattgaatatcccaattttaagtgcggggatggatacagtgacagaatcggaaatggcgattgcgattgcccgagaaggcggcatcggcattatccataagaacatgtccatcgaagaacaagctgagcaaatcgataaagtgaagcggtctgaaagtggtgttattactgatccgttctttcttactcccgatcgccaagtatttgacgcggagcatttaatgggaaaataccggatctcaggtgtgccaattgtgaatgaggagcaaaaacttgttggcattttaacgaaccgggatttgcgctttattgaggactactcgatcaaaattgacgacgtcatgacaaaagaagggcttgtaacagcgcctgtagggacaacacttgaacaagcagagaaaatattgcaacagcataaaattgaaaaactgcctcttgtcgatgacaatggcattttaaaagggctcattacaatcaaggatattgaaaaagtgattgaattcccgaattctgcaaa

SEQ ID NO: 6580 - DNA, 840 bp, Bacillus clausii
cgattcaatggtaccctggccatatggccaaggcgcgccgagaaataaaagaaaaattaaaactgatcgatgttgtgattgaacttgtcgatgctcgcattccccagtcttcccgcaatccactcattgatgaattggcgcaacaaaagccgagactgatgctgttaaataaggctgatttagctgacccagcggaaacagaacagtggcgcgctttttttaaacggactggagctgaagtcctggcaatcaatgcgcaaacaggaggaggcgttaaaaacattgctcctgcctgcaaaatgctagcaagcgccctttatcaaaaatgggaacaaaaagggatgaagccgcgcccgctgcgagcgatcattcttggtatccccaatgtcggcaaatcgacgctcattaaccgccttgttaataaacggcaggcgaaagtcggagatcgccctggggtgaccaagcaacagcaatggatcaaagtcaagcaggaacttgaacttctagacacaccggggattttatggcctacatttgatgaccaagaagtcggattacgccttgctgcaacaggtgcaattaaagatgaattgctagactacggcgacgtggctgcctatgcgcttcgctacttagcagctgagtacccagatttgctccaagcacgctatggcatcgaacgaagcagcgaagaggacgatgacatcgtccctttgtttgaagcgatcggaaaaaaacggggttgcatcgttcgtggaggccttgtcgattttgataaaacagctgaattgatcttgcgcgagctgcgtagcggcacaattggaaaagtgacgctggaaa

SEQ ID NO: 6581 - DNA, 240 bp, Bacillus clausii
  misc_feature (1)...(240): n = A,T,C or G
aacgtaaagcgccttccactcgtgcatggtggcgaaaaattaaacaccaaccctatattcgtgtaaccattctcgcgatcctaggcgttctgatttatgtatcgatgttagacaacgtcataccagagcggctaaacgtaaatttgtccgagccagcggagcaagatattcgtgcacctatgacggtagtggaccaagcggcaacngagcagcgaaggacggaagcgatcgccagcattg

SEQ ID NO: 6582 - DNA, 936 bp, Bacillus clausii
gagaacaatggggaacaagagccggctttattatggcggctattggatccgcaattgggttgggaaatatatggcgttttccctatgtagcttatgacaatggagggggcgcattttttctcgcatatttgtttgccatacttacagcagggatcccgctgttattaatggaattttcaatcggccaaaaatttagaggatcttccccgctttcatttgcgcgcatcaataaaaagacggaatggcttggttggtggcaagtcgcgatttcttttgtggtggcgacatattattcggtaattatcgcttgggctctgtcctatatggtgttttcatttaatcaaagttggggcagcgacacccaaggtttctttttaggggactaccttgaagccactgaagcgggtgtgcttggtggattgaatggcaatgtgttaattccgcttatcattgtatgggcaggcgtatttgttatcatgttagctggtgtaaaaaaaggcatcgaatgggcaaaccgcatttttattcctttacttgttgtgatgtttttagcaattgttgtacgtgccctcacattagaaggtgctgttgatggattggatgtctttttccgacctgattggcaagcgttagcccaacctggtgtttgggttgccgcctatgggcatattttctttagcctttcaattggctttgcaattatgattacttatgcaagctacttgcctaagaaagaagatttaaacaatagtgcgtttattactgcttttagcaacggaagctttgagctgcttgccggcatcggcatttttgcgacgcttggttttatggctggtaatcttggcgttcctgtggcagaagtggcaacgagcggcattggtctagcctttatcgcgattcctgaaatcattaatacgatgccggggttcaatggct

SEQ ID NO: 6583 - DNA, 678 bp, Bacillus clausii
  misc_feature (1)...(678): n = A,T,C or G
tacgcgaacatgtaggcggtcgcggtgtggtagcaaagctccacggcaaaaagccaggaccgacaatcgcttttcgtgctgattttgacgcattgccgattcatgaagaaaatgatgtttcttatgcatcgacgaagccaggcgttatgcacgcttgtgggcatgatggccacacagctgctttgttaggtgttgcggcaacgttgtttgaccaagtagatgagcttcgtgggacaatcgtgtttttgttccagcacgctgaggaaaaacctcctggcggcgcccgtgaaatgattgctgacggatgtttagaaggggttgatgccgtatttggcgcccacgtatcctcgcaaattccacttgggcaaataaatgcaagccctggagcagttatggcagcagttgatgcgtttactgtgaatatacaaggaaaaggcgggcacggcgcccatcctcattcgacgattgattcgattgtgattggcagccagcttgtcaatgatttgcaaaccattgttagccgccgcatcaatcctatggatacggccgttgtcacagttggcgtcttccaagcaggcacagcgttcaacgtaattgcagatacngcgcgaattgaaggaacagtgcgcacctttcaagaagaaacgcgcgctttcatagaagaagaaattcgggccg

SEQ ID NO: 6584 - DNA, 744 bp, Bacillus clausii
acttacaaaaacactacggaaagaaaaataatagaacgaaagctttaaacggtgttcggtttgatattcttcctggagaatttttaggaatcatgggaccgagcggctctggcaaaacgacattgttaaactgcattgcgaccattatcaaaccgacgtcagggcgggtcctgttaaatgggcaaaacattagcgcgtttgacagcaaggatttggcagagtatcgcggcagtcgtattggctatttgtttcaggactttgaactgctggataatttaacggggcaagaaaacatattattgccattgtccattcatggaattgattttgccaaagcacaagcgaaaataaatgagctagcaggttttttagaaataaccgacattcttaacaaatttcccgctcagatgtctggggggcaaaagcaaagagtcgccgctgcccgttgtttgatttctgaccctgatatcgtccttgctgacgaaccgacaggggctttggacacacgctcggcaaaaacgttaatgaacaagttggaagggattaaccggagtagtggaagaacgattttaatggttagccatgacccgaatgcagcaagcttctgctcaagaatcctatttattcaagatggtgtcatctttcatgaactgcgtcgaaaacaggatgagccacaagaaacattttatgaacgaattttacaggtactagctcagcttgggggaggaagcgccaatgttctct

SEQ ID NO: 6585 - DNA, 156 bp, Bacillus clausii
  misc_feature (1)...(156): n = A,T,C or G
acaagcaaattttatgttcagaggaaaatgagcataaatatttgcgcggctgtncacctgaatgccgcgtccaccctcgcaatctctatgtaaaagagcatcagctatctcctgaagaacaccaagcgcgacttgacgttcttggagagaggctac

SEQ ID NO: 6586 - DNA, 510 bp, Bacillus clausii
tattatgctgttgcttctagttggctttttaattggccggcgtagaggttttattttacagtttatccatctggttagcttttttgtagcgatatttgtcgcttggaattactatgagcctcttgcccgtacgatccgcctctatattccatatccggaattttcgtctgatggggcattcggcatgattatccaagcctttgatgcagaaagcgtctattattcggcgattgcgtttgcgattttattttttgggacaaaaatcttgcttcacattattggatcaatgcttgattttgtttcccatttgccgatattgcatacactcaaccgcttgcttggcggcatgctcggcttcgttgagttttacttgctgctgtttgtattgctttttgtagcaacagcattgccaataaacgaagtgcaatcggcgttgcaatcgtctgttgtcgcagaatttatgattaaccatacaccttatctgtctgattggttaaatgacttatgggt

SEQ ID NO: 6587 - DNA, 453 bp, Bacillus clausii
  misc_feature (1)...(453): n = A,T,C or G
agaacaaattagtgtttaaactggaacagctncgtttaacgtttgnggaagtaagccagcatattggccacaatccagagcttggccacgaagagtttattgcctgcaaaacactgactgacttactaaaatcacacggatttacagtagaagtgggaacatgcgggctagaaacggcttttacagcgacatttgacagcggccaacctggaccggaagtgggctttatggctgaatatgatgccctcccgcaaattggccatgcttgcggccataatttaattggcacgatgtcggcggcagcggcgattggtctcagtgacgttttgcataaaacagggggcaagatatatgtctatggcacaccagcggaagagacgcgtggagcgaaagtgaccatggcagatgcaggattgtttgatgatcttgacgtagccatgatggttcatccga

SEQ ID NO: 6588 - DNA, 578 bp, Bacillus clausii
ttgtgtatattccactcgtttctttttatcgttcttccctttagttcctctctctgttttcgtttgtatggcttcctgagcaagtgaatctgtttattgtattgctcgaatcgcttttgacgtttgttcatcctgcaattcttaagctaagtggatctacttttcagcttgtgcttgggaaacctccgatatggcttgtagttgcgatgtatgtcgccctagcttttgcttttgtccattggcaggaacaaaaatggcctttgcggttcgcctttttgccttttgttgtatgtttgatcgttggtgctttagcgccttatgttcagtcaaaagcagttgtgacgatgattgatgtcggccaaggcgatagttttttgattgagcttccttaccgaaaaggggtttatatgatcgacactgggggagtggcagtttatggcgaggaagaagactggcaacaacggaaaaacacgtttgacccaggaagtgatgtgattgctccttttttaaaagcgaaaggcatcagcaaaatagacatgcttgttttaacacatggcgattacgaccatattggcggg

SEQ ID NO: 6589 - DNA, 558 bp, Bacillus clausii
agaggcagtcaaaaaagtaggtgagggggagatagatggctttcttcttataccggacggctttactgctgatagtttgtatgccgcggtaactggagaatccccgacgacaaagctgacgtttaagagggataaagaaacaggtgacactagtgcattatacaatatcattcacggctttatggatcatttaaattaccactttgctctggaaaccctctccggcgctactgaagtagaggtgaagcttcctgaaggaggccttgaacaggaggaagcagcggagaacttttcattaacgcaatatttcacgattacgatggccatattgtttgctttatttaccgctatgaccgtcgctacaaaaacagggcatgaaatgaggcaacaagtatttaatcgcatccttatcgcgcatcaaaatcgattgctgtttctagttggaaaaacagtttcaactttttgcttggcttggctgcaaatcatgcttgtctttacgttggcccatttcattcttggtgtattccctgagcgaacggcgaatttttggttaggact

SEQ ID NO: 6590 - DNA, 734 bp, Bacillus clausii
atgaagaaaacgatggagcaacattccgtaaatggcgtgtccatggcgaacgggagcgtttcatttcgttcggtcactttaaatgtatatagcttcgctatcgatgggattatcattgccgctggtgcttccgcactaaaaaaaggctttctccccttctggaaacaacagccgattgatgctctatattgcacccatctccatgaagaccatacaggctgcgccacttggtttgaacaacaactgcatgttccgatttacttgcacgaatcttctctttccgcagctaggaagactggcgactatcccctttatcggaaactgttttggggcaagcgcaaaccgtttcaccctgctgcgattccggcaacattccaaacgaggcactcgaactgggtcagtatttttacgcctggacacgccactgaccacgttgccttcctaaataaatcgactgggcaactgtttacaggcgatctctatgtacaaacaaaaacaaaacttattatggatggtgagtctgttccacaaattatcgcctcgctccataaattgttgcagtatgatttcgaagacgttttttgcagtcatgctggctatttaaagcagggccgcaaaaagctactactaaaacgagactatttagaggcattaagcaaccaagtccacgatctttacaaaagcggactccccattaaggaaatcaaaagcgccttttcccttggacatacccc

SEQ ID NO: 6591 - DNA, 451 bp, Bacillus clausii
atggatgatcgtttgtttaaagcggcgatgggaaagttcgctacaggcgtcactgttgtattgacgaagtgggaaaatgacaaccatggcatgacagcaaatgcatttatgtctgtttccctagagccgaagttgattgtcgtttcaattgctaataaagcaagaatgaaaccgattatcgaacaatccggaaattattcggtcaatatattggccacaggccatgaagacttgtctatgcattttgcagggcaaaaagagttggcccatgtcgactttagcgagtttgcaggcattcccgcgataaaaggggcgattgcgacaattgcctgtgatgttcacgatactgtcgtgcaaggtgaccacacgttgtttttcggcaaagtgagagatgtgctcgttacggaccgagagccgcttgtctattacgaaggaaagtataaaaaaatct

SEQ ID NO: 6592 - DNA, 425 bp, Bacillus clausii
  misc_feature (1)...(425): n = A,T,C or G
atgattggcattaatccgtttgagggcttgtggggggctttccgtgatgacacggaagactttaaccgcctccgggaaattgcccctgtgtaccaacaagctgcttgggcaaaagggttagcagaaataggcgtagaagatggggaattggcgaaccaattggcgactcattttccatcagaccggcgaaaaaacccgtatgtgtttgacgatacgtttgcagtccttgatgaactgcancaatcttacaggcttttgcttttaacgaatggctctcctgatctgcaaaatacgaaattggagattactcctcaacttgtcccttattttgaccatattttgatttctggcgcttacgggaaaggcaaaccgaatgtagcaatgtttgagcatgcgctggaattgtcagggacagcgaaagagga

SEQ ID NO: 6593 - DNA, 756 bp, Bacillus clausii
agatcggcatgatttttcagcatttttatttaatcaaccaaaaaacggtatttggcaatattgcctttgctttaaaagccgcgggtgtaagggctgatctaattccagccagggttgaagaactgctagagctcgtcggcctttcgaataaacgcaatgcgtatccggcacagctttctggcggccaaaagcaacgtgttggcattgcccgagcgctagccaacaaaccaagcgtgctattgtgtgatgaagccacgtctgcacttgacccaactacaactaaatcgattttggcattattaaaaaagttgaacgaagaactagggctcacaattgtgctcattacccatgaaatggcagtggttaaagaaatatgccataaaatggcgattatgcaagatggcaaaatcattgagcagggagatgtatatgatgtgtttgccgcgccaaaagcacagttaacacaagagtttattggcgatgtcgtctcttttcatatccctgaacaaacattgaggcaattttctggaacgattgctaaagtaatctttaaaggaagcgttgcccagcaaggcattatctcggatacattgcaacagttttctgtaaaaggaaactttctccatggagcgatcgaatatatcggcggccgcccgcttggcatttttattatggaattgaagggcgagccaacagcgattcaggaagcgattgcctatattaagcaacgttccgcggaagtggaggtgattcgcg

SEQ ID NO: 6594 - DNA, 574 bp, Bacillus clausii
ttggaaatacaatcgttagcggtgttttgtgggtctagtgctggcaaagacccagtttatatagaacaggcgacagcctttggcaaactcctcgccgaaaatgaaattacccttgtttatggcggagcgcaagtaggttgtatgggggccgttgccaatgcttgtttgcaagcggggggtcgtgtcattggcgtgattcccaaaaaactgcaaaatgtagaaattgcgcatgacaaattgtctgagctgtatgttgtcgatacgatgcacgagcgaaaagcgctcatggctgagcatgcagatgcctttgttgccttgccaggaggagcaggaacgcttgaagaatggtttgaagtgtttacttggattcagctagattaccatcaaaagccatgcagtttattaaacgtagccgatttcttcaatccgcttttggccatgcttgatcatacaattgaacaagggtttatggctgaagcatatcgagatttgtttatcgtcgagaaggaacctcaaacgctattggagcggttacaagggtatcgtcatcagcatgtatcaaaatggacagaga

SEQ ID NO: 6595 - DNA, 551 bp, Bacillus clausii
tacaatacactcgaccaattaaattggatggcgattgctaagggcgaagatgagatcagtgaagtcattgaattgatggggaaaatgctgcggattggcctctcgaaaggaaaaagtttcattccaatagccgatgaactggaccatatccgctactatatgcaaatccagcaatgcacaaaaaacgtcgatatttcatttgaaattgatgtcccacctgaactccgccattactatgtaccgaagtttacattgcagccaattgttgaaaacgcgattattcatggatttcatcgccgccaacgtgggatgattgacatttccattcgtccgtacaaacaagcacttcggctacaagtgaaagatgacggcgtagggtttgaacaaaaggcgatttcccagaaaaatggttatggtttgcaaaacgtcgcagagcgtttacaagcgttttttggtgaggaagggacgatcactgtttacagtgcaataggggcagggacgacagtattgattgaaattccgcaaaagcaaacaaggcgattggggaggag

SEQ ID NO: 6596 - DNA, 630 bp, Bacillus clausii
tccaatcgaattatcaactaggcaacagcaaatcgtcgatattgtaaaagaaaatggcccaattaccggcgaacatattgcagaacgtctatccttaacgagggcgactctacgtccagacttggctattttaacaatggccgggttcctggacgcccggcctcgggtaggctacttttatacggggaaaagtgaaagccccgttcttgccgataagctccaggaaatcaaagttcaccattatcaatcgaggcccgttttgattgagcaatcagcttctgtatacgaagcgatttgcacgatgttcttagaagatgtaggcacactttttattgtagatagccatgcaacattggttggagttgcttctcgaaaagacttgctgcgggcaagcatgggcggacagtcgattgagtctattcctgtgagtgtcatcatgacgcgaatgccaaacattacaatgtgtgagaaggatgattcggtaattgaagtcgcacaaaagctcatctcccggcaaattgatggattgccaattgtaaaaaaagtagacgctggatcaggtttcgaagtggtggggcgtattactaaaaccaatattactcagctgcttgtagatctagccagtaaaga

SEQ ID NO: 6597 - DNA, 240 bp, Bacillus clausii
  misc_feature (1)...(240): n = A,T,C or G
ggaagcggcagtcacgttacatgagtcagtccgtgaccgtctggatgagattgaccgtattgaaatccatacccatgaatcggcaatccgcatcattgacaaaaaagggccgctttacaatcctgctgatcgggatcatngttggcaatacattacagcaatgggccggtnaaggggtgcaattgtcgcagatgactatgaagatgaaatggcccaagatccccgcgtggaccaacttcg

SEQ ID NO: 6598 - DNA, 599 bp, Bacillus clausii
  misc_feature (1)...(599): n = A,T,C or G
atgcacatccaactgtcagatggctgtctcgtctatgctcataagcgtggcaccggattaccaacactctttctacatgncggccctggatattggagcggctcttttgaacagcttgctggccccatattggagaaaacaagaacaatgatctatcttgaccaacgaggctgcggtcgttcacaacatgcgccttcgtctacctaccgttatgaccgcttgcttacagatatggaagaagtccgccgtttttttggctttcacaagtggagcgtgttcggtcactcgtttggcggcttactcgcctttctctatgccttacagtaccctaaccgtgtagattcgttaattttatgcaatacaacgttgtatatggctgaatcgttaacctatcaactaaagtatgggagcaaccttctcgggaaaaccgctaacccgcctacacaaacaagtttattggtaaagcactttcaagataccattatccaactccgtgaaggtggaaactgggaacgtatccagtttcaacacaccgcacatgcaaaacggttagaacaggccgacgattgccccgacaatcaaagcgaccatcgctttca

SEQ ID NO: 6599 - DNA, 585 bp, Bacillus clausii
tcttctcgctccagcaattggcgccggcatcgcttatcagctaggaggaaacacgctcgtcatttatgcggctatggcttctagtacggtgggcggcaatgcaatccgctttgtcgaagggttgccagttctcgcatcaggacaacctgtgagcgctgttattgcagcagtcgcagcaacttatgtcggcaaacgactaacaggaaagacgaaactggatatgatggcgattcctttctccggtatctttgttggcgggcttgtagggcttgtgatggcagccgtgacgacaccgatgctagaatggataagcgcacaactggctacgtctgtacaaggatcgcctattctcgctccaatggccatcgctctcacatggagcatattgcttatgacgcctgcttcatcagccgcacttgcgattgctttgcaaatggacccgatctcaagtggtgcagcattaattggttgcacagcccagtttgtcggtttcacacttatgtcttggaaacaaaacgatgctggcgccttacttgcccaagggcttgtcacgccaaaagtccagtttcccaatttaattaaaaa

SEQ ID NO: 6600 - DNA, 456 bp, Bacillus clausii
  misc_feature (1)...(456): n = A,T,C or G
agctgcctcgaagccagaagttgtgaaaaagcttgtcgctattaatattccccatccagccgatatgcgtgttgctttaatgaagcggccattgcagctgttccgcagcgcatatatgctgtttttccaagtgccctatgccccagaaaagctgcttgccgccagggattttgcctacttggaagctggaatgacgaaaacagccaatgagcgggcttttacaaaggcggaattgcgccactataaaacagcttggcggcagccaggagcgctgaaaggaatgcttaattggtatcgtgccgtccgtttccaagggttagacaggaagaccgagcttgatctgccggtctctgtgccgacaaggatcatttggggagcgaatgacctgtttttaggaanagcgctcgcgcaagcaagcttgaaaangtgcagcaatggcgatgctgtgttagtaga

SEQ ID NO: 6601 - DNA, 222 bp, Bacillus clausii
ggacattaaggcaaattttgctcatgaccgacgggcattcgaattacggcgaagatcctgtaacgattgcgcgcttggctcaagagtatgacgttacggtaaatgtaatcggcattactgatgaaaaccgcgaaaatgaaaaagggcttcaagaggttgaagcgattgctctagctggtggaggggtaagcgaaattgtatttgccaggcaactggccaaaa

SEQ ID NO: 6602 - DNA, 828 bp, Bacillus clausii
atgaatttggcgatacatcgattgatagccacttggtcgtgccaactaaggaagaaattatagaagtgaatagtggttgtatttgttgcaaggtacgggctgatttaatcaatctattgaggaatttgaatgaacgagaagaaccgattgaccgtattattattgaaacaacaggtatggctaatccggcacccgttattcaaacgtttttaatggataagcaaaccgcacattcatttgaaatcgatagtgtgattacgatggttgatgccaagcatatttggcaacatttagcggaagaagaacctgggcaacaaatcgcttttgctgacgttctcttgataaataagatcgatttgattacggacgatgaaaaaaataaactgggacaacagttgactcatatgaacccacatgcgaagcaaatttatacgacatttgcacatgtagatattcgagatgtcgttgggaaaaaatcgtttgatttaaaaaatgtattaaaaatagatccgactttattaacggaaacgcatcaccaccatcataatgaacaagtgacttcctttgtgtttcaggaagatcatcccctcgatttagaaaaagtgaacaactggttcgcctatttagtccaatttaaaggagaaacgttgtatcgttataaaggtgtcctttatataaagcaactggagaaaagagttgtttttcaaggcgtacatatgctgtttgctgggacagagggagcgccatgggcgaaagaggaaaagcggcaaagtgagatcgtctttattggcaagcatctcgacgatcaggaactagcgaaaggctttc

SEQ ID NO: 6603 - DNA, 306 bp, Bacillus clausii
  misc_feature (1)...(306): n = A,T,C or G
ggaccgggctgccgaagtcccttgcggcaggaacagccagggcagttgaagcgattgttncaacgtttaacttagaagatgtaaggcccatttacgcagcaacccagtacaatcaagaaaaaggcttgtttttaatccatagccgcaaagatggagcgattccttacacagagtcagaagcgatacacagccacgccgctggcagtgagctttggctacctgaaaaaggcggccatataaggagctattttcattacaaagctgagtacgaggaacgcgtattaaactttcttgaccggaccttta

SEQ ID NO: 6604 - DNA, 390 bp, Bacillus clausii
atgcaaaacggaaaatgaagcgattattatcgatgggaaacggttgaatattatcggcattgatgatgctggatctagccgaggggatatagacaaagcgtttaatggcgtagccagtggatataacctcgtattgacccatgatccgaacattgtccttgatatggatcatgtctcatttgactatttgcttgctggccattttcatggcgggcaaattcattggccaaagccttatcaccttgtgaaaatgggaaaattagtacgtttgaaaatggtaaaaggtttgcatcaccataaagggcaaccgttttatattagtgaaggtttagggcaaacagggttaaatatccgtcttggaagccgtcctgaaattacgctgcaccattt

SEQ ID NO: 6605 - DNA, 435 bp, Bacillus clausii
tcatgggtgtgtcggcagcggtgcttgctattcctggactgcaagtgttcttgctcgtttgcgggtttatctttttgctatggatcggacaatcgatttggcgggcaaaaccggaacatgccagtgccgtagacgaaacgttgtcaatgaaaaagcaagtgttatttgctctgtccgtgtcagttttaaatcctcacgcggtattggatacaattggcgtaataggcacgagttcgcttcgctatgaaagtttaagtgaaaaagcgatatttgcgctagcatgcattgctgtttcttggctcgctttctttttgcttgcagctggtgggaaaacggtgcgggcgatcgataagagaggtacatggcttgtgcgcgtcaacaaagtctcggccatttgcatttgggcgatggcgctgcttattggcgcccaactcg

SEQ ID NO: 6606 - DNA, 501 bp, Bacillus clausii
aacttggcattgtcgcggcttctggttcttatttcatttggggattgttgccgctgtactgggcattgctaaaacatttgccatcactagatattttaatgtaccgcattgcgtttgcctttgtttttatcgctatgctgctcttgttttcgaagcaaaaagcccattatcgtacagagttgaaatgggtatttacgaacgggcgcgttttcatgagcatcttcacagcgtctattttaataagtttaaactggtttattttcatctttgccgttagcggcgaaaaagtgattgatgcaagccttggctattacatcaacccgcttttaaatgttgtccttgccaccttgttcttaaaagaaaaactgagcaaagcagaagtcgcagcagttgcgtcagcggcaataggcgtattgctgttaatcatcattggcggccacattccgtgggcttcttttggtatggcgctcactttttgcttggatggattcattaaacgtg

SEQ ID NO: 6607 - DNA, 762 bp, Bacillus clausii
catccaatgcgccgttcttggccttgggcgccttggcttttaccatgcgaaaaatttgcttacggaagtgagtggggcggcaattgtccaagtcatagacccccttcctggccgggccaaggatgtcgcccagacatttggggtgcctggttactcggacgatgtgctcgatgcatttgcaaatcctgcagtcgatgccgttgttatcgtcacgccgacgcggacgcacgctgagatgatcaaattagcagctagctatgggaaagatgtctttgttgaaaagccgctgactttgcaattagatgaatcgatagaagtagtgaaagcggttcaggaggcaggtattatttgtcaagtggggtttatgcgacggtttgacccggcttacgcagatgccaagcggcgaattgctgctggagagatcggcaaacctctctattataaaggctttacccgcgatgcaggcgcgccgccgcctgaatttataaaagatagcggcgggttgtttgttgattgttccattcatgattatgacattgcccgctatttgattggggcggaaatcacagctatttctggccacggtcaggtgctgaagtacccgtttatggaagcgtttgacgatgttgaccaagccctttcctattttgagtttgacaatggggcggcaggggatgccgaagctagccgtaattcgccctatggctatgacatccgcgctgaaattattggttcagaaggtagtctgtttattggcgaact

SEQ ID NO: 6608 - DNA, 570 bp, Bacillus clausii
atgttgtttgccactcttgatacgtctgtgcgtaaagtggaacttgacaaaaaccattctgttttattggcggatacggttggctttgtctctaaattgccaacacacctcgttaaagcattccgctcaacattggaagaagctcgggaagccgatttgctactgcatgtcgtcgattattcaaatgaacgccatcgcgaaatggcaaagacgacaaatgaaacactccaggcaatggaaatcgatcgcccgatgatttatgtttacaacaaaatggatcaagtgaaagacgcgtttcctcaagcgcatggcgacgagctgtttatatcagctaaggctaaacaagggcttgatttattagcacagaaaatagcaagctatgtttttcaagattttgaaaaacatctgttcatcattccttatcgtgacggggaggcggctgcttatttaaacaaccatgcccatgtccacacacagcgtgctgaggaggacggctggcatatcgttgccgatttgcatgaacgagacttaaaacgggttgaaagctactgtgtttcaaaagaacgataa

SEQ ID NO: 6609 - DNA, 375 bp, Bacillus clausii
agacacgaaggcttatattagacaaatggtgcttgacgacatcgacgaggttttgctgattgagcgtgatgcctttacaaccccctgggaaagggaagcttttgaaacagagctgacgaaaaaccaattcgcttgttactatgttgtcgtcgtagacgggaaagtcgttggttactgtggactgtggaaagtgatggatgaagcgcaaattaccaatgtggcagtcgcctcggattaccgcggccattcttatggagaaagcttaatgcgttatgtgatggagtggttaaaggcactgggcgtcgtgagcctatcattggaagtgcgcgtatcgaatacgccagcccagtctttatatcaaaagctcggtttccg

SEQ ID NO: 6610 - DNA, 771 bp, Bacillus clausii
ctagcaacaagcaaggcaaacctgtcatcgtcttattagttgattcgctcatggatgagccattgcaaaaagcagtggcggacggaaacgctccagcgtttgagtttttaatgaacgctggccgttactactctgatttggttagttcgtatccaacaatgtctgtaacgattgacagcactttgcttacagggacgtatgcaaacggccatcgcattcctggtttagcctggtttaaaacagatgaaaagcgcctcgttaattatggcagcggcttaaatgaaattatcgcccttggcgtcaagcaagtcacaactgatagcatgctccatttaaaccaagagcatttaaacaaacagacagcaacgatttacgaagaactagcttcccacaacctcgaagcagcatctctaaatggtttgatttatcgaggcccaaagccgcacacattaacgacaccaaatggtgcagcatggctaaatatgctgccgaaaacgattgaaacacaagggccatcgttgttgtcaatgggggcgttttcccatttcagcccgaaaaacgatcttcagttatggaaatcagctggattaacagatgcagcgacggcaaatgagctagtttatcttattgagcaaaatcaactgcctgcttttacgctcgcttacttccctgaattggataaacaagtccacaaacgcggctcgactgcaaactctgttatcaaatcactaaaaatgcgctcgtgtttcgcgataaatgtttcctcgtcga

SEQ ID NO: 6611 - DNA, 165 bp, Bacillus clausii
  misc_feature (1)...(165): n = A,T,C or G
ggaggatattgacatgatagaaatggcaggcctcggggtagcgatgggcaatgccagtggaaaactaaaagnaaaagcctcctgggtcacacggactgttgaccaagacggctttgcctttatggtccatgaactgttccgaaagcaactacggctgcaagtgga

SEQ ID NO: 6612 - DNA, 161 bp, Bacillus clausii
aacctggagatgtcgtgacgctcgatggcgaccttggagcagggaaaacccattctgcgaaaggcattgccgttgcccttggcgtaaatggtgtcgtcaatagtccaacatttacgatcattaaagaatatgagggcaacatgcccttttatcatatggat

SEQ ID NO: 6613 - DNA, 266 bp, Bacillus clausii
ctgcgttttgttttgcaaattattgggctattcatctttgatcgcattggcgggtggcttgccgctgctcttcatctaccactatcaggaagcctagttggcatgatgctcttgttcgtgctccttgtcactggcgtggtgaaaagcaagtggctagaagacggtgcgttggctttgcttgcatttttactgcttttttttgtgccgacaacagtggggattatcgctgagcctgctttgttttcaacgcaaggcttgttgttggt

SEQ ID NO: 6614 - DNA, 372 bp, Bacillus clausii
ctacgatgtaattatagtcggcggcggaccctctggcctgatggcttctgtcgccgctgcgcaacaaggggcacacgtcctcttgctcgataaaggcaacaaactcggtcgcaaacttgcgatttcaggcgggggacgctgcaatgtcaccaacaggatggaaaggaaacagttgattgaaaacattccagggaatggccgctttatgcatagcccattcgctgtatttgacaatgaatcgattattgctttttttgaaggctgaggaattcgcttaaaagaagaagacagaggacggatgtttcctgttaacgataaagcacaaactgtggtcgacacactgcttgcacaaatccgtaaacttgatgtcac

SEQ ID NO: 6615 - DNA, 942 bp, Bacillus clausii
gtatgccagcggatatgtaaaaaagctgttaacccacaaacaagcactgcttgcaggggttgtggacaatgcgccggaacgcagcccgtatttgcccgatttacgagagcgcggtgtaccggtctaccattctctaacctcgttttatagagaacatcatgccgatttggctgttattgccacaccgattcattttcatacagtccacgctctggaagcgttaacgaacggcagccatgtcctgtgtgaaaagccgctttccgctgtggcaaatgattttcctttgtgggaaaaagcagtaagagaggcgcaaagatgggcggcgattggttttaattggtcatttagcaaaaccgttcatgcgttaaagcgtgaccgaatggccggcttgtttgggcgggccaagtcgctgaagacattggtgttttggccgcgaaacacagagtactaccaacgttccaattgggcaggaaaacgctattcccagcaagggcaggcgatttttgatagcattgccaacaatgccgcagcccattttcttcatcatttgttgtatgtgctaggcgacaaaattgatacttgcgccaatgtcgttgacatcgacgctgaattgtatcgggccaatccaattgaaacatttgacacatgcatattgcgggcgaaaacagacgaaggagcagcgttattgtttgtagcctcacacgccacggaggaagaggccggtccgatgtttgcgttggaattcgaaaaagcgacaatcgaatataggtgcaccaataaaacagggcacgtcgtcgcttattttaaagatggttctacaaaagtatatggcaggcttggcgttacgcacgatgattcatttgcaaagttggacgattgtattgaagcaattattgatccaaacagaaaggtcccttgtacgtacgaaacagcatttgccca

SEQ ID NO: 6616 - DNA, 408 bp, Bacillus clausii
tgaatgtgttttaaatataccaagccctttcttatgggaaaatgttgaacgattggctccgctaactgggaaacagcccgttccagctggcaagaaacagcttggatttacgtatgaaaaagacaagtatggcagtagtggcttaacgcccgctccgtctgaagcagtaaaaccgacacggattttagaatgcccgcttcaaattgaagcaacagtgaaacacattcgcattccagagcattcgcccgattttgcgattgtcgaaacacaagcagtacacgtacatgctcataaagaaattatgattggcgaaaatcatattgacccaagtaaatggagtccgcttatctataatttccgccattattttggcttaggcgaacaactgggaaaaacgtatcgggcgga

SEQ ID NO: 6617 - DNA, 522 bp, Bacillus clausii
gagcggaatgactggaacgacgactgtagagtggacagaaaaagaaaagcaaaattggcaagcgattgagacgaagcaatcgtttcgcctcgcttttagtggccatttttccgccggaaaatcgacgcttttgaatgagcttctcggtgcgcctctgttgccgacaagccccattccgacaagcgcaaaccaagtgatcattggccaaggcgacattcgtgttgtattagaaaaagcaaatggtgaagaggaaaactggcaaggggcaattgattgggatgctgtcaaacgttcaggcatggacggcaccgaaatcaaacggctgcgcatttatgcccctgttccttttttaaaacatggcagcgaacttatggatacacctggcgtcgactcgactgaccctacgcatcaacgtgtgacattagatgccctttatacaaccgatgcgattgtatttgtcatggattataaccatgtaaaagcagaaacgaacctctattttttaaaacaacttagcacaga

SEQ ID NO: 6618 - DNA, 933 bp, Bacillus clausii
atgaatcgcctgtgcatcagtttgcttacagcgagtgcagcagttgtcttcgttttaagcagcgatgttggcgttgctggcgctttgcttataggcgcaatcgccctcttgccagcggcttggcagagtgggcggctagcaacggtggcggcatttgtactgccgttgcttctgtttgctagtgtggcgactgggcacaaaaaaagcaacgtcagcatgctttcaggtgaagaaacaacatttatcgtagaggtaaaagaaacacctcgccttgatggaaatcgcttgaggatggtggttgaaacaacggccggtgagcgattgcaactagcaagccgtttgcaagcagaaagcgagcaacgtttaggtaaattattaccaggagaccattgccacgtaaatggcaagttgagcgagccagaccctccacgcaaccgctatgcatttgattatagccgctatttatacgagcaacgaatccactggctgttggaggcagagtctggatcttttgtatgcaaacgcatggataggctttcgttattgacacacttgcaggcgtttcgagcacaattgcttcacgaggctgttgctgcctttccaaaagaagcgggaggcattgtgttagcgcttacccttggagagcgtttctatgtagaagaagacgtgattgaagcttactcaacgcttggcattatccacttgctggcgatctctggcttgcatgttggcttggtaactggagccgctttctttatctgtatccgcatcggcttgacgcgtgagcgtgccgcactatttatgcttattctcttgcctatttttgcgattctcgccggggcagcgcctccggtagtacgcgcgtctgcaatggcatttgtgttttttctgtttgccttacacaaatggcgagttcaccccttattcggtttt

SEQ ID NO: 6619 - DNA, 246 bp, Bacillus clausii
gcccgattttcatgccttctgctgaggaagttcggataaagcttgttttcgaacaggaatcgcttcgtattgtcggtgcccaagtcatgagcaagaccgatcatacacaattaatgaataccatatcggtctgcatccaacagaagatgacggtgactgatttagcgtttgctgatttcttcttccaaccacattacagcaagcctattcatctgctgaatacgctcgcccttaacattcttgaac

SEQ ID NO: 6620 - DNA, 219 bp, Bacillus clausii
  misc_feature (1)...(219): n = A,T,C or G
atcctcaggcatgcatcaatttgccgtgtggactggtttagaaaatgaagggtttggcgcttctttgcaacactataacccgattgttgncgaattggtgataaaagaatggaatgttccagaaacgtggaaacttcgtgcgcaaatgccttttggcaaacctgtgcaagagccaggcgagaaagaatttttgccgcttgaaaatcgtgtaaaattgta

SEQ ID NO: 6621 - DNA, 294 bp, Bacillus clausii
aaaaacagacttgcttttagaggaaattgctgaatatgtgctaaaaaaggagattacaagcgaagaggcgctagaaaccgcagcgcacgttcttgttgatacgattggctgcggcattctcgccctccgctatccggaatgtgtgaaaatgcttggaccagttgtgccagggacggttgttccaaatggcgttaaagttcctggcacatcccatgttctagacccgattcggggcgcttttaatattggtacgatgatacggtggcttgattacaacgatacgtggcttgctgc

SEQ ID NO: 6622 - DNA, 228 bp, Bacillus clausii
aagcgctgtcttctttgcttctcagcttaacaacagcgacgatcggtcttgttggcgcgacagcgatggcaggagcaattggcgcaggcggaattggcgacgtagcgatcacatatggctaccagcgttttgacaatggcacgatgctcatcacagtattgttgttaattgtcattgtccaaggcttgcaatctttaggaaacatttcatcgaaacgcgtccgtagac

SEQ ID NO: 6623 - DNA, 933 bp, Bacillus clausii
cgattttggtcattttgcttgcaactctattatgggcgtacatgcaaatcaaaaaaccgctgccgcaaacgacaggagaactcgtcgtcaatggattaaatgctcctgtcaacgtctatcgggatgcgcaaggcgttcctcatattgaagcccaatcggacgatgatttatattttagccaaggctacattaccgcccaagatcgcctgttccaaatggatttaagcagaaggcaggcgtcgggacagcttgctgaagtaatgggagaaacctttgttgactcagatgttttctttcggacattcggcttgcgccgggccgctgaggcatcggcatctgcctatgacgctgaaacgtatcagtatttagaagcttacgctgatggcgttaatgcttttatcgaacacgctcaggcaactggcacacttccacttgaattccgtttggccggctatgagcctgaacaatgggacccgattgactcgttaacgatagggaaatatatggcatacgacttaggcggcaattggcaaagccaagcgttccattactggctaagccaacatgtgagtgaagaggaagcactcgatttgcttcctagctatccagcagaagggcctgctgttcttgacttggcacaaacgattgacatggatgtcgaagcggcgtttgccaacattggctctaaactgccacacccttttaacggcagcaacaattgggtgctttcaggggaacggacagcgtctggcatgccgctgttggctgatgaccctcacttaggattgggggcacctagcatttggtatgaaacccatttgacatcgccgactgtgaacgttacaggcgtcattttcgctggcgtccctggcattattcttggctcaaatgaaacaattgcctggggtgtcaccaatgtcggccctgacgtac

SEQ ID NO: 6624 - DNA, 467 bp, Bacillus clausii
attgtcttgtttaatttgttgcctatttatccacttgatggcggaaggatggtacaacttgcttgtttagctgtttggccgtacaagcgggcgatggcagctagccttgggatttcggttgggtttttggccgtagcgctgtcaatcatgctgtttttgccctttcaccttaatttgttcgtgattctttctttcttggcactgacgaatggattggaattcaagcagcggaactatcgatttatgcggtttttaatggcaaaacaaacagatcgtgcgacgaaatctatacatgccagggtttctgggcagctgcccattcgtgatgccctggcgcttttacggaggggccaagtgcagttgtttgtaatagaagatggcggcaatcggtacacagtggcagaaaaagagcttttgcaagcctattttgcggaagcgaaacttcatgcaccagtaaggacattagt

SEQ ID NO: 6625 - DNA, 228 bp, Bacillus clausii
cgatgccaatccaatccttttaatcgacgaagatgacgtaacggctggccacgctgcttctgttggccggattgacccgctgcaaatgttctatttaatgagccgcggcatttcacgggctgaagcagaacgccttgtcatccacggatttttggagcctgttgtttcccagcttccagttgcgtcagtccgcaagcaaatgaaaacggtcattgaaagaaaggcaaa

SEQ ID NO: 6626 - DNA, 618 bp, Bacillus clausii
ttaaatcaacggctgattgggtgagggaccaattattaacggagtcaacgggccatgattggtaccatattcagcgggtcacagaaacggccaaatcgatcgccgctgaagagggcgctgacatgtttgttgtggaaatggccgcactgcttcatgatttagcagacgacaaacttgtggcgagtgaagaggaaggcatacaggaaatcaataaatggcttgtagataggtcagtgggaaaagccgattcagcccatattattgaaatcattgagacgatttcttttagcaaaggcaagccgttgcgtacgttagaagcaaaagtcgtccaagatgcagaccgccttgatgcgattggtgcaattggcattgcccgtacgttccaatatgccggcgcaaaagggcatgccctctatgacccaaaagcaaacgtgcggacagagatgacaaaagccgaatatcggagtggacaggggtcagcgattcaccatttttatgagaaactgcttttgttgaaagaccggatgaatacacatacaggtaagaaattggctgaatctcgccacgcgtttatggaacagtttttaaaacgcttttatgcagaatgggatggaaacg

SEQ ID NO: 6627 - DNA, 496 bp, Bacillus clausii
atggcgaatttattagaggcaagaaatataaacaagtcagtagaacttggaaacggtcagtggctccacatcttaaagaatgtaagcttagaaattgaagcaggggaattcgtatcgataatggggccgtcaggaagcgggaagtcgacgctgatttatcatctaagcggcatggaccgcatttcttctggaaatgtgacatttaaaggcattgaagtcggaggtctggctgaagaggaactggcacaaattcgcttgaatcacataggatttatttttcagcacatgaacttactgaagaatctgtctctgattgataatgtgatgtttcctgctcttgtatccaaaggtgctaataaacatgcggtgcaccaaaaagcaaaaaaactgttggaaatgacgggaatagaaaggcttgccaatcgccaaatcaatcaaggctcaggcggccagttgcaaagagccgccatttgtagagcattgatcaatgatccag

SEQ ID NO: 6628 - DNA, 797 bp, Bacillus clausii
gctttgtttgtccttttagtgctattgtcgatttattcgctcacacttgatggagctaaggaaggactggcctttctgttcaagccaaattgggaaagcctttcaagcgaagtagttttgttcgctcttggccaatccttttttgctttatcgattggcgtctcggtgatggtgactttcagttcatatgcgtcaaaaaagcaagatttgcctgtatctgctgctacattaggggtaatgaatatttttgtcgcaatgctggcaggaatcgttatcttccctggtgtgttcactttcggtctagaaccaagcgaagggccgacgcttatttttgcagccgtgccagcgattttttcgcaaatgccgtttggcgatatcgtggtcgtcctcttttttatgcttttcttcttcgctgctcttagcaccgctttttcactgttagaaattgtagtcgctgcctttatgagaggggatggaggcaaacgggcaaaaggaagctggttaatcgctctgtttgtgttgctgatgggcattccttctgcattgtcatttggcgtgatgggggatgttcacctatttggtatgccctttttcgacttggttgactttcttgcatccaatttattgatgccgattggctcgttgctcatatgcatctttttgctcgttaaagtaaaacggcaaacacttgcagcagaatttcaagagggcagcgcccttggcaaaaaaggatttacattatggcatacgattatgactgttatcgtccctgtagcaattgccgttgtcttgatcga

SEQ ID NO: 6629 - DNA, 516 bp, Bacillus clausii
ccgctcttgatccagatacgacaagctcgattttacaactattaaagaaaataaacattgaatacaacattacgattttaatgattacacatgaaatgtcggtcattcgcgagatttgcgataaagtcgccgttatggaaaaggggcgcatcatcgaggaaggatcggtgttgtcgattttttcaaatccacaacatccgacaacggaaaaattcgtccgctccattatcccgactggcctgcctgcccgtgtcaaagaagcgctgcagcagaaagagccgaaccggcgcatttatgaagtgactgtcactggcgatagctcccactcagatttgctgcgctcgttaatccagacatttggcattgaagttgacattttgcatgcgacaatgaacgacattcaaggcacatcgtttgggcggatttacttcgacttacgggcagaaccagaaatacttgcagaagcatccaattacttaaaatcgcattcgcttcaaccgaaggaggtgacaggcg

SEQ ID NO: 6630 - DNA, 315 bp, Bacillus clausii
tgtcgatgctttttatcgctacatcgcggctcatgaagacgttcgccacctttttcctgaagacctgactcatacagcatacaaacaaaagcggtttttaacgcaatttttcggcggtccaccgctctatacagaagagtttgggcacccgagacttagagcgcggcatatgccgtttgtcatttctcctgtccaagctgaagcttggctttcctgtatggagcgtgccatggacgacgtgcatttatcaggcgacattcgtgattatatgatgcatcggcttaggctgactgcacatcatatggttaatcaccc

SEQ ID NO: 6631 - DNA, 261 bp, Bacillus clausii
atcagattacaattgggcaaggcacacgattggaaacgcttgcaaaaggaaataccgcttacgtcaacagctaccaccaccaagcggtgaggcaagtccctgctggttttaaagcttcggcttggacaaatgatggtgtcattgaggcgattgaaaacagcgctagctatccttttcaagtcggcgtccagtggcatccagaaacgttagtagacgatgaattttcaacccgtttgtttcatgctttcatagcctcctgca

SEQ ID NO: 6632 - DNA, 555 bp, Bacillus clausii
atataaaaatgattgcgctggatatggatggtacgctgttgaatgataacaaagagattacaagttggacgaaaaatcaaattaggaaggcacagcatgcaggtatcactgtcgtcttatgcacgggacgtcccttttcccactgccacacttacattcaagatttgcaattacattcccactcgataacatgcaatggtggacaaatttacgcagtcgaccattctgttatgacagaacatcttttcgatccagccacgctggctaatttatatcactttgcacaaggactagaaatgaatacatggacgatttctacgaaggaagcgtattataacgatttgccggaaaactgcagcgaatgccagtggctgaaattcagctgctcccataaggatgaagatattttaaataagatcgcagagaaagtgcaatcgatagacggagtagaaataagcaaccggacagctttcacggttgaagttaatcctaccggcgtgaataaagctgcagcacttgaatgggtctgtgaaaagttaggaataacgatgaagc

SEQ ID NO: 6633 - DNA, 600 bp, Bacillus clausii
atgtcagatataaaaatgattgcgctggatatggatggtacgctgttgaatgataacaaagagattacaagttggacgaaaaatcaaattaggaaggcacagcatgcaggtatcactgtcgtcttatgcacgggacgtcccttttcccactgccacacttacattcaagatttgcaattacattcccactcgataacatgcaatggtggacaaatttacgcagtcgaccattctgttatgacagaacatcttttcgatccagccacgctggctaatttatatcactttgcacaaggactagaaatgaatacatggacgatttctacgaaggaagcgtattataacgatttgccggaaaactgcagcgaatgccagtggctgaaattcagctgctcccataaggatgaagatattttaaataagatcgcagagaaagtgcaatcgatagacggagtagaaataagcaaccggacagctttcacggttgaagttaatcctaccggcgtgaataaagctgcagcacttgaatgggtctgtgaaaagttaggaataacgatgaagccatgtaatggcaataggagacagccctcaatgacataa

SEQ ID NO: 6634 - DNA, 836 bp, Bacillus clausii
atgagcttacatgttggagaaattgcatataccaacacattgccgtttttcttcgagctagaccgcagctcattagaacaacatggcatatgcataacgcaaaatgtaccggcgcacatcaaccatatgctagcctctggtgaacttcaagctgccgccatatcgtctttttcctacggcaaaaatgaaaaagactatgtggtgttaccggatctttgtgttgcttcggctggcatggttcactctctgctcttgttttcaaaagtgccgattaataagcttgagggcgagtcggtggctttgacaacaagctcagagacaacggttcatttgctgaaactcgtattaaagcgtttttatcaggtaacaccttgctataaacaagaaaaacctgatttggcaaacatgcttacatcccatacagcagcccttttaataggcgatgacgcgattcgagagcgccacgctgatgtcccttatgtgtatgaccttggccagttgtggtatgaatggacgggcttaccgatgacgtacgcattatttgcagttaggagagatgcgctcgaaagcaaagcggaagaaattaacgtgctgcaccagtccttacgaaaaagttatttgcgaacagcagcggatgggtataggcagataaaccgttatttagagcgtaaaggaatggcaagcctttctttttgggacatgtattttgaggcactgcttcatcagccaacaagcaaaacggagcaaggtttgctgtattattttcagctttgttatgaagaaggctttcttgaacgggaagtgcctacattgagaaagtggaggccgaccacgtc

SEQ ID NO: 6635 - DNA, 1026 bp, Bacillus clausii
aatccgatcgattttagcaatccgtgaacagggagggattgcgcttcctaatggggagacgcttatgcctgacccggtgttagtaggaagaaacgaggcaaaacttgaggcgcttgcgagcaaatacgggctaaatcggatcgaaacggacttagaacaggcgctggcagacgaatacaatgtcatctattttgatgcacaaacaacgagccgccgcgctgccgcaattaagcaagccatctcagcaggcaagcatatttattgcgaaaaaccaacggcgacaagcttagacgaagcccttgaattagctgagcttgccaataaagcaggagtgaaaaacggcgttgtacaagataaactgtttttgcctggtttgttaaagctaaaacgattgattgacagccatttttttggggacatttattcggtgaaacttgattttggttattgggtatttgaaggcgattggcaggaagggcagcggccaagctggaattatcgagaagaagatggcggcggcattattgtcgatatgtttgcgcattggcgttatgtaatcgacaacttgtttggcgaaattcaatctctttcttgcctaggagcgactcatattcgcaaacgcgtggatgagggcggccaaccatacaaggcgactgccgatgatgcagcctatgcgatttttgaattggaaaatgggattgttgtccaagcgaactcctcatgggtgacacgtgtcgaccgtgatgatttattgacgattcacgttgacggaaaatatggaagtgcagtcgcgggattgcgggattgcaaaatccaacaccgtgtgatgacgcctcggccgacatggaatccagatataccaaacccgatcgctttccaggaactctggcagcaagtgcctgacaatgagccttacgagaatggctttaaggcacagtgggaactgtttttgaaacatgttcatacagacagtccatttccttgggacttgcttgaaggagccaaagggacacagttatcagactt

SEQ ID NO: 6636 - DNA, 372 bp, Bacillus clausii
tcgcatttcccctccatgcggacggaaagtggacgagtgaacatagccaagcggtcaatgacttgattgattcagttgggttagagggactaaaccgcaaacgggtgaacttgcttagtggaggccaacagcaacgagtggcgatagcaagggcgcttgttcataatccgactgttttgttagcggatgaaccgactggaaatttagatcgagcaaaagcagaagaaatactggccttgttgtcaacgttccaccgcaaggataagcaaacggtcgtgatggtgacacacgacatttttgccgctggttttgcagaccgcatcattctttttagggacggggtcatcgaccaagttatttcgagggaggatc

SEQ ID NO: 6637 - DNA, 582 bp, Bacillus clausii
cagtgttgtcagaacttggtgagtatgggagggtcgaatgaacttcttccaatccgtgctggcaagctccggccagtcaacagcctgtttgccatttttttattgccaataatgaagtgtatatgggccacttttatcaggccgaaaagcatgtgcgcctctatctagaaaaagagccaaacgggcagtttgctgaagaagcgcatgaattgcttgagctatttgaagatgacccttttatggaggaagaagcgagttcggagcaatatttagacgaccatgaacaggcatggcttcttttgcgaaaagggcaagcagagctggcggtgccgttgcttgagtcaatcgttagcaagcatcctcgtttgtgggctgcccaaaatcatctcgccgaagcgctattttgcatcggtgaaaccgaaagagcgtttgccatttgccaggaagtgctcgataaggattctggcaacttgttggcattatgcaatctcgcattattttactttgaaatgggcgatactaaagaggcgaaatggtaccgtgagcggcttgcaagcgtttatcctcttgcttcaggtcacg

SEQ ID NO: 6638 - DNA, 684 bp, Bacillus clausii
gcaataccgaccgcgtcatggaacctcttttccggatggatattgttcacgaccacgtcgaccgtgaccgcctctgggatgaccttgaccatttgcggttaaaatattacgacatcccaatggctgacatttctcttgccgaagctgtccaagacttgttcaatgtcgccaataaacatgattgcattgtccctgtcgatttgacaatgcttggaaaagcactattatcagtggaagcgattgtctcgtcacttgctccgacattgcgcattattgatattgttgaaccgtttgggcgtgtcttaattaaggagcgctatgatccacgcaactttgctaaaaaagttcaagccgaatttcaagatggcatggaaacattgcgctattttccacgagatatgcgcaaaacgttaaaagatatccgtgacggaaaattaaaagtcaatatctcaattcgtgaaatccaccatttgattcaaaaagtggaccgaattagcaataaacttgctttttcgatcgtgctcctttcatttagcattattatggctggagtcattatcggtggctccttaacggcagagccaaccatcctattgcaaatccccgctattgaaatagggcttgtaattacctcactaatgtttttttggattatctgggcaatttttaggtcggggcgttttt

SEQ ID NO: 6639 - DNA, 729 bp, Bacillus clausii
tttctaggtaccaagatattattacagccctttatcactatggttttggccaaattgtccgtgatttagggctgctagatcgcactaaaaaacgaaccaaaaaaaaacgtgccaaagactcttcgctttcggtcgccaagcggattcgcttgcttttagaagagcttggccctactttcattaaacttggacaacttgcaagtacacggggggacctctttcctgcttatgtcctaactgaattggagaaacttcaagacaatgtgccaagctttgcctatcaagaggtgaaagacatcattgaagtagaactggaagcacctcttgagaagttattccgttcctttgagccagtcccgttggccgcggcatcgattgggcaagtccatcgggctgaactgcctactggcgaaaaagtcgtcgtgaaagtacggcgcccaggaatcgagcgcacgattgaaacggaccttgccattttgcaagatttgctagagttagccgaagagcggatcggttgggttaaacgcttccgtctcgttgatttgtttcatgagtttgccgaagcgctaaaagaggaaatcaattataaaaatgaggcgcaaaacgcagaacggattaggcggcaaaactcggaaacacaacatctttttacgccggttgtctactcgtctcattcaacaatgaaagtgttgacaatgacctatgtggatggcacgaaaataaccgatg

SEQ ID NO: 6640 - DNA, 211 bp, Bacillus clausii
atgaaccagtctgaagtcgagattgtcatcatcaccggtatgtctggcgctggaaaatccgttgctgtccgaagctttgaagatttaggctattattgtatcgacaacttgcctccagtcttgctgccgaagtttattgaattgattgagggcggaatcgataaatcctcaaaagtggcgctcgtcatggatttacgagggcagtcctttt

SEQ ID NO: 6641 - DNA, 389 bp, Bacillus clausii
  misc_feature (1)...(389): n = A,T,C or G
cgctggaagttgcaggagttccagctgccgagcggaaaaaacgggtcgaggaattgattgaacttgttgggcttcatggtcgaggagacagctatccgtctcagctgagcggcggccaaaagcaacgggttgggattgctagggcgcttgccaacaatccgaaagtgctgttatgcgatgaagcaacttcagcgcttgacccgaagacgacagattccattttggatttgctccttgacattaatgaaaaactgaacttgacgatcgtgctcattactcacgaaatgcatgttatccaaaaaatttgccatcaagtancggtgatggaaaatggcaagattgtcgaacaagggcctgtcattgatgtgttccgcaagccgaaagaccag

SEQ ID NO: 6642 - DNA, 621 bp, Bacillus clausii
atggtaatgaatcaaacgttaacaaaatatatccttgttgttataagcacagctgtgacggctttcgggattactctcgttttagtggcggaaatcggcgctgatcccataagcacgtttttattaggtatgctacatttcattccgattcagtttggaacagggagtcagatttttagtttgacatttttagtggtcaattatgcgcttaaccgcgacttttttggagtaggaagtttgatttttagtattggctgtgggtatttcattaacttgtttcttagtctcgatttaccggctatcctatcgttgaatacgatcccgaacttatttattgccttgacgggcatactgatttacggagttggaacagcgctttttttatttacaaaaacaggaacaggtccgctggaaggattaatgctctttttttctaagcgcttcaacgtgacgatcaaggtaacgagaatggcgattgatggaatgttagttactactggcatgttattaggtggtttggttggtattggtaccatcttttggattttgttaacaggaccaattattgagttttcgttaaagctcttcactttccttagaagtcgagcaacacagccatag

SEQ ID NO: 6643 - DNA, 597 bp, Bacillus clausii
gaaatatttacttgatcgtgctattgttgttgctcgtaggccaagtagtgttatttttacggccagtgtgggacatattggcgacattgctcggaccgctttgtgtggcttttgtatcggcctatttgcttcaccctattgttgagtgtcttgttcgccttggattgccgcgggcacttgccacgtttatgttgttcttagcatttattcttgcaattgccgctatgcttttttggggattgcccgcgcttgcagcacaggtaaaagaagccatggatgtactgccaaggcaattggctgaagtgaaaaagtcactgttgaacttacaacgtacagcggaaaacctaccaaacccactcgacgaccatgtcggtgaatggagcatgaaaatcgaaacattcgcgaaagcggggctagaccagatagaacaagtgattatccggatgttacagtcctttatgacatggattgtcgttccttttttagtgttttaccttttaaaagactacgagctccttaaacgggttgctttttacttaacgccaagaaaatggcgaaaagggttgacagcctatgcaaccgatgttgatcggacat

SEQ ID NO: 6644 - DNA, 894 bp, Bacillus clausii
aagcgcttactttaattttgttgtcttccctgcttttatggccgcaagctccagcacacgctgggtttcttggcgcaggaaaaccagcccctggcgctccgccaggaacctgggttgttggtgattcgccagcaacgactgctggatcgccgattttgtttgtccatggccttaatagttccgcactcacttggttcgagccaaatgacatgttcgtacacacatatgagcaaggatttccgagcgcctacatcaatttgcaccctgataaatcaaactggcaaaatggcgagttgctagcggaaaaaattcgcgatatttatcaccatttcggtgaaaaggtcacagttgttgctcatagcaaaggcggcgtcgatacgcaaactgcgctcctacattacggagctgaaccttatgtaaaagaagtcattacgctcggttcgcctcaccacggaagcgaacttgccaacttagcatacagcaactgggctggctggctcgcggaaatcatcggccaacgctcagaaggcacagactctttgcaaacagggaacatggcctattttcgagcgcaaacagatgctttaatctctgcacaatctgtccccttttcgacgatttcaggaacatcctggggctcgtttggatctgctctctatttcggcggattgtatttgcaatttttcggcactaatgatggggctgtgacagtaaatagctctagactaagctacgcacaagaacttgcttccaaccgttgggatcatatgcaagtggcgcaaggacaccttgttttccctttgctgcaagcgcaaatgggtgcacaggctaagaaagaagaaaatacaaagtccatgagcgcagctatagtccgtggcggccaatttaacggaa

SEQ ID NO: 6645 - DNA, 569 bp, Bacillus clausii
atgatacaattaaaactagggtttattggcgtcggcggcattgcatcaggcaggcatatccctgcattttcgaaaattgagggagtcgaactggctggcgtttatgatgttaatgagaacagagcgaaagaagttgccgaccaatttgcgattccttttgtcgcaaaagaggcagcggaactgttcaaacgtgtcgatgctgttattatttgtacgcctaacaagttccaccatgagatgtccgttgctgcacttgaagctggtgtccatgtattttgtgaaaaaccgatggccattacggatgcagcgtgtgaggacatggtcaacgcagccgagaaagcaaagcgtgtattgcaagtcggttaccattaccgttttaaaaaggaatcgcaagccgccaaacgcctaattgcttctggaggaatcggcgaccctctagtcgtgccgtgtcgaagcgatgcggcggagaaaagtccctggatgggggcgtgttcaccaataaatccctttcaaggcggagggtgtctaatggattacggttgtcatttgttagatttagcactttggct

SEQ ID NO: 6646 - DNA, 867 bp, Bacillus clausii
  misc_feature (1)...(867): n = A,T,C or G
ttttttctggaaaaatcgtggagcattatgcattaaagaaacagttccgcgtgcttgcgctatacaatacgccaagtatggctnagaagacgatacccgtgaaaccgcggcgtgtaattcgcattgtgctctctgaagtcgattgggcgaatcgcctgaaacgggatatcggccatgccaagcaacaatttaacacgatttataaacagcttggcgtttgggaaattcaaggagaaaacgtctatgtgatgagcttgcctcctgttgattcatgggaagaaacgatggagccttttacgatcggcaaccgaaaaggaaaaattcgcaacattgccttgcatacagatacggatacatacaatgagatcactgaacaaacattggagaatgacgggctgccaccgtttgagccattggattctcacgaggcgatggaacaggagattttgcggattcacgaaaacgtaaaacgcacgaccgttggccgccagacaaaagaacggcaaacgttgttttttggaaaacctcgagtgatctatgcgctgttaatttcgatattaattatgtatagcgtccttgaagcaaatggaggaagcaccaacattgaaacgttaattgactttggcgcaaaatacaatccactcattgtagagggcgagtggtggcgtctattttcagcgatgtttttgcacattggctttttccatttgttgatgaacggcatggcgctttactttttaggcagtgcagtggagcaactttttggttcgatacggtttttggtcatttatttcatggctggcttatttgggtctgccgttagctttgctttcacagactctttgtcagcaggtgcgtcaggggcat

SEQ ID NO: 6647 - DNA, 333 bp, Bacillus clausii
ttgtagaaagctcaatgcggaaagtagacaaagggctgattgaagcagcaatcgcttcgggcgcgacgccatggatgattataaaagacgtgctctttttagaagcgcgtgcttcgatggtacaagggcttactcttacgattatcagcttgattgcttactcggcaatggcgggtgtcattggcggtggcggagttggcgatttagcgattcgctacggtcattatcgctatgaccatacgattatgattgcgactgtggtgatattgatcattctcgtccaagtatttcagtttttaggagatttgactgcaaaagcgacagataaaagaa

SEQ ID NO: 6648 - DNA, 342 bp, Bacillus clausii
aaaattggattgggaaaagtagaagatagcgacataaaagtcccgttttctttccattcaacctttagtggaaaatgcgattaggcacggcattatgaaacgccctcatggcggaaaggttcttattcaagtttctaacaataaaacgcatgccatcgtatcagtagaagatgatggagtcggaatggacgacgttcaacagcaacggattttagagagaaaagccgctagccgttcaggggttggattaattaatacggaccagcggttaaaacggcacttcggcacggggcttcaaattgatagtgaaaaaggcaaaggaacaaaggtatcgtttcatgt

SEQ ID NO: 6649 - DNA, 701 bp, Bacillus clausii
atgattggccgaacgattgccattgttatttttctcataggttctttatgggtgttcacaaaggtcttctcccttacataccctttttggtttgcggctttgttcgcctggatgctacagccagttgcccgtttcttccaacaaaagctccgcttcagccgtggttttgccagtttgtttggcttgttaggcggaatcttggtgattagcgcgattctaacggggttggtttttcttatttattttagtttgcgccaattttttgagcaagtgccaacgtggattgaagaaggctctgaaaaaatgcaaatcttctttaatgaaacgatttggccgtattggcagcaagtacttggtttgtttgatacgatcgatgtaggcacacacaatgtcctgtcggaaggaattgaccagttaggaacagtgcttggcaattttcttggtgatatcggacagggggttgttgactttttaacaacagcgcttttagggttaccgaactttttagtggcgtttctgtttatcattttgagcatttattttatggggaaaagctggagttattaccaagatgtttatgatcgccatgtgccaaaacggctgcgtaaaaaaggcagagagttcgtacaagcgatccggcggaggctgtttggctttcttcgagcccagttcatcctcatgtttgtgaccgcttgtattgt

SEQ ID NO: 6650 - DNA, 957 bp, Bacillus clausii
  misc_feature (1)...(957): n = A,T,C or G
gctcggagttgatggtgcgttttgaccgtgaaaaactggaaaagcagccatttcatgaagaagcttttcgagaaaaattaagcgagtacggcgattcccttcttgttgtatcagatgatgatttattaaaagtgcacatccatgcggaatatccaggcgaagtgttgacagaggcccaagcgtatggaccactcatgcaagtgaaaattgaaaatatgcgcgagcagcacgcacgccttacaacaaatgacagccacgctgggcatgccccagcaacggcacggccgaaagcagagtttgcgattgtgacggtcgcgatgggttcaggaattgaaaaactgtttaagggccttggcgctgaccaagtcattgccggcgggcagacgatgaacccaagcacagaagacattgtccaagctattcataaagccaatgccaaacaagtcattatcttgccaaacaacggcaatattgtcatggctgccaaacaggctgcagaggtaagcgaagcggacgttgaagtcgtggcgacgaagacggtttccccaagggtttagcagcgttgctcgcatttaatccattcaaacagttttgcaaggagaaccgcccgtccgcaatggcccgaaagccgatgaaaggaagtaaaaacgggcgagttaacgtacgcagtcagggatacgcaaatggatantcanacnattaacaagggcgattttatggggatagccgacaaaaaaattattgcttgnggccctcgtaaacaagacgtggcgaaaaagctccttgatgaaatgattgatgaggaagcagaagtgctgacgattataacgggcgaagacgcgaccgcagacgatacaagtcaaattgaagcttacgtcaatgagcgccatgccgacatggaagtcgatattgttgagggcggacagccgttgtactcgtacattttttcagtcgaat

SEQ ID NO: 6651 - DNA, 474 bp, Bacillus clausii
atgcattgccgatcaaggaaacaactgccacattcatttgctagcatcaaaaaagggacgatgcacgcttgtgggcatgacgcccatacggcaattttacttggcgcagcgacgatattaagcgagcggcaccaggcaggtttcctaaacggcacagtccgttttttgtttcagccagctgaagagaagatggatgaagctgggaagactggcgctatctatatgatagaagcaggggcgatggctggagccgatatcgcctttgcgcttcatatgtgtccttggctgcgcccgaatgcgattcaagttcatagcggtgctagcatggccagctttgatgcatttaaagggacgattacaggcagcggggggcacggagcgtatccccatttaggcgttgacgccatatggttgctttcgcaagtgctgccggcgatttacggactgactggtcgcttttccctccccgcttga

SEQ ID NO: 6652 - DNA, 420 bp, Bacillus clausii
atttgctagcatcaaaaaagggacgatgcacgcttgtgggcatgacgcccatacggcaattttacttggcgcagcgacgatattaagcgagcggcaccaggcaggtttcctaaacggcacagtccgttttttgtttcagccagctgaagagaagatggatgaagctgggaagactggcgctatctatatgatagaagcaggggcgatggctggagccgatatcgcctttgcgcttcatatgtgtccttggctgcgcccgaatgcgattcaagttcatagcggtgctagcatggccagctttgatgcatttaaagggacgattacaggcagcggggggcacggagcgtatccccatttaggcgttgacgccatatggttgctttcgcaagtgctgccggcgatttacggactgactggtcg

SEQ ID NO: 6653 - DNA, 972 bp, Bacillus clausii
atgaaacaaggcattttgccattagggggagggatttttttgcattcatggattaacgagtggcaagcgctttaccaaaacatttggcagtcgccgactagcagaagcatagatgatgtgatcgtgcttgaacagatgacgcagcaagtattggatgtttggggagcgatggatgaggcattgaaccaattgcggcagcggttaaaagaaacggcgccaatgtttgtgtacgaatcggaagggacgatcctgttcgatgcccatcagtttgacgaagcgctttgttgtttgaaaaacgaggaggctgaaggcgaaagagaaaatattcgtctgttgtatatcgcctatgcttcattatacacggagaaatttgaggaagcgagaagcggctttttatatgtattgcaagtatctttcgatccgctcgtcacccacttcgcttaccttggcattggcattattgaaatggttgctcgccgagcagaagaagcgatattgtttttagaaaaagcaaattcattaacagacaaccctgatgtcgtgtataatttaggcatatgttattattggttggaagcttacgatagtgatgcagcttattttcactcttatacgcaagtatgtgacgatgccgatgcttttatgttgcttggcctttcgctttataaaggtggaatggttgaggaagcgcgcggcgtatggcttgattgtgcagagaacgttgattcgagcgaagcgcttttggcgctggccaagctaaccgaatggtacggcgaacatgaactggcatgctacagttacgaacagctaatgtttatcaatgggaaaacgccggagttgcttcatggctttgcctggaaccaagcattgtcaggagatagccgtgcggttgatttattgttcgagcttggcaagacaagccagcaagcgtatgaatcatggtgcatgttgcaggctgcccaaggagggtaa

SEQ ID NO: 6654 - DNA, 396 bp, Bacillus clausii
atggcatgcccttctcttcatgttggcctgttctcttattcgccgttagctgtttcctgctttgacagcaatgccatggcgttcaagctctcctttaagctcctcggcaaaagcgacagcatgtgccgccatcgccatgaatacaaacggtttgtgccgtcaatctctacatcggtgcccttgcttgaagtcccgcactttttccttcctggtattccatccgcaacaaccttgtgcaagaccgcttcttttggatcggttattagagcgttcgggacacgccttgatgttaggctgccatctgcttggtacgtgcgatccgcaaacacctcgctagctgttttcaaccctacttttttcccagcagcaataagggcgcttccagcaggtccataa

SEQ ID NO: 6655 - DNA, 690 bp, Bacillus clausii
  misc_feature (1)...(690): n = A,T,C or G
tgttctgttattgcatggctttacaggaacgactgctgatgtccgcatgcttgnccgctttttgcaaaagcatggctatacatgccatgcccctttatatagagggcatggcgtgccgccagaagagcttgtaaagtacagcccagaagattggtgggctgatgtacaggcagcgtatgaacaattgcaacaagatggctataaggaaatcgcagtgtgcggattatctctaggtggtgttttttcattaaaagcaggtttctctatgcctgtaaagggaatcatatcgatgtgtgcccctgtcaggcccaaaacggaggaagcgatcaaagttgggatgctccgttacgcgaaagagtacaagcgtcttgaaaagaaagaagacgcggtgatcgaagccgaaattagcgcgcttgcagaaaaatcgcttgagccgctttatcagttgcggcagttgatggatgacgtacgggaacagcttgacttgatttatgcgccaacgttcgttgtccaagcgcgctatgacgaaatgatcgataccgaaagcgctacgatcattttggacaatgttggcacagacgacaaacagctaaagtggtatgaacattcgacccacgtgattacactcggtgaggagaaagaacagcttcatgaagacatacttgagtttttaaatcacttagattggtc

SEQ ID NO: 6656 - DNA, 431 bp, Bacillus clausii
atgaatcatgcaaataacatgaaccgctggatcgatgtatcgcagccacttaatgaaaaacttgcccactggccaggtgatttgccgtattcgtaccagttgacgttttccaaacagcaaacaggttctgtcaatattggccaaatggcgatgagtgtccattctggtactcacgttgatgcgccgtttcattttaaagacgacggtgccaaaatatcagacttggatattaatgtgtttataggaaaagcaagagtcgttgatttatctaaacacgaaagaatcgaccaagctgcccttcgtcctctccatttagaaggaataaaaaggttgttaataaagacagccgtcccgaaccaagcaactgcatttcctgataagattccatatgtaacggcagacggtgctgcctacatgaaggaaaaaggcat

SEQ ID NO: 6657 - DNA, 567 bp, Bacillus clausii
  misc_feature (1)...(567): n = A,T,C or G
aaatagatgagatcattgaaaatgttgaaaaagtgatgattggcaaacgagcggaaatccgtcttagtcttgtcgccttgcttgcaggggggcatgtgcttcttgaagatgtgcctggtgttggcaaaaccgtttttgttaaagcaatggcgaaaacaattaacggctcgttcaagcgaattcagtttactcccgacttactgccgtcggatgtgacgggcgtatcgatttacaatcaaaacaagcaagcgtttgagtttcgtcctggcccagttatggcgaatgtcgtgcttgccgatgaaattaaccgtacgtcgcctaaaacccaatcggctttgctggaggcactagaagaaggaaacgtcaccgttgacggagagacgatggtcatccattcgcctttttttgtaatggcgactcaagaaccctgttgaatactctggaacattccctctgccagaagcgcaactggaccgggttttaagtcagaattaagcttaggctacccaacgattgaagaagagctggaactttttagggcgtngttgaagcaagaagccatccaaa

SEQ ID NO: 6658 - DNA, 606 bp, Bacillus clausii
catcataaagcataaaaaaggcattatccttttatttgccatcactgcccttttcgcagcggtagcccaattttttgtgtcgaccaactacaatatggtcgattacttgccagatgatgctccttccactgaaggcctggcgttaatggaagaagagtttcgctcagcaatgccgaatgcaaacgtgctcattcatgatgtctccattcaagaagcgattcgttataaagagcaactagcaagcattgatggcgtgagcgacgtatcgtggctcgatgatgtgtttgatattcggattcctctcgaaatggctgactctggcttaattgaaacgtattacaaagaccatgacgcccttttttcggtaacgattgacagtggcgccgaagtagcggcgacagatgacatttactcattaatcggcgaggaaaacgccgttactggggaagcggtcaacacggctacttcccaaaaaatgactggctctgagacgctctatgctgcagcgttgctcgttccgattattatcattattttggtcctatcgaccaaatcatgggtcgagccattatttttcctaacagcgatcggcgtttccgtcttcat

SEQ ID NO: 6659 - DNA, 417 bp, Bacillus clausii
  misc_feature (1)...(417): n = A,T,C or G
acgtgtaccggcacacagttgtgggagataacgaggacaggctaaaaaaagcacttcaagaagcacatgagcgtgccgatctcgtcatcttaacgggcgggcttggcccgacaaaagatgacttgacgaaagaaacggtcgcggcgttttgtggaaaaaagcttgtgtacgatgaagccgctcttcatgaaattgaacattattttaaacgccataaccgcgtcatgacacctaacaacaaaaagcaagcctatgtgattgaaggctgcaccgtgcttgcaaaccgtcatggcatggcccccggaatgctatgcgagcttgaagacgggaaaaaactggcgcttttgcctggaccaccgagcgaaatgaagccaatgttncgtcaacgagcttttgcctaaactgttaggcgcaact

SEQ ID NO: 6660 - DNA, 990 bp, Bacillus clausii
  misc_feature (1)...(990): n = A,T,C or G
gcatgtcgccattccccttcttgccatcctgctcgggctgcttgtcggcgccatcgtgatggtcatcacgggccataatccgattgaagcgtatggggcattggtagcaggtatttttggcagcagctattattttggcgaaatgattcggacgatgacaccgcttatattagggggactcgctgttgcatttgcttaccggacagggctgtttaacattggcgtggaagggcaactgattgtcggttggcttgcctctgtttacgttggagccgcttttgaagcgccgatggccatccacctcccactttctattgccgctgcggcggtagccggggcgctgtgggcatttgttcccggcatcttaaaagcaaagttttatgtccatgaagtcattgtcagcattatgatgaactatattgcattgtataccgccaatgcgatcattcgcacttacttgcttatacctggcgagcggacagaaagcatttatccttctgcctcattggcttcgccattctttcagtctcttacggaatattcacggctgcactatggctttttaatcgcagtggccgcgtgtttgtttatgtggttctttttatggaaaacgacagcgggctatgagcttcgcgcagttggtttaaatgcaaatgcttccacttatgcaggaatgaatgttagccgcaatattattctttcgatggctatttctggcgcatttgccggactggcaggagcggcagaaggcttaggaacttttggatacatgagcattctttcaggcttnacaggcgttggttttgaaggcattgccgttgcactactaggtaccaatacagcgcttggcgtgttcttgtctgcctttttattcggaggcttgaaaacaggcgcattgacaatgaaccagcaaaccaatgtgccgacagaactgattagcatcgtcattgcactgattattttctttgtcgcttcaagctatgttgttcg

SEQ ID NO: 6661 - DNA, 1254 bp, Bacillus clausii
ctacgatgtaattatagtcggcggcggaccctctggcctgatggcttctgtcgccgctgcgcaacaaggggcacacgtcctcttgctcgataaaggcaacaaactcggtcgcaaacttgcgatttcaggcgggggacgctgcaatgtcaccaacaggatggaaaggaaacagttgattgaaaacattccagggaatggccgctttatgcatagcccattcgctgtatttgacaatgaatcgattattgctttttttgaaggctgaggaattcgcttaaaagaagaagacagaggacggatgtttcctgttaacgataaagcacaaactgtggtcgacacactgcttgcacaaatccgtaaacttgatgtcaccatccgtacgaatgcccgagtcgccgacattatcgtagaagacggccaggcagttggagtggcactcgaagacgggcaacacattggcacaaaagcgctgattatcgctactggcggcaaatcagtgccccacacaggatctactggcgacggatacccgtgggccaaaaaagcaggccacacaattactgagctttatccgacggaagtgcccattacactcgccgattcctttatcagcgatcagtctcttcaaggcctgtctttacgcggaattgaactagcggtactgaggccaaacggcaaaaaaatcatttcccatgaaggcgacatgatttttacccatttcggcatatccggtcccgcggcattacgctgtagccagtttgttgtcaaggcgctgaaaaagttcaaaacgcctacgatcccaatgacgattaagttgttccccgaacaatcggcagagagccttttccaagcgctcgtcaaacgggcaaaggcagagcctaaaaaaacgttaaaaacagcattaaaaggggtggcccctgagcgattgcttttgtacttatatgggtcattagagatcgattccagtgaaatgtgcgccaataccccacacgatgcctttcgaaaattagcatcagcattagacgcgtttccattacatgccgatgggacattgtcgattgaaaaagcatttgtcacaggtggcggcgtatcaattaaagaaattgagccaaaaacgatgcactccaaaaaaacaacaggcttgtatttttgtggggaagtgctcgacatccatggctatacaggcggttttaacattacatgcgctttctcgactggctatacagccgggcagtcagcagccctttttgcaaa

SEQ ID NO: 6662 - DNA, 846 bp, Bacillus clausii
  misc_feature (1)...(846): n = A,T,C or G
ttggagtggaagcaatggaaggaatcgcaacgaagaaattagaaacgttacaaacacaagtcatcgaatggcgcaggtatcttcatgcaaacccagagttgtcgtttgaggaagtagaaacgcctgcttttatcgtacagaaattaaaggaaattggatttacagatatacgcgaacatgtaggcggtcgcggtgtggtagcaaagctccacggcaaaaagccaggaccgacaatcgcttttcgtgctgattttgacgcattgccgattcatgaagaaaatgatgtttcttatgcatcgacgaagccaggcgttatgcacgcttgtgggcatgatggccacacagctgctttgttaggtgttgcggcaacgttgtttgaccaagtagatgagcttcgtgggacaatcgtgtttttgttccagcacgctgaggaaaaacctcctggcggcgcccgtgaaatgattgctgacggatgtttagaaggggttgatgccgtatttggcgcccacgtatcctcgcaaattccacttgggcaaataaatgcaagccctggagcagttatggcagcagttgatgcgtttactgtgaatatacaaggaaaaggcgggcacggcgcccatcctcattcgacgattgattcgattgtgattggcagccagcttgtcaatgatttgcaaaccattgttagccgccgcatcaatcctatggatacggccgttgtcacagttggcgtcttccaagcaggcacagcgttcaacgtaattgcagatacngcgcgaattgaaggaacagtgcgcacctttcaagaagaaacgcgcgctttcatagaagaagaaattcgggccg

SEQ ID NO: 6663 - DNA, 552 bp, Bacillus clausii
  misc_feature (1)...(552): n = A,T,C or G
cagcggggattagccacgtgcggtcggttttgcgacgtttggcgcttttgtcggcggaattggcggaatggctacgttgctttatttttatttcaaacagcgtcnnacgattttggcacgtgnacaaagccaccctgccaaagaaagacagacgcttccgagcangtataaggaactgatttcttangcattgcctctttcttttgtcggcttggcgattccttttttccaggctgtcgacttgtattcgattgagggggcgctttctgggacagagtatgccagcgaagcgaaagcgtttgtcggcgctttaacaggagtggcccataaaattgtccttatcccaatggcgctagcaacggcattatcaattacgttagtgccgacgatnacaaaagcatacgttaatcaagacaataagctttnacaaagctatattacgcanacgtaccaagtgattttatttattggcatcccagcggcgantggtatgtntgttntagcagagccaatttatttngcgctattcggcagtgcgaactaggagctagg

SEQ ID NO: 6664 - DNA, 453 bp, Bacillus clausii
tcgcgtttgaagttaacttgcaaaacttcgggcgccggttcttctatgtcgttgctgggagttatactgtcttgtatatgggattcttgtttttaattattgcttgcacggtattggctttacaatttttgacgcaaatgaagcagactggagggcgctatgtcaccctgtcgatgttaggcgccaaacgtgatcaaatgaaaaaatcgatgcatacacaggtgttgtgggcctttttgttaccgatgtctctcgcatgcgtaagtgcagctgttgggataagggcaatgatttcatttgtggtcattcgctttgaggacgatcccctcctgtatcctatcgcgattgcctttgcctgtatcgtgatcgccattgtagcgatttatggagtcgctgttgcccgttcggctgaccatgagatcgataaattacggtggaagccaaacatcgatt

SEQ ID NO: 6665 - DNA, 873 bp, Bacillus clausii
tcctaatgttaggaatgcgcaaggagcgtctaattgtccagcttttggctgaggggctgatgacctctattttggcactcgctggaggccttttagtagggggctttttagcagaaatcattagtttaaccgtttctaaattagtcggacaggggatcatcgggcatcaatttagtttgtccgtagaggcgattatttttacgattattggctttttattgatccagtttatcgcattggtcatgcttggtggaagattgtttcaacaggaggtccatcaattactgtatgagcaaatggacaagaaaacggatatggggcatgtgaaaggcaatgtactccatgtaggactaggttctgtcttactaggtgttgcctattggatcgtcttatatcggtttgcggactttggcggactgcttctgtttgcggcacccctttttggaagcttaggaacgatcctttttataaggggatttggaaaactactaggcatttgggcaagtttgtccaagcgtaaatcgatgaaagggctgcacacctttacattaaggcagtttcaagagaatgttgctaaccggtcaactgcggttgcggttacatcgattctgctcacgttgtcgattattttgattgccaatggtgcttcaacgattttaagtttagacagtttgtataatcgagattcctcagtatatgattttacggttaacggagagagtcaaaaagtggagccatttttggcttccgaaaaaatgcgcccttatgtcgaagactcaaacctgttggaaatgggaaagatgaacgatcagggagagcgcgcggaagatgggatgccactgtcattggttgattggtctaaattaaaagagc

SEQ ID NO: 6666 - DNA, 972 bp, Bacillus clausii
gtatgattttaccatcattggcggtgggattgtcgggttagctgtcggtcacgccctattttcccgttatccaaaggcaagtgtattaatcattgaaaaagagcaggaagtcgccgctcatcaaacagggcataatagtggtgtcatccattcagggatttattataagccaggcagctttaaagcgaagtttgcaaaagcaggtaaccaatcaatgactgccttttgccaaaaacatggccttaaagtagacatttgcggaaaggtcattgtcgctacaaataagaaagagcttccactgcttgaccacctctaccaacgagggattgacaatggcctcgatctccgaatgttatcgaaggaggaattacatgaggccgaaccgtatgtaaacggccttgccgccatatctgtgcccacagccgggatcgtcagttacaagcaagttgccgaaaaactcgctcatttaatcgctgaaaaaggtggagaaattcaattcggtacgacggttgagaccattaccgagaacaatgaaggggctacgattgaaacagataaagggacgtttcagacgagctatctcatcaattgtgcaggcttgcatagtgaccgaatcgccaagcttgcaggctatcatgtggatatgaagatcgtacccttccggggagaatactataagcttaggccagaagaacggcatcttgtgaaaaatttaatctatcccgttcctaatcccgattttccattccttggtgttcatttcacccgaatgattgacggagaagtagatgcagggccaaatgcggttttaagctttaagcgggaaggctataggaaaaccgatatcgattggcaagatgtagcggaggtcattcgctacaaaggcttttggcagttagcgactaaatactggaaggaagggacggaagaaatggttcgttccttcagcaaaaagaagtttgtggaaaacct

SEQ ID NO: 6667 - DNA, 486 bp, Bacillus clausii
  misc_feature (1)...(486): n = A,T,C or G
ctattgcattgctataggtattccggcgctttgcggcttggtcgtgcttcgtgaaggggttgccgagctatatttaggagaagcgtttcgggagacggccgtgctgctcatgccgtacattgccgtgggcgccttgttaaaaggctttaaactctatggtgtcaatattatgtttcacttgtataagcaaacaaagctgcaaatggtgccagtcgcagtagctgccatcgccaatgtgatactaacgattgcccttcttcctacttatggcttagaaggggccgctttcgcgacggtggttgcttatgggttggcgattgctcttgcgtggctgtttataaataagcaaaatgggggcgggctgccatttccgggtaaaagatttttgtaaaggttttngtgtgcaacagcgatcatgctcctttgcatgtggccgtttttaggcagcgctcactggggcatgctcatccttcaagtggggatcgg

SEQ ID NO: 6668 - DNA, 300 bp, Bacillus clausii
atcaactaaaaacatggcgccgtgatttgcataagcgtcccgaattaggctggtgtgaataccaaacaacggcttacatttatcatgttttaaagcctctatgttttacccttcatcttggcaatgaagtaagtagcaaagaaaaaatgggtgtcccttctgctgaagtggatcgcctccatttcaagcgggcagaggaggcaggcattgatgctaagttgctcgagaaaatggctggcaatcaaacggggcttgtggcgacttttgacacaggcaaagcagggtaaacatatggcttat

SEQ ID NO: 6669 - DNA, 962 bp, Bacillus clausii
acagacagaagccagtaaaagtcccagacggcattgcccactttctagagcacaaaatgtttgaaagcgaagaaggcgatgtttttcatacatttggcaaacaaggggcacaagcgaacgcttttacaagctttacccgcaccgcttatttattttcaagcacatccaacgtcaaccaaaatgttgaaacgctgcttgactttgttcaacacccttattttaccgatgaaacagtggaaaaagaaaaaggcattataggacaagaaattacgatgtatgatgatgatcctgattggcgcgcttactttgggacaattgaaaacatgtattcatcccacccggtcaaaattgacattgcagggacgatcccgtcgattagcaaaatcacgaaagaggacttgtacacttgctatgagacgttttaccatcctagcaacatgttgctgttcattgtcggctcggtggacgtaaatgaaatgatgcagctcgtccgggcgaaccaaagcaaaaaggaatttgccgacccaaaaccgattgagcgtcacgtgaagcctgaagggacgccagtcgacagagccgaacatgttgtcgctatgcctgtccatacgccgaaggtatttgttggctttaaagagtcaaacccaacgcggcaaggggaagaactgctaaaatacgaactgtcgttaaatgttttgctcgatcttatgttcggcccaagttccgaggcatacgaggctatgtatgaggcagggatcatcaatgagacgtttgcatttgactatactgcagaatatgggttcggtttttcaattatcggcggagacagtacaaagccagaggaactaaaagaaaaaattattgagaccattgctgcattcaagcagcgtccacttgcgaaagaagaagcggatcgggccattaagaaaaagattggcgcttttcttcgttccttgaactcgcct

SEQ ID NO: 6670 - DNA, 678 bp, Bacillus clausii
gcggctggattttgctttatgcgttgttgtcgttcggcaattttgtccttgcagatgggcgtgattacgagcagttgtttgtcagcattaccgccagcccttgggcgagcatactcggtcttgtgttattcgtgttccttaatgtcgtcgtgttgtctttcggcattaaaaatgggattgaacgggccaacaagtacttaatgccacttttgtttttgtttttgcttataattatttttcgtggcctctcccttgaaggcgcgatggaaggcgtccgttttttcctgcagcctgacttttcaaaaataaccgcgccaggcttgctggaagcattgggccaatcgtttttctcgctggcagttggcttctcttgtatggtgacatacagttcctatcttggagaaaagcaaagtttgccaggctcagctgcgtatgtggcagcaatgaacgtatttgtgtcattattggctgggcttgcgatttttccaattgtttttgcctatggcattgagccagcctctgggccagggctgttatttatcgcgctgcctgcgatttttgcacaaatgcctttcggtgctttgtttttaagtttgtttctgttgttgttcttctttgcgaccattacttcgtctttaagtttggtggaaattattatttctgcatttacccaaaaca

SEQ ID NO: 6671 - DNA, 741 bp, Bacillus clausii
  misc_feature (1)...(741): n = A,T,C or G
aggcattacnaaatggaaaacacgtatctgtgaaaagccatttacgtcggacngtacgagaatcagaacgagtaatggaacttgctcgcaaaaaacaattaatggtgttcgaagcgattacaacgattcatttgccaaattatcaacttattaaagaacagattggcaaattgggccagcttaagcttattcaatgcaattatagtcaatattctagccgctatgatctcctaaaggctggtgaaaccccaaatgtgtttaatccgcaattttctggcggtgcattagccgatatcaatatttacaatcttcattttgtccttcatttatttggagcgcctgagtcagttgcctatactgcaaacaaacatccaaatggaatagacacttcaggagtcgtcgtattaaaataccgtgattttgtcgctgagtgtgtgggcgctaaagatacaagaagcaaaaattttgttttgatacaaggagaaaaagggtacattcatgttgaaaatggcgcaaatgggtgccgcaatgtgagtgtgcatttacaagaccaagtaatcgatttgaatgaacaaacgagtagtaacctgatgtattacgaacttcttgcattcaaagatatctatgacaaacagcaatataaccgttgtgaagaattactaaagcattcttactctgttatgcaagtatttgaaaaagcaagacagtcggcaaatattgtttttgcggctgatcagcaat

SEQ ID NO: 6672 - DNA, 396 bp, Bacillus clausii
actctcctttccatgatcagcgcagcaagttgatgccgattaacaacaagtacccgttagaccaggtaatgaatgtattggatcagcatattcacgagacagggagaaaagtttatattgcttacgtcatgcttcggggagtcaatgattcggagaagcatgcgaaagcacttgttaaacggattctaaacaatcgctatccccatctctatcatgtcaatttgattcgctacaatccgactgttggtacgcctgaagactatggccaaaccatagaagagaaactgcaaactttttaccgtgtcgtaaaatcagctcgaatccctgtaacgattcggagtcaatttggaagagaaattgatgccgcctgcggccaattatatggtcagtatcagg

SEQ ID NO: 6673 - DNA, 916 bp, Bacillus clausii
  misc_feature (1)...(916): n = A,T,C or G
atggaagaacggaatcgaactgcatttatccaaaacttattaaagttagtagcgccaggcacgccgcttagggctgggattgacaatgtactccgcgctaaaacaggagggctgatcgtccttggctacaacagcgaaatgatgaatattgtggacggcggtttctttattaatagtgatttttcaccggcttatttgtatgagctagctaaaatggacggtgccattattttgagtgaagacggcaaacgtattttatatgccaatacgcagttggtgccgaataataatataagctcgagcgaaacagggattcgtcaccgttctgctgaacgggttgctaaacaaacaggcaatttgacgatttccatttcccagcgccgaaacgtcatcactctctaccaaggggaatatcgttacgcgctaaaagacattggcgtcattttgacgaaagccaatcaagccatccaaacgcttgaaaaatataaagcggtattagaccaaggaattacaaatttaggagcgcttgaatttgaacagcttgttacttacagcgatgtgattcaagtcattcaccgtgtgcaaatggtgctgcgcattaaacaagagatccaaaattttatccttgagctaggagacgaaggccgcttaatcacgatgcagttaaaagagcttgtttccaatacagagcaggaagccctttatttgctaaaggattacgctaaagagcggacgcaggacgtaaagaaaacactaaaggaactcacgacgttgttaaacgaagacttgctcgacgaacaagcgattataaaagcgcttggctattcaagaacaagcaattttctagaacaaccagcatcgcngcgtggataccgaattttgcaccgaatcccacggttgccttcacaaatcattg

SEQ ID NO: 6674 - DNA, 204 bp, Bacillus clausii
cgttgctcgtcattgtctgtgtcgtcattatccagcaaattgaaagcaatgtcttctcgccacaaattatggggcgccagctttccgtgcacccgctgacgattatttttgttctccttgtcgccagccagcttgcaggttttgtcggaattctccttgccgtgcctgcctatgcagtcagcaaggttattgtccagcacacgt

SEQ ID NO: 6675 - DNA, 576 bp, Bacillus clausii
gctcgtgttgtttcaaaaagaacaggtagaactatggaggaattacaagtgggtatgggttcctgttgtgtttctgttattaggaagttcgacgccgctctccacatactttatgccgcaaatattagaggacttcggcgggttgccagaaggggccgttatcgacattcctacgcccacaggaactgaggtgctcgcacaaacgttatctgatttcggattgctcggcgtccttgtcttgacgttggcgttgatggggatcgtatcggcggaacggcgcagcggagtagcagcgatcattttactgaagccagtgccctacttttcttatctcacagccaaatgggcggcgattatttgctttacatgggtgtcacttggccttggttacggcttagcgatgtattacacgaaccttctattcgatgccgtttcgcttgaacgttggttcagtagtttttttcattttggattgtggttaacgctcgttatgacgattgttctgttttatagcaccattcttaaacaaacaggcacagcagccttctgtgcactaggtaccattcttctcatcag

SEQ ID NO: 6676 - DNA, 327 bp, Bacillus clausii
atacatccagggagcaagcgtttattttgaatactaccgttgccaagcgcaagaagcaaaaggaacgttgcttttgttgcatggttttttagcgtcatcagcctgttttcatcaattggttccttatttacacaaggattatcacctgatcagttgtgatttacctgtgtttggccgctcaagtaaggcaccaggaacggtctattctctttctggttatgcccatcttgtcgttgaattggcagctaggcttggccacgcctatgtgacaattgttggccattcgatgggcggacaagtggcgttacatgcggccaaagcattccc

SEQ ID NO: 6677 - DNA, 552 bp, Bacillus clausii
atgggggcaattgaatttaaacaagtgaaaaaaacgttcaaagatggtgttcatacaattgaggcgttaaagaaaacagatttcgcggtagcaaaaggggagtttgtcgatattatcggcccgtctggttctggaaagagcacgtttctaacgattgccggcggattgcaagcgccttccgagggagaagtattgattaatggtaaactttttagcaaaaagaaagaacaagaacgcgccaaacgaagatttaaagagattggttttgttttacaatcatcaaaccttgtgccattcttgacagtacaacaacaactacagcttgatgataaaatcagcaaagaaaaaagaaatcagacagccgacaacctctttacgcaattaggcattgacaaattgaaaaagaaatacccagaagagctttctggcggtgagcgtcaacgagtcgccatcgctcgagctttgtaccacgacccgacgatcattttagctgatgagccgaccgcaagcttggatacagaaaaagcgtatgaagttgctgagatattggca

SEQ ID NO: 6678 - DNA, 1116 bp, Bacillus clausii
  misc_feature (1)...(1116): n = A,T,C or G
cttggaagatcaagttcgccacccgggttgctcgcccaaagtgacaacaggcgttgaacaactgggcggagcgnattatgatatctttttnaaggaaggacgtcatctgatcggtttttttggcagtgatgaaccataagaacgctattgctgttagaggagaaccggtnttgaattgcttgatgatatccgtgaacggacagcgagggagaaagtgccaattacgctcagcattggggtcggcacggaagaaacgtcattaaaacaactgggcgccttggcccagtcaagcttagatctagcgcttggccgcggcggcgaccaagtggcgatcaaaaagaaaaatggccgcgtccgcttttatggcggcaagaccaatgcgatggaaaaacggacacgggtacgcgctcgcgttatctcccatgctttgcgcgattttgtaaaagaaagcgaacgagtgattgtcatgggccaccagcgtccagatatggacgcgattggggcagcgattggcgtattaaaaattgctgacttaaatgaccgtgaaggctttattgtgctcgatgtggaggatattaacccggatgtccagcggttattggaagaaacggagaaacacgaccatttgtggagccagtttgtttcgccggaagaagcattggatttagctgataaagagacgttgctcgtcgtcgtcgatacacacaagccatcgcttgtcattgagccgcggctattggaaatgattgaccgaatcattgtcattgaccaccatcgccgcagcgaagactttgttgaagatccggttctcgtttatatggagccgnatgcgtcatctacggccgagcttgtgaccgagctgctcgagtaccagccgatgcagttcaaaatggaccggctggaagcgacagcactgctcgctggcattattgtcggtacnngangtnctgccgtncgtactggggcgaggacatttgatgcagnctagtttttgcgggccaacggcgccgatacggcgctcgtgcaaaagctattaaaggaagacttggcgtcttacgtaaagcgtgctaagcttgtagaaaacgcctatctttaccgagagggctatgccattgc

SEQ ID NO: 6679 - DNA, 260 bp, Bacillus clausii
  misc_feature (1)...(260): n = A,T,C or G
atgtttttancaatcaatgaaatgaagcattccanattacgctatgccttggtgataggtgtcatgttcttgattgcctatttggtcttttttttaacgggattagcctatggcctggcacaggaaaatcgcatggttgtcnataaatggaacgctgatcacatattattagcggaagaatcacataacaatttaaacatgtcaatggtctcaaaaaatgtatttgacgacgtttccgctgatgaganagcgattttagc

SEQ ID NO: 6680 - DNA, 302 bp, Bacillus clausii
ttgcaaacgaaaaacgctcattgtcgaagaaggacatggagacaagatggtcgaaaaattcgctgctgacggaatcattgaagagcagccagggtttattgatttacaagtaatgaaacaaaaaccacgaaaaggccaagaagaaattttagtgctgattcgctgggattcagaagagtcgtggaaggcttgggaaaaaagtgatgcccatctggctggccatcgtgccaatcgtggcaagcctaaaccttcatttatcattgattccaaccaaaaagtatacaaccacttagctggcaaat

SEQ ID NO: 6681 - DNA, 2265 bp, Bacillus clausii
  misc_feature (1)...(2265): n = A,T,C or G
aaccgtcgggagagagtacgcctaccagtttgcgaaagaacgcacagatgagattatccgtgaagtaaaaaaacgggctaatgctgctttggaaaaagcacaaactggcttgcgaaaaacagatgaggcggcgttggaaaaaggcaaggctgaacttgaacagcntcaacgcttgaaaccacttgtcgaaaaatgggtacaccttaacgaaacatatgcgcatcaagcggaaagccttgaaagtgctgcgaaaagagtgagcgacaacggtgcatttgaacaggcgttgcagcaggcccgaaaacagcagcagccagaagacgagcaacagacaaattgggtaaaagacatcgtcttttcagatgagacgcttttagctgcagaagagcaagcaaagccaacagagcggctgcgctttagccatgaaccaaacaaagatgttttgcgtacgctgctccgtcaatatcaagcgaacatatggggcagcgagtggcgagagcgccttgaacgtcgcctcaagcaaatggaaagacagcagttcaccatttctttgtttggtgcttttagcgctggcaaatcgagctttgccaatgcccttcttggagcggatgtcttgccaacatccccacatccaacaacggcgacgatcacacgtgtgcagcaagcaaccgcttcatttagccacggcactgtccaaattcggtataaaggctatcaagagctcgaacaagaggttgcctcgatcggcaaactattggcgctcactcttacaccagaaacattaacatcgtttaggctggcaggtgtcaaaactgaaacagctgncaagaagcaagcgctgcctatttacagacgcttgctgctagcttgaagcaaagagaaatgttgttatcgacaacagctactgtcccattaacagagcttgagtgaacttgttgctaatgaagctcatgcctgtttaattgccgatgtctgtatttactacgattgtcttttgacaacgcaagggctgacgctcgttgatacacctggcgtcaattccattcatggccgtcatacaaatgtcgcttatgaacaagtaaggcgttctgatgcaattttttatgtaacatactacaaccattccttttctaaaactgatgctcgctttattgaacaacttggcaaaattaataaacaattcacaagcaacaagctttacttcgttttaaatgcggttgatttagccgctaatcaaagcgagcgaaaaggggtggaggcgtatgtgttacgttcgttgcaaagcgcaggggtagaaaatgctgctttgtacccactatcgagcaaaatcgccttggccgaaaagcaagtaggtgagcctgtaactggattgtttgctgcatttgaaaatgaattgtacggaggaatgctccaaacgtttaaacagctgaatgtcgacattctttatgaagaagtcgcagcatatagccgctatttacaacaaatggctacttatgcaaaagcgggagcagggagccaaaaacagcataaagacgaaatgagcgaatcgcttgcgcaaatgtacgatgcgttttgccgggaagcaggggaaccacttaaacagcggctccagcaagaagctagcgaattgtttctttatttgcgcgaacggatgcaatacatgttgcgtgatgggtttggcgaacatgtaaatgtagcgactgtacagggaacgaccaaaaaagcacagcgtgaatcactagcaaaagcgttgcgcgagtggggagaagacagcagttcgtttcttgcccaagaagcgagggccactgccgttcgtttgacgctatcgtttaaacgccattatagacgctggctgaaagagtgggagcaggcgattcagcaagcttatgaagcattttatttggaagagcaagaaacaattccgtttgctcttcaagtggaaccggctgatattcgatttgatgctgagcgacatgcaaagaacttccaatcgcttaaatcgctgtttgaaggcggagaattggacaatgtaaaagaacaagcggcagcagaactagctgcttcagctgttgtttatgtacgcgatgaggaagcacgttgcaaggaagcgatcacccaagcggtacagacggcctttatgacagagaaagctcggatggaaagcgcgattgcattacaattgcaacgccttgaaaccgttagtagccgggagtttgcaaagcaaatggaacaagaaaacaccgcattacaaaactggctcgaaca

SEQ ID NO: 6682 - DNA, 1031 bp, Bacillus clausii
  misc_feature (1)...(1031): n = A,T,C or G
aggaattggtaaacgaaccggtaacggaaacaggcttagcgccgaaacaagttaggcaagttgtcgagttgttaaaggaaggcaatacggtcccttttattgctcgataccggaaagaacaaacaggcggtcttgacgaattgcaaatcaaagcaatcgccgatgcgcatgaatatgctgaaaacgtcatgcaacggcgggaagaagtgctacgcctcattgatgagcaaggcaaattgacagccgaattaaaggcgcaaattaaagcggctcgaaagctgcaaacattagaagacttataccggccatataaacaaaagcggcgcactcgggcaaccgcagcaaaagaaaaagggcttgagccattggcgcaagaaataatgtctttcccgagagaatttccgctagaaacagcgacaacgccctttatcaatcaagaattaggagtgccagacagtgaaacggcaatcgctggcgcgaaagatatactagcagagatgtttgccgaagacccagaagtgcggtcaaggctccgtgaacgggctttaaagcaagcgacagttgaaacaagccgaaaaaatggcggcgcagaagatgaaaaaagcgtctacgccctttattatgattttcaagagcctattaaaaaaatggtgcctcaccggacactcgccgttaaccgcggtgagcgagaagaggtattgcgcgttcacgtacgcttcccaagcgatgcctttatcgaccaaatcaaacgcctcatcatcaaaaagcatggttcacctgttgttcccattgtcgaagaggcgattgaagatgcatacaagcgtttggttgagccttcantagaaagggaagtacgggcatttttgactgaaaaagcggaagagcaggcgatcacgattttcgcagaaaatgtaaagcaactgctcttgcagccgccgatgaaaggcaaagtcgtgttaggcatcgatccagcttttcggacaggctgcaaatgggcggttgtagangctacaggcaaagcacttgaagta

SEQ ID NO: 6683 - DNA, 981 bp, Bacillus clausii
  misc_feature (1)...(981): n = A,T,C or G
gagagttggccagcaaatggcatgtcccagatggaagcgtccaaacaatgagcggcggggaacaaacacgtaaaaaaattgcggcagctttagcatccgatccgcatatttttattgccgatgagccaacgagccatttggacatcgatggaatcgagcaactagagaaagagctaacggcttttaatggtgcagtgctgttaacttcccatgataaagtattggttaataaagtgtgtacgacgatttgggaactggaagatggctgcctcactgtatatgagggaaattacgatcattatcttaagcaaaaacaggccaacaagcaaaaagcacacaaagaatacgaagcatttgtccaagaaaagaacaggctggagcaggcagccaaacagatccaagcaaagtctgcgaaaattaagaaagcaccgagcaggatgggcaattcagaagcacggttgcataaacggagttcaggtgttcagaaagcaaagctaaaccgcgctgctgaagcaatgcggacgagaatcgagcagcttgaagtgaaagaaaagccgaaggaggttgagccgattcgttttgatatggcacaatttcctattcttcatagcaaacgagcggtccaattccaaggctgccctgtacaaatcggcgccaacattctaaaagcaaacgttcatggagaagtgccgacaggggctaggttggcgattattggaccgaacggatcgggaaaaacaacgcttgcccggcaaattgctgaccgcagcggcggcttgtatgtagcagcaccagctaagatcggatttttccaacagcagcaagaaaacttgcacgaaggaaaaaccgttttagaaaatatgatcgaagacagcccgtatacacaaacgttcatccgcacagtcttgtcaaggttggcattttccagagacgaaatcgataagaaagcggctgtgttgagcgncggtgagcgagtacggg

SEQ ID NO: 6684 - DNA, 693 bp, Bacillus clausii
  misc_feature (1)...(693): n = A,T,C or G
ggaacgctcactggctacgttggaacagcagatggccgatccagacgcgatagagcaaaacaattaccaaaaactgcttgctgaatacgaccagttgcagctcgcttttaaagattccggtggctaccaatacgaagcggatatccgcagtgtgctagctggactccattttcatcattttgattacagcacagccatttctactctcagcggcgggcagaaaacaaggcttgctttagccaaactgctcctttcaaaaccagacattctcgtcctcgatgaaccaacgaaccatctagatatggaaacattgtcttggctcgaacagtatttggctaattactctggggcaattttagtcgtatcccatgaccgttattttctggacaaacttgtaacgaagacagtggaattatcgcgggggaaaacgacaacctttcacgggaattatagccattacctcgacgaaaaagcaaaacggtaccaacaagcagtcnaacaatacgagaaacagcaagaggaagtcgccaaactagaaacatttgttgccaaaaacattgccgtgcttcaactacgaaacgagcgccaagccgaagaaagcaactcgaaaaaatcgacatgatcgatcgccctgatggcgaaaaatcggttgttttttcgtttaaccttcaacnagccaacaggaaatgacgt

SEQ ID NO: 6685 - DNA, 626 bp, Bacillus clausii
atgcgcggttttatttttgatatggatggcgtcatcattgacagcgagccgctccatttccaagtagagcaagatttgtgtaagaaatacggcgttgagctggcggaaaaagaattagaatcctatgtaggcacccgcgcgagggatatgtggcagcaaatcaagaaaacacacggtgccacgtttgaagtatctgccgtgctgaacgaggccaatgagcgaaagcaagcctatgtggtcagcggggaagtcgaaccgatccctggcattaaagaactgcttgccgctttaaaaaataacgggtaccgcattggtttagcgtcttcgtcgccacggccgttcattgaagcggtgcttaacggttttggcatcagcgactattttgatgttgtcatgagcggagaggaagtcgctaacgggaagcctgcacctgacatttatagggaaacagccgaaaaactgggcgttcaaccggatgcttgcacggtattagaagacgctgcacatggcgtgcaggctgccttggccgcaggaatgcgcgccattggctttgtgaacccaaattcaggcagccaagacttaagtgcagcacacgaccaagtaaacgagatacggcaaattcaacc

SEQ ID NO: 6686 - DNA, 841 bp, Bacillus clausii
gtgaatacgttttttcgaggggttctcgtgctgagcgctgcggcgtttgtaggggaatgtttggagtttatgatcaacgttgtattggcaagagagctcggcgatgaagcgttcggtttgtacatggcgatcttgccaacaatgctatttgttgtcgtccttgcaagcattgaattacccgtttctgtatctaagttaattgccgagaaagaacctgtttaccattggcatgtactcggcaaagcgctgcagctcgcgttcgtttgtgctcttgccgtcatgattggtgccttgattgtattgccccatttaagtgctcttcattcttatcatgcaggcgtcagatggatgttggtgctgctcgtaccaatcattacgttttcgtcagtggcaagagggtatttgatgggcgcccaggaaacagggaaaattgctgtggccaatttattgaagcggtcgacgcaattagctggtttgctcattgtgtttaaattgttttcctttgaaagcaacatcgctatttttatggcgttgctagcattaaaattaagcgaactgtttgtgttaatttatttggttattgtatttataggcaaaatacgagagacgaaaaaagcacatgtccagaaaaaagggcccaaaaaagaggtttatcaaaaactgttgcaagtgtcattgccaacaacaggtttgcgcatttttcactccgctacatttgcgattaaaccttttttaattacgaaagcattgtccaatgcaggcatgatcgaaagcgtggccatggtccagtatgggaaattgtctggcattgcctttacaatcggctttttttccagctttt

SEQ ID NO: 6687 - DNA, 477 bp, Bacillus clausii
  misc_feature (1)...(477): n = A,T,C or G
ggatgttaaaggagtattaggaagctgcattgtggaatatccagggacgattttatttgtttccccatgaccgtactttattattcgcctagcgacgcggatcatcgaattggatcaagggggcacaaatgtttatttaggcaattacaatgactaccttgaaaagaaacggcaaaatgccgagcgtgctgccttaaaaaaagaagaaaccntaaataagcaggccggtgaaacagatagaaattcgtttcagcttgataaagaggcgaaacggcaagagcggcaaaaaaagcggcggattgaagcaatcgaaacagaaatggaacaaattgaagcgtccatttccgctcttcaccaacaanttgctgacccagacgtttataccgatcatcaaaaagcgcaaacgatccaagccgaactcgagcaacaaaacaacgctttcgaagcgttaatggaagaatgggaaactctttcgac

SEQ ID NO: 6688 - DNA, 447 bp, Bacillus clausii
ttgtatttgcgacacaaaccgttgccggcttgattgagcaacagcttcttgggattgaccaagggtctgaaaatactgcgcaactggttcaagtcgcacaagattttttgccttttattcttgttgtggcgattcttggcccgattattgaggaactcgtttttcgaaaagccatttttggctggatttatgtccgcaccaatttttttgttgcggcgctcataagctcgattatttttgctgtcatccactttgattttcaacatattttgatatatgctgctatgggtttttcgtttgccttcttatacgtaaaaacgaaacggattattgtacctattatctcccatatggcgatcaacagttttgtcgtcattgtccaagtcgtgtttgctgagcaactaacggagattatggagcaatacgagcagcagtcatcctttatcc

SEQ ID NO: 6689 - DNA, 933 bp, Bacillus clausii
tgaagtatatgatcatcggcggcgatgcagctggaatgagcgcagccatgcagctcgttcgtaaagatgcacaggccgatattactgtattggaaaaaggcgaacattattcgtacgcccagtgtggcttgccctactggatcggcggcgaaattgaatcagatcgcaaacttatcgcccgtgatgccgatacgtatcgcctgaaacacggtatcgatgcccgcattaaccatgaggtaaaggcggttgatacgaaacaaaaaacggtttccggggatggtttttgccttccttacgacaaactgttaattgcctcaggtgcgagccctttcattccagactgggaaaaccgcgatttaaaaggaatttatacgttaaaaaccattccagatgctaaaaaaataattgctgccctcggtacggaaaagaaaaccgtaaccgtaatcggcggcggttcgattgggctggaagtggctgaaaatctcgctaaagcgaaccaccatgtgaggattttggaacgggccaagcggctagcgatgaattttgataaggaaatggcggattatattcatgagaaagccattgatgaaggaatagagcttgagttgaaccacgaaatcattggctttagcggcaacaaagacggccatgtcactggcatccgcaccaacttgactgaatgtcccactgacatcgtcattgtcgctgtcggcgttcgcccaaataccgactttttgcgagacaccgatgttcacctcaacaacaacggcgccattcgtgtaaaccgctatatggaaacaaacgtgcctgacgtttatgcagcaggcgattgtgcaacgcagtaccaccgtctgatcaacaaagacatgtattaccctcttggtacgcatgccaataagcaagggcggatcgccggcctgaccatgtgcggga

SEQ ID NO: 6690 - DNA, 324 bp, Bacillus clausii
  misc_feature (1)...(324): n = A,T,C or G
gcatttnatggcctacatttgatgaccaagaagtcggattacgccttgctgcaacaggtgcaattaaagatgaattgctagactacggcgacgtggctgcctatgcgcttcgctacttancnnctgagtacccagatttgctccaagccgctatggcatcgtaacgaagcagcgaagaggacgatgacatcgtcccttcgtttgaagcgatcggaaaaaaacggggttgcatcgttcgtggaggccttgtcgattttgataaaacagctgaattgatcttgcgcgagctgcgtagcggcacaattggaaaagtgacgctggaaa

SEQ ID NO: 6691 - DNA, 465 bp, Bacillus clausii
ttgctgacgatccgccgcttttgtccattgctgtaggcaggcgtgaggggcaaatgaaagatacggcgcgtaatgcggtggccatggaagaaatggtgattcatgtcgtcagtgaaaaaatcgtcgccgatatgaatgagacagcagcaacgcttgcgccagatgagagtgagctggaacggacgtcttttcatttgacggaaagtgttacggtctcagtgccggcaattaaggaagcccgtattcgatttgagtgcaagctcgaattccacttgccgaccaaaaacgatgcgggggagctttcatttgatttgcttattgctcgtgtcttggctatgcatattgcagaggacgttgtcgatcaagaagcgaatggcgtcgacatggacgctcttcaacctgttgcccgattagcgggaccgaactatgcagggctaggcgcacgttatttccttaagcggccaa

SEQ ID NO: 6692 - DNA, 219 bp, Bacillus clausii
aagggcatgccctctatgacccaaaagcaaacgtgcggacagagatgacaaaagccgaatatcggagtggacaggggtcagcgattcaccatttttatgagaaactgcttttgttgaaagaccggatgaatacacatacaggtaagaaattggctgaatctcgccacgcgtttatggaacagtttttaaaacgcttttatgcagaatgggatggaaacg

SEQ ID NO: 6693 - DNA, 489 bp, Bacillus clausii
atgaaagttgtcaatcatgcgacgaaatacgaacgattaaaacattttttgaatgctttaaatgaaccgacgtaccggtataaacagattacagaagcgatttttaaacaccgtattggtgagtttgaaaaaatgaccacattgccaaaagcactgagggaagcgctcttaaacgaatttggaccttctattcttacagtggagccagtgctagaaacaacgtctcaacaagtcactaaagtgttgctaaaagtagcgggaaacaaccaagtggaagcagtaagaatgcattatgaagcagggtgggagtcgttttgcatttcttctcaatgtggctgtgggttagggtgtacgttttgttcgacaggggccattgggttaaaacaaaacttatcagcagacgagattacagaccagttgctctatttttatctaaaggggcattccttagatagtgtctcttttatgggcatgggccgaaagcgctag

SEQ ID NO: 6694 - DNA, 480 bp, Bacillus clausii
gtgttatttgctattattgcctgcttactcgcttcgtttttcttctctggaagtgagactgcactcactgcggcgaataagatgaaaattcaatcaagagcttcaacaggagatagaaactcacaaaaactacttcatcttatctcaaaacccgatcaatttattacaacgattttgattggtaataacattacaaatattctattgccaacacttgttacaatgattgcgattgattacggcattagtgtcgctttagctactgctatattgactgtcgctatcattgtctttgctgaagtattgccaaaatcaattgctgcatcgtttcctgataaaatcgcttatttcgtttccccagttataccgtgcattaatgattcttcttaagccaattacttacttgcttaacttagggaacaggcgcccttatccaactcctttctaaaagccagccaaaagaaaaatcgttttcaaaag

SEQ ID NO: 6695 - DNA, 390 bp, Bacillus clausii
  misc_feature (1)...(390): n = A,T,C or G
gaatattcttatcattagcgacagcnatgggtggaccgatcagttaaagacgattataggccgccacgaacatgaggtggaccaagtcatacatgtcggtgattcagaacttcctgaacacgcgccagaactggctggggttaacgtggttgctggctattgcgatgtgttctcttcttttccaaatgaggtagtatgccaatgggaaggaacaaccgcttatatcgcccacgnccatcatcatggcgttanacagacgcttgcgaaactaatcggccgtgcaaaagaaaaaggcgcacgnatcgccatnnacggccatagccatattgcccgggccgcagagcatgatggtgtcatcctcatncatcccgggagtgttcgcctaccaaa

SEQ ID NO: 6696 - DNA, 892 bp, Bacillus clausii
gtgaatgtagatgccgtgtttgcagaaggcggcgttaaagcgtttgcctttgtaggggcagttgaagcagcggaagaacgcaagctttcttttacacggattgccggtacaagcgcaggtgcaattatagcagcgctgcttatggctggctatacgagtaaagagctgcatcggctgttagatcagcttgatgtcgtaaaaatgaaagatgaacggatgtcgtttttgcctttacctgttgccaagtggatcaatctttactttcgcctcggtttatataaaggcgatcagttggaagcatggcttcaagacgttttggcggaaaaaggcatccgtcgttttgctgatcttccgagcggctcattgcgggtaattgtttccgacattacccaaggacgaatggttgtgctcccagatgatttgcctaaatataaatatgaccccggcgcctttagcgtagcaaaggccattcgcatgagctgtagcattccgtatttttttgagccggtaaagctaaatgacagatcggtgaaaaaaaagctgttttatatggtcgatggtgggttgctaagcaattttccgatgtggctatttaaagacggcagccaaggaggttggaggcggccggtgattggctttcaattagcgccacggcttgacgagcggccgccagcggtaatcaacaatgccgttgacatgtacaaagcgctgttcgaaacgatgacaagcgcccatgatattcgctatattagtgaaaagcatgcgaaaaatgtcgtctttatcccggtcgaggacatcaaatcaaccgacttttcgctaacgacagaagaaaaacagcatatggtccaactcggtcgagaaaaaacaactgcctttctatcgacatggacac

SEQ ID NO: 6697 - DNA, 906 bp, Bacillus clausii
atgtcagaagacgcctttatgacaaaacgcaatggaggagaaaaaagcttggtttctatcatccaagccgagagtgaagagggcaattgtcaccagtcattacccccaattggacgagagcccagtaaacaaacgttgtccacttaccctatcttggccgatatactcggcttaaagccagatgaattgctattagaaacgaaaaaaccagtcgatgattgggtttccttcattctggaagagattaggaaggcgatccgtcgtgatgactttgcagcagtgaaagcacttatcgtaaagcactttaataacccagcttttcagtcacctaaactacggcagtttctcctttggcatcaagctattattgtttactatgtagaccacaatcaacacaaagcgatgcaattgctcaacagtgcgctaaacgctacaggatatgcgactaaatcaacgcctagcgcccaggagctagggattcttatcagtttagcagtcctccattctgaagaaggcaacaatgaccaagcaataagcctttttaaacaagccttaaaaaaaacaacttgtccaaaaactgtccatacaaacctcgccctctatttgcgtatctatgaccatttggtacagttgttgtatgaaagcaacgatttccatcaagcgattgaatatgcagaaaaaggactgaagctcacaagtgaggacgactatttgcctattaaaggagaacttcattacacgcgcggcaaatcgtttcatcaccttagccaacaagaagaagcgctagtagattttcaaagatcctttacactctttcaaaccattggccttaaaagtaaggccgaaatggtccaaaaacagttagcacttcttcaagaagggaagaaactgccttttcactgttaa

SEQ ID NO: 6698 - DNA, 759 bp, Bacillus clausii
  misc_feature (1)...(759): n = A,T,C or G
gacagtaagaattggcattattggttgcggaggcattgccaatggcaaacaaatgccgagtttggctaaagtgaaaggcgtcgaaatggtggcgttttgtgacattattaaagaaagggcagagaaagcggcggaaacgtacggcagcgaaggcgcgaatgtgtataccgattacaccgagctattgaaggattcgtcgattgaagtcatccatgtgtgtacgcctaataagtcccatgcgccgattagcattgcagcgatggaagcaggcaagcatgtgctgtgcgaaaagccaatggcgaaaacggccgctgaagcacggcaaatggtggagacagcaaagcgcacaggcaaaaagctaacaatcggctatgacaaccgttaccgcaatgactccctttatnngaaggagctngnggaacaaggcgaactaggcgacatntactttgcgaaagcacatgccgtgcggcgtcgtgcggtaccgacgtggggcgtctttttaaacgaggaagaacaagggggcggcccgntaattgacatcggtacccatgccctagatttaacgttatggacgatgaataactacaacgttaaaagcgttgtcggcaatgtttactacaagctgtcgaatacagaaaatgcggccaatgcttttggcccgtgggatccaaaagagtttactgtcgaagattcngcatttgcgttnattacgatggaaaatggcgcaacgattacattggaggcaagctgggcccttaa

SEQ ID NO: 6699 - DNA, 1121 bp, Bacillus clausii
cttgtgtatattccactcgtttctttttatcgttcttccctttagttcctctctctgttttcgtttgtatggcttcctgagcaagtgaatctgtttattgtattgctcgaatcgcttttgacgtttgttcatcctgcaattcttaagctaagtggatctacttttcagcttgtgcttgggaaacctccgatatggcttgtagttgcgatgtatgtcgccctagcttttgcttttgtccattggcaggaacaaaaatggcctttgcggttcgcctttttgccttttgttgtatgtttgatcgttggtgctttagcgccttatgttcagtcaaaagcagttgtgacgatgattgatgtcggccaaggcgatagttttttgattgagcttccttaccgaaaaggggtttatatgatcgacactgggggagtggcagtttatggcgaggaagaagactggcaacaacggaaaaacacgtttgacccaggaagtgatgtgattgctccttttttaaaagcgaaaggcatcagcaaaatagacatgcttgttttaacacatggcgattacgaccatattggcggggcaacttggattgttgaatgaaatcaaatgttgaacaggttatttattccggaagggccaattgaaaaaggagactgaaatcgagctcccttgaaaaacattgatgcatcgccaacgaatttccattttacgaaagcaaacgaggtgcttgctgagaattggtatgtgtggcatccgccagagggagaacatgttaaaggaaatgacggttctgtcgtgttatttgctaaaattgaaggggtaacgtttttattcactggagatttggaagaggcaggagaacagaggcttattcgctcgtatcccggcatgcaggcggatgtgctaaaagttggccatcatggcagtttatcgtctacgacagaaccgtttattagccaagtggcgccgcgctatgcattcatctcggcaggggcacaaaaccgctttggccaccctcaccctgaagtggttgagcggctagaaagggcgaatatcgtcgtgtggcgaacagacatacatggaatggttgaacttacgcttagcaatggagaaattgaggc

SEQ ID NO: 6700 - DNA, 273 bp, Bacillus clausii
  misc_feature (1)...(273): n = A,T,C or G
ttttctnttccccgttgcgcttggcggggcagctaacacgacaagcgttgacnttgccaacaggagccgtccgaaaacagaagaacaatttttaattaatggcattgccgttgaagatcagcatnttgtcgtcatggacgcatttcgctatctatcctacgctgaaaaaaatcggcttgagtttgatttggtagtccttgacccgcctagctttgcccgttcaaaaaaacggacattcagngccggcanaagactacacgcttttgttggaga

SEQ ID NO: 6701 - DNA, 582 bp, Bacillus clausii
ttggcgctaatggagaggggaagtcgacgctattaaagctgattttaggggagatcgagcctgatacaggacaatgcaaaataggggctagtgtttcattaggctatttgtcccagcatggcacagaacttgatccaaagcagacggtgctcgaagcattccgcgccagtgcgcttttagcagatggcgaagcccgaggccagttagcgcggtttttgttttatgggcaagacgtttttaagcgtgtctgcgatttaagtggaggcgaaaaaatgcggctgcggctagcacagttgattttcgaaaagcataatgtgctcgtgttggatgaaccgactaaccatctcgatatagactcaaaagaagtgcttgaagaggcattggctgattttgcaggcacgatcatcgcagtatcacatgaccgttattttttgaacaaactttttcctgtcacctattggcttgaaaatggagctgtcactcgttatgaaggctcgttttcatacgcctgggcaaaacgaaaaaaacacgagcaataagcagccaaagcaaaagcgccagacaaaggggaaatgcccatcg

SEQ ID NO: 6702 - DNA, 201 bp, Bacillus clausii
ttcaaggtccgccccgctattggaccaccgattggacagcggcacatcgctccgtccaaaagctccggtcattagatccagccgttctcgttcctggccatggattgcctcttttcggccaagagctccgcgacagccttgccgtccttgaccagcaatttgaacgcatcgctgtccctgattatgggaagtatgtgcaga

SEQ ID NO: 6703 - DNA, 264 bp, Bacillus clausii
cgatacaaaaaaacaattgtttgctttaagccggattggcttaacagacaaagaaaagcgccggatattggataaacaaatgggtttccttttctttgtacctgtgcttgtcggcagtgtccatgccagctttgcctacgtgatgctcagcaacatgctcgatgtcaaccttgtattaaacgcgatcttggtcatttccatttatgctgccttgcaattgatttactttttgatcacgagactgctttacttccgtgccgctct

SEQ ID NO: 6704 - DNA, 690 bp, Bacillus clausii
  misc_feature (1)...(690): n = A,T,C or G
ttacggttagtgataaagtagctgttcgattaaaaaggggatacccccttttccataaagatgattttcacttgcctgctgacgtccgcgaggggatgattcttcgcgttacagatggtggcggccgttttttggcgcgtggctattacggaaaacagaatgtcggccaaggctgggtgctttccactaacaaaaatgagccgattgacgcccgtttttttaaggggaaaattgaaacggctttaaacaaaagggctgggctttttgtcnatgaagaaacaaccgcattccgtgttttaaatggggaaggagacggaatcggcggacttacgattgactattatgaaaggttttttgtattaacgtggtacagcaaaggcatttattcatttcgcagccaaattcttgaagcgcttactgcgtgtacggcctacaaaggcatctatgaaaaagaaacgttttgctantgaaagccaatatgtccaaaaatgacaaattcctttgttgcgaacgaggccagttccctttgcttgttaaagaaaatggcatgtatttcgctgtttatttaaatgatggaccgatgacgggtattttttttcgaccagcgccacgtaagaaaacggattngtgaccaatacgcgcctggagcacggatgttaaaccttttttcctatacaggtgctttttctn

SEQ ID NO: 6705 - DNA, 228 bp, Bacillus clausii
  misc_feature (1)...(228): n = A,T,C or G
cgcttggcggggcagctaacacgacaagcgttgacnttgccaacaggagccgtccgaaaacagaagaacaatttttaattaatggcattgccgttgaagatcagcatnttgtcgtcatggacgcatttcgctatctatcctacgctgaaaaaaatcggcttgagtttgatttggtagtccttgacccgcctagctttgcccgttcaaaaaaacggacattcagngccg

SEQ ID NO: 6706 - DNA, 663 bp, Bacillus clausii
atgaaaaagaaaggcgcatatgcagtcatttttgatatggacggtgtgattgtcgacagtgagcctgtttatcgcttgtggaatcaagagttatatcggcaattaaagatttctgttcctgaggaaatcaaattgcaattgattggtggcagcataaaacggaaatggcaattgattaaagagcattgtgggctttcccaaacggtagaagaactaattcaataccagtacgaatcctttcaaggaaaagaatgctgcttcaaggacattcaatttcccgctgtccggcctttaatcgaaagccttaaaagcaatggggtccgtatagcattggcatcttcgtccgacagagagagaatcaaccgagtagtaaccgattgtggattggcgcatctattcgatgtggttgtaagcggagaggaatttgcggatagtaagccggacccagagattttcctgcagacggcgaaaaggctcggccaagctccagcacaatgtattgtcattgaagattcaacgaatggcttactagcagcaacccgggcagggatgaaaaaagttggcgtaaagcatccatctatcccgatggatttatcgctggcagatatcacaatcgattcattggaacagttaagccctaccatattaggagagatggtgtaa

SEQ ID NO: 6707 - DNA, 594 bp, Bacillus clausii
  misc_feature (1)...(594): n = A,T,C or G
aagcaacacaacgattaaggcaggaaacatctgaancggatcgcagcctgttctcattcgcgaaggggagctaattgtaaaacaagggggacatcgacaaccaccaagtttacgaacagctccgccttgtcggcttgctcgatgattcattaatcatttatccctacatagggttagccctatttgttttcattctgatcgcggtttnagcctattttttaaacgattcgcaaacgaccgttgccactgacaactcccatttgctcatgtatgcgatcgtctttaccgtgattgtggcatnaatgaaaacatcgagttacttagagagcctattgatgataaacggatttgggtttgttgtcccagctgcagcaggggcaatgctccttacgttattgttgcagccaaaaatcgcgatngtntctagctttttgtttgcgattattggcagcgtttattacaatcacgattctacgagcacattttcatttacgtatggtttctatatatttataagctgtttaacggctacctactttttaaatagtaccaacaaaactacgccgatttgccgggccggtccgtttgttgctt

SEQ ID NO: 6708 - DNA, 396 bp, Bacillus clausii
tcttgccaaaaatcgcagcaaaaacatctgtggcgatgcctcttgtctctgtgcttgccattctcgcgatcttatcagcagtggttgccgccaacactggcagcttgatccaagcaggcttgattagctttgttgccgtgatgctccataatgccgccggcctcgcactaggctttatagcagctctcgctttccgtttgccggctagccagcgtcgtgcgatttcaattgaagttggcatgcaaaattccggtctaagcgtcgccttagcaactgcccattttacaccattggctgccataccaagtgtactcgccgctgcttggcacaacatttctgggcctatccttgccacatactggtcaaaacggccactgccaccagaggccacatcac

SEQ ID NO: 6709 - DNA, 197 bp, Bacillus clausii
tctgattctgcgactgcaattggttgcgtaaaaaagaaaaaagccaattctacattaagccggacaaaagaaacggaagaaatttggtcgcttgtagaacgagcggagaaatggctgcgcgaaaaccctaaccataatccagtgttaaagtgggaaacggatgtgtggggagaaataaaagccgattatggccgaaa

SEQ ID NO: 6710 - DNA, 512 bp, Bacillus clausii
  misc_feature (1)...(512): n = A,T,C or G
atggttgatttacaagtgcgctcatcgcagcgggcaggcatgaatattcattattggaaaacggacaaatttaaaaccgttacatttttactaatggctaaagcgccattgaatgaacgtacattgacagtaagagcacttataccttctattttgcaaagtggcactaaaaactatagcaatcgcaaacaacttaggcgcaaacttgatgatatgtatggagcgattttaacgggcgatgttcaaaaaaaaggcgagcagcatgtgcttagctttcgcatggaaatagccagtgagcggtttttgacaggccaacagccattattgaaagaagcgctttccctttttaaagaagttgtttttgagccaagactagaagatggggctttcgcgaaagcgattgttgagcaagaaaaacgtgccttgtcacagcggattgcancgatttatgacgacnaaatgcgttatgccaacgttcggatcacagaggaaatgttcaaaggcgaaacgtt

SEQ ID NO: 6711 - DNA, 660 bp, Bacillus clausii
  misc_feature (1)...(660): n = A,T,C or G
ccgtttcgctattgccgagtttaagtgaagcagcagcaaatagacaaaaagtccttattcaccaccgtttanaacaagctttacgaatggggcttttgtcaggaggcatttgcgttgtcgttctttatgtattcgctagtgaattgacagtgctcatgtacaacgcgccacacgcagcctcgctattgcaagtaatggcaccgtttgctctctttttgtacttgcaaggcccccttgctgctgctctgcaagcattggattacgccaaagcttccatggttaatagttttattggcgccatcgttaaaacgcttgcgattttcgctttagcttctagtccgagctttggcataatgggagcagctttggctattgtaactggttttgtactcgtaacattgctccacatcgctacactcgccaagacgacaggatttgtgatccacgctgtgccaatgttgaaactagcgctgctcatcgtcgtaactggctatgcaggcatgcaaatagacacctatttattcaacggattgccttacgcagcaaaagcgctcgtaagcatcgccataacttgcatgatctatgtatttggcattcttgcctttaagctccttagcaaagaggaactaaaacgccttccattcatcaaaaagtttatgt

SEQ ID NO: 6712 - DNA, 473 bp, Bacillus clausii
atgattgatgtggaattaaatgatgaagggcagtttctttcaagcgagcaattgcaactagttaaggacgtcctaaaccatgctgcgaaagaagtgagcttgttgcagcaaagtgaggtgtcggtgacatttactaccgaagaggacattcacgagttaaaccgtgaacatcgagggattgaccgcccgacggatgtactgtcatttgccttaaatgatgagacaggcgaattcgatccaacctttcatgaggatcttggcttacctaatttgttaggggacatggtcatttcagtcccccatgtcgagaggcaggctgctgactatggccattcgtttgaacgggaacttgctttccttgttgtccatggctttcttcatttgcttggctacgaccatatgaacaaggaagaggaaaagcaaatgttcactaaacaagaggagattttacaatcctatgggcttgggagatc

SEQ ID NO: 6713 - DNA, 194 bp, Bacillus clausii
gtgacgtcaatcatttcgattgcggacagtgtagaagcggcagttcgttctatgcaaaagccgacccctgataaaattgaaaatctggttgataaaattattaaagataagctggaagatgggcaattcgacgagtctgatctgacgctagccgaattaaacgccattaaagtttcccttatgtgaaacgttaa

SEQ ID NO: 6714 - DNA, 447 bp, Bacillus clausii
ggttgctaataagatggacatgccagaagcaaatgaaaaccttaagcgatttaaagaggcacttggcgaggaaacgaaaatttttccagtttcggcgatcacgaaagacggtgtccgtgaattgatgctagcgattgctgatgaattggagcatgcgccagagtttccattgcatgacagcgaagagcaagtagaggcaagagtgctttataaacatgaattgccaattgagccgtttacaatcacccgtggagacgatggcgtgtttgaattatcgggagctgaactggagcgtgcctttaaaatgactgattttgctagggaagaatctgtacgccgctttgcccggaggatgaggaaaatgggcgttgatgaagcgttgcggaagcgaggcgcaaaagacggcgacctagtccggattatgaaatttgaattcgagtttgtcga

SEQ ID NO: 6715 - DNA, 622 bp, Bacillus clausii
atgcttaattggattgttcggattttctttttattagcgggaggaacattagggttcttgtttgtcccctgaattcattgcagtgatagcgctagaagtaccggcatggttggctagtccttataccaggggcagtactcggtgctttgctcttatatggtctgtccttgtttattgtcgatcttattgttaatttctttcgggttgtcgaggaaacaattgtccaaagcgccgcttgctgatgtgttgtcctgatcaatgggcttaacggtcggactcgtggctggttattttctcggaacgccgttaagtggattggatttgccggttatcagcaatattttgcctatgtttattacgatttttctcggtcatctaggcttcccaatcggctttcaaaaaacaagttgagctatttccattaagttgtctcctatgcgagtgccaagagataaagagcgtgacaaaaagaaagaagagactgactctaatctcggcggcaaacaaatgaaaattcttgatacaagcgtcattattgatgggcggattgctgatatttgccaaaccggctttctagaaggcacgcttgtcatccctggattcgtgttagatgaattacagc

SEQ ID NO: 6716 - DNA, 552 bp, Bacillus clausii
  misc_feature (1)...(552): n = A,T,C or G
ttactgttcaagatataagacgcgatgcacaagtcgttgagaaaaacggcgatgtcgtcgttattttgaataaaagcaatcaanaaattgctggcataaacgtattccacgcctcttcttatggagccattagcggagttggtgcgatagagctcgatgaaggcattaaagcgctcctaaaagaagcgtgcgacaaaaatggtgtcgctcttgaaatggaatgggagcagaaacctgcttttgttgtcggttatgtagaacaaaaagagaagcaccctaatgcagacaagctttctgtatgccgtgtaaacatcggcactgatacattgcaaattgtttgcggtgccccgaatgtggcccaaggccagaaagtagttgtcgcgctcgttggtgccgttatgccaagcgggcttgtcattaaggaagcaacgctgcgtggtgtcgcgtcttccggtatgatttgctcagcaaaagaattagggctcgaaaatgccccggcagaaaaaggcattcttgttttgagtgacgatgaagtggtcggcacaccctttt

SEQ ID NO: 6717 - DNA, 480 bp, Bacillus clausii
aaaggacgcgaagctccagcagcaacaagcccaattttttccgccttttgtcattgtgaccgatgaagcgcacaattttgccccgaaaggctttgatgcgccagccaagtcagtgttaaaggaaattgcccaagaaggacggaagtatgggacgtttctaatcttcgcaacgcaacgaccaacgttgctcgatgaaacgattacggcacagctcaattcaaaatttgtttttcgtacagtgcggggaacagacattcaaacgattaaggaagaaaccgacttaacagcggaagaaggcaagcgtcttccctatttgcggtcaggcgatgtgtttgtttcatcggcgatcatcggccggacaatggcggttcggatagggttagcccattcaacgagtccccatacgatgaatccatttgatgagcttgagcaaatgaatgcagcagacgatgaagaagttatcgctgcattagcggactt

SEQ ID NO: 6718 - DNA, 1008 bp, Bacillus clausii
tcagtatgagacaaaacggggaagtgtactaacgcaattattcggaacgtgaagggacggatatgtcgctgatttcaacggtgcgagaagagtatatccttgatgaatttaaaggaattcgacaaacgatgcaaattattatgcccgttgcaggtggaataggtcttatagcgattgccggatttatgctaacgattattaagccaattactgaattaacgaaagagacaaagcggcttgaagaaggtgattttgctgcacaagtgaaagtccgttcacaagacgaaatcggccagttgggctcacgctttaataaagcagttagtcaaattcagcggttgattgacacaaaatatacgctggaaattcagaataaagaatcagaattgaaagcgctgcaaagtcacatcaaccctcattttttgtacaacacattagatatgattcggtggacagctaggcttgagaaagcatttgagactggcaaaagtattgaacatttatcaagactatttcgcattagtcttagtcagggaaagctttacattacgcttcatgatgaaatgaattacgtccaaagctatttggagttgcaaaaacggaggcttggcggccagctcacattttcagtgcggatggaggcaggcattgaacgaagtcttatcttgaagctaattttgcaaccgttagtggaaaattgtctccgtcatggatttgttgaaattaagcaaacgaatacgattcggatccgagcctatcggaatggcgactttgttgtgattgatgtacttgacaacggcatcgggcttcaggtagatgtagacgaatttaattactttttgaataccaaagataaaaatggccatggttttgctttacgcaacacgcacgaacgcttaaagaagacgtttggtggaacctgtggactattagcggtggctactaaagaaggtgctcacattcgtgtatgcattccatacgtagaaagtgaaagggagcaccggaagc

SEQ ID NO: 6719 - DNA, 697 bp, Bacillus clausii
gtgaagctaattgtcactgatatggatgggacgctacttgatgaaaaacgctctgtatcgaaagagaacgaagaagcgatcaaggcagcacaaaagcaaggcgcgattgtcgcgattgcaacagggagagatctttacgaggcaacagtccctttgaaaaaaacagggttatcattgccgatcattagtgcgaatggcgcgcaaatccatgatgaacaaaaacgacttctccatgaagccgttctaaatgcagaccaagtccgccatgcgatggcagtcttaaaagatgaaaatgtgtattttgaagtgtatacgaatgaaggcgtttattccgacgattttgaagcgggccttgccgtagtagtcgatgtcttaaaatcgacaggcgcgaaattgtctgagcaagaaatcatgacattcgccaaggatcgttttgacaacggctcaatcaaattgatcgattgttacgagaaactgctcgaagacggagccgttgtgcttaaactccttgctttttcactcaatgcagaacggcttatgagtgctagagacaggctagagttagacaaaagccttgccgtcagcgcttctgcagcagacaatcttgaaattaccgatgtgaatgcccaaaaaggcattgcagtcttgcgattagcacaatcgctaggcttttctccgaaagatgtgatggcagttg

SEQ ID NO: 6720 - DNA, 747 bp, Bacillus clausii
tttgctgtttttcctgaaattttcacgcttcagctatatcttttcttcccgagaaaagtccaagccaggcgattcgccgtttaacggagtttacagaggattatattgcactgtttccgacgcttgctgttcgctacaacgtcaatataatcggcgggtcccattacgtagaagaagaagggaaaatttataatatcagctatttgttccgccgtgatggtacgattgaaaaacaatataaactccatattaccccaaacgaacggcttttttggggaattagcggcggcgacgaagtaaaagtatttgacacagattgtggcaaaattgccattcaaatttgttatgacattgagtttccataattggcccgtattgctactgacaaaggggcgaacatcatcttttcgccattttgtacagatgaccgccaaggctatttgcgtgtccgctactgttcccaggcacgggcgattgaaaaccaaatttacaccgtcatttctggcacagtccgcaatctttctgatgtggccaatatggatatccagttttcccagtctggcattttcacgccgtctgatttcacgtttccccgcgacggcatcgtaggggagtgcagccctaatattgaaaccgtcgtagtaggagacgttgatttggaaattttgcggcgccaccgccgttctggcagcgttaatcaattacgtgaccgccgtgatgacatttatcatgtcgtttacaaacagt

SEQ ID NO: 6721 - DNA, 174 bp, Bacillus clausii
ttcttcgttccttgacctcgcctgaaaacattgccaatgaatttacacgctatgcgtttaatggcatgaatttatttgatgtcgtgccggtgcttgaatcgttagaagcatctgacttggaaacagtgctccatcaccattttaaaagcgagtaccggacggtagcgacagtca

SEQ ID NO: 6722 - DNA, 828 bp, Bacillus clausii
atatgatgcggagacaatgacagctaagctcataaacgaaaaaatgaccattgttttagcggaaattgaagcgttactggcgactgccaaacaagggaaagtgttacgggaagggctcgccaccgctatcattggcaggccgaatgttggcaagtccagtttgatgaacagcctcgtccacgaagcaaaagcgattgtgaccgatatacctggaacgacgagagacacgcttgaagagtatgtcaatgtccgcggcgttctttttcgccttattgacacagccggcattcgcgaaacggaagacattgtcgagcgaattggcgttgaacggtctcgccaagcactcaaagaagcggacttaatcttgcttgttttaaactatgcagaagagctttcaaaagaggatgaagctttgttcgaagcggttaaaggactggatgttgtcgtgatcgtcaataaaatcgaccaaacagggcggattgatatggagcgtgtccgccaactggcaggagataatccagttgtggcgacttccttcctccaggaagaaggagtcgaccaattagaagaagcaattagtcgcttgttttttgctggtggagtggaaggcgctgacttgacgtatgtgtcaaacgcccgtcatattggtttgctaaaccaagcaaaagcccatgctgaagaggcgattggtgctagtttaaccgacgttcctgttgatttgattcaaattgatgtgacacggacgtgggaattattaggcgaaattattggagaagatgtccaagatagtttaattgaccagttgttttcgcaattttgtttaggaaa

SEQ ID NO: 6723 - DNA, 759 bp, Bacillus clausii
atggaaagagtcgtgatttgcggcctgagcaacagggcgcttaagatgtttgtagaaccgcttattgctcgttttcaccaagacaatgagattgttgctttgcttgatattgacccgaaacggtatgaggtttgtttgcaaacgtatcctacacttgccaatgccacgttttaccggcccgaccaatttgaacaaatggtcaaagaaacgaacgcgacgatggccgttgtcgcaagccgcgacgatacacatgtggattacattttacgcggcttggcgttagggctcaacgtgattagcgagaagccgatggtgacaacaagcgaagatgcgaggcgtgtcctcgaagcggaaaaggcgagcaaaggaaaggtcactgtcgcgtttaactatcgttacaacccgtaccacatcaaaattaaggaattaatccaatcagggcgaattggccgtataacgtcgattgacttaaattggtatatcgatacgtaccacggatcgagttactttaaacgctggaaccgaaaccgtgctttttctggcggtttgtctgtccataagtcgacgcaccactttgacctcgttaattggtggattagccagcgcccccaagaagtgtttgcctttggcgacctgcactattacggggcaaacagcgaattaaacccacggcgggaaaatggccgccattgcgggacgtgcagcgatcagcaaaattgttcgtattacaggcgctggtttggccgcagccaatcgaac

SEQ ID NO: 6724 - DNA, 291 bp, Bacillus clausii
tgtcaactggatacgcgaacaaaaattaacaccacaggcgattttgcttacacatgctcattttgaccacattggcgcactagaagaagtcagacaagcatttgcctgtcctgtctatcttcatgacgcagaaaaacaatggcttttagaccctgtgaaaaatggttcagctcgaatgggaagagagccgattaaaacaaagcctgcagatcacttgttcaaggacgaaggcacgctgaaagtcggttctttttctttcaagctttttcatacgcctggccattctcctgg

SEQ ID NO: 6725 - DNA, 231 bp, Bacillus clausii
taagctcattggcgagcgccatcctatcgacttggcctttattccaattggcgacaactttacaatggggccagaagatgcaaaaacagcaacggaatggattgacgccagcttaactgttccaatccattacaacacttttccgccgattaaacaggatcctcatgcttttgttaatagccttcaaagcggcaaaggacgtgtcttggaagttggcgaaacgatagtatt

SEQ ID NO: 6726 - DNA, 792 bp, Bacillus clausii
  misc_feature (1)...(792): n = A,T,C or G
aattgcgaaagaatttggcgccggcctagtttgcgcggaaatggttagtgacaaagccatcttgcataaaaatgaaaaatngttacaaatgctttatgtagatgagcgagaaaagccgcttagtttgcaaatttttggtggggaaaaagatacactagtagaagcagcacgattcgtagaccaaaataccaatgccgatatcatcgacattaacatgggttgtccagtgccgaaaattacaaagtgtgatgctggagcccgatggcttctcgaccccaaaaaaatttacgaaatggtcgctgccgttgtggatgcagtcaaaaagccggtaactgtcaaaatgcggattggctgggatgaagaccatatttatgcaatcgagaatgctcgtgcagttgaacgagcgggcggaagtgcagtggccgtacatggtcgcacgcgcgttcagatgtacgagggtgtggctgattggaatattattggcgatgtgaaaaaggcagtgaacattccggttataggcaacggtgatgttgctacaccgcaagacgccaagcggatgctcgacgagtatggcgttgatggtgtgatgattggcccgtgcagctctcgggaacccgtggatgttgtaccgtacaatccaatatcttgagaatggtctcttcctccagaaccgactccacgtgagaaaattgaagtttgnttaatccattggatcgtttggttgctttaaaaggcgagcgtgttgcatgcgcgaaatgcgtaaacaacagcttggtatattaaaggattgcg

SEQ ID NO: 6727 - DNA, 320 bp, Bacillus clausii
ccataggtgtttgcgattatggcgattggcttactgcttagcggcattgtccgttcaagccagcagctaaatgccgtcattccccttgtcgcaaccgtatttgctatgattggtggcgccttctggccactagaaattgtccaatcagaaacgatgcatgccctctcatatttgagcccaattaggcatgcgctagatatgatgaaaggagccacataccaaggcgcaagcctagccgaatttttattgccgacatccgtgctgttgtttatcggattaaccgtaacaggaattggcattcggcttatggaaagaaaagc

SEQ ID NO: 6728 - DNA, 176 bp, Bacillus clausii
atgtcagttgagacgaacccactgatcggtccggataagttaaaagaacggtccgaaggaaaacaagaaccaaaatggctaacggacttgcgtctggatgcattgaataaagtcgaaagcctcgagcttcctaagccggataaaaccaaaatccacaattgggattttacgtcctt

SEQ ID NO: 6729 - DNA, 447 bp, Bacillus clausii
caatgagctgtctttaatgaaatttattcgcaaaatggacgaaaaaatggacgttctcgacatggaccaatcctttgcgcagcgttatttgaatgaaggcttttcaggcggggagaaaaagcgcaatgaaattctccaattgctaatgcttgaaccgaaaatcgccattcttgacgaaatcgactcagggcttgacatcgatgcgctaaaagttgttgcccaaggtgtcaaccaaatgcgcggcgaagagtttggctgcttgatcattacccactaccaacgccttcttgactacatcacaccagataaagtccatgtaatgatgcaaggccgcatcgttaaatccggcggctctgaacttgctgagcgtcttgaagcagaaggatatgactggattaaagaagaattgggcattgaagacgaacgcgttgatgccaaccaagaagc

SEQ ID NO: 6730 - DNA, 573 bp, Bacillus clausii
  misc_feature (1)...(573): n = A,T,C or G
gaatcgtatttataactcatgatttaagtgttgtcgctgatatcgctgaccgagttcttgtaatgcgcaccggcaaaattgtcgaagaagcgactgtgtttgatttatttgacaaaccgcaacacccttatacaattggcctgttaaaggcaatgccgacattggacacaagtttttagttcttagcccatccttggcaatcccccaggcttagccaatggattgtcagtagccaggaaaggaggaaacaaaaaatggaaccgacgagtgaattgcttctggatgtacgccatctaagcaaaacatttccattgaaaaagagcaaaacaaacaaagcaccttcctttaaagcagtggatgacgtcagtttccaagtttttaaaggagaaacattgggcattgtcggcgagtcaggcagtggaaaatcaacagtggcgaaaatgattttgcagctcttagaaccaactaacggggaaatttattttttaggncaaaaccttgccaaccagtcaaaagcggaaagcaaagcgactaaaaggcgtatgcaggcagtgttccaagacccatatgcgt

SEQ ID NO: 6731 - DNA, 1029 bp, Bacillus clausii
ttcatgcgcccgcacaaaactttgtgttcgctagcacggatggcacaatcgcgtaccgagccaatggcctaattccaatccgcgcaaacgccgatgatgcattattgccagcgcctggctgggacccggcttatgaatgggaagggtatattccttgggatgagttgccaacaatcgtcaatcctgaatcaggaatcattgccaccgctaataacaaaattgctggagatgactatccttaccacatttcccacacatgggcccaaccttaccggcaacagcgaattatggaggtgctcgcagcaaaagacaaccataccgtaaccgacatgcaagcattgcaaatggacgtcgccaatttgcaagcaaccaacttgcttcctcttctgacagaagcgttaccagctgagggactgcgcgctattgacgaggaggggttaaatgttctggcggactggaaccaatttgacgagcgcgaagaagctggaccgctattgttccatttttggatggaagaaatcgagaatctgttgtttgccgataaaattcctgctgaaatcaacgagcttttttacggccgggctggtgttgtcgatgaattgctaagacgtgcagcaactggtgaaccaggtccatgggtagaaaacgctggcggttttgaaacagtcgtccttcaaagttaccaagcggcaatagacaaagccgctcgtatacaagggaacaagccagcaaagtggcgctggggtgactttcaccaagttgaatttagccatccaatggcagcgatcacaccgttgaattacttatttgatcgggatcctcttccagcagacggcagccatattacgacgatggcggcaggctacaaccgcgaaacgggccttgtcaaccacggcgccggttggcgtggcgtatttgatttaagcgacattgaccatacgtaccacatcgtcgctcctggacagtctggccacgtcacaagcgagacataccgctcgcaaatggaagcttggacagagggccattatc

SEQ ID NO: 6732 - DNA, 227 bp, Bacillus clausii
atgccgtacgtaaacatcaaagtcactaaagaaaatggaggtctaacaaaagaggaaaagctgactttaattaaaggtgtaaccaatttgttggccgaaacattaaacaaaaatccggcttcaacagtagtagtcattgatgaaattgacatggataattatggacttggagctgagcaaatctctgatcgaagaaaagcaggaaaataaaagagggctcggaatat

SEQ ID NO: 6733 - DNA, 294 bp, Bacillus clausii
tcgcggttggcttaatgctgcttttgagtttgctacgcgtgcatgtcgtgttggctttagcgatttcggctattgtcggcgggcttgttggcgggctaagttttaacacaactatccaagtttttacggctggattaggaggcaatgcagaaattgcttttagctacgctctgttgggtggatttgctattgcattagctaaaacaggattaccagactttttgattagcaaactccagcagtggatggaacgaaaaggagagagcaagcagcagacgttgacaaaaatgctgc

SEQ ID NO: 6734 - DNA, 621 bp, Bacillus clausii
ctatcgaggagctattcacacaaaaccgccaaccaaaagcggaaggacaagcagcagccaagagcccggtccacataaccgaaaaactcgtgacggaaaaccaaaaagtcaaacaaggcaaattgcatattggctttcgtacccatacaacgtttggcgatgaagattatgaggcgatgcaagtcgccaatggcatttttggcggattcccgtcgtcaaagttgtttcgaaatgtccgtgaaaaagaaagtcttgcttattatgccgcatctcgccttgaaagtcataaaggcgtgctaatggtaatggccgggattgaatttaataaatttgaacgtgcggttgctattataaaggaacaagcagaggctatgaaaacaggggaatttgacgaggaaacgattgaacagacaaaagcgatgctcatcaatcaaatgctagaagcgattgatacaccaaggggatttgtcgaactgtcttaccatgaaatggttgcagggacgacttatccaattggcgagcggattgaagcgttaaagaaagtcacgaaaacagacattgtcaatgcagcgaacaaatgggaattggatacgatttactttttgaaaggggagagtgaat

SEQ ID NO: 6735 - DNA, 657 bp, Bacillus clausii
gcgttgccttgaactttcttgcagttggcctttcggtctatattatcaatttgctttacggcagcgggcaaaccgcttatatcgaaaaccggttttaccgttttaacattccaggtttaagtgacattcctgtcatcggaccgttgtttttttcaaatgtgtatgcaacatcctttcttgcgtttggacttgcctttctcgtttattatgtcatttattatcggccgtttggcttgcgtctccgctctgtcggcgaacatccacaggccgcggacacaatgggcatacgagtaatcaagatgcgctatatcggcgtcatgttgtcgggcgtgtttgccggccttggcggcgctgtttttgcagcgacgtttagcggtaatttttcagcaactacgatcacaggccaaggatttatggcactggcggcgttaatctttggcaaatggcaccctcttggcgtaattggcgcaacgttgttctttggactggcccaagcacttggtgtagtcggccaacagctgccgtttctttctgatgtgccgcctgtatttttgctaattgccccttacgtgctgacgattttagcccttgccggttttgttggccgggcagaaggtccaaaagcgttaggcaagccttatataaaaggatcgcgct

SEQ ID NO: 6736 - DNA, 435 bp, Bacillus clausii
gattgaatctgggaatgtagaagaagcactccgtttactagatgcgtttgcgaatacaacgaaccatgaccagctctaccaagcagcggagctttattatgagctaggacatgttgataaagcacggccgcttattgaacaattgctcgaattataccctgatgaaggggagttgtacgttttggcggcagaaatgatgattgacgccgaccaagaagacgaagcgattgagtatttattagagatcggcgaacacgacccaagttttttacaagcacaactgctgcttgctgatttataccagttgcaatctcttgatgaagtagctgagcaaagactgctcgccgcccataaaaaagcgtctaatgaggtcatcattacgtatgcactcggtgaattttatcttgaacaaggttcatataataaagcaatccc

SEQ ID NO: 6737 - DNA, 386 bp, Bacillus clausii
atgaccattaatacgttgctatttgatttggatgggacattaattgatacaaatgaattgattatccaatcctttctccatacattggaaccagattttccaggtgtctatacccgggaaacggtgctgccatttatcggtccaccgcttgtagacagcttttcacgcattgatgcttcccgtgccgaagaatgggtccgcacataccgtgattttaaccatcaacaacatgatgcgcttgtaaaggaatacccaggtgtaaaaacaggcatcaagacgctgcataaacaaggttacaagctagcggtcgtaacgactaaaatcagggaaactgcgcaaatgggcctagagttgatggggctttccccgtactttgatgtgattgt

SEQ ID NO: 6738 - DNA, 397 bp, Bacillus clausii
atgctgtttatgaccattaatacgttgctatttgatttggatgggacattaattgatacaaatgaattgattatccaatcctttctccatacattggaaccagattttccaggtgtctatacccgggaaacggtgctgccatttatcggtccaccgcttgtagacagcttttcacgcattgatgcttcccgtgccgaagaatgggtccgcacataccgtgattttaaccatcaacaacatgatgcgcttgtaaaggaatacccaggtgtaaaaacaggcatcaagacgctgcataaacaaggttacaagctagcggtcgtaacgactaaaatcagggaaactgcgcaaatgggcctagagttgatggggctttccccgtactttgatgtgattgtcg

SEQ ID NO: 6739 - DNA, 423 bp, Bacillus clausii
aaagcgggcgattgcattgacgaatgaacatcaccacgaaccacaaaacatcatcctttttccaggagttgtgaaacggcttgtagaggaaggcatggatgaattaaaacgaaaaaatggccaaaaagcgctccagcttttttcacaagcggaaacgtatgagccgacgagcgcccaagctcgttttggcgtagtactaagtttgattgagttaaatcgtcaagaggaagcggtagaaaaaacaaaagcactattacacgaaggcattggcgattactacgaaacgctgcaagtccatgtgtctttgcttgtacagctgtcgcgttatgaggaagtcgtccacttgttggaaacagttctcagcgaaaaccggctgccatctgaacatgcagaaaccttttatgaacttctccatttcagtag

SEQ ID NO: 6740 - DNA, 366 bp, Bacillus clausii
gtgtaggaaaccttggaactgcattattgcagtataatttttcgaaaaacaacaataccgtgatcacccatgcttttgatgtcgatgaaaagaaaattggtacaaaagtaggcgaagttcctgtgtataactgggacaagcttgaagaaattgggttgcaaaatgtttcgattgcggttctgactgtgcctgcttcccaggcacaaaaaagtgcagaccgcctcgttgaagcgggaattgaagggattctaaactttaccccagtacgcttatccgtaccagcccatattcgcgttcatcatattgaccttgcagtggaactgcaggcgcttgtttactttttaaagcattacccactataagaag

SEQ ID NO: 6741 - DNA, 342 bp, Bacillus clausii
  misc_feature (1)...(342): n = A,T,C or G
tctgtggtttcttggcgtaccttatccaattgtgctcggtttttttgttggggcgaccgattttatcccttattttggagcgattattggcgcgattccagcggtcggtgcagctcttcttgaatcaacaacactcggtctttatacagtgattgctttagtcattattcagcaaattgaagggaatctgctatccccggtcattgtcgggcgnacggttcatttgcatccaatgatcattattattgcgctgttaattggcgtggaggctggtggcattgttggtttgctcattgcggtgccagttgctgcgattttaaaggtgacggtcgtccatattcg

SEQ ID NO: 6742 - DNA, 597 bp, Bacillus clausii
acgaaatatttacttgatcgtgctattgttgttgctcgtaggccaagtagtgttatttttacggccagtgtgggacatattggcgacattgctcggaccgctttgtgtggcttttgtatcggcctatttgcttcaccctattgttgagtgtcttgttcgccttggattgccgcgggcacttgccacgtttatgttgttcttagcatttattcttgcaattgccgctatgcttttttggggattgcccgcgcttgcagcacaggtaaaagaagccatggatgtactgccaaggcaattggctgaagtgaaaaagtcactgttgaacttacaacgtacagcggaaaacctaccaaacccactcgacgaccatgtcggtgaatggagcatgaaaatcgaaacattcgcgaaagcggggctagaccagatagaacaagtgattatccggatgttacagtcctttatgacatggattgtcgttccttttttagtgttttaccttttaaaagactacgagctccttaaacgggttgctttttacttaacgccaagaaaatggcgaaaagggttgacagcctatgcaaccgatgttgatcggac

SEQ ID NO: 6743 - DNA, 597 bp, Bacillus clausii
aattaaaatacgcagccggtgcagggattgggttgtttattgcctttattggctttaaaaatgcagagattatcgtaagcgaccctgccacctttgtggcgcttggcgatttgtcagctcctggccctttgctggctgtttttgggattgtcgttacgattatttttgtcgtcctcggctttaagggcgcggtgttctatggattggcgattactgcaatcgtcggtgtcattactggctttacgacattaacaggcgtcgttagcgccccgccaagcatcgcaccgacgtttttacaagcattccaagtagattggcaaaatgaagtgtttactgtgcaaatggttggtgtcgtgttaacgctcttatttgttgtcttttttgatacagcaggcactttatttgccgttgccacacaagcaggctttgtaaagaacaacagacttccacgtgctggcagagcgttgtttgccgatgcgagcgctacgacaattggctcattgctcggaacatcgacaacaactgcttacgtcgaatccacatcaggcgttgctgttggaggacgcacagggctaacggctatttttactggattgc

SEQ ID NO: 6744 - DNA, 842 bp, Bacillus clausii
atgaatctgcgcacactcgcccgtagaaacatcactggccacgcccaacgctatgctgcttattttctaagttgcgtgttcaccgtcatgatcttttttatctatgctcagtttatttttcacccagatatcgccgaggaaagcatacaccaggtcgtcaaaaacggcatggtggcagcacaagtaatcattgtcttattttcgatcttttttatcgcctattcgaacaatgtctttttgcaagtgcgctcacaggaattcggccttttaaccctttttggcatgaacagacgccagttacgctcccttgtttattatgagcaaacgattatctcgattgtcgctatcgtctgcgggctactgcttggcacgcttttctcgaaattgtttttgatgtttatgacgatgttgcttgctgtcgacgcgccgattacgttcaaatttgtgcctgctgcttatcttgtaacaggcgttggctttttcttattattccaggttctctcgctgctttcattttggaaacttcgcaaccaagaagtgattcaaatgctgaaagaagcaagcaagccaaagatgatgccaaagacatccgtttggctcaccgtgcttacggtggtttgccttggagctggctatgggctagctgtcacaaccaacatgatgaccgtcatgctaaccatgttcccagtattagggcttgtggtagtcggcacttattttctatttacccagggcacggtagcgctttacaagcgcctctacagtaacaaacgctccttatactcaggcacgactttaattacgcggacaaacattttgtttcgcttaaagattacgcacgc

SEQ ID NO: 6745 - DNA, 564 bp, Bacillus clausii
  misc_feature (1)...(564): n = A,T,C or G
gctccaatcgatccctaacttgctgtttgttactcttgtatacatcatcacccttttcttatttagccttgatttgccgcgtttgctcagcaacacgttcaatttatttaaagacgaaacgtcacaaaaactacaattcgtttttcgacgaatgggcaaagtgtttttaggctattggaaagcgcaatttattttaagcatcggcgtcttcctagcctgttatatcagcttattatttattgctcccagctctgccttgattatgtcgattttgatttgggtagtcgacattattccattgtatgtcgggcctgcccttattctagtaccatggggcttggtcgctatcatacttgggaatacggcaatgggcattcaattgatggtgctcgccctcgtgctgttgattttgcgccggatcatcgaaccaaaagttttaggtgactcaattggtttaaatgcattgccaaccgtgctgtcaatgtacttncnttttgtattcttcggtgtcatgggattgattttagggccttttgtttacattgccgtccgttcggcaataga

SEQ ID NO: 6746 - DNA, 273 bp, Bacillus clausii
cgataggagcggcagtcgcacttgccttaggagctccttcgtttgtcgttttggcgaccattgtttgcggtacagccgggccggtgtacggcgggcctgcgggtagttttttagccgccgttgttgctgccgaaacaggcaagcttgtgtttggttcgactaaagtagatattctcgttacgccaattgtaacgatcgtgagcggctttgtcgtcgcctggcttttagggcctgctatttcatttgtgatggaatcgattagcggggcgattg

SEQ ID NO: 6747 - DNA, 732 bp, Bacillus clausii
gcctcgtcgggcggaatggcgaggggaagacaacgctggcccgcatccttgcaggactagaaccccctgcgactggcgaggtcggctggcgaaaaggactggcgaaaggcatgttagcccaagcacctacctattcgccagatagttgtgtctacacgatactagaaacggtatttagcgatataaaaaaagtgaaagagcatatgacgcgattggaagaagtgctcgcaatcgagcagcaaccagccaagctagaacgtgtcttagaggaatacggccgtttacagcagcagtttgctgatgttggtggctttgaatatgaggccaatattcgccgcattgccgcaggtcttggcattacgggattgcttgagaaacgttggggggctcttagcggtggcgaacggacgaaagtcggcctagcctgtttattgttgcaaaagcctgatctactcattctagatgaaccaactaaccatcttgatttgtacgcgtttgattggcttgctgactgggtgcgccattatgcaggggctgtgctcattatttctcatgaccgtgctttccttgatgcggctgtaacggaaatatgggaaatggagaacggggtgctgcatcaatatgcagccaattacagtggctatttaatagagcgggaagaacgcctcatgagagaattccacaatacgcggatcaacagaaaaagatgaagaaaatgccggaagcgattaa

SEQ ID NO: 6748 - DNA, 467 bp, Bacillus clausii
atgggcgccaaaaagccaacgattggactggcccttgggtctggcggggctagaggctttgcccacattggtgtgttaaagacgcttacagaagcgggggttcacattgactatttagctggtagcagcatgggtgcattggtggcgactatgtatggcgtaggccattcggttgaaacgatggaagtttttgcgaaacatttcaaacgaaaatattacttggattttacagtctcaaaacaagggcttattgctggacaaaagattgaaagcctcattcgtttactagctaaaagacaaaagctggagtcgctttttccgccagttcaagtggtagcaactgatcttttaagtggccaaaaagtggtgatgtcaaagggagacgtcgccaaggcggttcgagcaagcttgtcgattccaggcatttttgttcctgtgcaacgggacgggcagcttttagtagatgg

SEQ ID NO: 6749 - DNA, 441 bp, Bacillus clausii
tcaattgggcaatacttggcccaggagccatcgctagcgattttgcccaagcactaaacaacatcaacggaacgatttatgcagtcggttcaaggtcgattgaaaaagcgcaggcgtttgcaagcaaatttggtgtcaagcatgcgtttggaagctatgactccatgcttcacgatgaaaacatcgacgccgtttatattgcaacgccccattccaaccactatgaatacattaaaaaaagtttacaaagtggaaaacatgttttatgcgaaaaggccatcacggtaaacggccaacagcttgaagaattaatgagcctcgcaaaagaaaaacaacttgtgctaatggaagcaatgaccctttttcacatgccgctctatgccaagttgcaacaggtgattcgctcaaatacgttagggccagtcaaaatgatcaatgtca

SEQ ID NO: 6750 - DNA, 431 bp, Bacillus clausii; identical to SEQ ID NO: 6656

SEQ ID NO: 6751 - DNA, 681 bp, Bacillus clausii
ataaaacacatgcagacttggctgtggcggcgctccgagcaggaaagcatgttcttgtagaaaagccgctggcgctgactgtcgccgaggccaaaaaagtgcaagcggcagcacaggaggcgaacacgatcttgcaagtcggctatgttcgccgttttggggcaaatgcccaagtgctgaagacgttcattgataacggaaagcttggcgatatttattacgcaaaggcttcactgttgcggcgcgtcggcaatcctggcgggtggttttccaacaaagagctgtctgggggtggcccgcttattgacttaggggtccacatcattgactgttgctggtacttaatgggacggccaaacgttgaacgagtgactggccatgtctatgataaactcggaaaccgcagcaacattgagcacctttcgttttacaaaacggctgactacgatgcagccacgaatacagttgaagatttagcaaatgccttaatcacgtttgaaaacggcagctcgcttatggtggacgtttcttactcccttcatactaaaaaagaccacctttccatacagttatttggaacgaaaggcggtgctgagctagaaccagagctaatgcttgtagcagaagaacaaaatacgattttaaacattgagccgcaattggatcatcctacgttccatt

SEQ ID NO: 6752 - DNA, 501 bp, Bacillus clausii
aaacgacgctatttaaaatcttgatgggtgaaatcgagcctgacgaaggcacatttaaatggggaattacgacaagccaatcgtattttccgaaagataactctgccttttttgaaggaaacgagctaaatcttgtcgattggttgcgccaatactctcctgaagatgacagtgatacgttcttgcgtggttttcttggcaggatgcttttctctggcgaagatgtgcttaaacaagcaaacgtcttatcaggcggcgaaaaagtccgctgcatgctgtcaaaaatgatgctctcaggagcgaatgtgctgctgttggatgaaccgacaaaccacctggacttagagtcgattacagcactaaacaatgggttgatcaattttaaaggctcgctccttttcagttcccatgaccaacaattcattcgcacgatttcaaatcgcgtcattgagttgacagaggatggcatcattgacgaagactcgtatgaagattacttaa

SEQ ID NO: 6753 - DNA, 574 bp, Bacillus clausii
atggataacaagcgttacttaacacctgacattggccgtggctttatgcttttgttaatcgctgtagcacatgcacctctttttcacaaattaatagagggagttaatgaacctgcaatctcagatcaattatttaaggcgtttgtagtaacctttgtcgatggtcgtgcgtttgttacgttttctttactatttgggtttggaatagcactaatggttaaacgccaactagataaagggatatctgtaaatgaatcaaagcgtttattgcgaagacgctcgctcttcatgatcttatttggcttcacacatcaggtttttataggtggggcagatatcattgcattctatgggatcgctggactattaatagaaggattgatttttaaatcgaaacgatttaaggaaaaagctctatttgttataggtacactatcgttcctaaccatttctactggatggtggtttctctctttgtttaaggaattatcagaagaagcaaatgttaattatttagagatggtaatagaaaatgttattgcatttccaattactgttctcgttcagactacat

SEQ ID NO: 6754 - DNA, 447 bp, Bacillus clausii
ttgctaataagatggacatgccagaagcaaatgaaaaccttaagcgatttaaagaggcacttggcgaggaaacgaaaatttttccagtttcggcgatcacgaaagacggtgtccgtgaattgatgctagcgattgctgatgaattggagcatgcgccagagtttccattgcatgacagcgaagagcaagtagaggcaagagtgctttataaacatgaattgccaattgagccgtttacaatcacccgtggagacgatggcgtgtttgaattatcgggagctgaactggagcgtgcctttaaaatgactgattttgctagggaagaatctgtacgccgctttgcccggaggatgaggaaaatgggcgttgatgaagcgttgcggaagcgaggcgcaaaagacggcgacctagtccggattatgaaatttgaattcgagtttgtcgaat

SEQ ID NO: 6755 - DNA, 675 bp, Bacillus clausii
  misc_feature (1)...(675): n = A,T,C or G
ctctcntggcttttactatgtacaaagcgaaggggcgcttatcccaatgccgaggcagaggggtttttcggaagcgcaagcagacgccgcttgtcggcgactatgtcgaatttgaggcggaaaatgaaacggacggttatgtgatggcgattaaagaacggaaaaatcagctaaaccgaccacctatcgccaacgttgaccaggcgattctcgtcttttcggcaaaagagcctgattttcatacgcttttgttggatcgctttttggtacatatcgaacaacatgatatcaagcctgtattggtcattagcaaaaccgatttgcttgaggcgagtgaacgggatgtcctaactcggcaaatggcggtgtatgagcaaatcggttatcccgtcctatatacatcgacgaaacaggccgatgatcctagcgaattgcttccgttgttggcaaaccaagtatctgtgattgctggccagtctggattcgggaagtcttcgctattgaatgcgcttgccccagaagcaaaaattgaaacgaatgaaatatcaaggcatcttgggcggggacgtcatacaacaaggcatactgaacttttgccgataggtgaaggccttgtcgctgatacccctgggtttagctcgctggagtttacggacatggaggcagaagacctcc

SEQ ID NO: 6756 - DNA, 672 bp, Bacillus clausii
tgaacgaacgaaatgagggtaaaaacatgtcaaaggaatcgatttacggccttacaatggctcagttgactgactggctgatggagcgtggccataaaaagtttcgtgccgcgcaagtgtgggactggctttatcgcaagcgggtgacgacgtttgcagaaatgaccaacgtcaataaagactgcctccagctattagaagaccactttgccattgagacaatgagcgaacatgtgcggcaggagtcaaaggacggtacgattaaatttcttttccgtctccaagacggcaatttaattgagacggtgcttatgcgccataagtacggcttctcggtttgcgttaccacacaggtgggctgcaacattggctgtagcttttgtgcgagtggcttgttgactaaaaaccgcgatttgtccagcggtgaaattgtcgagcagattatgaaagtccagttccatttagatcaagtaggaaaagaagagcgcgtgagccacgttgtcgtaatgggcattggcgaaccatttgacaacttccagaatacagtcgattttcttgagatcattaaagatcataaagggttggcgattggagcaaggcacattaccgtatcaacgagcggcctagcccacaaaatctatgaatttgccgacttgaaactgcaagtcaact

SEQ ID NO: 6757 - DNA, 564 bp, Bacillus clausii
  misc_feature (1)...(564): n = A,T,C or G
cggtgttcattcgccgacaacagtcgctatttttagtgaggaggagaatgcctcaagtattgagaaaaaatgggaacaattgttgaatggggatgatgcattccagtttatcatcgttgatcctgagcaagcccgggaggacatacgagctggtcaactcgatgtggccgtaaagctaatggaaacagattataaactcattgccgctggcaaactacctagtgtcgctattgttcaacagcatgttgataaagtctttcaacgggaggcatacggtacggcgatatcggctgaggacggaagtagccgtgaggagtttgagcggtatttgaaggatgccccttttcaggtagacgtacaaggcattgaccgcgaggaaacgatagagtataacatgacgacgcagctattgtttgcttttacttttctagtctccatgtttattgccggttttaaagtcaacaatgtgatgtacgataaaatttctggcgtatggantcgaatgattctgtcgccgataagcaaaaccagcatgtacagcagttatcttttatatagtttctt

SEQ ID NO: 6758 - DNA, 519 bp, Bacillus clausii
  misc_feature (1)...(519): n = A,T,C or G
ttgtcttctatgcgggagcacctattgggaaagattgtcgctggcgaggttggttgttgccgaacgagaacatctatgtggaaattgtgcaaggaagcttgaaccagtcaaatccggctgtagaaaatgcggcaaatggtgtggaggcagcgaacaaaattgttgcttggactgcaagttatggaaagcgatgcataaagatgacccgcttgctcgtaattgctccctttactactataatccctttctaaaagagctactgtcggcttataagtatcgtggggacgctgctttggcgcaaatgttcgccagtcagctaaaacaagcgatacgccgcgagtttcggtgccattcattaacgtatgtgccactcagtgcagaccgtttgcaagagaggggctttaatcagtcggaactgctgttgacggcaagtgggctcccagcatcaccagtattggcgcgggtcgaccaagcaccagcaaaacagantaaaaagacccgtgaaaatcgaatcaaatc

SEQ ID NO: 6759 - DNA, 347 bp, Bacillus clausii
atggcaaaatccaggaggcaacagcatcctgataagctgcttgttttccggaaaggaacgaggcctgtgaacatcattgaaaacatcaaaatggcgtttcattcgattgctgcgcaaaaattgcgggcgctattaacaacgcttggcattattattggtgttgctgccgtcatcatggtagtggcaattgggcaaggtgctgaacaaaagttaaaagcacaaatcgtaggcgtagagaacattcgggagatttatttcgaaccatcggaattcgatgaacagcaaaatccgaacatttacgccttctggcagtactcggaacaagacgtaacagacattcaagcgtt

SEQ ID NO: 6760 - DNA, 277 bp, Bacillus clausii
gtgaacatcattgaaaacatcaaaatggcgtttcattcgattgctgcgcaaaaattgcgggcgctattaacaacgcttggcattattattggtgttgctgccgtcatcatggtagtggcaattgggcaaggtgctgaacaaaagttaaaagcacaaatcgtaggcgtagagaacattcgggagatttatttcgaaccatcggaattcgatgaacagcaaaatccgaacatttacgccttctggcagtactcggaacaagacgtaacagacattcaag

SEQ ID NO: 6761 - DNA, 300 bp, Bacillus clausii
  misc_feature (1)...(300): n = A,T,C or G
taacgtacgcagtcagggatacgcaaatggatantcanacnattaacaagggcgattttatggggatagccgacaaaaaaattattgcttgnggccctcgtaaacaagacgtggcgaaaaagctccttgatgaaatgattgatgaggaagcagaagtgctgacgattataacgggcgaagacgcgaccgcagacgatacaagtcaaattgaagcttacgtcaatgagcgccatgccgacatggaagtcgatattgttgagggcggacagccgttgtactcgtacattttttcagtcgaat

SEQ ID NO: 6762 - DNA, 597 bp, Bacillus clausii
ttcagacgagcttgaccaacagccatcgccgaaagaagcgatggcaaaagcgatgcgaaaatcgtttccggttatctttgtcagtgcattaacgacgttttttggattcatgtcgctaatgctaatggactttgggattggcgtcgatttagggtttaacctcgtaaaaggaattgtgttcagctttatatcagtcgtcgtgtttttgcctgcgttgacgctgacttgttacaaatggatcgaaaaaacgacacatcgaagcttcgtgcctagcttcaaaggcagcggagccaagctgcttaagctgcggatccccgctctcgtccttgttctgttgctgctcgttccaagttttttggcgcaaagcagcaccacgtttctttatgggcttggggacttgcctgaacagacacgcgctggcgccgatgcgaaacgagtcgaagaaacgttcgggcaatcaacgccgattgtcttgctcgtccctaacgacgacatcgccaaagaagaaaagcttgtccaagagttggaacagattccctatgtcgagtcagtgcttgcctatgccaacatggtcggggcagcgatcccttctgattt

SEQ ID NO: 6763 - DNA, 1243 bp, Bacillus clausii
ttgaatgcagaaataatggccgttggctcagagctgcttcttggccagatcgccaatacaaatggccaattcatctctaaacagctagcaagcattggtgtcgacgtgtaccggcacacagttgtgggagataacgaggacaggctaaaaaaagcacttcaagaagcacatgagcgtgccgatctcgtcatcttaacgggcgggcttggcccgacaaaagatgacttgacgaaagaaacggtcgcggcgttttgtggaaaaaagcttgtgtacgatgaagccgctcttcatgaaattgaacattattttaaacgccataaccgcgtcatgacacctaacaacaaaaagcaagcctatgtgattgaaggctgcaccgttcttgcaaaccgtcatggcatggcccccggaatgctatgcgagcttgaagacgggaaaaaactggcgcttttgcctggaccaccgagcgaaatgaagccaatgttcgtcaacgagcttttgcctaaactgttaggcgcaactgaacatacagaaatcacttcccgtgtgcttcatttttttggaattggggaatcacaattagaaacagaccttttggacttgattgcgacgcaaacgaacccgacaatcgctccattggctggtgatggggaagtgaaactgcgcttgactgtaaagcatgcagataaaaatgaagctgcccgtttgcttgatgaaacggaagcattgattcggaaacgggtcggttcatatttgtacggctacaacgaaacgacactggtcaaggaaacgtttttgcgtttgcaggcgagcggtctgacaattgccagcgccgaaagcttgactgccgggcttttctcaagcgaattggctgcgtttgctggtgcatcggacctgctaaaaggaagcgtgactgcctactccaatgaactgaagcagcaattgcttcaagtttcaagcgccacccttgctagcgacggcgccatcagcgaagcatgtgcgttggaaatggcacgtggcgtcaaaacactttacggttccgatatggccatctcttttacaggagtggctgggcccggggtgcaagagggccacgaagcgggtaccgtttttctggcgcttcttttgccaggagggaaagagcgcgtatacacgctgtctttatcggggggacgcaatgccgtacgaatgcgggcggtgaaatttggctatttttatttactggaagaattgaaaaggagcaatg

SEQ ID NO: 6764 - DNA, 465 bp, Bacillus clausii
atgttattttatgaaaatttgattatgggaatcattgcaatagttattggaattattcttggaaccttactttccaaattatttgcaatgattttaataaaacttatgggttcaattgccgaggtggacttcggtatttccattctagcgattacccaaacagtcatagtctttatggtcattattttattcacttccgttcaaggttaccgtttgatttatcgttttacattaatcgaattattctatgatgagaaaaaaggtgaacaaattccaaaggtttcacttatatcggctgttatcggagttatattgcttgtcgttagttactggctgatattaaaaccatttcctgacgaatttactacggaatatttaatgaaaaattatggtattgcttttgttgctctcgtcattggcacccatttattttttcgatctgtaacggtctatttattaagatta

SEQ ID NO: 6765 - DNA, 761 bp, Bacillus clausii
atgaaaactattgtcgaagcaaaacaaataaaaaaagtctatggtgcaaagggaaatgtattttcagctttggaggatatagacttaaccgtcatggaaggtgaattcgtcggtattatgggtccctcgggtgctggtaaatcaactttactaaatatattggcaacaattgacgagccgactgctggtgacatcgtggttgacggaatcaatttgacaaagatgaatgaagagcaattatctgcctttcgccgtgacaaacttggtttccttttccaagactataatttattagatactctaactgtgaaagaaaatattatcttgccgttagccttggcaaaattgaacgttaaggaattggaacgaagagcagatgaagtggcagataagtttggcattcgcgacattttaaataagtacccgtatcaaatttctgggggacaaaagcaacgcacggcagcatcacgcgcgattatttcaaagccaaacctaatattggcagatgaaccaacaggtgcgttggattcgaaatcagcaacagacttattagaaagtttaaaggatcttaatgaacaagacaaggcaacaattttaatggttacccatgatgcttatgcggcaagttattgtaatcgcgtcctatttattaaagacggtaaaatcttcacagaacttgtgaaagggaaaagatcccgcaaagaatttttcaacaaggtgttggatgttctatcagcactggggggtggagcaaatgacgt

SEQ ID NO: 6766 - DNA, 477 bp, Bacillus clausii
tacaacgaaccacaagccgattgtgcgtaccaacgatgacggaatatggagaaggattcatctgatcccatttaccgcatccattccaaaggaaaaacaagacaaggacttacccgaaaagttgcgtaaggagttgcctggtatcttgcggtggatggtggaaggtgcgttgaagtggcaggcggaagggcttgagaaaccaagttccgtcgaaagagcaacccaaagttatagagaagacatggatatattagggccattcatcgatgaattgtgcattgtaaatcctttagcgaaggtcgaagctaaaaaactatttagagaatacaagcagtggagttttggcaatgacgagattgatattcaaaacagaaagttttaccgaatgatcgaaagcagaggatttaagaaatttaatggagcaaaaaacaaagtgtatttttccggtttgggattaaaagaagagaataaaagctt

SEQ ID NO: 6767 - DNA, 600 bp, Bacillus clausii
  misc_feature (1)...(600): n = A,T,C or G
agctgaaancaatgaaggaaatgcctcatccgaagaccctcaatttctaaatcttttaactggtggcacaagcgggacttattatccacttggaggagaaatggccacttttatttccgacggcactggcgtcgaaacaacggcccaatcatctaatgcttcagccgaaaacgtagcgcaattaagcagtggcgacgcagagattgcgtttgtgcagacagacgtaatgtccaatgcggttgaaggcgtcaattcttttgaaggggagcctgttgacaatgtgcttgcgctcggctcgctatacccggaaaccattcaaattgtcaccactgccgattcaggcattgagagtgtcgaagaccttgccggcaaatcggtatctgttggagctccaggatcaggtacatatgtaaatgctgaacagatcctcgagattcacggcatgagcatggatgacattaatcaacagcctttaagctttgatgaatcgacgagcggcatacaagacggcaacattgacgcagcctttattactgccggaacgcccacaggggctgtcgaaggattatcggcgacaaatgaagtcgcgattgtgccaat

SEQ ID NO: 6768 - DNA, 302 bp, Bacillus clausii
aacagcattcagagctttatcaggaacgtgcatcccaagccaaaaccgtccgtaagatcgtgtttatttgcgttttaattctgtttgccgtgatattggcagccggcatatttagttatttttacttaacaactgctttaaaaccaatggacgaagaaggggaaggcaccgatatagaagtaacgattcctgtcggaacttcgacaagcggtattgcggacattctagaagaagaaggattaatccccaatgcaacgtttttccgttattacgcccgttataaaaatgaatcggatttccaa

SEQ ID NO: 6769 - DNA, 501 bp, Bacillus clausii
ttgccattatgtcagacaagccgcaaacaacacggaataaagtacaaggcgtgttgacgcgagacgacgcgcaaattgtctttatggacacgcctggcattcacaaaccaaaacaccggctaggcgactttatgatgaaagtcgcaaaaaatacgctccgcgaagtggatttgattttatacgtggtggaagcggatgcgaaattcggccctggtgaacagtatattatcgaacgacttcatgaaacgaaaacgccagtgtttttattaattaacaaaattgataaagtttctccagaagagctgcttaaagtgattgatttgtacaaggatcgttatccatttgcagaaattatcccgatttctgcattggaagggaataatgtgccaacgcttgtcgaacaaattgtggagcacatggaagaagggccgcaatattatccagcagaccaagtgacggaccacccagaacggtttataattgcggagcttattcgcgaaa

SEQ ID NO: 6770 - DNA, 573 bp, Bacillus clausii
  misc_feature (1)...(573): n = A,T,C or G
aggtcggacggtgaaagaagcagttgccaatgcagtgcagcatttgggtactacgaaagaacagttagtntatgaagtcatcgaacaaccacaaaaagggtttttcggtttgtttggcgaaaagccagctgtgattaaagctcatgtgccgccaagatctgcagacgttgcccgctcctttcttgaagaaaccatttctttaatggggttaaaagctgaactttntgtcgagcaagtaggcaaagaagcgtttttttcgttgcatacagaagaaaaggatcaagggcgtttgattggacgcaaagggcagacgctcgattcattagagtatttaacgaatttggctgcttcccattcgcctagcacggatttcgtcaaagtccgcctcgatgccggaggctaccggcacaaacgggaagaaacgctcaagcagctcgcattgcggatcagccataaggcaaaaacgacaaaggaaccgattgtccttgagccaatgccagctcgtgaacgtaaagtcattcatactactttggcaaacgatgccggcgtgcaaacccattcgcaaggcgaagg

SEQ ID NO: 6771 - DNA, 657 bp, Bacillus clausii
cgccgcggacaaaaacagcgcttatgaaagcaaaagagcagggacatgttatcgcgattgcgaccggccgcccttaccgggcaagcaaacgttattatcaagaactacagctaacgacgccgatcatcaattttaatggcgcttcggttcaccaccccttagacgctcattatccaaggatactagaatcgatcccacttgcttatagcaaggagttaatcaaacgatgtgaaaccatcggcgtctttaatatgatggtggaaatcggcgacacgttttatatgaaaaaacaagctggcttttttgcagagtttctaaccgacggcattgaacctgctgggacaggagaactacatgcactcgtgaaagaagcaccaactgctattcttattgaaccgaagcccgaaaaagtcaatgtccttcacgacaccttgcaagagacgggaacggaaacaacactgcaacgctggtggaaaggcgaaacgcgtattttagaaatcgccccacgcaatgtgacgaaagcaaccgctctcgaaagaatcgccaacgattacggaattgaccaaggaaacgtcattgcctttggcgacgaagagaatgactatgaaatgattgaatatgctggtcacggcgtcgcgatgggcaatgccatcgacg

SEQ ID NO: 6772 - DNA, 232 bp, Bacillus clausii
atgaaagtgcctgcttatatcaatgaaataagcgcatgggaagactcatttacattttttgttcccatcaaagtccgcttttcggaaacagatgcatttggccatgtgaataatacgtctgcgtttatttattttgaacacgcaaggcttgaattttttgagtcttgcggcttaatggaaagattgggcccgcaattagcagtgataccattggccgttactgctgatttgc

SEQ ID NO: 6773 - DNA, 564 bp, Bacillus clausii
ttcagatcgtgacgtatcgattttccgttcaggccgcggcttgacgaaggagattgttgaagaaatttcccgtatgaaagaggagcctcagtggatgcttgatttccgcttgaagtcgctcgaacaattttacaaaatgccaatgccacagtggggcggcgacctctctgagctaaactttgacgacatcacgtactacgtgaaagcttctgacaaaacggaacgttcatgggatgaagtgccggaagagattaaaaacacatttgacaaattgggcattccagaagcagaacagaaatacttggccggcgtttccgctcaatacgagtctgaagtggtttaccacaacatgaaagaggacttggaatcattgggcgtcgtctttaaagacacagactccgctctaaaagagaacgaagacatctttaaagagtactttgctacggtcatacctgctgcagacaacaaatttgcagcgctcaactcagctgtatggtcaggcggctcgttcatttatgtacctaaaggagtcaaagttgacacgccgctgcaagcgtacttccg

SEQ ID NO: 6774 - DNA, 528 bp, Bacillus clausii
tgcttctcccttatgggttcggccaactttttcatcggatcattgccgacaatatggcgcaaagcgggcttgtaattgatatggcgatgatccctaaagcgatgtttctgccgacagcaagttctgtacttggcttagtgcttgccgtatttgtaagttatcgcaaaaacagagcgtatcataacgaaccacttgctgggtatgagcacgcccaagaccagcaaccctttacaaagtggacactgactgccgctggagcggcagttgtcgttacagttgctgtgcaatgggcatatagcgactcgatggtaccggctgcgttgtctggcattttcgtattgttagctacgagagccgtgcaatttcgaattgccgacgacatgattaccgatggtatgaaaatgatggcttttatcggctttgttatgctggccgctgccggttttgctgatgtaattagggaaacggggcacgtagaaacacttgtggccgacgtcgtcgctgcccttggaggcaataaagcgattg

SEQ ID NO: 6775 - DNA, 452 bp, Bacillus clausii
atggttgaaagtaatgtgctacctttcgattatcccgatttctttctcgtagttagtaacgaaatgtttgctgagatagccaaaaaagaggctccattaacttataaagtatatgaagtggaaaatgaagtaacggcacaagccacttcaaagaaagtaaataaactggttggaaacgattttcaagtttcttcatcattttatactgagtataagcaaggtaaagaaggaaacgcaattactctctttatttttggttttttgggacttgtatttttagcggcaagtggaagtatcatttatttcaaacagttaacagaagcgaatgaggcgaaaggacactatgaaatccttagaaaaatcggtgtcaataaaaaggatatacgtaaatcaatcaaaagacagtcattatttgtgttcggattgccactaaccgtaggaatattgcatag

SEQ ID NO: 6776 - DNA, 227 bp, Bacillus clausii
gctgatttgcaatgtaactatgttgcccaaattcaatacggggatacgttacatgtaggggtaaaagtggataaaatcgggcgttcttcattggacattcattatgtagcaaaaagaaacaccgatatttgtttaacagggagaggcacagtggtgcaagttgacaaacagacaggcaaagcactccctttctctgagaagatgcttgctaaactagcatacaaaaa

SEQ ID NO: 6777 - DNA, 395 bp, Bacillus clausii
aaatgaaagggctcattatcggccgtgaagggcggaatattcgcgcgttagaaacgttgacggggatcgatttaattattgatgatacgccggaagcggtcattttatcaggatttgatccaattcgtcgcgagattgcccgttcagctctggagaaacttgtccaagacggacggattcatcccgcccggattgaagaaatggtggataaatcgcggcgcgaggtcgatgaaacgattcgtgagtacggcgagcagacgacatttgaagtcggcgtgcacggtctacaccctgatctaattaagattttgggcaggctgcgcttccgtacaagctatggccaaaatgtcttaaagcactcgatggaagtagcccatctagcagggattatggcg

SEQ ID NO: 6778 - DNA, 239 bp, Bacillus clausii
  misc_feature (1)...(239): n = A,T,C or G
atgaatgacaaacagctatccttgcgccttgagcgggtagcctcctacttataccattataagcgcattgcagacattggatccgatcatgggtacctnccttgctacctggcattgcggtgccccggtctgactgcaatcgctggtgagttgaatgaagggccttatcaatcggcctgtgcgcaagtgagtcgctcaggtctttctgatgcggtagaagtccgtaaaggaaatggctt

SEQ ID NO: 6779 - DNA, 908 bp, Bacillus clausii
atgaaacctagaattggaatgattggattaggtgggattgctcaaaaagcgtatttacctattttatcaaaagaagtagattggacctttgtcggagcatactcgccgaataaacagaaaagagaacaaatctgcaaccactatcgcatcaaagcatatgaagatctatcttcgttaagtgaatcatgtgatgccatctttgttcacagctcaacagaaacacattatgaaattgtatctcaactacttcgtgatggaatcgatgtttatgtcgataaaccattagcagctactattgaacaggctgagaaattggttcatttaagtgaggcgcttggcaggaagctgatggttggatttaatcggcgcttctcaccgatgtatgtaaaattaaaaaagttactgaaagagaaagacactgcttggataaaccttgaaaaacatagaatcgcctcaatcaatgatacgctttcttacgaacacatcctgttagatgactatctccacctagtagataccgttagatggctttcggatggagacatacgttttgaaaatggctttttgaaaacgattgattctaagttagcctttacacagcaacaattccagtcagatgacaatatcatctttaacagttccatgcataggagtgcaggcaccaatctagaacaactagaattagtaacaactgggggaatctttcgtgtgaaaaacatgaacatctttgaatgtgaaacagataatcaactttccactttttattctggctcctgggaatcgatcctaaaacaaaaaggatttgagcatgctgtgaaccatttcattcaatgtattcaacaaaatattgagccgagtgtaccagctagagaaggtttagagtcgcagattttgttgcaagaacttat

SEQ ID NO: 6780 - DNA, 516 bp, Bacillus clausii
taaaagacatgctctatggttcagtcgaagttgaaccggtactacgcgatttaatgaacagcaggctgcttcagcgattaaaaggcgtccatcaagctggagcagcttatcttgtttggccaaagtggaatgtaactcgcttcgagcactcgattggagtcatgttattaatacgccgattaggaggctcgttagaggaacaggcagctggcttgctgcatgatgtttctcacacagctttttcccatgtatccgactatgtgtttaagaatgaaaaggaagattaccatgaacaactgtttcataaacaaattgccgaatcagacattccagcgattttgaaaaagcaccaaatcgatgtaaacgatattatcggtgagatcgagaaatggccgttgcttgaacagcctgctccacatttatgtgctgaccgaatcgactatacattgcgcgatttatatgcttatcgattcatttcttttcaggaagcctatcatttcttagagcacttattgt

SEQ ID NO: 6781 - DNA, 494 bp, Bacillus clausii
atggcaggaagacaagaaaaagagcttcaaaatgtgacattgctcggcagtgagcaaacggaatacaaatacagttatgaccctggtgttcttgagacatttgacaatcagcacccttatcgggattacatggttaaattcaattgcccggaatttacgacgttatgtccgaaaacagggcaacctgatttcgcaaccttgtacattagctatatccctgagcaaaaaatggttgagagcaagtcgctgaagctgtacttattcagtttccgcaaccatggcgatttccatgaggacagtgtcaatacaattatgaatgacttaattgaaataatggatccacgctatattgaagtttggggaaaatttacgcctcgtggcggcatttccatagacccttactgcaactatggcaaaaaagggaccaaatacgaggaaatcgcgaactaccggttaatgaaccatgatctgtatccagaaacgataacgaaccg

SEQ ID NO: 6782 - DNA, 732 bp, Bacillus clausii
acatgaccaatgtcggcatggggcggaacatccaatttatgcggcgtttatctgaagagctcgatatgcatattgtggccagtacaggctgttacaaagacccgtttattccggcggaggccctttcttggaacagggagcaatttgcagcgtttatgttgcaagaaattgaggaaggcattgatggttctctaagcaagcccggtgttattggggaaatcggcagcagtttaaatgaattcaaaccagtggagacagagctatttcatggggcaatcattgcagcgaaggagagtggattgccgttagcgacacataccacattggggacaatggcgcttgagcaagtcgagctgttcgcaaaggaagggttgccgctcgaccaagtgattattgggcaccaagatttaaatgaaaacgatgaagtggtgcttgaagtcctagcagctggctgttacgtcgcgatggatacgattggcaaaagaaaattaccgttctgatcggggaacgtcttcacttcactgttgcgctttatcgaagcaggctatggggacaaaatcatgttatccactgatatcacaagaaattcccacctttttgctgccggcgggcaaggctttgattacacgctacgggagtttcaaccgagaatggaagcgtctgggctatcgcagcaggaaatacgaaaacttttgattgaaaacccagcaaacgcgttttcaaagagggaag

SEQ ID NO: 6783 - DNA, 425 bp, Bacillus clausii
  misc_feature (1)...(425): n = A,T,C or G
attgatggagccatttttggcaaagattcgaagataagcaggaggacgaaagaggcgatcaattatttaaagtataaagggatcncagttgtcctgacgacatcgcagcctttttcacgggcccaaaaggcagcgaaagcattaaagcttgatggcatggtaatcgctcatggaggagcgcttgttgcggatacagatagaaatgaatggtttaatcgccagctcgaaatggatacaacacttgatttctgccatatccttgaacgtttcgactgtgatgcccgcctattatatggcaaccacgctgtagcgactcggccgttacaaaaacaaaacttgcttgcacgaatgtcattcagttctcctggtgaacagttaatgtacccgaccacttatgtggattctctttatgancangttttgaa

SEQ ID NO: 6784 - DNA, 324 bp, Bacillus clausii
aggggactgtttgggtagcaagccgcaaagaactagcacttcaactgtcacaggcgggtccgcaagccgttttgcagccacttgcgtattggattgacagtttgcctgcggccgaaaaagtctatatgaagcaaaatcatccagagatcgctagcaaatgggatgaccgttttggtgaccgtatcaacgaaatcgtatttattggcatcgacatggatgaatcacaaattcgaaaagagctgcaagcatgcctgttgaccgatgaggagctttcgcaagattggagccagtttgtcgacccatttccgtgggtggtttcacgcg

SEQ ID NO: 6785 - DNA, 327 bp, Bacillus clausii
ttttgaaatccataatccccatatccaacggattacacgctttctcctaaaaaaacaccaacaggcatttttagaatcgccagcggctacaaaaaaccatcatgaatttatgtccggtttggcattccatgtcgtatcgatgctacggattggcaaaagcttaatagagctttatccaactcttgacaaagacttgctttacgcaggcatcattttgcacgatttaggcaaagtccgtgagctatctggtgcgattgatactacctatacgttagaaggaaagcttctcggccatatatcgatcatgtccaatgaaattgctcaagc

SEQ ID NO: 6786 - DNA, 439 bp, Bacillus clausii
gtgattgaatttaaacaagtgacaaaaacatttcattcaggcaaccagacagtcactgccctcgacaacgtgaatttacatgtcgcccgaggggaaatttatggtgtgattggttttagcggcgccgggaaaagtacgctcattcgaagtgccaacttgcttgagcgaccgacatctggcgaggtcctcattaatggtgttaatttggccacattaaaaagccgagaactgcaaaaggcaaaacgaaatatcggcatgatctttcaacattttaacttgctccaaagcaagacagtgttcgacaacgttgccacgccattaaaattaacaagaacgccaaaagcggacattcgcaaaagagttaccgaactgctgtcatttgtcggtttatctgacaaggcagataactatccagaacaattgtctggagggcaaaaaa

SEQ ID NO: 6787 - DNA, 549 bp, Bacillus clausii
atgaagccactttccgctcttgatccagatacgacaagctcgattttacaactattaaagaaaataaacattgaatacaacattacgattttaatgattacacatgaaatgtcggtcattcgcgagatttgcgataaagtcgccgttatggaaaaggggcgcatcatcgaggaaggatcggtgttgtcgattttttcaaatccacaacatccgacaacggaaaaattcgtccgctccattatcccgactggcctgcctgcccgtgtcaaagaagcgctgcagcagaaagagccgaaccggcgcatttatgaagtgactgtcactggcgatagctcccactcagatttgctgcgctcgttaatccagacatttggcattgaagttgacattttgcatgcgacaatgaacgacattcaaggcacatcgtttgggcggatttacttcgacttacgggcagaaccagaaatacttgcagaagcatccaattacttaaaatcgcattcgcttcaaccgaaggaggtgacaggcgatgctcgagtggctgcctga

SEQ ID NO: 6788 - DNA, 237 bp, Bacillus clausii
aaaaacaatcgcagaaatgcaaaaagaagtcgactcgtacatagggcagtttaaagaagggtattttagcccactggcgatgttggctcgcttgacggaagaattaggcgagctagcaagggaagtgaaccattactatggagagaagcccaaaaaagcattagaagaagacaaaacgatggaacaagaaatcggcgatatgctgtttgtcctcatttgtttggcgaactcacttca

SEQ ID NO: 6789 - DNA, 1227 bp, Bacillus clausii
atgttttatataggaaaagacgcaaaacagcttttaatggacaaaggcgcgctggtcacgatgttgttcatgcctctcgtgcttattctcattcttggttttgccctaggagacgcgtttacaggcatgccagaaaaaatcgacgtcgctatcgtttcagatgagacacttgcggacgcggtacagcgtttttctgacgagctggatgattggcctgcccaagaaaaaacagccgttttaggcttagctgaacagctgtctgttccagaattattgattgaaaccgttgagagcacagaagacttggacagcattacgtttcattatgaaaatgagctcagtgaagcaagggacaaggattatgctggcgttctgcatattggcgaaggctcccgggcgcaaatatgggaacagcaatttctcgggggcggagaatcgactggtgcgttcactttttatgccaatacagacgagccgcagcaagcagccattgtcgaggcgattatgaaacagtttatcgaccaattttatgcacagacagctttagcaaacgccggtcttgaatcaagtatgttagaaggaattggagacgttatttaccaaggcagtcagcctatatcggcatttgaatattacatgtttgcgatgggcgtcatgtttgtgttctacacagccggatttatggcttctcatgcgtatatggaaaagaaaacatcggtttacgctaggctcattctcgccaatgtctcacaagtaggatatttagttggcaaaggcgtgacgaccgttttccttgtactcattcaattgatgttaatctttgccgtcaacttggctttatttcgaatcgaaattggcaattggcctgcggtattgctcatttcgctcatgcttggcatcgctgtcgccagcgtcgcgttgctcatcaccgcgattcagtttcgctttcgctctgaaaaagtcgcaaaccaatttatgttttttatcatcaccatttttgcgtctgtcggcggcagcttttttccagtcagcgacttgtcgcctttattggcgcagctaagccaatggacgccaaatggccgtgcgctaactgcctttttacaagcagctcaaggggcggctcttgaagagatacgtccagctattcttatgctttctggattttcatgtctatgttttgcaatcgcttggctgttttttccgcggcaaggaggtgcggaatcgtga

SEQ ID NO: 6790 - DNA, 537 bp, Bacillus clausii
  misc_feature (1)...(537): n = A,T,C or G
gttgcctgccagggggcgcctcngaagttattgctttaagcgagcgttaccaagcagaccagcggattgtancggcattccatacaactaggattactttgtttgtgctcgtcgtcccccttctcgtaggcctcgctactggaggaggcgtgtctctgccggctgcagcgacacagccatttgcagcagatgcctggcttgtttttctcgcgttgcttggtgcagcggtcattttttgcttagcacgctttgtcacgtttccaggagcgccgatgtttttagcaattgcccttggctttgccatccaccagctgcttgtgcctgaatatagcatgcctaatattgttcttggcagcgcccaagtgctgatcggctcgttgattggcatgcgctttgaccggaaaacacttaaggaacttagccgtatcggcgcagcaagtgcagcggcattggcgctttatgttttgatgagcgtcgggctagcgctaatttttttcttgcttacgccgctgcccgttttttacaagtttgctagcg

SEQ ID NO: 6791 - DNA, 333 bp, Bacillus clausii
ttcttgagctgaagaaacacgcgaatgtggttgtaatgacaaatagtgaccgggatgatgttggacgcttatttaaagaattagggctagaaggcgtgtttgaacacatcatttcatctgccaagaaaccgactagaacgatgggcctttttgaacaacttttgtccctctatcgggtaaagccagaagaagcagtcagtgttggcgataatttcattaacgaaatcgcccccgctgttttgctcggaatggatgcggtatacatccatccacaacggccaaaggtagagcttgagcaagtacgtgttgtaagcactgtccttgagctatggt

SEQ ID NO: 6792 - DNA, 273 bp, Bacillus clausii
cttggattctgcgcaagctcgatttcttgcaaggacatatgaatgaagtgtctgatttccgtattggctcatggtggaaatttagcttaatgtttattactcccctcgtccttggcgccaattttgttcttgcgttaattaataacattcgcgctccttatgaggatatgcccctttctttcttagctgtttcaggttggggcgttgccggtgcggcgctcgttgttggtcttttactaagcctgattaaatggcctccaggcaaattggaag

SEQ ID NO: 6793 - DNA, 186 bp, Bacillus clausii
taggcatttcgttgcaaaaacgcatggctgttggcgacagtttaaatgacattgctatgattaccgaggcaggccttggaatcgccatgggcaatgcccaagaggctgtaaagaggaaagctgattggattacagcaacaaacaccaatgatggcgttgccgctgctattcagcgctgggtcgtat

SEQ ID NO: 6794 - DNA, 900 bp, Bacillus clausii
gcatgagctggcaagaagcgttagcagttgtgtttgtcgctggggtgctttttgccgttattagctttactaggtttgcgacaatccttgacagagggattccagctgacttaaaacatgggattacagctggaatcggttgttttcttatgtttattgggttgcaaaaagggggcatagtggaacacagccgtgaaacaatggttcagctggcaaatttatctgaaccgttgccgctcgcaacgctattgactcttgtggtcgcattgtttttgtttgtccgtggcatatctggacatttcttatgggctattttatgtggaattgggatcgggctcgtactgaacgtgcctaatgtgaaggatacgatcacgttttcaacggagggcataatggctgtctttgggcaattgtcattttcggcaattgcgactgtgccattttggacgtctgtttttgccatgacaatggtgcttacgtttgaaaacatcggcctgatttccggctatacaaaacaattaggacggccagataaaggaaaaagggcactccaagccaacgctatctcagcgcttgccagcggtgtatttggctcaagtcccactgtttccacagctgagacggctgcagggttggcagcaggggggaaaacaggagtttcagcgattacaacaggcatgttgtttttgtttacatttttgctgtttccactgctcgtgcatatccctgatagtgcgattgcgccaattctcgtcatcgtcggcgctttaatgatgaaagaagtacgggaaatttcatttgctgacatctccgattggttgcctgctatgtttatcgttataggaattccgtttacgtattcaattgccgacggcattgctttcgggtttgatgcttata

SEQ ID NO: 6795 - DNA, 432 bp, Bacillus clausii
ggaaatggctcatggcaagcggcttgtccaagtcgggtttatgcggcgttttgacagcggctatcttcaattaaagcaagcacttgagcaggaattggtcggagaaccattgatggtccgttgcgtccaccgcaatgtcgagtccgcagaaagctatacaaccgacatggcgattacggacacattgattcatgaaattgacgtacttcattggctcctaaatgacgagtatcaacatgtccgtgtcctttatccgaaaaaaacaaagcatgcgcttccccatttgcaagatccgcaactcgtgttgcttgaaacgaaaaaaggcgtcatcattcaagcggaaatttttgttaactgtaaatatggctacgacatccaatgcgaaatagctggcgaagagggcgttatcagtctgcctgatgtcccagcagt

SEQ ID NO: 6796 - DNA, 237 bp, Bacillus clausii
aagcactgattggcatgggctccacgattctagacggcgccgaaattggcgagggcgcatttattggcgccggcagccttgtccctcctggtaagtcgattccgcctggaacacttgcttttggacggcctgcaaaagtcgtccgtcctttaaatgaaacagacaaaaaagaaatggcacggattcgccaggaatacgtagaaaaaggccaatactacaaatcgttgcagcaacaga

SEQ ID NO: 6797 - DNA, 315 bp, Bacillus clausii
ggggttgtatgaagtttctggttaccaacgatgacggtatttttgcgccaggcgtacaggctttaattgagacgttgcaacattttggcgatgtattggttgtatgccctgatcaagaacggagcgcgattagccattcgattacactcaggcagccgattaaggcgacgcctgtgtcgatttttggacagactgtacccgcttatgcggtgaacggaacgacagccgattgtgttaagttggggctagaagtattgtgtgatgctaagccggattttgttttttcaggcatgaacattggccctaacctaggcc

SEQ ID NO: 6798 - DNA, 756 bp, Bacillus clausii
atgcaaaaatttgcaacagaagtacgtttttcagaaacagcatttgtaaagcgtttggaaaacaatcgctttgaagttaagttttttacaccaaactgtcaagttgacctgtgtggccacgccaccgtcgcagcttttaaggctttattggatagcgagctgattgaagacaatcgtgcatatgtgatggaaacactagccggtgcgctctccattgaagtcgcccagtcctttatagtgatggaacaagccgagccaagactagggaaaacaattcgtgattacgctattttatcaaatttgtttgaaatcgataaaagtcagattggcgataatcaatttgagttaatacctcaaacatcaagtacaggggtttgggatttaatgcttcctataagaacaaaggatgtattgtatacattaaaaccaaactttgaaggaattgccgcctttgcagaagaaaatcacatcgcaggcatccacgcatttacacttgataccactaagggcgtggcggaaagtagaaatttctgtccttattacggtattaatgaagaagcggcgacagggacatcgactggagctttaacctattatctctacaaaaacaatgtcttaaacgattttgaccacaattacgtctttatccaaggactcagtatggatcgaccatctacgatcgtaacgaaaatggtgaatcacaaccaacccgaaaataaaggttgccgggaaggcaagaattttatcaaaaggtga

SEQ ID NO: 6799 - DNA, 417 bp, Bacillus clausii
atccgaatgctcgttctcaaaaggagaaatgtagcatgttagaagacaaagctgtggtcgtctttagcggcggccaagacagcacgacttgcctattctgggcaaaggagcgttatcgttcgctccacgcggtcatttttgactatggtcagcgccacaaggaggaaatccaatgtgctgtcgacattgccaatgagcaaggggttccttataaagtctttgatatgggcttgttgaaccagcttacggcaaatgcactaacgagggaaaatatcctcgtccaagccggtgaagcaggggaatcgcctagcacattcgtcgccgggcgcaaccatttgtttttatcgtttgccgctgtatatgcacgggaaattggagcaaagcacattatcactgggtgtttgcgaaacagatttt

SEQ ID NO: 6800 - DNA, 793 bp, Bacillus clausii
atgcatgtcgctgttttccaaatggaagtattagcaggaaagccaggccagaaccgagaacgtgctaaaacgtgggttgagcaactatgccgcgagcaacaagagcggccgcttacgatcgtgttgcctgaattatggacgactgggtatcagcttgaggaccttggcgaactggcggaagaagagggaaaggagacgattgcatttttgcaacaactcgcgcgaacgcatcgcattcatatggtcgccggttcgattgcaacaaagaaagacggcggcatttacaatacagcgcttgtcatcgatgcgcagggcaagcttgtctacacgtacgacaaagtccaccttgtccctatgctgaatgaacctgcttacatgcaaggcggaagcgtgccacctgccttatttgaattagatggtgtcaaaatggcggtcctgatttgctatgatttgcgttttcccgagttagcgcgccgtcttgcattagaaggggcagaagtgctttttattgttgctgaatggccgttagcgcgtgcgatgcactggaaggcattgcagcaagccagagcaattgaaaatcagttttatctcctttcttgcaatagcgtcggcagccacaatggaactgcttatgcaggcacatcgatggtaattgacccgtggggggaaattatcgtcgaaggcagcggcactgaagaagaatggcttcaatgtaaagttgattttagcaaagctgctgaagtgcgggagagagtgccggtgttttcaagcaggcggcccgatttatatcggt

SEQ ID NO: 6801 - DNA, 749 bp, Bacillus clausii
atgttcacgtatgaagaagatgacaatgaatacgttgtcacctacgtacaatctccttcactcggctgggcattaattgacgttgtccctatggaaaaggtattagagccgattaaaacgacgcgcctgtggttttatgtgactgtagcgatgctcttgctttttggcgttgcggctgcatggcttttatacacgcaaattcatcggccaatcgacaggttaaaagatgggattttggcgtttaaaggagccgactatagcgtgcggatgaaagtgcctaagcaaaaagagttcgccattgcaatgaatggatttaatgaaatggctgaacaaattcaaacattgattgaacaagtgcttgctgaaaagatgcgctctcaagaggcatcgttgaagctgttgcaagcacaaattgatcctcattttttatacaattgcctgttttacattaaaaatatggcaaaagtgaataacaccaatgctgtggaagcaatggccctgcatttaggtgattatttccgttatcgtgtaaaagtggaggaagaaaaaacaacgatagcagaagaaattaaccttgttgaaaattttttggcgatccatgcgctgcgaaaaaggcgtttgcactatgacattgcagttccggatgaaatgaagacgattacgattccccggctcataatacaaccgattgttgaaaatgcgattgtccatgcaattgaaaacatcgaaggcgatggatacatccaaat

SEQ ID NO: 6802 - DNA, 1176 bp, Bacillus clausii
atttcggcagcatgcctgatcggttccctggctaccaatttgttagcgatgatgaggtgcgccagcgctatgaacaaaaatggggtgttaaaatcccagcagaacctggcttgaataaccatgaaatggtcgacgcgatccatgaagggaagttgaatatcctctatttaaaaggcgaggacatgggcatagtcgattcaaatgccaactatgtgcaagctgcttttgaaaagctggacttttttgttgtccaagacgttttcttttcgaaaacggcccaattcgccgatgtcgtcttgccagcaagcccgagtcttgaaaaagaagggacatttacgaatacggagcggcgtgtgcaaaggctatatcaagtccttgaaccacttggcgattctcgccctgactggatgattatccgagacattgccaatcggcttggggccgcttggtcgtataaacatccatctgagattatggatgaggcagcatcgctagcgccattgtttgctggcgtacgctacgaccgccttgaaggctacaacagcttgcaatggccagttgcagaagatggcacagatacacctttgctgtttaaagacaaattcccgctgccagaaggaaaagcccgcctatatcctgttacatggacgaaaccgcttgaattcggggatgaatatgacattcacgttaacaatggaaggttgcttgaacatttccatgaaggcaatctgacgtataaatcgaaagcgatcagcggaaaaacgccagaagtatttttagaagtatcgaaggaacttgctaaagaccggggcattacggacggaacaaaagtacggcttacatcgccatatggcagcgtgaaagtaaggtgcattgtcactgaacgagtcgcaggaaaagaagtctatttgccgatgaacacgagcggagagggagcaatcaattatttgacaagctctcattcagacaaagacaccgacacgcctgcttataaagaagtcgctgctaaaatggaagtgttagagccacaaggcaaaaacccacttccaaagacgaaccaccgctatggcgatcctcagccacaaataggcgtgcgcgttcaagaaaagtgggcccgaaaggattatgtgtttcctggcgatgtagtaaaggaaaggagagcgcagaccaatggct

SEQ ID NO: 6803 - DNA, 420 bp, Bacillus clausii
agtcttaaaagatcaaaatgtgtattttgaagtgtatacgaatgaaggcgtttattccgacgattttgaagcgggccttgccgtagtagtcgatgtcttaaaatcgacaggcgcgaaattgtctgagcaagaaatcatgacattcgccaagcatcgttttgacaacggctcaatcaaattgatcgattgttacgagaaactgctcgaagacggagccgttgtgcttaaactccttgctttttcactcaatgcagaacggcttatgagtgctagagacaggctagagttagacaaaagccttgccgtcagcgcttctgcagcagacaatcttgaaattaccgatgtgaatgcccaaaaaggcattgcagtcttgcgattagcacaatcgctaggcttttctccgaaagatgtgatggcagt

SEQ ID NO: 6804 - DNA, 750 bp, Bacillus clausii
atgacaacgatcaattgggcaatacttggcccaggagccatcgctagcgattttgcccaagcactaaacaacatcaacggaacgatttatgcagtcggttcaaggtcgattgaaaaagcgcaggcgtttgcaagcaaatttggtgtcaagcatgcgtttggaagctatgactccatgcttcacgatgaaaacatcgacgccgtttatattgcaacgccccattccaaccactatgaatacattaaaaaaagtttacaaagtggaaaacatgttttatgcgaaaaggccatcacggtaaacggccaacagcttgaagaattaatgagcctcgcaaaagaaaaacaacttgtgctaatggaagcaatgaccctttttcacatgccgctctatgccaagttgcaacaggtgattcgctcaaatacgttagggccagtcaaaatgatcaatgtcacatttggcagtttaaaggaagcgaacccgcaaaatcgttttttcaataaagaacttgccggcggggcgattttagacattggcacctatgcgttatcgtttgcgcgcttttttttagaaagccagccacatgaagtgttgacgacggtcaagccgtttgaaacaggcgttgatgaacagtcgggaattgtccttaaaaccaaacaagaacagttggcaacaattgcactagcaatgcgctcgaaaatgccgaagcgaggcattgtcgcctgtgagggggggctacataaccgtcgatga

SEQ ID NO: 6805 - DNA, 465 bp, Bacillus clausii; identical to SEQ ID NO: 6691

SEQ ID NO: 6806 - DNA, 774 bp, Bacillus clausii
caaacgtaaagcgccttccactcgtgcatggtggcgaaaaattaaacaccaaccctatattcgtgtaaccattctcgcgatcctaggcgttctgatttatgtatcgatgttagacaacgtcataccagagcggctaaacgtaaatttgtccgagccagcggagcaagatattcgtgcacctatgacggtagtggaccaagcggcaacggagcagcgaaggacggaagcgatcgccagcattgattcccaaatgaagcacaatacaaaatacgaagaagacagagttcagcaagtcaatgatatctttagtgtaattggaagtgtgagggaagactcagccgagctggaaggggaggaggaggacagcgatgaccagaacatgcctcttgaagaccaagttgaacgtgtgcgcgctgatttctccgatactacaaatgctgatttgcaagatgaaacgatcgtcgccttgcttgaggctacggatgcccaattccaattagccctggacacctcggtaaatacagttcatgaaacgatgagccaacaaattcgtgttggcgatttgcaggaggtaaaacaagaagcgcgagaccaaattgaaagcatttcgacgcttgtttctgatgtgcgccatgctgtcgctgaaattgttgacatggcgattgtgttcaatgttacatatgatgcagaagcaacacaacgattaaggcaggaaacatctgaagcgatcgagcctgttctcattcgcgaaggggagctaattgtaaaacaagg

SEQ ID NO: 6807 - DNA, 513 bp, Bacillus clausii
ctattgcattgctataggtattccggcgctttgcggcttggtcgtgcttcgtgaaggggttgccgagctatatttaggagaagcgtttcgggagacggccgtgctgctcatgccgtacattgccgtgggcgccttgttaaaaggctttaaactctatggtgtcgatattatgtttcacttgtataagcaaacaaagctgcaaatggtgccagtcgcagtagctgccatcgccaatgtgatactaacgattgcccttcttcctacttatggcttagaaggggccgctttcgcgacggtggttgcttatgggttggcgattgctcttgcgtggctgtttataaataagcaaatggggcggctgccatttccgggtaaagattttgtaaaggttttgtgtgcaacagcgatcatgctcctttgcatgtggccgtttttaggcagcgctcactggggcatgctcatccttcaagtggggatcggagggctaagctatggtgttgcctgtttgctgct

SEQ ID NO: 6808 - DNA, 315 bp, Bacillus clausii
cgccattgaatgaacgtacattgacagtaagagcacttataccttctattttgcaaagtggcactaaaaactatagcaatcgcaaacaacttaggcgcaaacttgatgatatgtatggagcgattttaacgggcgatgttcaaaaaaaaggcgagcagcatgtgcttagctttcgcatggaaatagccagtgagcggtttttgacaggccaacagccattattgaaagaagcgctttccctttttaaagaagttgtttttgagccaagactagaagatggggctttcgcgaaagcgattgttgagcaagaaaaac

SEQ ID NO: 6809 - DNA, 660 bp, Bacillus clausii
atatcattggcgcctacgatgaaaacgagctgactcgctctatcgaggagctattcacacaaaaccgccaaccaaaagcggaaggacaagcagcagccaagagcccggtccacataaccgaaaaactcgtgacggaaaaccaaaaagtcaaacaaggcaaattgcatattggctttcgtacccatacaacgtttggcgatgaagattatgaggcgatgcaagtcgccaatggcatttttggcggattcccgtcgtcaaagttgtttcgaaatgtccgtgaaaaagaaagtcttgcttattatgccgcatctcgccttgaaagtcataaaggcgtgctaatggtaatggccgggattgaatttaataaatttgaacgtgcggttgctattataaaggaacaagcagaggctatgaaaacaggggaatttgacgaggaaacgattgaacagacaaaagcgatgctcatcaatcaaatgctagaagcgattgatacaccaaggggatttgtcgaactgtcttaccatgaaatggttgcagggacgacttatccaattggcgagcggattgaagcgttaaagaaagtcacgaaaacagacattgtcaatgcagcgaacaaatgggaattggatacgatttactttttgaaaggggagagtgaat

SEQ ID NO: 6810 - DNA, 1227 bp, Bacillus clausii
  misc_feature (1)...(1227): n = A,T,C or G
tgataatgggcttgatgtttacattcttcaaagccagggtttcacaaaacgtttgncactttacaactaaatacggttcgattgataaccattttgttcctcttggacagacagagccagtaaaagtcccagacggcattgcccactttctagagcacaaaatgtttgaaagcgaagaaggcgatgtttttcatacatttggcaaacaaggggcacaagcgaacgcttttacaagctttacccgcaccgcttatttattttcaagcacatccaacgtcaaccaaaatgttgaaacgctgcttgactttgttcaacacccttattttaccgatgaaacagtggaaaaagaaaaaggcattataggacaagaaattacgatgtatgatgatgatcctgattggcgcgcttactttgggacaattgaaaacatgtattcatcccacccggtcaaaattgacattgcagggacgatcccgtcgattagcaaaatcacgaaagaggacttgtacacttgctatgagacgttttaccatcctagcaacatgttgctgttcattgtcggctcggtggacgtaaatgaaatgatgcagctcgtccgggcgaaccaaagcaaaaaggaatttgccgacccaaaaccgattgagcgtcacgtgaagcctgaagggacgccagtcgacagagccgaacatgttgtcgctatgcctgtccatacgccgaaggtatttgttggctttaaagagtcaaacccaacgcggcaaggggaagaactgctaaaatacgaactgtcgttaaatgttttgctcgatcttatgttcggcccaagttccgaggcatacgaggctatgtatgaggcagggatcatcaatgagacgtttgcatttgactatactgcagaatatgggttcggtttttcaattatcggcggagacagtacaaagccagaggaactaaaagaaaaaattattgagaccattgctgcattcaagcagcgtccacttgcgaaagaagaagcggatcgggccattaagaaaaagattggcgcttttcttcgttccttgaactcgcctgaaaacattgccaatgaatttacacgctatgcgtttaatggcatgaatttatttgatgtcgtgccggtgcttgaatcgttagaagcatctgacttggaaacagtgctccatcaccattttaaaagcgagtaccggacggtagcgacagtcaaagacgaag

SEQ ID NO: 6811 - DNA, 933 bp, Bacillus clausii
atgaatcgcctgtgcatcagtttgcttacagcgagtgcagcagttgtcttcgttttaagcagcgatgttggcgttgctggcgctttgcttataggcgcaatcgccctcttgccagcggcttggcagagtgggcggctagcaacggtggcggcatttgtactgccgttgcttctgtttgctagtgtggcgactgggcacaaaaaaagcaacgtcagcatgctttcaggtgaagaaacaacatttatcgtagaggtaaaagaaacacctcgccttgatggaaatcgcttgaggatggtggttgaaacaacggccggtgagcgattgcaactagcaagccgtttgcaagcagaaagcgagcaacgtttaggtaaattattaccaggagaccattgccacgtaaatggcaagttgagcgagccagaccctccacgcaaccgctatgcatttgattatagccgctatttatacgagcaacgaatccactggctgttggaggcagagtctggatcttttgtatgcaaacgcatggataggctttcgttattgacacacttgcaggcgtttcgagcacaattgcttcacgaggctgttgctgcctttccaaaagaagcgggaggcattgtgttagcgcttacccttggagagcgtttctatgtagaagaagacgtgattgaagcttactcaacgcttggcattatccacttgctggcgatctctggcttgcatgttggcttggtaactggagccgctttctttatctgtatccgcatcggcttgacgcgtgagcgtgccgcactatttatgcttattctcttgcctatttttgcgattctcgccggggcagcgcctccggtattacccgcgtctgcaatggcatttgtgttttttctgtttgccttacacaaatggcgaattcaccccttattcggtttt

SEQ ID NO: 6812 - DNA, 1126 bp, Bacillus clausii
atgacggaatggactgaaaatgcaactagtaccgtcctttgcaggattaatcaaactaaccttcgaataaaatacaaaatgaaagcgcattcaaaagagaggggggggaatttgatggagtcaacaccatcagctggccaagcgccaaaaaaacggcaaatcctatttatttctggagcagcgattttggtcattttgcttgcaactctattatgggcgtacatgcaaatcaaaaaaccgctgccgcaaacgacaggagaactcgtcgtcaatggattaaatgctcctgtcaacgtctatcgggatgcgcaaggcgttcctcatattgaagcccaatcggacgatgatttatattttagccaaggctacattaccgcccaagatcgcctgttccaaatggatttaagcagaaggcaggcgtcgggacagcttgctgaagtaatgggagaaacctttgttgactcagatgttttctttcggacattcggcttgcgccgggccgctgaggcatcggcatctgcctatgacgctgaaacgtatcagtatttagaagcttacgctgatggcgttaatgcttttatcgaacacgctcaggcaactggcacacttccacttgaattccgtttggccggctatgagcctgaacaatgggacccgattgactcgttaacgatagggaaatatatggcatacgacttaggcggcaattggcaaagccaagcgttccattactggctaagccaacatgtgagtgaagaggaagcactcgatttgcttcctagctatccagcagaagggcctgctgttcttgacttggcacaaacgattgacatggatgtcgaagcggcgtttgccaacattggctctaaactgccacacccttttaacggcagcaacaattgggtgctttcaggggaacggacagcgtctggcatgccgctgttggctgatgaccctcacttaggattgggggcacctagcatttggtatgaaacccatttgacatcgccgactgtgaacgttacaggcgtcattttcgctggcgtccctggcattattcttggctcaaatgaaacaattgcctggggtgtcaccaatgtcggccctgacgtacaacaagctctat

SEQ ID NO: 6813 - DNA, 732 bp, Bacillus clausii
aagtcgattgggcgaatcgcctgaaacgggatatcggccatgccaagcaacaatttaacacgatttataaacagcttggcgtttgggaaattcaaggagaaaacgtctatgtgatgagcttgcctcctgttgattcatgggaagaaacgatggagccttttacgatcggcaaccgaaaaggaaaaattcgcaacattgccttgcatacagatacggatacatacaatgagatcactgaacaaacattggagaatgacgggctgccaccgtttgagccattggattctcacgaggcgatggaacaggagattttgcggattcacgaaaacgtaaaacgcacgaccgttggccgccagacaaaagaacggcaaacgttgttttttggaaaacctcgagtgatctatgcgctgttaatttcgatattaattatgtatagcgtccttgaagcaaatggaggaagcaccaacattgaaacgttaattgactttggcgcaaaatacaatccactcattgtagagggcgagtggtggcgtctattttcagcgatgtttttgcacattggctttttccatttgttgatgaacggcatggcgctttactttttaggcagtgcagtggagcaactttttggttcgatacggtttttggtcatttatttcatggctggcttatttgggtctgccgttagctttgctttcacagactctttgtcagcaggtgcgtcaggggcat

SEQ ID NO: 6814 - DNA, 762 bp, Bacillus clausii
atgaatgccattgatctaaatagcgacgtaggcgaaagttacggcgcctacacgatagggaacgacgataaaatcatgccttacatttcatcagccaaccttgcgtgcggatttcatgcaggcgatgcccatgtgatgaaggaaacggtttcacgtgcattggaacatagtgtcgcgattggcgcacacccaggccttcctgacattggcggttttgggcgtagaaaaatcgatatttccccacaagaagggtatgaactggtcgtgtaccagattggcgctttatgggcgattgcgaaagcgcaaggaggcaagctccatcatgtcaaaccacatggcgctttatacaatatggctgcagctgacgaggcactagctgaggcactcgccaacgctgtttaccatgttgaccccaatttggtcttttatggacctgctggaagcgcccttattgctgctgggaaaaaagtagggttgaaaacagctagcgaggtgtttgcggatcgcacgtaccaagcagatggcagcctaacatcaaggcgtgtcccgaacgctctaataaccgatccaaaagaagcgtctgcacaagtgttgcggatgatacaggaaggaaaagtgcggactcagcaaggcaccgatgtagagattgacgcacaaaccgtttgtattcatggcgatggcgcacatgctgtcgcttttgccgaggagcttaaaggagagcttgaacgccatggcattgctgtcaaagcaggaaacagctaa

SEQ ID NO: 6815 - DNA, 1017 bp, Bacillus clausii
atgtcgccattccccttcttgccatcctgctcgggctgcttgtcggcgccatcgtgatggtcatcacgggccataatccgattgaagcgtatggggcattggtagcaggtatttttggcagcagctattattttggcgaaatgattcggacgatgacaccgcttatattagggggactcgctgttgcatttgcttaccggacagggctgtttaacattggcgtggaagggcaactgattgtcggttggcttgcctctgtttacgttggagccgcttttgaagcgccgatggccatccacctcccactttctattgccgctgcggcggtagccggggcgctgtgggcatttgttcccggcatcttaaaagcacagcttcatgtccatgaagtcattgtcagcattatgatgaactatattgcattgtataccgccaatgcgatcattcgcacttacttgcttatacctggcgagcggacagaaagcatttatccttctgcctcattggcttcgccattctttcagtctcttacggaatattcacggctgcactatggctttttaatcgcagtggccgcgtgtttgtttatgtggttctttttatggaaaacgacagcgggctatgagcttcgcgcagttggtttaaatgcaaatgcttccacttatgcaggaatgaatgttagccgcaatattattctttcgatggctatttctggcgcatttgccggactggcaggagcggcagaaggcttaggaacttttggatacatgagcattctttcaggctttacaggcgttggttttgaaggcattgccgttgcactactaggtaccaatacagcgcttggcgtgttcttgtctgcctttttattcggaggcttgaaaacaggcgcattgacaatgaaccagcaaaccaatgtgccgacagaactgattagcatcgtcattgcactgattattttctttgtcgcttcaagctatgttgttcgcctgatgcttctgaagcggaaaaaggggg

SEQ ID NO: 6816 - DNA, 954 bp, Bacillus clausii
  misc_feature (1)...(954): n = A,T,C or G
tggatgtgctcgcgctaattgtttcaacgacgatttattctgctgcccctttaatgcttgctgctctaggcggcttgtttagtgaacgttcaggcgtcgtcaacattggcctagaagggttgatggtgataggggcattttctgtcatcgtcacaacgctcactcttgaagcggcangggtaggtgctctatctgtttggatcgggttgctttgtcgctgctgtggtcggcgcgctgttttcattgatttcatgcagtcgnctcgatccattttccaagcagaccaagtcgtaagtggcgttgccttgaactttcttgcagttggcctttcggtctatattatcaatttgctttacggcagcgggcaaaccgcttatatcgaaaaccggttttaccgttttaacattccaggtttaagtgacattcctgtcatcggaccgttgtttttttcaaatgtgtatgcaacatcctttcttgcgtttggacttgcctttctcgtttattatgtcatttattatcggccgtttggcttgcgtctccgctctgtcggcgaacatccacaggccgcggacacaatgggcatacgagtaatcaagatgcgctatatcggcgtcatgttgtcgggcgtgtttgccggccttggcggcgctgtttttgcagcgacgtttagcggtaatttttcagcaactacgatcacaggccaaggatttatggcactggcggcgttaatctttggcaaatggcaccctcttggcgtaattggcgcaacgttgttctttggactggcccaagcacttggtgtagtcggccaacagctgccgtttctttctgatgtgccgcctgtatttttgctaattgccccttacgtgctgacgattttagcccttgccggttttgttggccgggcagaaggtccaaaagcgttaggcaagccttatataaaaggatcgcgct

SEQ ID NO: 6817 - DNA, 970 bp, Bacillus clausii
atggaagaacggaatcgaactgcatttatccaaaacttattaaagttagtagcgccaggcacgccgcttagggctgggattgacaatgtactccgcgctaaaacaggagggctgatcgtccttggctacaacagcgaaatgatgaatattgtggacggcggtttctttattaatagtgatttttcaccggcttatttgtatgagctagctaaaatggacggtgccattattttgagtgaagacggcaaacgtattttatatgccaatacgcagttggtgccgaataataatataagctcgagcgaaacagggattcgtcaccgttctgctgaacgggttgctaaacaaacaggcaatttgacgatttccatttcccagcgccgaaacgtcatcactctctaccaaggggaatatcgttacgcgctaaaagacattggcgtcattttgacgaaagccaatcaagccatccaaacgcttgaaaaatataaagcggtattagaccaaggaattacaaatttaggagcgcttgaatttgaacagcttgttacttacagcgatgtgattcaagtcattcaccgtgtgcaaatggtgctgcgcattaaacaagagatccaaaattttatccttgagctaggagacgaaggccgcttaatcacgatgcagttaaaagagcttgtttccaatacagagcaggaagccctttatttgctaaaggattacgctaaagagcggacgcaggacgtaaagaaaacactaaaggaactcacgacgttgttaaacgaagacttgctcgacgaacaagcgattataaaagcgcttggctattcaagaacaagcaattttctagaacaaccagcatcgccgcgtggataccgaattttgcaccgaatcccacggttgccttcacaattcattgaaaatttcattgacgaatacgttcatctcttcaagcgtaatgggttgctacgga

SEQ ID NO: 6818 - DNA, 892 bp, Bacillus clausii
atgcttaattggattgttcggattttctttttattagcgggaggaacattagggttcttgtttgtccctgaattcattgcagtgatagcgctagaagtaccggcatggttggctagtccttatacaggggcagtactcggtgctttgctcttatatggtctgtccttgtttattgtcgatcttattgttaatttctttcgggttgtcgaggaaacaattgtcaaagcgccgcttgctgatgtgttgtctggatcaatgggcttaacggtcggactcgtggctggttattttctcggaacgccgttaagtggattggatttgccggttatcagcaatattttgcctatgtttattacgattcttctcggttatctaggcttccaaatcggcttcaaaaaacgagatgagctatttcaattagttgtctctatgcgagtgccaagagataaagagcgtgacaaaaagaaagaagagactgactctaatctcggcggcaaacaaatgaaaattcttgatacaagcgtcattattgatgggcggattgctgatatttgccaaaccggctttctagaaggcacgcttgtcatccctggattcgtgttagatgaattacagcatatcgctgattcttctgatgcattgaaacgaaatcgtggccgtagaggccttgacatactaaataaaatacaaaaagaattgcctgtcaatgttgagatatacgaaggcgattttgaagacattcaagaagtggacagcaagctcgtcaaattggcaaaaatcacttccggaattgtggtaaccaatgattttaatttaaacaaagtctgtgaattgcaaggtctaaaagtgctaaacatcaacgatttggcaaatgcggtcaagccagttgttt

SEQ ID NO: 6819 - DNA, 231 bp, Bacillus clausii
cgttgctcgtcattgtctgtgtcgtcattatccagcaaattgaaagcaatgtcttctcgccacaaattatggggcgccagctttccgtgcacccgctgacgattatttttgttctccttgtcgccagccagcttgcaggttttgtcggaattctccttgccgtgcctgcctatgcagtcagcaaggttattgtccagcacacgtaccggcttatacgtatccacagacggt

SEQ ID NO: 6820 - DNA, 360 bp, Bacillus clausii
aagatgtagctcaactggatggcggcattgtcacttacggaaaagacccataagtaaaaggggaattgtgggatggcaaatgctatgtattcgatgagcggctaacggtgccgattaaccacgtagcgccaactgtagtcggaaaagattactttgacggaaaaccgtgtgagcggtatgtcaattgcgccaatccagagtgcaacaagcaaattttatgttcagaggaaaatgagcataaatatttgcgcggctgtacacctgaatgccgcgtccaccctcgcaatctctatgtaaaagagcatcagctatctcctgaagaacaccaagcgcgacttgacgttcttggagagaggctac

SEQ ID NO: 6821 - DNA, 840 bp, Bacillus clausii; identical to SEQ ID NO: 6580

SEQ ID NO: 6822 - DNA, 390 bp, Bacillus clausii
  misc_feature (1)...(390): n = A,T,C or G
atattcttatcattagcgacagcnatgggtggaccgatcagttaaagacgattataggccgccacgaacatgaggtggaccaagtcatacatgtcggtgattcagaacttcctgaacacgcgccagaactggctggggttaacgtggttgctggctattgcgatgtgttctcttcttttccaaatgaggtagtatgccaatgggaaggaacaaccgcttatatcgcccacgnccatcatcatggcgttanacagacgcttgcgaaactaatcggccgtgcaaaagaaaaaggcgcacgnatcgccatnnacggccatagccatattgcccgggccgcagagcatgatggtgtcatcctcatncatcccgggagtgttcgcctaccaaaac

SEQ ID NO: 6823 - DNA, 912 bp, Bacillus clausii
ccggaaaatattttgcactgcttgttattgtagcggctatcactgcttttcttgttccagaagtttttatcccgattaatggctatgtaccaattttgctaggcatcgtcatgctagggatgggaatgacgttgaagccagttgactttaagcttgttgccacacgcccactccctgttttgcttggccttgtgttccaatttacgatcatgccctttaccgctttcgcgattgcttatttgctgcaattgccgccagaactcgcggctggccttgtgctgcttggttcagtccctgggggcacagcgtccaacgtcatggtttatttggcaaaaggcgatttacccctttcaattacaatgacgtcaatgtcaacgttattggcgccaatcgctacaccggctttgctttatttgttagctggacaatggctgccagtcaatttcgtcgacatgtttacgatgattgttcaagtcattgtcattcccgttatcgccgggttattgattaaccgtttcttgccaaaaatcgcagcaaaaacatctgtggcgatgcctcttgtctctgtgcttgccattctcgcgatcttatcagcagtggttgccgccaacactggcagcttgatccaagcaggcttgattagctttgttgccgtgatgctccataatgccgccggcctcgcactaggctttatagcagctctcgctttccgtttgccggctagccagcgtcgtgcgatttcaattgaagttggcatgcaaaattccggtctaggcgtcgccttagcaactgcccattttacaccattggctgccataccaagtgtactcgccgctgcttggcacaacatttctgggcctatccttgccacatactggtcaaaacggccactgccaccagaggccacatcac

SEQ ID NO: 6824 - DNA, 218 bp, Bacillus clausii
  misc_feature (1)...(218): n = A,T,C or G
attttaagtcaccatgggaaaggggaatggggcagtccaaaaacccctgtagtgagggaggnaaaagttctccatttaattgataatattgatgcgaagattaatatgatggatcgggcgcttgaacgggtacagccggnagagttttcggaacgggttatggcccttgataatcgcagtttttataanccgagctttcataaaaagccaatagagtt

SEQ ID NO: 6825 - DNA, 559 bp, Bacillus clausii
atggcaaaagcgatgcgaaaatcgtttccggttatctttgtcagtgcattaacgacgttttttggattcatgtcgctaatgctaatggactttgggattggcgtcgatttagggtttaacctcgtaaaaggaattgtgttcagctttatatcagtcgtcgtgtttttgcctgcgttgacgctgacttgttacaaatggatcgaaaaaacgacacatcgaagcttcgtgcctagcttcaaaggcagcggagccaagctgcttaagctgcggatccccgctctcgtccttgttctgttgctgctcgttccaagttttttggcgcaaagcagcaccacgtttctttatgggcttggggacttgcctgaacagacacgcgctggcgccgatgcgaaacgagtcgaagaaacgttcgggcaatcaacgccgattgtcttgctcgtccctaacgacgacatcgccaaagaagaaaagcttgtccaagagttggaacagattccctatgtcgagtcagtgcttgcctatgccaacatggtcggggcagcgatcccttctgattttc

SEQ ID NO: 6826 - DNA, 216 bp, Bacillus clausii
atgaaccgacccgtttccgaatcaatgcttccgtttcatcaagcaaacgggcagcttcatttttatctgcatgctttacagtcaagcgcagtttcacttccccatcaccagccaatggagcgattgtcgggttcgtttgcgtcgcaatcaagtccaaaaggtctgtttctaattgtgattccccaattccaaaaaaatgaagcacacgggaagtga

SEQ ID NO: 6827 - DNA, 202 bp, Bacillus clausii
atgcttcttactgagaaaaaagcacctaaaacagcgattagtatgatgagcccactaattcctgtgaaaaattcgatatttacttggaaaggcaccgcttctggcaacagcaaggatgtacccaaagttgacagcaagcctatcatgacacctaatgctgttaataagaacgtttgcgcaataacagaagttgatatatatc

SEQ ID NO: 6828 - DNA, 339 bp, Bacillus clausii
atgcttgtagatgcagccgccttgcaaaagcgtgcagccaagaccggttttgaatgggcaaacgtcgaagaagtgtgggaaaaattgtttgaggaaatagaagaatttaaagtggaagcggccaagtcaagcaaaagcaaaatggaaaaagaatatggagacatcctgcttgcagcggtaagcttggctcgattttatgatctctccccagagatcgcgctccatcgttcgttgactacatttaagaagcgatttttgtatgtggaacaaaaagcgcaggaaaaagggcaggcgatagccgacatagaagatgcgcgaactggatcgctggtggaatga

SEQ ID NO: 6829 - DNA, 386 bp, Bacillus clausii
atgtatgcgatcgtctttaccgtgattgtggcattaatgaaaacatcgagttacttagagagcctattgatgataaacggatttgggtttgttgtcccagctgcagcaggggcaatgctccttacgttattgttgcagccaaaaatcgcgattgtttctagctttttgtttgcgattattggcagcgtttattacaatcacgattctacgagcacattttcatttacgtatggtttctatatatttataagctgtttaacggctacctactttttaaatagtaccaacaaaactacgccgatttgccgggccggtccgtttgttgcttgcgccaaatattatcactgtacttggcgcccattattaatgaaaaagcatccatgtaa

SEQ ID NO: 6830 - DNA, 345 bp, Bacillus clausii
gttatttcatccacatgcggacgtgcacgctatcaaaaaagagaacattggcttgattgaagtaatgggcttagccgtattgcctgggcgcttaaaacaagaactagctgagctagcgactgtcctaccgagcgctaacgcagcagaacaaattgagcaaaatgaaacaattgcaaaacacaaagagtgggcgctttcgctaaaagagcaaaagccgaaccttataacagcgaatgtggaagcgctccttaagcaagaagttggtcggttgtttgcgactgtcctctcccatgctggcgtctttaaagataccgactcaggagaggctggtttcatccgttttct

SEQ ID NO: 6831 - DNA, 576 bp, Bacillus clausii
atcctttgtttatctttggggcaattgcagtcggttttttccacgacgctgcactaggaatggttttagcaattgcccactatggcggcaacgtgttagtcgggctttccatgcgtttttatggggtttctggaacggacgagaatagccgcagcaaaaaggggctacagctgaaggacgctttcttgcttttgcatgaagaacgcttaaaagacgggcgcacgctcgggaagttgctcggcgatgccgttcgttcatcgatccaaacgctgctgttgattggcggttttattattttgttttccgtattaaacgagatgctgtcactactaggcgttcttagccttgtagcattcgcagtccaacagctcttttcccttgttgcgcttccacctgaactagctaagccttttttacctggtctgtttgaaatcacaattggggctgaacaaataagcagcacagacggcgtatctatatggtttcagcttattgtgtttctttcatccttgggttcggcggcttttcggtgcaagcccaagtggccagcatctttgactgagtcagaccttcgct

SEQ ID NO: 6832 - DNA, 174 bp, Bacillus clausii
acgtcgaaaaccccactgggtttattataaagaaattttccgttccaaatttcaagctggttgtgtaaaagcgaaattggaggataattggcagaatggatatgaaattggccctttagttgaagttaaaaagctacgatcaaataaatatgtagttcgttacacgtatgatga

SEQ ID NO: 6833 - DNA, 131 bp, Bacillus clausii
gacagttatctgagctgaaaattgaaagtacatatttggcggaaatgattcctttatcgatctataaaccgccccattatacaccgttaaaatcgtacagactcttgatttgccaagatggccaagactat

SEQ ID NO: 6834 - DNA, 1046 bp, Bacillus clausii
ttgcggattagcggcatgtcgtttaatgcggggattttttacagcggggcaggctttttggcttgtgcatactatgatgaacagggcaagctgcattcatggggaaagccagtcggaatgcaagcctatttccaagctggcaaactgattgtgaaaaccatgccatttcggtttgtcgcactcattctcgccctgctgtgtttaattattgtgcccaaaatcgttccaagcagctggaatgggtttcctgtttatacaatattttatttattgtttgccgggcattttctatttcctgagccgttaaaaaagtaccatggcgcagaacataaagtgtttagtgcaaaagggcgcatttgtacggaacggttacaggcgataaaaagagcggatattcgcaaccgtggttgttccactgggctagttgtcgtttattttttaagtgtcttccttctaagtggaagcctttctttgtttacgccaatacaacaagcgctaatggtttcctcctatgcggctctggctgccgttgtcctttatcaactttttcaccgcaagccgtggctaaaagggcttgaaaagatcgttttagttctttcttactggttgcaacttcatgtgacaacgaaagagcctgacgagaaccatcttcaatgcgcgattgccgcctatcaacagttaggctatttagcttttccagaaaacataaaaaagcggaggcttccgctaaaggagaacaagagaatggcaattgcagacatatcgatcattccaattggtacttcctcgacaagcgttagcgcttatgtagcatatatccaacaagtgcttgatcactatgagaaggaaaggaaaatccgttacgagcttacgcctatgagcacgttgattgaggcagagctgactgtgttgtttgaagtgatccagaaaatccatgaagcgccgtttgaacaaggagccttgaggacggcaacgtcgattcgcattgacgaccgccgcgatcagcctttaacgatggaaggaaaacggaaatctgtgcaagagaa

SEQ ID NO: 6835 - DNA, 513 bp, Bacillus clausii
agtcgtattaatattgccggtcattttaatgatcgcgatcgctctgagcggtatatattacttgaatcaagaagaaacgatgacaaatgaacagctgaaagctgaaattgaactagtagctgaacgaggagaagacggtacattgtcacttgaatggagctggccgcaaatgccagcagaaggcatgtatggaaccgactatattggcattgcctttactggggcagacgaagtggaagttggcgaggcagtccttgatacagaagaacaacatcgctataaaggcgagcgtgtcgaaaacgggatcatttttgcatatccgacggaaatggcagaacatcaaagcattggcacgaagggcacgattgtccaaccgttgcctgcttctgccgagaacatcaccgtttctgtcctacatacatggacgaaccatgaagcgttgacgatggaagacgccacttttgaagcacctgcttttggtagcgccaaaaatgttcagcattgggtaaaaac

SEQ ID NO: 6836 - DNA, 138 bp, Bacillus clausii
tttttgagcaagggtttactacaaaagaaggtggacatcgcggtttcgggctctcactcgtgcaagcggcattaaaagaattaggtggctttcttgaagtcgaggcgaataagccgacagggacgatcattagtttgt

SEQ ID NO: 6837 - DNA, 324 bp, Bacillus clausii
atgctcttccggtgtcacctttgccattgttgctttataaacggcgtggggaatcatcgattgagaagaattgattttcatgttaccgccacctttgctactcattttttttatgaagcgtttcttgcaatcgataagaggatctttgctccccgtcgatgcgtttcgctggctttgattgttgtccgctatttgccaaatcccgcttcatttcttctctgcaggagtggcaaatccacggttccttcgttcgctgtttgcatcgctcgcatatattatataaattcgggaaatggcgaagctgcaagcgtccttttcggatga

SEQ ID NO: 6838 - DNA, 236 bp, Bacillus clausii
actggggtaagctatgatatggtgcagacgctcatccgaaaaggacgcttgcagcttcgccatttcccgaatttatataatatatgcgagcgatgcaaacagcgaacgaaggaaccgtggatttgccactcctgcagagaagaaatgaagcgggatttggcaaatagcggacaacaatcaaagccagcgaaacgcatcgacggggagcaaagatcctcttatcgattgcaagaaac

SEQ ID NO: 6839 - DNA, 234 bp, Bacillus clausii
taaaagaggcattaacaaatgtcgccaggcatagcgatgcgacaaaagtagctgtccatctagatgtcacagagacgattgtccgcctcagcatccaagataacggcacttgttctgctcagtctaaagacggcagtggcttgagaaatttaaaaatccgtgcacgtgccgctggtgggagcttgtctgtgaaccgctcatcgggctattcgattgtttgtgtcctgccaatcc

SEQ ID NO: 6840 - DNA, 549 bp, Bacillus clausii
atgaacgctttacagcaagctgaaattgaagaactagaagggcaggaattgagcgaggaacgtttcaagattacggatcaggagtctctaaactgggctttccgaaaaatcgctgcattaaaaactcaaatggaagagacggacgcaattgcggcaaaagagattgagcgcatccatctgtgggcagcagaacagcataagccagtaaaacaatccattgaattttttgaaagcttaattgctcagtatcacatgcaattgcttgaagaaaatccgaaggctaaaacgctgaaaactccacacggcaaatcaaaaagtactcgtagaaagccagcgcctgtggcagtaaataaagacaagctgttggagcatgtgaaagaagctggtatgtctgactatataaaagaagaaattcgctggggcgattttaaaaagacacttagtattactactgccgatggacaacctgttgttgttgatgcttggggacaacgcgtagaaggcgtagaaattgaccagggtggaaccacattcaaagtagaagtgtga

SEQ ID NO: 6841 - DNA, 71 bp, Bacillus clausii
gtggctttaacaactggaatagtagggttgccaaacgtggggaaatcaacgctgttcaatgcgattaccca

SEQ ID NO: 6842 - DNA, 174 bp, Bacillus clausii
  misc_feature (1)...(174): n = A,T,C or G
agaaaaggaatttgcgttaggcgatgtggtggaaatgaagaaaccacatncttgcggggaaaatcgatggaagattatccgcatgggcatggatgtccggataaaatgcctgggttgccaacacagcgngatgctaccacgccgggacttttcaaaaaaactaaaaaaagtatt

SEQ ID NO: 6843 - DNA, 110 bp, Bacillus clausii
  misc_feature (1)...(110): n = A,T,C or G
agcgatcgttttcctggcgttggnaaaaagacagcagaagcgattgtcgacgcactcggtgaaagggcgatttcagctattattgaagaccgaacggtattaaacaacat

SEQ ID NO: 6844 - DNA, 549 bp, Bacillus clausii
  misc_feature (1)...(549): n = A,T,C or G
agtcttgctagtggcaagcttgttttaccggccaaaacaattgtttgaagatgttagcaatcatttagtcgatggctttttgnttgcttttaaagcaatggggccggtcatccctattgccgggttcttttttctcggtagcagcgatttcgccccggccattcttgctattgacgaagcgccagcgtttttatttgaattagtcgaagcaggcgaatcgtatatccctaccgaaccaggttggactgcatttggattgttaatgattggcatgattacaggccttgatggctctggattttctggtttgccattgactggagctcttgctggtgcattggcgcctgtttcagggatcgatccagccactttggcagcgattgggcaaatgggtgccatttgggttggcggcggcacgttgatcgcttggtcttctctcgtcgctgttgccggtattgctcgcgttcatgttcaagatttggtgcggctctgttttattcctgtaattgctggtttgctcgtttcaacgattctcgcgcttgtgatttg

SEQ ID NO: 6845 - DNA, 315 bp, Bacillus clausii
atgttgaagacacagaatggcatacactcgtatttgacgtggttgtgttgccaggtcaagcagggaaagatattgagaatacagccgttgtcgatggcgacaatatcgacgacccagatgagccacgtgaagatgtcgaaatctacccacgtgagccaaagcttgagtcaagaaaatcagcaacaaacgcggacgaaagcaaagaccgctatgaagttggcgacacggttgtgtacacgattgaagcgcgcaacacggttgaagacagcttgctcgaaaacctcaccattacggacgttcttccagaaggggtaa

SEQ ID NO: 6846 - DNA, 279 bp, Bacillus clausii
atgtataaaacgatcgacggtgtccgcgtatggggggaaccacttgaaaacgctgttgaacaggccgttcgctgcagccagcatggcgatgtcgtccaaacgctattaatggccgaccaccataaaggctacagccaaccggtaggaggcgttgtcgtctatgacggccaagtatccccttctggagtcggttatgacattgcctgtggcaacaaagcagtgcggacaaatgttacttttgaggagattcgcttggagctgcctcagcttctcgataaa

SEQ ID NO: 6847 - DNA, 302 bp, Bacillus clausii
atgattcccaaacagacgctatctactgtacagttaaccgtcttaactgcgatcacattactcggcgtgcaatttttgattctgccccgcgtgctgacggtaacggcaaattcaacagacggctggctaacgattgtggctggagcgctctatacgttcattctcacttgcttagcgctctacttcataggccgccatcatgcaaatgacctttatacttacgggtatatgacttttggcaaaatcggcggcacgttgcttctttttttaatcaacgtttacttttgggtagcttcaagcta

SEQ ID NO: 6848 - DNA, 264 bp, Bacillus clausii
  misc_feature (1)...(264): n = A,T,C or G
cggaagaggttttggcctgggtaacgaaaacatttccacatttagtgccgaaaatcgcatggaatcagcctatgtttaccgatcacgatacatttattatcggcttcagcgtcgctaagcatcatttggctgttgcccctgaacaagcggggattcatcaattcnctgatgagattgaacaggctggctatgatcacactaaggaactggtacntatcaagtgggatcnaccanntgattnttcattattagaaaagatgatcg

SEQ ID NO: 6849 - DNA, 423 bp, Bacillus clausii
ggacgatgaacggattgttaattgtctttgcacagcccctgatccattgggtgatccaaaaggggaaactaacgcttaaagggcaaatggggcttgggttgttcatttttgctttgtcctatcttgtattgacacaagcccaagtgttcagtggcttttttgtcgccatgctcattttgacaatcggcgaaatgtttgtctggcctgcagtgccaacaatcgccaacgcccttgctccatctggacgggaaggtgcatatcaaggcattgtcaatagcgtagccactggcggccgcatgattggtccgttactcggcggcatagtggtagatggattttcaatccaagtgctgtttgtcctcattagtattttactgctactggcgattcctctagcccgtatttatgaccgcccgctattaa

SEQ ID NO: 6850 - DNA, 754 bp, Bacillus clausii
atgcaggcgattttatatgtgggccacggtagccgggtcaaagaaggaaatgaccagtttcgtgcttttttaaaaaaagccaaaagccatttttccggcgattatttccaacctgaagcgtttattgaacttagtaaaccgacgattgccgaagggattgatcggtgtgtacaaaacggggcaacggcaattgccgtcattcccgtattgttattgacggcccaccatgcgaatatggacatccctcaggaaatacaagcagctaagagaaaatatcccgacattgcatttgcctatggcaagccgtttggcattcaagctgatgtcattgatgttgctttaaagcggcttgctgatgcagggctgccactgcttgcagaggaaggcaagcggcaagaaggtacgaccgttcttgtcgtcggcagagggtcaagcgatggcaatcaaccaagtgatgtcgctaaaattgcccgtctactctatgagaaaacagcatgcgacaatgttgaaacgtgttttatggcagcaacaacgccgacagtggcccaagggttagccaaagtggagaaacttggtgcgcagcgtgtttatgtgcttccatatttgctctttaccggcattttaatgaacgaattggccaacacgctagcagacagaaaaggaaacacagccctgcatatgtgttatgcgaattccttggggagcgacgacgggctcgcgcctgtgttgataggccgcgtcaatgaagcgcttc

SEQ ID NO: 6851 - DNA, 510 bp, Bacillus clausii
atgtttaaaaaacgggccgctccctctttctcgggccctccacctactccatctgctggcccagtgacgcggggagcaagttcgccaactgtatccaaagagcagcgggctgaattgcagcaatttctccagctagcataccaatccgtactagaatatgaacaacttcgcagccaagcgcctacgcaacacttagcttctctcattgatgcaacgattgaagaagaaaaaagtcattatcaaacactgctccatgcttataagcaattaagcggcaaagaccctactattaccgaacctactttacctcgaaacgactatatccctgctttaaaagcagcgtttgaaaaagaacaagctgcggcttatacgtttgaacaggcagctcgctttacgactaaccctgctttgaaagaagtgtatgcttctcttgctcgtgatgagcagcgacatgccttatggctgctttctttcttaacgatctacagtactggcggagtttcccattaa

SEQ ID NO: 6852 - DNA, 89 bp, Bacillus clausii
ggcggcgatctgacaattgtatggcaagagaatggcgatgtgctcatgcgtgggccagcagagtatatttgcacagggaatgtctttct

SEQ ID NO: 6853 - DNA, 669 bp, Bacillus clausii
  misc_feature (1)...(669): n = A,T,C or G
gccatgtgcttttatggataactacgacccggcgactgtatttagttcgattgatacgcaagggcgttatgcatacggcaaccagccgcaaatcgccaactggaatttggcaaggtttgctgaaacactcgtgcctttgcttgccgaagatgaaacaaaaggggtggaaatcgcccaatcagcgattgaagactttaaaggccaatacgtaagcaattggctggcaggcatgcgcaaaaagctaggcttattcaatgctgaagacggcgacaaggactttgtagagaagttgcttcgccttatgcatgagcatgaagcggattacaccaatacattccggttgttaacactaggccagccagaaaaaacggcgatgaatgaagctgctgaatttgccgattggctggaacaatggcaacagcggcaaagcaggcaagcgcaaacgaaggacgaggcgatgaagctgatgcgaaccaacaatcctgccgttatcccacgtaaccaccgcgtcgaagaagcgcttgcngcagcagtcgatgaagaagatgacagcttggtgaaacaattgattgctgtattaaaagagccttatgcgtacagtgaagagcaagaacgatatgccgaggtgccagatcgttgccaacatggctatgtgacctattgtgggac

SEQ ID NO: 6854 - DNA, 330 bp, Bacillus clausii
atgggggataatgagattgacaccgcgaacgaacaaccaatccaagtaccacttcatgtcgtcggcactaagggaccagccgccttcaacgccgcaaacgccgaaacattcgtttgcattccgccgtttattgcggtggcgagccgaatcagacgagcatttgcccattgtgctatgaacgcctgtcaacgctttgttctcctcaggggcgatataacgccacacgatgtcttgaccaggaatatgaaaatgagaaagcagtccaatatcgtcgcttccagcaggatgtccagtcagcccaatgccatgctcctcgcaccaatcggctaa

SEQ ID NO: 6855 - DNA, 171 bp, Bacillus clausii
ctggctagagcgtacggttcatacccgtgaggtcgggggttcgatcccctccgccgctaccatatctatacataacgaatcaagcttttatggcggttgtggcgaagtggttaacgcaccggattgtggttccggcattcgtgggttcgattcccatcagccgccccatat

SEQ ID NO: 6856 - DNA, 69 bp, Bacillus clausii
ccacagtagctcagtggtagagctatcggctgttaaccgatcggtcgcaggttcgaatcctgcctgtgg

SEQ ID NO: 6857 - DNA, 390 bp, Bacillus clausii
  misc_feature (1)...(390): n = A,T,C or G
atgncggcaacattgacgatccagacaaacntgaagcagaaatngaaattacngaaccaccagcaccaccaacacctggcgatggagacaaagaagatccagtcgatccgactcctggcgataagccagaagaaccaaaaccaggtaatggcggcacgaacaaacctcaagagccgacaccaggagacaagtcgccgtcagacggaagcaagttgccgaaaacagcgncaagcacgtacancttgcttctcattggtgcaagcctgctngtcctcggagccannatctggttctttagnagnnaaaaggcancataaccancacgcnaaggtgaancgcnnacgcccttcacctttctctatgtgtgcccggcatgcgcatgggctatag

SEQ ID NO: 6858 - DNA, 368 bp, Bacillus clausii
aagtgttcggccatgtagaagcatcaaaagatttgaaattgctccttgtcattggcggcctttatgcactaagtgtggcgctttccaatacatttgtaaatatattcttgtggaaacagtctgggaaatttatggacctcgctttatacaatttaatgtctgtcatgttgcagccactcgcctttatccttgcagggaagctaacgaaaagaatcgaccgcgtgtttattttgcgcctaggcgtaagcattatgtcgcttttctacatcacggtgcttctagccgggtcacatgccgcggattatttgcttttgcttggtgcgttgcttggtgctggcgctggttgttattggcctgcatttaatgtg

SEQ ID NO: 6859 - DNA, 450 bp, Bacillus clausii
atgtatttaacagaagaaaatttcaaagcttcaaccaaagcgtttcaaaagttaatggaacggcagcaagcgcctgtccagcagttgttcttgcctgggcccgtcacacaattgaaagccgtgcaagaggcttgggcaaaggctcctgtatcccaccgggccgaagaattccatcacgtgatggcacaaacgaaagaaaagctgctccagttaacaaatggtcgttatgtcgaacttgcagttgggacagggacacttgccaatgagatggtagcagctcaactgtcgacgctacatcaaaaaggtgtcattctcacaagcggtgaatttggcgagcggttagtcaaacaagcagagcggtgggggttatcatttgaccaattggcccattcccaaactggcccggtaccttacgaaaacattgagaaatggctagaggcccgattctga

SEQ ID NO: 6860 - DNA, 499 bp, Bacillus clausii
  misc_feature (1)...(499): n = A,T,C or G
atggntcggttcaaccattnaataaaagaaggactggaaacgangaggcgttggatggagaaaggctatatccatccagagtcaggcctttgggacgagggcaaagcggcggaactgttcacatctgggcgagccggcatcattgctggtcctcattggatgcctgactggcctttaagcgagctaaagcaaaatgtagagggcgcagagtaccaggcttacgacattccaagtggtccagacgggcaaaaagggcgttctactggaatttcatctcacaatggtgcagtgatgatcaatgcgaacgcgacagaagaagaaatccaagcattcttcgtttaccaaaattatttatttgatcattttgccaacccaactgaaggtagcgaatttgaatatggatttgcagaaggctatgactacgtcattgaagatggtgaagtgaagtcagcgatgaagagattcctggccgccgcattgatcctggtaaatacacgct

SEQ ID NO: 6861 - DNA, 498 bp, Bacillus clausii
atggaagtgttaaaacatgaatcgatgtctggatggaacaaatttgctcgaacattgccagtaaggcaaaatcaaattgtgcaaagccattatctcttttttgtcgtgctattggctattgggttagcgattacgattgtcctctctttgttatcaagcgtcatggtcggccaatcattggatataagcactgtcgcttccatcatgaatggcattgcaatcgccgtgattttcgggactttttcgtttccattaacgtacatgtttggatctgaaaaggcggacggcattttggtttttgcaggtcttgcggcatttgggctttacttattaagtgcgtggctatatggggagatttttgagaacgtttcattcacgtttgtcggagagatgcatccagaccttttcttctcgattctctttctagggatctctgccgtcctgtttttcatatcgtatctgttagcttctcaagtttataaacaaaaggaattttaa

SEQ ID NO: 6862 - DNA, 777 bp, Bacillus clausii
tagccatgacttttccgagaatgaagcgatattaaagcaaaggctcggtcttgatcaatcctttgacgttggcgttcgcaagctaaaaatttttaacagagaagtcggcatttattatttgacaggtcttgtcgacaatttgtatatcattgaaattttacgcgaactcatggaagttgaaggcagattgcgccgtgtcgaacaaccgtttgtcacgattaaaaatcatttggcccatatccaagtggaagaaaccgaatcaatggaccgcgccattactcaagtgctgtcagggctgatcttcgtcattgtagacggggaggcaaaagcgcttgttgccgacgtccgctcctatccaggaaggggtcctgaagagccagatacagagcgtgttgtccgcggggcacgggatggctatacggaaaatattatttttaacacagggttgaccaggcgccgcattcgtgacgagcggcttcggcaagaaattatgcaagttggcgtccgctccaaaaccgatatttgcctttgttatatagatgggattgtcgaccctggctttattaaaatcattaaaaaagaattgaaagcgatcaacatcgacggcttgacaatggcagacaaagtcgtcgaagaatacattgtcaaacaaggccttaacccttttcctttagtgcgctacaccgaacggcccgatgtagcagctacccatattttagaaggacatgtcgtcatcattgtcgacacatccccgtctgtcgtcataacgccagcgac

SEQ ID NO: 6863 - DNA, 294 bp, Bacillus clausii
tagcattgcttctaaaacacatgcaaaagagtgggcccatgttgatgtatctgttgaccgaacaggcgaactgactgggtacggagtcgacaaagaaggggtgcctgacctggaaatagggcgtatttatggcgataccgtttctatttttgatgaactgcaaattccctatatagtcggcatcggcgatattggcaagatggcacgctttgatgatgtcaaacgcggggcgcctgtgacgcggcaagcgttagaaatgattttagaaaggagtggataccgtgaagtcccccg

SEQ ID NO: 6864 - DNA, 441 bp, Bacillus clausii
caggggaactagaaggcggcatcatcgtttccgaatgcaatggcgacccccttacatttgaaattcttgaagtcgctacccctgacatcgaaccaacgtatcaaaacggccactttcacttccatattcaccagcatttttcagggcgaatttctgaaaactgggacacacgggatgaaagtttttccgatgattacttgcacacatgtatagccgctgtaaaaaagacggtcgaagacggggcgtcaaacatgatggagcggttgcaaaaggaatacaaagcggacgcagcacggctctatttggaagcgcaacttgcttacccgaaattatggcaacaaattcgggccgattgggatgatgtttattttgccaatgcttcttttgactatgagctaacaattgaagtgattgacttaggggcaaaagctagccgtcgca

SEQ ID NO: 6865 - DNA, 267 bp, Bacillus clausii
gacagcgtcgagccggctcatgacgttgatgcgcggcacaaaacgtttttttgtccgtgaatcgccgatgaaagaaattgctgcttccatcgaccaagatgtattggaaacagggtcttttacagcattgaacgaagaaattcagcgcttgattccgcgtctttctaaagaaagtgccgaagcattagcgaaatcagactttattgatgaagacaaccagttaacgcgttccggctataaagcattgttgcaggcaagtgaagacaa

SEQ ID NO: 6866 - DNA, 74 bp, Bacillus clausii
caatagggggaaatgatgaaattattatccaaagcatgacgacaacaaaaacgcatgatgtcgaagcgactgtt

SEQ ID NO: 6867 - DNA, 390 bp, Bacillus clausii
atgagtcatcttacagaatttacggatccggataatagagacaaatcgattctagttaaaggtgccagagcacttgctggagcatctacagaaattgggggagctgctgcaggtgcatttattgggggcgcacttttatcgccaatcccagggggtgcctttgtcggtgcggctatcggtggttatatcggtgggaaagcaggtagtgaaatcgtggacgatgtgaaagacgcggctgaatatgtattttctggccagattatagatgacgcaaaagaactaggcacaaaagtaattaatcaagtggcagatgtaacagaaaatgtaacaaaatcagtaggcagcatatttaaaggggctgcggatagtgtgcttgggtggtttagttaa

SEQ ID NO: 6868 - DNA, 435 bp, Bacillus clausii
gcagaaagaaagtgcaaagatagtctatatcgcaaaccagatgggctatccatttaatgagcgttaccactttcaccggtacggcccttattcggacgagctgacagtgcgattagaagagttgtgcaaccttggttttttaatcgagagcgaagaagacaaaggccattattcacaatatcgctatacgctttcgccccaagggcaagcgtttttggaaatgtaccatccccctgttgccggctacaaggacttgtgccaatcattgaacaaccaatcagctcgttttttggagctattgtctaccatcctttattttagcgatttagaagaaggagcaaggcgtgagaaaatacgtcagctcaaaaaaaagcaaaattatagcgatgatgattttgatgaagcccatacatacttgcaaaaactggcccaagt

SEQ ID NO: 6869 - DNA, 540 bp, Bacillus clausii
  misc_feature (1)...(540): n = A,T,C or G
taaccgtgctcattatccctttcacgtttttatgggcagtggtgattaaaaggccaaggcgctttaaaaaacttgcttttctctatttaaagggcaatacgacacagcttcacagcttgtttttcttgtttttggcggcaggcttttttgttgaagtgtttccttacacggtttggtttgagtatatgaatgccttttttgcttttacttatcaagaaggatcgttgtttttgttttacttgctcgttggattatgcatttttggctttgcccttgtcggcttccatcctcttatttcaattgcgattctatcaccgtttttacaagaacaagttgcggcctatccttacggcatcagcctattgctcattggcgttggacttggcacagtcatgataggcccatttaatgttacgccaacgattttggcgatgcagctaaatgccaatccgtacagcattattcgcaagaactttgcgtttgcttttagctatttggtggttatcgntgggatcgcctattcatgtagcctgatgaatg

SEQ ID NO: 6870 - DNA, 234 bp, Bacillus clausii
atgacaaggagcttaatggaaatgtggaaattatggataaaaaccgctgttgcttttgccgggggcgccttggcgatgcatatggtgagacaagctcaagaaaacaatgtccgcttccacactttctcaagcgcgaaaatcccgacaaaagcagatccaatcgagcttttgtttatttcggatatccaccggcggcgtattgccgatgaaatattggatatggcgagagagcgt

SEQ ID NO: 6871 - DNA, 171 bp, Bacillus clausii
aagcgacgaagcgttagaacagcaagttgactttcttggagctaaagtagcgcggggtgtgattttacggaaactagtgaaccatcaaatccatcatcgcgggcaaatgactgttttgcttcgccaagcgggcttgaccgttcctggcgtatacggcccaacgaaagaaca

SEQ ID NO: 6872 - DNA, 237 bp, Bacillus clausii
atgcctttattgtttttgtcaggcttgtttatgcctttgcaattagtgccacattgggttgaggtcatcgcccgtttcaacccgctaaattgggcggttgaagcaggacgggaagtgcttggcgcacagcctgattggagccttgtcctacaacatggaagctacctgcttcttctctttgcagcttcatgtctgcttgttgttggagcatttcgccactatcaacgattgatttaa

SEQ ID NO: 6873 - DNA, 377 bp, Bacillus clausii
atgaaacgagtaaagccatttgtttattttgctttccgatggttgattgtcctgtttattcttgctgctacctttgtctttggcatgttccaaggcggctttgtcagttggtttttgttttacagtgtcgtcattgtgtttgtctgttcatgtcttgtttcttttctttccttgtttggagtgaaggccacgcgctatatatcgaaacaggagctacgaacaggtgaaggatttaacgtagatgtaacgatctcaaggccacggttgcttccatttttttattatgaagcaagtgacaccattcctgcttctatattggcagagcggcatgaagcgattttctttttcacgttaaaaaaagagctgcgtttttcata

SEQ ID NO: 6874 - DNA, 272 bp, Bacillus clausii
  misc_feature (1)...(272): n = A,T,C or G
aaggtcggcggggacacaattacaatcgaatgccgagaagctcaagtagctgcgcaagtgctcgctgcagcttattctgttcaacagccggaaaagcaagatgaatcgacattgcatgtcgttacagagaacggagctgagaagctccccaatgttatcagactactggaagancaacatataccagtagattctattaaggtatcaagaccggatattggggatgcctacctgttgtatacaggaaaaacattaaggaaggacgagacttc

SEQ ID NO: 6875 - DNA, 201 bp, Bacillus clausii
tgtatttgcatacgtgcgcacggatggcacggagaaactccttgttgtttcaaatttttaccctgtaaattgcgattttgaatgcccagaagatctggtatcattaaaagcgacgcagttaataggcaactacaaccaaaaacgaaaactggaaaaaacattttcgctcaagccttatgaaacggtggcattccagttgaa

SEQ ID NO: 6876 - DNA, 351 bp, Bacillus clausii
atggaaattgattaccgtaattacgagaagaccggaactgtaaaagatatagtattaacgcctaccatagagacggaaagaaccatagaaagatgggaagctgtatctcaagcgttcccatcaattaaatttccacaggaagaagtagaagaaggagattgggttcaagtatgtcaaaggcttcttgggagtgaaggagaaatgagggaagtagttgtgtctctagcttccgagttgcctgaaggagaaactatgggtggtgtagagagtttaaatatatatgttcagaatggagttatacaagaagggaattttgaagaaatgttaaaggagaaaggggttatcaaatga

SEQ ID NO: 6877 - DNA, 747 bp, Bacillus clausii
atgggcagctcaccagaagaaaaaacagaaaaaacgccagcagaaatggatccggcagacttgccgcaaattgatgcgtttcaaaatgagtattcccgagaaatgatggtgtcgacagagccagtagcggaagggtattatttaatgcgctcaaaattggcgcctttacgatatggtttccagaagaggccgtgtttatggacaatgcgtctggcttggatggggaccattatgaaaagcttagaatttcctttgaaaggtggtctaaataaaaggatggacatgtctgctatcccatttaatttagatttttattttgatgaaaatttacgagaagttcctctgtcaaaagctgaaatgatgaaaggtatcgaatttctaaaaaaacaaataccaatattccagaacgataaaaacgaaatagcaaaaatctatggattaatgggcgtttatttgcggactgttaaagaattggaagaaagtaaaaaatatttaaggttagcgattcaaacatatgaaagcacaagtaatgacaatagcttgtttgttaataaactacgtttggcccacacatatcaatggcagaaagactttcatacgtctaatcaaatgtttaagaaactgatggaagaagccgaaatatgtgatgaacgtcggggtatactagattttgtttatcaacattatgccaaaaatttgtttgaccaagaaaattacgatcttgctataagttattttcacaaagcc

SEQ ID NO: 6878 - DNA, 336 bp, Bacillus clausii
  misc_feature (1)...(336): n = A,T,C or G
atggtgcatggcacaaagcataaaaaacgagcgaacatttggaaagtagctggtggcgcaagtcagctgctcgctgtgttgctgttttttacagcaatgaggctttgggatgggcttcttacagtgacattggacttcccgagtagcctgttgttccttgtgttgtccgttgtcggctggtttggcgcgaggcgccttaaacacgttttagaggaacaacaggaacnaacgcaagatcggcaaatgccggtagtcttgccaccgccaccacacgctacagccactttaaaaaatgcgcaggaagaggcagaaaaacaaaacaataataacagttaa

SEQ ID NO: 6879 - DNA, 159 bp, Bacillus clausii
ctcaaaccgagcgtaataagcgctggcaagagcaaaacaaagaccgcgcccgttatcttagcgctcgctcaagtgccagaagctttatccgcaatcgcgccacggctgaggatttggacgagctggaacaattgattgccgaacggcgccagcaacttt

SEQ ID NO: 6880 - DNA, 363 bp, Bacillus clausii
atggacgatgttaaaaaagaaatttggcgtggtaaccttctgtgggaaggaagtcggatgatgttaccggaacataaacaagcatggattgaaatgcagcagggtgaagataaggtcgatttacatggtgagttagatcaagatcagtggcaagaaatcggtattgttgtgatggatgccttaaagcatgccctacccgtcaacgtccgctactggaaagagggctattacattgaccaagtgtgttacatatataaaatagatcacgaaaacaagagggttaggattgagcatggcccagacaatgacagcatacgtgaatggatagatatgcgggtcatctatgatgtgcagcgcatttaa

SEQ ID NO: 6881 - DNA, 660 bp, Bacillus clausii
taaacgaagctgaaattgaagcagtaggcggaacatacgaaaatggccgattgactgtgacggaagaaataggagggcttgacatttacataggtgaacgggatgaaagcgagatcgatgactacttgtccttttatctccgtaataattcagagactgctccactatttcaattaacagtcaatgaattcaaaacgtcgcgcaaatcccgtgagtcaatttaccgaaccgatgtaaaccacataacgattcgcgtagcggccaatgacgtattatcgttacgcgtaccagaaggaagctatacactagacgagttggcgctttacacagaaacctatcgccaccttgatgaagcagttgcaacgagcgaagacattcctgttcaattgtcttcgcgggaaatctcgattgattataacaatgatgaggacaacaatgtgctggccatacctgtgccttatgaaaaaggctgggaagtagaggttaatggtgaaaaggctgaactgctaaaagtaaactatgccttcctcggcgtacccttgcaagcaggggaaaaccacattgtcttttcttattggccaccattcttccgcctttccgccttattaacagccactggtttgcttttagcagcaggttgggcaattgcaagaaaaaaac

SEQ ID NO: 6882 - DNA, 258 bp, Bacillus clausii
atgtccaattcgctgttcgtaagcaaatcgattgtgccagaatcccatttgtatcgttgctggcggaatgtgtggtacgttttcatcgagtcaacaaaacagcgagcgcttgggctaatcagcgttttccatttagctttttgcagctgccaagttaatagcatatcttcgacgtcactatcatcttgccacggtccgtctagattgtttcggttcacaatatcatggagtgcctctggccgaaagagcgtcgcttgc

SEQ ID NO: 6883 - DNA, 547 bp, Bacillus clausii
atgacagctaaccgccaagatgcgtgggcgcaggaagatgatttgctccttgccgaaacggtgcttcgccatattcgggaaggcagtactcagcttgctgcatttgaagaaactgcagaaaaattatcacggacaagtgcagcttgcggatttcgttggaattcaacgattcgcaaaaagtacgaagccgaggtggcgcttgccaagaaaaaaagggctgcgaagaaaagggagcaagcaaaaacaaaggcaaaggttggaacgactagcgacaacgccgttatgcaaacagtagctgaagaaaaagcagcgcctacatccaacaacatagagttagatgatgtaattgcgtttttacaagggcttaaagaggaacaacatagccaagcagaagcgaaacagttacaagaagaaaacgagcgtttgaaacaagagttagaaaaaataaaaaaagaaaaacaagtgattgcagacgattaccgtgcactgctggaaattatggagcgtgcgcgaaaatggacgaacacagatggagaaggcaatgtct

SEQ ID NO: 6884 - DNA, 336 bp, Bacillus clausii
  misc_feature (1)...(336): n = A,T,C or G
atgtcgctgatcattccgaaaggagccaaacacgctgaagaggcgtgggaatttatgaaatattttggcagcgaacaaggacagcgtacgttcaacgaaatggatcaccaaatgtcggttattgatccggtcaatgaaganctgtatggcgatgatccgattatgaaggaatttattgacattttgccggattcgaattcgcggcctccgattgcaagcgggcaattgttatggaacgagctcgaccgggcagtggagtatgcgatccacggcagagacgagccccaggcgttgcttgacaaagtcgctaaaaaagtggccgaagaggaaaattag

SEQ ID NO: 6885 - DNA, 267 bp, Bacillus clausii
gtacgttgcttaatgaactcgttgagcctgtacccttactgtttcgcgatgtcgcaaaggaaaagattgccgggaaaattagcgagattgccattaaagaaaaagcgactacattgacgctagacattatgatccgcggctacattatcgctacaccaaaacgcgaccataaattcttgattaaaaaactaaccgaaaaagaaattgatttggcaccgtacgaacatttgcttgatcggaatgcagaaagccgtaaaatgaacgcac

SEQ ID NO: 6886 - DNA, 1095 bp, Bacillus clausii
aatatttattaaatcatatggaaaaaaacattacatcaaaaattcactttcttcatttgtccgtgatgtaaaccatcacctgatgggagattttgtttccatgcctcatgaagaaatcagacgtttctctaaaatggaatctttactacaaaacaaaatatctaggcgttttaaagtacgccctctagataaaaatgactttggctatctgattgaacatcttcatgaacaaacaggaattgcttatgacgaatatgactatgccctccctctaaagaaattaaaaaaggaaactttagtgaagcgttatgatctgattaaaacgactcgttgtttgatcgaagaaaaccaacgttatttaaaaatcgaacaggaagaacagacgacttatgtttcttattttaccatcaactcgattgtcgatgatcttgaatttccatctgatgaaatcttttattatcaacaacaacaattcgatttcccaatcgatacgtccatgaatgtagaaatagtcaccaacaaaaaagccttgtctaccgtacgaaataagaaaaaagaactcaaagacttggataatcatgcctgggaatccgataacgaaacaggcagtaatgttatcgacgcattggaacaggtgaacgaattagaagacgttctcgaccaaacgaaggaatcgatgtataagttaagttatgtgatccgagtttctgcccctaatttagacgaacttaaacagcgttgtaatgaggtgaaagatttttatgacgatttaaacgtgaaactcgttcgtccatttggggatatgttgggcttacacagtgaatttatcccagctagtaagcgttatatgaatgattacattcaatatgttacgtctgattttcttgcaggacttggatttggggcaacacaaatgttgggagaaacggaagggatttattttggttacaacttagatacgggaagaaatgtctatctcaatccaagcctagccagtcaaggcgtaaaaggttctgtcaccaatgcgttagcatctgcattcttaggttcactcggtggtgggaaatcctttagtaataacctgcttggctatta

SEQ ID NO: 6887 - DNA, 314 bp, Bacillus clausii
atgtatacagctattcgttctacccgcgtctacgattccgatttagctgcgtatcaagcgaaaacgattctgcttcaaggcacgtccattgaggcattgcttccctatcacgcatcgcttcctgatcactgcgttgttatcgatgtaggcgatcactatgttctaccaggatttatagatggatttagccaaattggcgcaaaagaaatcggtattcgctgggaaggcgaggatggggcagaaaccacgcaaagcgacgatttggctccttatcgaatcatcgacagcatttatcctttcgacgctgcatttaa

SEQ ID NO: 6888 - DNA, 131 bp, Bacillus clausii
ttgaagtccggcagcttagcgctgcttaccgaaaaaacaccggtgttgcaaaatgtctcatttgaaatcgccccaggtacattgacgggcattgtggggccaaacggagcaggaaagtcgacgttaatcaa

SEQ ID NO: 6889 - DNA, 99 bp, Bacillus clausii
ttaactttaatagtgttgcggaagaagcaggaattagcaaagctaccttatataacaatccagaaattagaaagcgaatcgaatcgctacgggagcagt

SEQ ID NO: 6890 - DNA, 477 bp, Bacillus clausii
atgaagaaaatttggaagcaagtaaccttatcattcagataaagccttgggaagataatgaccttgatttactttttcgtataaacgctccagaaatgatgcagcatcttggcggtccagagagtaaagaacagattttgaaacgacataaacgatatcttgagcttggtaataaaggacgtatgtacagcattatattgttaccagaattagaaccagtgggctctgtaggttattggcaaactacttggaataatgaaagtgtatatgaaactggatggagcattctaccctcttatcaagggaaaggaatagctacaaaagcagtaaagttagcaatagaagaagcatctcgtgagaacaaatatgaatacattcacgcattcccatcgattgataatcctgcttctaatgcaatttgtcggaagcttgactttcagtttatctctgaatgcgaattccaatatcctccaggaa

SEQ ID NO: 6891 - DNA, 136 bp, Bacillus clausii
gtggtagaaatgaaaacacgcgttggctttattggattaggaatcatgggtgcgccaatggtgcgcaatctactaaaaaaaggctatacggtgtcagtgtatgacgtccagcaagagcgaatcgacatgcttgcaa

SEQ ID NO: 6892 - DNA, 348 bp, Bacillus clausii
  misc_feature (1)...(348): n = A,T,C or G
atgttgccaatgctgcaacaaatccaagtgaattatcatgcgctcagcgctgcggagaaacgtattgctgattatgtgatgagcgcgccagaagaacttgccaatatccatattaaagacttggcggcaaaatgcagtgtttctgtagcgacaatcacccgtttttgccgaaaagtcggagccgccaattttgttgaatttaaaatgtcngtgagagacagcattcgaacagaagaagagggcggagaactaatcgctgaaatggagtcaatttacaaagcgattattggcggaagtcgggaactgataaaatcaggacgacattgtccaagcggctacattgcttga

SEQ ID NO: 6893 - DNA, 186 bp, Bacillus clausii
  misc_feature (1)...(186): n = A,T,C or G
tgtcctatatacaggcaatgggcttggttcagaaccagaactnacagacgggctttcaaggcgatatggcggtttttgcttagaagcacaagcttcccctgcctccntccaatatgacgatttgcngcacatttggcttgaaccgggtacgatttnccaacatgaaacggtgtaccgcttctcgac

SEQ ID NO: 6894 - DNA, 344 bp, Bacillus clausii
gtgtcttttgccgcgaatgccaaaaaagaactgacacagcttgaacttgtttcttgctgtgctcgggcagagctttctgccctcatccggatgaacgggtcgctgtcgcttggcaataagcaagtcggattagatgtaacaaccgaaaatgcagccattgccagacggatttacacacttatcaagcatctataccctaatatccacattgagttgctcgttcaaaagaaaatgcgacttaaaaagaataatgtttatatggtgcgcatttccaaagaagcgcgccaattacttgaggatttgcggattttgaacgggtcttttcaatttattcgtgacatttc

SEQ ID NO: 6895 - DNA, 324 bp, Bacillus clausii
tgaaagaaacagtaaaaatgacagaagtgatcaaccggattgtcaaaatcattgagttcgattacgagctccagctaaatgaagaatcatttgattacttgcggctgctcacgcatttaaggtactttgttttacgccagcttcaccaagagaaggtcgaatacaaacagtttgaccctgaattaattgaacttatccaaggaacatacaaaaaagcctatcaatgtgcaacaaaaattggccgtatccttcataagcagtatggctgggaactctcctctaatgaagagctctatttaacgttgcatatttggcgtttgcttt

SEQ ID NO: 6896 - DNA, 276 bp, Bacillus clausii
  misc_feature (1)...(276): n = A,T,C or G
acaacctgtcgtcaagcaggtaaaggctagccgaggtagcttgccccatacctttgaagccgttccgatcgaggcagaaaacatggtcattaccgcaatcaagctagccgaggacggaaaggctgcagctattcgcgcctttcaacctggtgtaggagaagggatggttcaaagccgtaccggtgcctcattgttccgctctaccattttggaaaaggatttgggcgaaattcagtcagaagccgtccggccttataacatnccnacataccttgt

SEQ ID NO: 6897 - DNA, 479 bp, Bacillus clausii
  misc_feature (1)...(479): n = A,T,C or G
atatttaccaaaaagagaggctctatgaaaacggaaacttgcataatacatcggcggcatttttacaaagccatgagtatgaccacgatgctcagcaggagctgcttgcagaaacagtcgatgaaaggcctctttccagagtggagtgggtagctgatttccgcaacaacacaccacttgtccaggattttcatggtacgagcgcctattcgagtgtgttgaataaacaccttctgttcttctactatcatgatttacaaattgacatgaaccgggaaagcgtcagccgttattctggctttggggatcgcgctaacttgcatagcttattccaagtcaaatataaactcgctgatcaacataaagaaacgccgatcccttacnggttttcagaagtggccaacaatgaccgctatactctttacgagaacgaaaaccttcttccttttgcccgtgtctcttcttcgacctatagtgaa

SEQ ID NO: 6898 - DNA, 276 bp, Bacillus clausii
actaaacggcatgcttaggcaattatttgcccttggggaatcgtatcccgatttaaaagcgaacaaaaactttttgcagcttcaggaagagcttgctggaacagaaaataaaattgcgtacgcccgtcaagcttataattcaaccgtgatgcgctataataccaagctggagtcgtttccatccaatctgattgctaatattcattcttttatgcgcatggaactccttgacattcctgatgaggaaaaagaaccggtaaaagtgcaattttaagg

SEQ ID NO: 6899 - DNA, 333 bp, Bacillus clausii
  misc_feature (1)...(333): n = A,T,C or G
aacgcctagttgtttacattgtttccgattccgtaggggaaacggcggagcttgttgtaaaagctgctgtcagccagtttagtggctccaatgtggagcttagaaggattccctatgtagaggacaaagggacgatccaagaagtggtgcaaattgcacgcaaagccaaggcgctgattgcttttacgcttgtcgncccagaaataagggactttntgatggaaaagcgcaaaggcggcgaatgtagaaacggtggacatcattggaccagnactttcaaagataccgacttaaccaatgcaaagccgcgctatgaacctgggctgatctacc

SEQ ID NO: 6900 - DNA, 101 bp, Bacillus clausii
  misc_feature (1)...(101): n = A,T,C or G
atgaatatcagtaaatttgtaacaccanngattatttttgggagtgacgcgattaggcaagcgggggacgcttgcgtgcggcttggggcgagaaaagtatt

SEQ ID NO: 6901 - DNA, 309 bp, Bacillus clausii
gggacaggagccagaaacgccgttccaaaagaaaatgtacttgcaatatccagaactagcctgggagggagcacgaattgtcgtagatgggcaggatgctcaaattccaagcatgtttacgggagccccgactgacaccatgctccaaaaaggcgatacgcttgatagtttgctaaaggagaattttagcaaaatgatttatggagaaaaaccaatcgatgattttgagtctcttgttgaccaatggaaagcttcaggtggcgatgatatgacagcggaagtgaatgaatggtttaaatcggttcaaga

SEQ ID NO: 6902 - DNA, 194 bp, Bacillus clausii
  misc_feature (1)...(194): n = A,T,C or G
atggctnactcaaactcaaataacttggtagnacctggcgtacaacaagcacttgatcaaatganaaacgaaatcgcttctgaatttggcgtaaacnttggagctnacncgacttctcgtgcgaacggttctgtaggtggcgaaatcanganacgtttggttgctcaagctgnacaacaattaggcggatttca

SEQ ID NO: 6903 - DNA, 621 bp, Bacillus clausii
atggagtgcggaatagactattttaattatgatttaacccatattcaagatatcgaccaactgttcgaagacatcttcagacaaattgatttgtattccaacgatgaagccatctatctcatcaataatgctgccatgttgacacctgtgagcccaattgaacggataaaaactgagagaataatagagaacatccatttaaatctattagcaccgatgatcataaccgcaaactatcttaaacgtaccaaggatatgaatgtggacaaaagaattctaaatatatcctcagcatctgctaaatatttattaccctcacaaagctgttacagcactgcaaaagctggtttagactcttttacaaagagtatagacattgaacagaagctcgttacatatcctgcaaaagtagctgctgtatatccaggcatgatcgatacccatttacaatcggaaatcagatccgtaagtaaggaccttttcccatatgttaatgagttcactcaactttctgaggaagggaaactacaaacgcctgaatacactgctcacaaattaatagagattctattaagtgaagattttggaaagactgttgtgatcgaatcgattgctcaataa

SEQ ID NO: 6904 - DNA, 942 bp, Bacillus clausii
  misc_feature (1)...(942): n = A,T,C or G
atcngnaannatgntcanagntgtttcctgtgtgnntttccagtcacgacgttgtaaaacgacggccagtgaatccgtaatcatggtcatagctgtttcctgtgtgaattcacagtcacgacgttgtaaaacgacggccagtgaatccgtaatcatggtcatagctgtttcctgtgtgaattcacagtcacgacgttgtaaaacgacggccagtgaatccgtaatcatggtcatagctgtttcctgtgtgaattcacagtcacgacgttgtaaaacgacggccagtgaatccgtaatcatggttatagctgtttcctgtgtgaattcggagtcacgacgttgtaaaacgacggccagtgaatccgtaatcatggncatagctgtttcctgtgtgaattcccagtcacgacgntgtaaaacgacggccagtgaatccgtaatcatggtcatagctgtttcctgtgtgaaatnccagtcaccacgttgtaaaacgacggccagtgaatccgtaatcatggtcatagctgtttcctgtgtgaatttgtnatcangacgttgtaaaacgacggccagtgaatccgtaatcatggncatagctgtttcctgcgtgaaattgtnatccngacgttgtaaaacgacggccagtgaatccgtaatcatggtcatagctgtttcctgtgtgaattcgcagtcacgacgttgtaaaacgacggccagtgaatccgtaatcatggtcatagctgtttcctgtgtgaattcacagtcacgacgttgtaaaacgacggccagtgaatccgtaatcatggtcatagctgtttcctgtgtgaattcacagtcacgacgttgtaaaacgacggccagtgaatccgtaatcatggtcatagctgtttcctgngtgaattcccngncacnacgntgtaaaacnacggccagtgaatccgc

SEQ ID NO: 6905 - DNA, 1032 bp, Bacillus clausii
  misc_feature (1)...(1032): n = A,T,C or G
atgattgcggattcactggccgtngttttacancgtngtgncngggaattcacncaggaaacagctatgaccatgattacggattcactggccgtcgttttacaacgtcgtgactgtgaattcacacaggaaacagctatgaccatgattacggattcactggccgtcgttttacaacgtcgtgactgtgaattcacacaggaaacagctatgaccatgattacggattcactggccgtcgttttacaacgtcgtgactgcgaattcacacaggaaacagctatgaccatgattacggattcactggccgtcgttttacaacgtcnggatnacaatttcacgcaggaaacagctatgnccatgattacggattcactggccgtcgttttacaacgtcntgatnacaaattcacacaggaaacagctatgaccatgattacggattcactggccgtcgttttacaacgtggtgactggnatttcacacaggaaacagctatgaccatgattacggattcactggccgtcgttttacancgtcgtgactgggaattcacacaggaaacagctatgnccatgattacggattcactggccgtcgttttacaacgtcgtgactccgaattcacacaggaaacagctataaccatgattacggattcactggccgtcgttttacaacgtcgtgactgtgaattcacacaggaaacagctatgaccatgattacggattcactggccgtcgttttacaacgtcgtgactgtgaattcacacaggaaacagctatgaccatgattacggattcactggccgtcgttttacaacgtcgtgactgtgaattcacacaggaaacagctatgaccatgattacggattcactggccgtcgttttacaacgtcgtgactggaaanncacacaggaaacanctntgancatnnttncngatnnacnnaccgtcgaaaaacnaactttttangngcnnaaaaccagncatacnaataacttaagggtaactagcctcgccgcctga

SEQ ID NO: 6906 - DNA, 137 bp, Bacillus clausii
taagccagccccgacacccgccaacacccgctgacgcgccctgacgggcttgtctgctcccggcatccgcttacagacaagctgtgaccgtctccgggagctgcatgtgtcagaggttttcaccgtcatcaccgaaa

SEQ ID NO: 6907 - DNA, 885 bp, Bacillus clausii
  misc_feature (1)...(885): n = A,T,C or G
atgaagagctcgcatcaagatagccgaagcgttgaatggcagcgcgtcctgcataagattgaacagctccgcattcaggggcagcaacaaacggcttctcgccagacgacaaagcgttttacccagcaggaattaaatgacgaagcttatcggtcgtataaaaatttgctggtgggtcgttcaaaacgtttacctgaacgtcaaatattgttgaatatcgctgattacttggaatgcacgagcgaagaacgtaacgatctgcttctttccgcaggctatgggccgcttccacagccaatggcaggtcgacaattggagcgggcattggatcgagccagattgctgatgcatcatttgccctatccagcgatgatcgtgaccgatatgctggatatcgttggctttaatgacgcttatcgtgagctatttgacctatctgatttctcatttgcagccgatgcccttaatatgattgatcttcatttcaatgctgagttaccgatttgcgtccattctacatttgacgaggagtcgcaggctcgctgggaatcccatgcgatttatggtattcaagcctttaagaaacagcaacccgctttatttgtcgatccgaagtatgatcgatttcatagaatgatggatcagtatgaggagattcaagcgttttggaataaagaagcattgacgacaaaggatgatttagagacggccaaatattttcttgtgcancaacctgcctcaacaaaacggagaccaatacgctacaatcagctgcaccttgctgtgactgaccaggcttacccgcgaattgagttctttgtacctgcagatgaagcagcccgtcatgtgtttgcagcaatgggatgtgctgtcgattgtttataa

SEQ ID NO: 6908 - DNA, 87 bp, Bacillus clausii
aagcttggcgtaatcatggtcatagctgtttcctgtgtgaaattgttatccgctcacaattccacacaacatacgagccggaagcat

SEQ ID NO: 6909 - DNA, 108 bp, Bacillus clausii
ctgacacatgcagctcccggagacggtcacagcttgtctgtaagcggatgccgggagcagacaagcccgtcagggcgcgtcagcgggtgttggcgggtgtcggggctg

SEQ ID NO: 6910 - DNA, 692 bp, Bacillus clausii
atgaactttaataaaattgatttagacaattggaagagaaaagagatatttaatcattatttgaaccaacaaacgacttttagtataaccacagaaattgatattagtgttttataccgaaacataaaacaagaaggatataaattttaccctgcatttattttcttagtgacaagggtgataaactcaaatacagcttttagaactggttacaatagcgacggagagttaggttattgggataagttagagccactttatacaatttttgatggtgtatctaaaacattctctggtatttggactcctgtaaagaatgacttcaaagagttttatgatttatacctttctgatgtagagaaatataatggttcggggaaattgtttcccaaaacacctatacctgaaaatgctttttctctttctattattccatggacttcatttactgggtttaacttaaatatcaataataatagtaattaccttctacccattattacagcaggaaaattcattaataaaggtaattcaatatatttaccgctatctttacaggtacatcattctgtttgtgatggttatcatgcaggattgtttatgaactctattcaggaattgtcagataggcctaatgactggcttttataatatgagataatgccgactgtactttttacagtcggttttct

SEQ ID NO: 6911 - DNA, 332 bp, Bacillus clausii
  misc_feature (1)...(332): n = A,T,C or G
atgaaagaagctcttgtttcagagaggggcgcctatcgattggacggnatnatggggtttttngaagattttggntactgggggttantngtgcatgcctttgcagatgntgtgatttttccagtgcctgcgttttttnnncnagtgnccttaagnttgcttnacccnaaccnagccntttggtttgcnacagtagggtatatcgnttgtcttcttggcacgccngtagggnatatggttggccgtttgctcggnaattctgtcttgcnaaagtggttnaagcccagcgctttaacaaaggccgagaatctgtttaagaaggncggtgaggc

SEQ ID NO: 6912 - DNA, 422 bp, Bacillus clausii
  misc_feature (1)...(422): n = A,T,C or G
atgttcaatctgtataaaaacctntatgccatattgctttacccactccgcacgcagggggatgaatcgctttttaacacggtgaaaccgcaaatgttgttgctgaaaacgcaattacgnaaacaatgccaggcacctatcacattaactacctcgctgccattcttattctgggaagaagggcctaagatttaccaaagcttcctttcagggacatcgccattggttcaggaagtccgccataaaaaagaacagctggccgttcgcgtttatgaatatgtagaagcacacttttttgaacagcctagcttgcaagaagtnncagaccacctttttctanccgcggcctatttatcaaaacggtttaaagaagagacaggcnagaagtttagngagtacatccatcgctngggcatggatcg

SEQ ID NO: 6913 - DNA, 288 bp, Bacillus clausii
  misc_feature (1)...(288): n = A,T,C or G
tcttggcaacgaacagtggtatangcagttttatccttacgttgattatgaagaacaagccattgtgcttttcgaaaaacagcggcctatgcagattaccgccgacacgtttacaaggttgctcgaatttgtccaacaatacacgcattattttattgggtccaatgccgatttgccaatagtcggcggttcgattttaagccacggccattaccaaggtggagcgcatacatttccaatggcgaaagcgccgtttaaaaaggcttttactctaaaaggagatccaac

SEQ ID NO: 6914 - DNA, 267 bp, Bacillus clausii
  misc_feature (1)...(267): n = A,T,C or G
gagaaccactgtttgcgtgggtgaacgacgattcagagaaacgggagtcaacgcttgtgctccctcaacatgcaggtgtgcctctagaggaaatggaagaaacggttgccaaagaattaggngtgaccgcttttgattctgtgcgcctcgggtatgaaaacggacaagcggtttatgagtttacgtatacatcggagacgcaagggaaattattttattacaccgcttttgaaacaggcgaatatatgaaaagctttagtattcgca

SEQ ID NO: 6915 - DNA, 189 bp, Bacillus clausii
  misc_feature (1)...(189): n = A,T,C or G
ggggtttctncatgtngncacatgaactggcaaangaaattgtcacacggacaatggacatcgttccttgtaatgtgaacatcatgaatgcagaaggggccgtgattgcaagcggtgaaaaaaagcgtctttttaacattcattcgattgcggtcgacgttttgcgaacagggaaatcgatctctatta

SEQ ID NO: 6916 - DNA, 224 bp, Bacillus clausii
acgtcggcattgaaaacaggggccaattacagaacaagcgcttagtccataatatattgcctgattcagacaatactgcaaacagtttgctagtcgtcgaagtgtttacagaaagcggcaattggtccagttatccgccccacaagcatgatgaggataatttgccctacgagtcttttctagaggaaacgtattaccatgaaatcgatccaccgcaagggttt

SEQ ID NO: 6917 - DNA, 322 bp, Bacillus clausii
atggagaatttcattcgcgttaagacaaggcaggaattaagagattggcttgaggaacattcaacgacagaaaaatgttgttggatcattgtaagcatggctgaacaaccaaatgttatccagtacgtagatgctgtggaagaagcattatgtgttggttggattgatggcataaaaaagaaaatatcagatactgaactagcccaaaggctttccccgagaaaaaagaacagccattggacaggattaaacaaagaaagagtacggagattagacaaattaggtttgatgagagaagaaggaattaaagccctccccgata

SEQ ID NO: 6918 - DNA, 419 bp, Bacillus clausii
ggaaagaactgcaatatgcgattgaagagattactgaaattgctaaagggtttggccttgatttttatgaaatgcgctatgaaatttgcccagcggatatcatctacacattcggtgcttatggaatgccaacacggtataaccattggtcgtttggcaagcaataccacaaaatgaagctccagtatgatttagggttaagcaaaatttatgagctcgttattaattctgatccatgctatgcctttttattagacagcaatagtttgatccaaaataagcttatcgtcgcccatgtgttggcccattgcgactttttcaaaaacaacattcgcttttctaatacacggcgcgatatggtagagagcatgagtgcaaccgccgaacgggttgcccactatgaacatattcatggcagg

SEQ ID NO: 6919 - DNA, 152 bp, Bacillus clausii
atgagtccaattgtccattgccgagtatctaactgcacattttgggcagagggaaacaaatgtggcgctgaagaaattcttgtagaaaccgatccttacgcagcagactatgaagtcgaagcaagcagtgaatggcatgccgatgcacaaga

SEQ ID NO: 6920 - DNA, 66 bp, Bacillus clausii
cgttggtcaagcggttaagacaccgccctttcacggcggtaacacgggttcgaatcccgtacgggt

SEQ ID NO: 6921 - DNA, 72 bp, Bacillus clausii
gttccacagtagctcagtggtagagctatcggctgttaaccgatcggtcgcaggttcgaatcctgcctgtgg

SEQ ID NO: 6922 - DNA, 371 bp, Bacillus clausii
  misc_feature (1)...(371): n = A,T,C or G
gccgatgcggacgctgatgctgangcggangccgatgccnatgngnatncggacgccgatgcggatgnggatncggacgctgangcggangccgatgcgnatgctgacgcggacgcngatgccgatgcngacgcngacgctgatgccgangcngangctgatgctgacgccgatgccgatgcggatgccgataaggacagggttactgataaaaatcgagtcgatcgagnctatactggtaagcaagactcttcgaaagatgggaagaagctcccagatacagcaacttccatttggactgtaggagttacgggaatggcagcactattagctggaataagtgctcgtctatttagaagaaagaaatagaa

SEQ ID NO: 6923 - DNA, 127 bp, Bacillus clausii
atgaggcgagtagggaaagtatcttttgctgaattggtgcggcaaaaccgtgagcgtcttactcaagatcgggaagcaatggagcgtttggaagcacggtttgaacaaaaacactcaatgccaaaat

SEQ ID NO: 6924 - DNA, 114 bp, Bacillus clausii
cccaatttacgcctgaccacttaggcgaccaatcacgcaaatcagatcggaacaacggcaagaaaatggccaccaagtccaatgaacagccgaactatgttcctccaaaagggt

SEQ ID NO: 6925 - DNA, 603 bp, Bacillus clausii
tgtgtttattaaacagatcacttgtaaagtaaaaaaagaaaagaaagatgttttttctgatggtcaagctaaatggggttatttaaatacattagaaggctttgtaagtcaaattggaggctggagtgataaacaagaaaataccgcctatatattttctttatggcaagataagaaaagttatttccactttatgaagaacgaacatgacaaaatcgccttccttactggtcaggaaggaagtatttcttctataagtatagacctatttgaggggaaatttgctatacgcgaacaaataggcactataaatgattttatgaatggagattatattcgttttacaaacgctgatgttctagaagatagaatggctcattttgaagaaatgcaaataaacgtttggaataaaaacatgtctcaagaaaaaagaatgctaggtagtttttttgctaaaaatccattaaataaaagatatctagttctaacagggtggactgataaaaaggctcatacaaattatttacgattgattaaagaaagtgacgtaaatgtagatgtatcgacagtttatggtgatcaatttgtagtagaaaaatcttg

SEQ ID NO: 6926 - DNA, 316 bp, Bacillus clausii
atggagcatccaaaaacactgatccgcgaaccgtattcgattgcaggcaaggaattggttttagagggccctctaccagctaacgaacttgccgactatgattttcatgaaggcttaacttccttccggccagcgactgaacaaaaaaaagcgcttttagaaattgccgaattgccagaagggcgtattaacattgtccgcgatggctcaatgatcgttggctatgtgacatttgtttatcctgaccctctcgaacgatggtcagaaggcaatatggaaaatttgctcgaactcggtgcgattgaaattgcgcctt

SEQ ID NO: 6927 - DNA, 791 bp, Bacillus clausii
  misc_feature (1)...(791): n = A,T,C or G
tttaggcatatggaatatgcaacaaacggtggaaaagtcattccaaccattncggtattcaaacaaggggcctcgatccgtatttggaatgcgcaacttgtccgttacgcaggctatcgcagtgatggccgcattattggcgatcctgcttcccttgaattaacggatatttgcaagcagcttggctgggttggcgcagggagcgattttgatgtgcttcccctagtcatatcggtagggacacgtccccctcaactattccctatcccagagcatcttattaaagaagtggcgcttgtccaccctgataacaaagcatttgctagactgaaccttaaatggtacgcagtcccgtttgtatcaaatatgcgccttgaaattggcggcatttcttattacgcagcgccgtttaacggttggtatatgggcacggaaatcggcgcccgcaatttagccgatgattttcgctataaccgcttgccagaagtggccgccgtgctcggaatcagcatggagcgggaagcatcgctatggcgcgacaaagtgcttgtcgaattaaaccgtgctgttctctattcgtatcaagagcaaggcataagcattgtcgatcatcatacagcagcaaaacagtttcaacgttttattggcaatgaaacagaagcagggcgcgacgtgacaggagactggacgtggctaatcccgccgatgtccccagcgcagacggacatttttcaccaatcgtttgataatcgcatcgtttcgccgaattacttccacgaaaagccacccta

SEQ ID NO: 6928 - DNA, 156 bp, Bacillus clausii
aaccattcataagatggatctatcctacacgactgagatggaaaaagggttgcagcagcggcatggaatgagctatgccgagtatgagaacagtttaaaaaaacgactggaagtggagaaggcgcggacaaaagagcattatgcatgcaaccgtct

SEQ ID NO: 6929 - DNA, 153 bp, Bacillus clausii
ttgcatcatttaccattcaaaaggatgcgttgaccatggtgcttctgaagaagaaatgctcgaaacaatagcggttgcgaccgcctttggcagtggtgcagcctttagccaaggagctacacttgtacaggaagcctttggtgaattctcaaa

SEQ ID NO: 6930 - DNA, 381 bp, Bacillus clausii
aactgtcatcatgcagttcgttgtccacttcccgccccatagcgaggacttggcacaagaacacttggctttcatctttgactttgcgctccgtattgccgcaggcagccttattgcttacttaattagtaaccatttgaatgtatacatttttgcttttttcaaaaggctattcccaagaccgtcgatgctctggcttcgaaatagcgcctccagttttattggccaagcctttgatacactcatcttttgctcgatcgccttcctcggcgtttactcgtttgatgtctggctcgaaatagctttcaccacctatttgatgaaatttcttgtctcgttgcttggcatcccattcatctattggctgagaagcattaaacc

SEQ ID NO: 6931 - DNA, 378 bp, Bacillus clausii
gtccttagatgtcgctcgcctttaccttttcggcaatgtcaaatttctagacttgctcatattgttgatggttctcgacattgtcaccggtattgcaaaagcaatcaaaaacaaaagcgtccgcagccgggtttctttgtatggctttgctcagaaaattgggattttcgttgtcattgttgttgccaatatgattgatatcgtattagatttgaaaggcatggttgcgtcggcaactgtgcttttttatatcgcgaatgagtgcttgagcgttgtaaaaaatttagcggccagtggagtgaaaatcccgcctgtaattcgggaaaaattgttaggttttgcgaaaagcgatgaagatagggactcaggtgaagacaa

SEQ ID NO: 6932 - DNA, 198 bp, Bacillus clausii
atcgttttttcaataaagaacttgccggcggggcgattttagacattggcacctatgcgttatcgtttgcgcgcttttttttagaaagccagccacatgaagtgttgacgacggtcaagccgtttgaaacaggcgttgatgaacagtcgggaattgtccttaaaaacaaacaagaacagttggcaacaattgcactag

SEQ ID NO: 6933 - DNA, 504 bp, Bacillus clausii
agcggattttgcacggccattatgtgtatattccccaggaagaacgagaagcgggacaccgacttggtgaattaagtgaaattgtttccgcgctatgcgataaccgtactgctgagcatgagcaggcgtttttgaacacgttgctcggacaagcgaaagtcgtttcctataaaaatgacgccgttttaggggagagttatcagaaggaaaaagatttttgcacgtatttgcttgaacaaatttctaccattctccaagtcgacttgttaaaagacaaaaaactgatgaatgatttggtttatcacatgaaagcggcttttttgagaatcgaacaagggcttgttattgacaacccgtatacggaagaaattaaagttcggtatcgtgccatttacgagatggtccaccaaattacagcggatatggggtatacgcttgtagctgcggaagtcgcttttattacaatgcatgtgagcgctggctttgaccgtagcaaaagcacac

SEQ ID NO: 6934 - DNA, 402 bp, Bacillus clausii
atggatccgctcgaaagccctgttggcgcccttgggcattttcaatttatgccccgtacatgggtcggttggtcttacccaggcattgacgacatcggcaatgtcgctgaagatgtcgacattacggataccgatttaattgaagcccataacggctatggcactgacgcgtcaggaagcggcaaagccgatccatttgacctagccgactctgcctactctgctgctcggtatttggctgaccacggcgcacgtgaaggcaactatgaagaagcgcttttctcttataacaaaagtgaagattacgttgaagaagtaatggggtactaccacacgtatacagaggaagggtacgagcttatacaacttccactaaacaggcacaaagcagcaggaacgtaa

SEQ ID NO: 6935 - DNA, 438 bp, Bacillus clausii
tactggaagattggagaagcagttattcgatattgagaaaggacgcttggacaaacagtcatttttacaaaacatttttgcctttattgaaacagctgtgcaagaaatcaaagccgatgagacaggcaagatcgaattaatggcgaaaaaacgtcaagtaacggaaacgcttggcaaatgcccactatgcgaaaaggctgtgatcgaaacaagcaaagcgtttggctgcagtggctggaaaagcggctgcccctttgtcatttggaaaaatgataagtatttggctcgtttcaaaaagaagccaacgaaaacgatggttaaatcattgctaaaacatggcttcgtcaacgtaaaggggctaaaatcaaaaaacggaaaaacgttttccgttacgttgcgttatcagcagcaaggcagctactttagttgggtactcga

SEQ ID NO: 6936 - DNA, 120 bp, Bacillus clausii
atgtgatgttgctgacaactggaggcacgattgcaagcaccacaagcgaaagcggcaaattggtcgcaggtgaactttctggagaagagttggcaaagctatgtggtttgccggaagaca

SEQ ID NO: 6937 - DNA, 225 bp, Bacillus clausii
tttttccaggttgaaaacgaggctagctaaagggtacacgcaaaaagagatggcgtcacagcttaaattgcatccttatgtagtaaagctcgctatgcagcaagtcaaagcgttaacgaccacgcaattaagacaagcccttatcgtttgcgaagaaaccgactatgccattaagacagggcaggccgataaagagctggccgtcgagctgttgctgctgcgatt

SEQ ID NO: 6938 - DNA, 144 bp, Bacillus clausii
gcttgcacgattggaagcagaatcggcgatccgtgtccttttagaagaatgtccagacatacgtctaggcgcggaaccagccgagttagcgtggcggcaaagcttaatcattagaggattagaaaatttgcctgtggaaacagg

SEQ ID NO: 6939 - DNA, 171 bp, Bacillus clausii
ttgcgcgcttcttattattgatatgattaatccgtttgattttgacgatgccgataagctattgcctgatgcaaagaactgcgcgaaagcgattgctaacttaaaggcaatactacgcgacaaagaatggccagtcatttatgtcaacgacaattatggcgattggcaatc

SEQ ID NO: 6940 - DNA, 144 bp, Bacillus clausii
  misc_feature (1)...(144): n = A,T,C or G
agcatgtatattatctatcccggncntancggccttacttgttgtttatccgttggtgcaaacgaaactgccgtacttgccgatcattcttgttatggcggggccgcttttgcaggcatctgtttatatggtttcatggcgaaa

SEQ ID NO: 6941 - DNA, 693 bp, Bacillus clausii
atgatctcggtcataacatgcacaaacagaaacgacagcatgaagacggtatttgacaattatttgcgtcaaaccatgaaggacaaagagcttattgtcatcctgaatcatgacaaaatcgatcttaacgcttgggaagagcaagcgaaaaaactgcctcgcgtttctgttttccaagtgccaggacgcctgtctgtcggggaatgcaaaaatattgccgctgaaaaaacagcctatagccatattgcaaaatttgacgacgacgattactatgcccctctttatttagaggcggcatggtctgcttttgaaaaacagcgcgaggcggatattgtcggaaaaagcagcgtttatttctatttccaaaaaagcaactgtataggcttatttccttcattgtatgaaaatgagtttgccaaacaagtggtcgactcgacgttagtattcaaaaaagaactattaaaagatgtttccttcccaaaaataaaagttggttccgataaaaaatttcaacgagattgtcacgcaaaagggtttcggattttttctactgatcgctataatcacgcggtaatcaggtctagaaacccgaatcatcacacttggaaaataagtgatgaacaattgctgaagggctgcatcaaccttgtttatacggaggactacaaacctttggtcacaagccaagtttaa

SEQ ID NO: 6942 - DNA, 690 bp, Bacillus clausii
atttaaatatggaacgatttcaaattagaacggatttagcgcttgaagcgcacgaaatggcggttgaagaacaacgtgaaaaaaccggtgaagaaagctcaagtgcggtaacggacgtagtggtaaaagaggaaacggtggaaggcgttaaaattaccactgtagaaataggggaggaaggggcgaaacggttaaataaacgtgctggccattacttgacgtttgaagcgcaaggaataaggaaaaaagacacggccctccaagacaacatcgaacgcatctttgcaaaagagtttgctgcttttttacgcaataaaggaattaaagactcggacacttgtttagttgttggattgggcaattggaatgtgacacctgatgctctaggaccattggcggtagaagaattacttgttactaggcatttgtttcaattggctcccgaagaaatagaggagggctaccgaccagtaagtgcattgacaccaggcgtgatggggacgactgggattgaaacaagcgacattgttttcggcgttattgaaaaaacaaaaccagactttgtcgttgtcattgacgctcttgcttctcgttccattgagcgggtaaatacaaccattcaagttgcagatacaggcatccacccagggagtggcgtcggcaacaaccgcaaagcaatgaacgaagaaa

SEQ ID NO: 6943 - DNA, 480 bp, Bacillus clausii
  misc_feature (1)...(480): n = A,T,C or G
aaatggatgtttttaattgtcggggacggtnataggcgctggctatgcttctggacgggaactgtgggaatttttcggggcagaaagcggactggctatcgtattgtttgcgattttatttacnatcagctgtgcggtcatattnacgattgcccaaaaagaaaagacaacccattatttgccgatacttgagaagttgcttgggcggcgctttgcaaaagcgtatgattggatgattattctttacttattttcagtgacggttattatgcttgcaggcgcaggggcaacactcgaagtatataacattcccttttggcttggcgttgtcattaatgcagcgttggtagtgttcatgtttgtaaaggatatgacaggaatgactaaaataaatgcatgtctcattccagtgctcattatttgcttagtagcggtcttactcgtttaccaatcatcaattggcttttcgttcacatttga

SEQ ID NO: 6944 - DNA, 324 bp, Bacillus clausii
atgaaagctcaattgtcagtcgcgcttttaacgttaccggtggcagggcaccagcctaaggctttacagcagcaaaatacgaaacagccgctgattgacgggacaaaagcagccgcttttattaacgaaacgtcacaacaactgaacaaagtcgcaaaacggtccctgaatttccacattcatgaagaactcgatcgtgtgtacgttcaggtcatagatgaagaaacaaacgaagttgtccgcgaagtgccccctgaaaaaattcttgacttagttgcagcaatgttaaaatcggttggtttaatcattgaccggcatatttag

SEQ ID NO: 6945 - DNA, 267 bp, Bacillus clausii
gacaggcggttatttatttggctggatactcgttgcgtttctagtcggctgttacgttacttacgctaaacgcgtaaacgtttggaaactaatggctgtcaatattatcgtcggaatgtttattctctatggatgcggagcgctgtacttgtcgcaagtgacagccacatctattagcgaagcgctcatgcttaatgtcgcttttattccaggagatacggcaaaagcagtgttggctgctttcattgctgtccgtgtccgtcatgc

SEQ ID NO: 6946 - DNA, 128 bp, Bacillus clausii
atgaatcagcacgtatttttaaaatgggcgcagcaaaagcatttatcgatcccttcgctgctattagaacattataccgatctacaactagacgagtatgaattcgttgcaattttgcatattcagtc

SEQ ID NO: 6947 - DNA, 96 bp, Bacillus clausii
gcatttgtgggccgtctctcgatgaaaaaggcaactccattgccgggatcaaattgctggaaatgatggccaaacgttattcactcagcatgtttt

SEQ ID NO: 6948 - DNA, 141 bp, Bacillus clausii
  misc_feature (1)...(141): n = A,T,C or G
gtttacaagcagcattggcaaagctgaaaaccgtgaaaggcattggtttcntttacttgcaagcaagcgatgtagtcaggcatttgctagtccaacgaattcttgaggcatacgaacgtacagaaaacgagcagtgaccaa

SEQ ID NO: 6949 - DNA, 564 bp, Bacillus clausii
aaaaacggattggactcgatattgacggtacgattacagacccggctacgtttgtcccttatttaaataaagattttaataagcaattcacactagctgatttgtctgaatacgacttgactaaaatactccgcattacagacaaagaattttgggattggatggaaataaatgaaccaacgatctatgctgaagcagagctcgcttatggtgccaaacaggcccttctaaattggagtaaagaacatgagctcatttacatcacagccaggcgtaaacacttaacagacgttactacctcttggttcgcgaatcgccaagtgccttatcaccatattgaacttgtcggcaagcatgataaactcgaggccgttaaagcgcaaaagcttgacgtttttcttgaagacaaacatgataatgccgtcatgatatccgaagaattcgctatccctgtcctcttattcgatacgccttacaaccaaatgccaacccccaaatctgtcgtacgggtgcgaaactggcaagaggcatatcattggatggcacgctggcttaaaagcggag

SEQ ID NO: 6950 - DNA, 78 bp, Bacillus clausii
cgatccctgttttgctcgtttacccattcttgcaaaaatattttgccaagggcgccttaattggctcaatgaaagggt

SEQ ID NO: 6951 - DNA, 933 bp, Bacillus clausii
atggcagaaatcgatgattttttgcaagggctctaccggcaagaggttggcactatcacttgtaaagacgagcgattggcagcattgcgcgaagcgatgggcgattttccgaaagcgacgatgcttgaggcgacatgcctttataagcggcaacacccttcgtttacgaagagcgcttacgtgcttccaacaacggcagaactaaaactgccgttccgtttattcgagcctgttggcggcaacaagaagccggttgtactcgcattgcatggccatggcgcaggcgcagaagaagcattgcaggaagattcgagccataacgcctttgccttaaagcttgttgagcaaggggccgtcgttgtgttgcctgagcttgccggctttggcgcccgtaaacggaagcaagaccaatcagagcagaacagttgtttttcccttgcctcccacttgcttctttacggcaaaacacttgctggtctgcgcgtgtttgaatgcgcccgtttgcttgattggataggcgaaacgcgccgtggcaacgttggctgtatcggtttttcaggcggggccttaattgggttgttgttggcagccacagatgagcggatcaaagcaactgtactaagcggtttcgcgagtctgatgcgcgacagcattttagcttcacgccattgcctagacaactacattcctggcttgcttgcgattggcgaaacgccgcaattgcttgaactggttaagcctagggcgctgtttattgaaagcggcagcgacgatcatcttttcccgtctgaatcggtaaagcacgcattgcatgaaagcaaatggggagaagcgcatttttttgccggaggccatcaagtgaacggaacaaaatcaatcccatggcttttgaacgaattgggaaaggagcaacaacaacgtggaaccgtttaa

SEQ ID NO: 6952 - DNA, 129 bp, Bacillus clausii
gtgccgaacgtgatgaatggcacgttgtcggtatcacagggcaagtccatgtccgcatagatgaaacggtcgaagaaggcgataaaatcagcgcaattggcggcattgcgactaaagacgaaaacggcc

SEQ ID NO: 6953 - DNA, 807 bp, Bacillus clausii
gctggggcgaattttaccgaattgaaacaacggccggtgcacaagcgaaagttgacgctcatgcaaacaacaaaaataatccccatgggacaacgaaggctcacgttggtctgagtaacgtcccaaactggagtggagcaactcaagccgaagcgcgagcagggacaaatgactctaagatcatgacaccgctacggacaaaagaatcaatcgatacttttgccagccaagcgacaattatccctgcattatctgccaatacaacaggtattgattaccccttggggctgaccacgttcatgcattcgaaccttggttatcctacaaatcacggtacaatacttaacattaaagtgtctaacttacggtttacccaatggtatttccctcattctataagacatgaggaaatcggagcttacttccggcatttttacgacggggatggctggactgactggcagaaagtagcaacatacgcagaggtaatcgatctaattgatgagcacgccgcgagaacggacaacccgcacaaggtgacatcacagcaagtaaatatcatatctcctcgaagagcagatatacctggttcagattatccaacaggagttactctattttcccaaactaacggacttagtaatgggtatcctgaaaatcttgctgttatagtgactgacaaggtagaaaactataggatggtccagacatgctatagagctaatggtgattctataaatgcaatgtggttacgcaagtggagacccgatctacccgatacgggttggagcgattgggagcaaatag

SEQ ID NO: 6954 - DNA, 2268 bp, Bacillus clausii
atgcagatgaaacagtttgacagccgccatgatgtacgattagtcattccaaacgaatatcggctgtgggaagaggcagaagtccattttttgatggaggatgcctctaaaaatttgctagtgaatgacaaagccgattatgtgaataaagaaacgggcgaagtggtctatcgtttgagggaagtagacacgatgaagcccggctgccacaaagccgttttccgcattgattacggcgatggcacaacgatgagcttcccacagcggggctacatcgcggtaaaggtagagcgcaccatccataacggacgcgacacacagattgtcgaagaaatcgcgcttaaagtttcgctgattgaccagaaatttgctgatcttgcagaagaagtagacgaatggagagaaaacgtcgcggatgatgtaaaagaaaaggtctatgacaatttagatatagaccgtctcagtaataaagaagtcatcgatgcacgcggcggtaaaaaagatttaaacgagcgcataacggatattgacgaagaaatcatttcccatatcgcggacaaaaagaatcctcacggggttaaaagcgaggatgtcaacgttattggacgtttgtcagttgatgccccctctacagcctacccagtaggcgtctcggtttttgacatcagtgggagcggatggccgtctacacacggcactgtgatgacggtcaaaatcaatgaaaaccgtatttctcagtattattttgatagagcggatacagttgcaaacacgggtattttgttccggtcgtctcatacagcaaatggctggggcgaattttaccgaattgaaacaacggccggtgcacaagcgaaagttgacgctcatgcaaacaacaaaaataatccccatgggacaacgaaggctcacgttggtctgagtaacgtcccaaactggagtggagcaactcaagccgaagcgcgagcagggacaaatgactctaagatcatgacaccgctacggacaaaagaatcaatcgatacttttgccagccaagcgacaattatccctgcattatctgccaatacaacaggtattgattaccccttggggctgaccacgttcatgcattcgaaccttggttatcctacaaatcacggtacaatacttaacattaaagtgtctaacttacggtttacccaatggtatttccctcattctataagacatgaggaaatcggagcttacttccggcatttttacgacggggatggctggactgactggcagaaagtagcaacatacgcagaggtaatcgatctaattgatgagcacgccgcgagaacggacaacccgcacaaggtgacatcacagcaagtaaatatcatatctcctcgaagagcagatatacctggttcagattatccaacaggagttactctattttcccaaactaacggacttagtaatgggtatcctgaaaatcttgctgttatagtgactgacaaggtagaaaactataggatggtccagacatgctatagagctaatggtgattctataaatgcaatgtggttacgcaagtggagacccgatctacccgatacgggttggagcgattgggagcaaatagaaaccgcttctggtgctcaggcaaaggtagacgcgcacgccagcgacaaaagcaatccccacggcgtcaccaaagcacaagtaggactatctaatgtagataacgccaaacaagctacaaaagctgagtttgatgcttttgtcgcgctaaggaacaatccgcataacgtcactaaaagccaggtcggtttgggtaacgtgcaaaattatcctgttgcaagtcaggctcaagccgaagctggcacacatacgggtagctttatgacgccacaaaggacgaagcaggcttttagtgcgtttgcaaatgagccgcttaactggattcgcgctagtttgcaatcgacctggagccattcggggagttggcccgttcggtatgccaaggattcgacggggactgtctatattgaaggttcaatgaatggcggcgcaatcggtggcgaccctgcaattgtccagtttacgttgccgcctggatataggcccggacaaacgtcttatttttggctggtaggcagttcatcaggtaccactggcgcgcaaggcttgcgttgctacctgggagcaaacggaaactttatcatccaagacatgacttggcctggtgccacgcaattcgttgccgtcaatatcgtgtttaaggctggtaattaa

SEQ ID NO: 6955 - DNA, 375 bp, Bacillus clausii
atgaggcagttttataggatagataatgatggctattatatcgagccaatcgttttggatgcggtcgaaaaaccaaagggcgatgtatacactgacccagagacaaatcttagttatgagttgccgcctaatacggttattgattcatttccagatggtctgtttcgtcctcgctttttagacggaaaatggtcggagggcgcaacggaagaagaaatagaagagtggatgcggccgccagaacgcccagcgacggaagtggaactcattgcccagcaagtcacagaccaagaactaagtgatatggagcaatggcaatccataaccgatcaggaaatccggctgacagcattggagggggtaaagcatgagtga

SEQ ID NO: 6956 - DNA, 201 bp, Bacillus clausii
tttgctgaaaacaagcatcgccgaaaatgtcgaactcccgcatctgtaccagtattgtggaacggaggattttttgtatgatatgaacacctcttttctagaagaggcccggcaagtaggcgcgtctttcgtttattctgaagggccagggggccatacatgggattattgggatcgttgcatcgacaactggcttttgtc

SEQ ID NO: 6957 - DNA, 180 bp, Bacillus clausii
atcgatgaatcgtgaaagtcatactacaacagagcagcacctgggacgatacaaaaaaggcgttggtacttatgaagaaaaaatgcccgctttttcccggacatacaacgagtttacagaccagtgctttaaagatggggccttgtcaaaaaaacagaagcatttaatggcgttgggcat

SEQ ID NO: 6958 - DNA, 316 bp, Bacillus clausii
  misc_feature (1)...(316): n = A,T,C or G
atgtntnatttactaaaactagaattaaggaaagcaagcttagggtggtattggaaaggagcgattgtcgccaattttctaattgtgctcaccgtttatgcacttatgtttatgggcaagttcgaggtcgaagacattccttttcatacgctcgaagaaggtttttttattagtggcttgtttgtccgcgccgtgtttattgtgtttgcggctgtactccttgcaaagctggtgattaaggaatataaaaacaagacgatcaatattttatttgcattgcctgtgcaacggaaaaaactgctttcggcaaaactgg

SEQ ID NO: 6959 - DNA, 360 bp, Bacillus clausii
  misc_feature (1)...(360): n = A,T,C or G
aaatgttgaacctattatttcaatcacatgcaggtttgtggcgcattaccatttngctttttttcctcgcatttatttnattgaaaataggaaaacctaagggcaaaaaaataacgcaaatgctattgcgcttgttatacgtgattatgatcgtttccgggctgggaatgttaatcgnactcaaatttccatggttatacgttatcaaagggattntagcactatggctcatctggacaatggaattgatnctctctaaatcggtggcaaggaaggaaagtggtccttctacaaaagggtactggattcagtttcttatcncttnaatactcnntatatggattgcagccaatatgattc

SEQ ID NO: 6960 - DNA, 564 bp, Bacillus clausii
  misc_feature (1)...(564): n = A,T,C or G
atgttngaaataaatcttccatttgaaattgcgggaaancgcttgcnncttcctgaaatcaatgtagctgnccaacctggacaacctgttgcgattcaaggagaggccgagtnnttgcaaacattnnngtcccagnttatgaacccattttctggctcaaccaaccagtttaaattagaagacaaaccttttgatccccattctaacgcctttatgttccatcaatccgatggcttgtataagcgtgtaacgccacgggaagtgatccgcttttggctgaagctctacaaaagcgaagaaaatgagaagcgtcttttggcagtatgcgaattgagtgaggtagctgacaaacgggtccgctcgctccctttgnctgaaaggaggcgtntgcatnnntgccgctgcctgatcatgccaagccaagtatacgtattcgaccagccaactttgcacgtggatcgccaaaccaagcacgtatcncatacgatnntagaaatgctatccaacaaatgcatcgncatcacgactacatctctggaagaagcaatccagctagggactgcg

SEQ ID NO: 6961 - DNA, 108 bp, Bacillus clausii
ggaagtcgattaaaaaaacagagattgaacgacttggacaccaagtaaaaacgggcctgcatccgcccattgattatttgcggacgcttgacgccgtttactttaatg

SEQ ID NO: 6962 - DNA, 126 bp, Bacillus clausii
agcgcttgattgacgatgtgattgagcctgacgagacgaggcagcgattaattgagtcattttcaattttagcgtgcaaagatgaccgtgctgattggcagaaaaagcacggcaacatgccgttat

SEQ ID NO: 6963 - DNA, 503 bp, Bacillus clausii
atggttgtcctttctgaaggctgggtccagtttttattggctatcagttgcgttctgctgctcgttattagcttgttggccattttttcttggttgaagcgaaagaaaggcataacaaaggcgaaagaacaagcaggcgcttttttagtatttgtcacagtgctgttaatttattttgcattgtcgctcgccctcccccgtgcgtatgtttctgatgtgctcatcgggccaaagacggcaaaaccggtcgaagacaatggagttcggtacttgagtttatcgacgatttacaaagtccacggaattgaaacaggggcagtaatccgagaagcacaggggaagaccgtacatatttcgattaacgaatatgagccgatttacggatttgccaaagcaaacgaagaagttgtccgaaatgaccagtcaattgacgtggcggcttatatcgatcaagtcgccgtccctgagcttgaaaagctagacaacgaggagattacagttaa

SEQ ID NO: 6964 - DNA, 357 bp, Bacillus clausii
agcaatgaagctaaagtatacaaacaaaatcaacaaaatacgcacattcgcactaagcttagtgtttgtcgggatcctcattatgtacgtcggcatcttctttaaagagcatccagtcattatggtcatcgctatgatactcggttttctagccgttatcgctagtacagttgtctatttttttattggccttctttcgacgcgagcggttcctgtcatatgcccgtcatgcgaaaagcaaacaaaagtactcggccgtgtcgatgcgtgcatgcattgcgatcagccactaacgatggaccgttcacttgaagggaaggaatttgacgaagcttacaattctcgtgcttccaaaaa

SEQ ID NO: 6965 - DNA, 222 bp, Bacillus clausii
gttagaagccgcgctggccgtacgtgaaggtttagacgaaaaacacgcattaaacgcccttacacttaccactgcccaatgcttagggatctctgacagaactggatcgattacagcaggaaagcaagctgacattgccatttggaatggcgatcctttatcgttaacaagctccgttacccacacgtttgtaagtggcaaactctgttatgaaaaggagag

SEQ ID NO: 6966 - DNA, 463 bp, Bacillus clausii
  misc_feature (1)...(463): n = A,T,C or G
atgcgttcgaaaaaatggcttactgtcgtcttcattggcttggcgactgctctaatgggtgagctccgtttcgccccatttggttgggaattccggtttggcatgggtagtagcacattcttttttctgctccttgtttttaggcaagtccccccttttctaacggggcttttgacgggagcggntgtcgtactgtttcgggtattaacaagtaccgtatttttggcagacccttactcttttgtagaagttctattcgtccatctttcagctatgttttattactgggctttcggtttaggaatcaaccttttaccgaccaagctcgtccaaatgaacatgctctggtttggattatttgttgtcgntattgatatcgcatctaatttaactgagctccttgcccgttcggtcttacaagacattacgactctgntatggacagagtggttagcattattgg

SEQ ID NO: 6967 - DNA, 347 bp, Bacillus clausii
atgcaagtaactggttataaacaagaggatgcgctcggcaaatcaatcctcacttacgtccaaccagatgaccatgagcgcttgcgctggaaattagagcaagtcaaattgacacggagagcacaccaatgcaaccaagtccgtattaaccaccgctatggtgatcgtgtcattgtcaactgtgcatcggttccgatcatcatcgataatgaattggttggcattacaggttacgccaccaatattacaaaaatattagaaacagaagaaaagctccgtacgacggaaaagttggctgtcgttggcgagttagcagctgggattgcacatgaaatccgcaacccact

SEQ ID NO: 6968 - DNA, 279 bp, Bacillus clausii
  misc_feature (1)...(279): n = A,T,C or G
atggtagcgcccgactttatatcgtatttaacgatcannccaaaatcaattgacagtccagatttcgagatgaaggctaaaatcgttcgcgtaacacaagggaatggcgtcgtattaatggaaggcaaaattaatacccctgaagaggcaatcgaaagtctttatttaggtgcgtatgcggtagtagttggaagtgccataactcgcccccatctaacgacattaagatttaccaacaaaataaacaaatatgaacataagatgccactctattattaa

SEQ ID NO: 6969 - DNA, 155 bp, Bacillus clausii
gttttgacttacgaggtgcgtagcgatgtcgaacaaccatgcaaagggcaaaaaataaattacgataactttgttgtctcagataaaagcatgtggagattccacgccttgtcaaaagcggtaggagtgccggagggaacgccgttcgaatcata

SEQ ID NO: 6970 - DNA, 108 bp, Bacillus clausii
atgtgcaaattattttacacattcgccttcctcgagtgctgctggcgcttttcgttggcgcctgtttagctgtagctggtgctgcttttcaagggctgttgcggaatc

SEQ ID NO: 6971 - DNA, 119 bp, Bacillus clausii
  misc_feature (1)...(119): n = A,T,C or G
ggtttggcagccttgcaaacggcatcgatcattggtgcttttccatttgctgtgattatcattttaatgattgtgtcgctttttaaagaactccgcaatgaaanancagcnctggcagt

SEQ ID NO: 6972 - DNA, 363 bp, Bacillus clausii
atggaatcatacaaatcggtacaatcaaacaaacaacgtcctatacagtcgcgccatcttgcgacgtttcttatcccatctttggctggagcggtcctgtttttagtccctgtgaaaatagatgacaattggactgtttttattggctatttggctggtttaatagaagacggcctttctggcgttttgcctggctttttattggccttgcttgtgttttccggtgttgcttcgtttttgtgttgggcgtttaaacctagatttatcttggataagccagccttaaaaacattgttttatacatcttttacttggacggcaattcgtgtcctcggcgctgtgtttgcgctaatggtcatgaca

SEQ ID NO: 6973 - DNA, 367 bp, Bacillus clausii
atgttagaacaactattatattgtcatgttcctgtgtcacacttagaaaatgcgatcaaatggtataaggaaatcctacaccttgaatttgtttggcatagtgaagaggaaagacaagcacaactaaatttcccctctggtcaaatgttatttttagttgaatccactcatcaaactactgcaacatttaaagtcaacaatcaaactcatccagtgattgcctttcaatgcaaacatatagaagcgttagccaatcacttaaaaaggaacgcagtcaaagtggaaaacattatggatgatgggctcggcaatttatttttagatttctatgatcctgatgggaacaaatttaatgtacaatgtgata

SEQ ID NO: 6974 - DNA, 126 bp, Bacillus clausii
taaaacggtgtttgctaaagtgcttatcggccttgcaaaagggaagaaaaactacgataagcgtgagacattacggcgaaaagacgcgaagcgcgaagtggagcgggcgataaaagagcgaatgcg

SEQ ID NO: 6975 - DNA, 373 bp, Bacillus clausii
  misc_feature (1)...(373): n = A,T,C or G
atgacaaaaaagccattgttccagcaaagtccccaaagctctgaagcgcttgattggcatcataagaagctgttttatccgactgattataatggctattaccactggcaccaaggttgtgaattgctcattgtgtttgatggggccggcagtgtcgttgtgaaccagcaaatgtcgccaatcaaaaaaggcatgctttttttcttccagccctttcaattgcaccatgttgcgcctgcttctgccgctacatatgaacgggccacacttcatttcgacccattgcatgccgaaaagcgcctaacggcctatccggcgatggtccaatttttccgccaattnaaaaatgactacaaccaagatccntttattg

SEQ ID NO: 6976 - DNA, 210 bp, Bacillus clausii
aaaacggaatctttggtccggcgtattagttggcgtcggcatcgctgcttttttagatgaagtcttgttccatcaattattgcaatggcatcatttttacgacaagtcgactagaacaatagggatcatttcagatggtatctttcatgcatttggctggtttgcgagcgtttcgggaatgttcttgctggccgacctgaaatcccgccg

SEQ ID NO: 6977 - DNA, 225 bp, Bacillus clausii
gcaagctcctcattcaaatcatccgtctttaccaacggtttatttcaccgcttaccccaccatcctgccgcttctatccaacttgctctgcctatggaattgaagcaatcgaaacacacggggccattaaagggagctaccttgccataaaacgcattttaaaatgccatccttttcatccaggtggcgttgatcccgtccctgagtgccaacataccaaacaca

SEQ ID NO: 6978 - DNA, 663 bp, Bacillus clausii
  misc_feature (1)...(663): n = A,T,C or G
gttaattgaagaaaacaaccgtttgcgccagcgactcacaccagacaacttaaaattgtacgaagatatgatgctttatattcgcacagacttgcggcttgcagagtatgaaagtgaacagattttgatggaaatgttgcatcatattgtagacagccaaaaggatggaaaaacggcgaaggatgtatttggcggcaacccnaaaggacttacgccagaagattaattgcagaacttgccgcgagaaagaaacggaatgtcgcccaatttatcattgcccaaggtagttgtcctgatcggcattgtttgtttggtggaagggcttggcaagttggttttgcctttattcgggctaaaagggcctgttgttataacaggaaatttaatggttacgttactaatgggcattatcggaacgggcgtggctgtatattggatttttaagcaaataaggaaagacctctttactgaagggaccaactcaaagaagcaatatatcaaaacgggtttgatcggtgctgttgcctttatggccatggtaggcattgtttatctgttgccagattggggcatccctcttacttttgcttggtggacatatgtactaatcggcatgtttttgctcattattggaaaacgtctgcaagctgcttgaaaacaggc

SEQ ID NO: 6979 - DNA, 234 bp, Bacillus clausii
atggcacgaacagtattgacagcagagatggttgagcaagctgtttacggcggggcgatccttggcggcggcggtggcggctggatcgcccaggggcttgaaaaaggccgggctgctctggcgaaaggcacagtagagctcattagcattgatgaattgaacgacgatgatgaagccgtatgcgtttccctcgtcggcgcaccggccgccaaagaccagtacgttgacgacaac

SEQ ID NO: 6980 - DNA, 291 bp, Bacillus clausii
  misc_feature (1)...(291): n = A,T,C or G
ggcttttagtcgttacgtatatcatttctgtgaagcgcggtatccaaaaggagaacggcagccgtttaaaacagtcgtcacgtcgttttttggcgctttctgggcgttgtttatggtctttatcattttatggggcattcttggcggctattttacgccaacagaagcagcggtcgtttgtgtgttgtacgcattggtcgtcggcggttttgtttatcgggagcttaactttaaanaagtgccagggctgcttgttagcacactgcggtcgacgtcctcgattctgttgct

SEQ ID NO: 6981 - DNA, 113 bp, Bacillus clausii
atgttcctcaagcgacttgaagtaaaaggatttaagtcttttgcagaaccgatactagtagattttgtgccaggcgtcacagcagttgttgggccgaatggcagtggaaaaag

SEQ ID NO: 6982 - DNA, 249 bp, Bacillus clausii
atgtctctctggatccctagaaagtccatacattccttcgtcctgcgtatccgtggtgtggaggccggatatgctcctatactgggtccatgcccgaatggggtaaatatgctccggctctgcactggtggtgtttggcttcaaatgattttgttaagtcagcgtttatacagcctgtcatgcttggttctgagggatgccacacaaaagcttagaaccatcaaaatggacactgacgctgtccaatga

SEQ ID NO: 6983 - DNA, 288 bp, Bacillus clausii
aaacgagtgtttggtggatccttgcacttcagtcacttacaagtgatactttaaaagaaaaaaaagatgaaatgactaacggtatgtatgaattagcaagttcaatgatcgagatattagctctacaagggattttatctgattcaactaatgtaaaattagaaaagagtaggctagcggcattaattgatggattgtccattcatgctctgttaagacctgatgtctattctccagaaaaggtaaaggaagtaatccgttaccatttagaaacactctgcaatgaaa

SEQ ID NO: 6984 - DNA, 879 bp, Bacillus clausii
gaaaagtcggaagtcgcaccaaaaaagcgcgggcgcaaatcgaaggaagagcgcgaccaatatcttcaagaacaatcagaaaaagaagcgaatctgccattgtatgaaaagaaatcaaagctcaattagacgtattgcgtgcagaggtgccaatgaaccccaaatggggtgtgaaaaagaatgcagacggtaaaaacgaatactggtttggctacaaagggcacctcgcagttggtgcatcaagccaatatattctgcaatccttgttttcttctggcagcttaaatgatggaaaagccgctattgccctattgaagggaatggatcaacgacttccgcttacgtctgcttcttaccagacattggatgcgggttatgattttgaaccgatttatgaccagattcatcgcatgtgtcaacagtctgtcattgcctataataagcgcaatgaaggcgaaatgatcgggtttgataaggattttgccccaacctgtttgcgagaacattcctataaatatgacagctttgatccgaaatacgaaacattgaaatataccagacctaaggaatgtaacgattgtccacttgcgaacgaaggtatctgtcaaaaagtgtataaagtcaagataaccaccgatttaagacgttatactgcgcctgcacgcggatcaaaagcttggaaaaacatttttaaccaacggacagccgtcgaacgtgtcaatgcttatttaaaagagttctatcagctcaaaaatgttcgttatcgcaccgagaagcgtgcaaaagttcattttgatatggtcgctttgatttataatgcttccaaattagctgcagatcgtatccaagcaaagcttattcaacaacaacaagctgcat

SEQ ID NO: 6985 - DNA, 278 bp, Bacillus clausii
atgaaaccaaaaaaagtattggtcgcttgtggtgcaggaattgcgacatcgacagtggtaaacagcgcaattgaagaaatggcaaaagagaacggcttaaaggtcaacttagtgcagattaagatttcggaagtaggcagccataaggatactgctgacttgctagtaacaacagcgatgacgcaagcggactttccttttcctgttatcaatgcacgctcttttttaacgggcatcggcacggagcaaacaaaaaaagaaatcctataagcgcttaa

SEQ ID NO: 6986 - DNA, 547 bp, Bacillus clausii
atgatttcttatttgcgccgggagcagccagacgtggtttgttccgcaaaagactacttaaatgtactcgttattgccgctaagaagctaagcttttcgaaagcgcagttaatcgtctcatgccgcgtccatttgagcgagcaagcacggaaacagccaggccagtttggccgcataaaaacagcagtccgttacagttatcgttttgccgatgatgtcgttggcgtctccaaaggcgtagctgaagacataaaggcgattgcccaattgcctgatgaaaaggttcatatcatctataacccggttgtgacgaaaacgttagaggaaaagatggaacagcctgttagccaccgcttctttgaagaaaggaatgccaaagtcattgtcacagttggccgcttgcatgtgcaaaaagactaccctacattattgcggtcatttgcgaatctacaacaaaacgagttgcccgaagcaaggctgctgtttataggcgatggggaagaaaaagaatcgttgcaaaagcttgctgcagaattagaagttggcc

SEQ ID NO: 6987 - DNA, 246 bp, Bacillus clausii
  misc_feature (1)...(246): n = A,T,C or G
accatgatgtgggctntcaatttttgttgacggcggtgatggagtatgaacaaacaggaagcgaagacgggctccgaatcggcttgaaggcagcgaattatttggtagggcggttcaatccagttggcggttttattaaagcgtggaatggcgacgacaaaaaaggctgggccattattgactgcatgatgaacatttctttgctttattgggccagcccgcgtcaccaatgacccgagctacgga

SEQ ID NO: 6988 - DNA, 186 bp, Bacillus clausii
  misc_feature (1)...(186): n = A,T,C or G
gaagcatactcatgggactggttgnacgtttgcttcagcgatagcagcagactcgcaaaggggcaaagccaatcgaagcagctaaaaagcgaaagcatatgtgactgccgcgatttcggaaggaattccattaggagccggaatcggcccgacggaccatgctgcttatcgccgccttggccaaga

SEQ ID NO: 6989 - DNA, 362 bp, Bacillus clausii
cactgggccgcagtgtgatcgtgctattgatcattaactttttccttggttttattgttcctggaattgacataggcgcccatggcggcggcttagtcggtggttttttggcagctgcagctgtacgtatgccaaaggaaacaagaaaaacaaatgtgctatggtccttatctgcactggcaggttatatcgtcctggcagctagtttgctgttttttggctatcagtcggccgcagggacagtcaacccagatatggccgcgctagaagcaaatcgcctgtttcagcaagggaattgggaaggaagcacggctcttgtggcagaaaggcttgaacaagatagtgagcatgtagagctgctg

SEQ ID NO: 6990 - DNA, 123 bp, Bacillus clausii
aaaggcgccctattcagactcgctttcgctgcggctccgcttcatcagcttaaccttgcacgataccgtaactcgccggttcattctacaaaaggcacgccatcacccgttaacgggctctga

SEQ ID NO: 6991 - DNA, 223 bp, Bacillus clausii
gtggtacaggaatatcaacctgttgtccatcgcctacgcctttcggcctcggcttaggtcccgactaaccctgagcggacgagccttcctcaggaaaccttgggctttcgacggataggattctcacctatcttttcgctactcataccggcattctcacttccaagcactccaccagtcctcacgatctggcttcgctgtccttggaacgctcccctaccca

SEQ ID NO: 6992 - DNA, 435 bp, Bacillus clausii
tcacgggtcgaggttagaatgccagcaccatcagggtagtatcccaccgacgcctccaccgaagctagcgctccggtttccaaggctcctacctatcctgtacagatgataccaacactcactatcaagctacagtaaagctccatggggtctttccgtcctgtcgcgggtaacctgcatcttcacaggtactataatttcaccgggtctctcgttgagacagtatccaagtcgttgcaccattcgtgcgggtcggaacttacccgacaaggaatttcgctaccttaggaccgttatagttacggccgccgtttactggggcttcaattcagagcttctcccgtgagggatgacccttcctcttaaccttccagcaccgggcaggtgtcagcccctatacttcgccttacggcttcgcagagacctgtgtttttg

SEQ ID NO: 6993 - DNA, 365 bp, Bacillus clausii
atgctttcagcacttatcccgtccatacgtagctacccagcgatgctcctggcggaacaactggtacaccagcggtatgtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtggactcttgggggagataagcctgttatccccagggtagcttttatccgttgagcgacggcccttccatacggcaccgccggatca

SEQ ID NO: 6994 - DNA, 111 bp, Bacillus clausii
  misc_feature (1)...(111): n = A,T,C or G
aaaagcttgcgagacaaattatccaagangtaggccggtaagagaatattaacagcgtgatcactggngtgacgcgcttaaggttcaagcttaaagatcaatctcttgcga

SEQ ID NO: 6995 - DNA, 615 bp, Bacillus clausii
tttcatcagcatttgttgctgattttttcgattctgtttttggctcttttggatcgacatcaatgtcggttcctggctcgtctggctcgtcgatgttcggtacttcaacgagtgcgacgttttcgatcgtctcgcccacatagccagaatcgattgttgcttcaaatgtaactgtgcgccattcggtgtctttgacttcgccgaactcagctgtaacagttccgtcttcatagcttcctgtaccaccgtgacttacttccaagctgccttcgacaaacgtcagaccttctggaagaacgtccgtaatggtgaggttttcgagcaagctatcttcaacggtattgcgcgcttcgatcgtatacacgaccgtgtcgccgacttcatagccgtctttgctttcatctgcgttttgagccgattttcttgactcaagcttaggctctttcggatcgacatcaatatcggttcctggctcgtctggctcgtcgatatttggtacttcaacgagtgcgacgttttcgatcgtctcgcctacataaccagggttgatcgttgcttcaaacgtaaccgtacgccagtcggtgtctttgacttcaccgaattcagccgttacct

SEQ ID NO: 6996 - DNA, 502 bp, Bacillus clausii
  misc_feature (1)...(502): n = A,T,C or G
ttgacgcttaatggtcgaagccagcaaatactcaatgaaatcgcaagcaatcgccgggtcacgagcgcaacgatcgccaagaaatacggccttacccgcaggcagatcagctacgcgattgaaaaaatcaatgagtggctgcaaagggagcatatccctgaaatcgagcggacaaggcaaggccattttattgttgatcaatccgttttttcaaagattacggggaaacaagattaccagcttccagatggacaagggtttttaaccgaggagcagcgcgtccactttattttattaatgctgttggcaaaaaaggaagagctgtcactgctccattttcattcccagttaggttacagcaagaacaccattttaaatgacttgaaaaaagtgcaagagtttgtatcgccattccaattggtggttcgctattcacggaaacatggntacttgttggaaggcaaagaactgcaaatccgaaaattgctgattcacttaacgg

SEQ ID NO: 6997 - DNA, 174 bp, Bacillus clausii
tgacacaaggcggtccgaactttgcgacgacgacaattgcctatttaatttatgtacatgcatttgaatattaccaatttggccttgcagctgcggaatcgttcgcattaggcatcgtcattattgttgcctctatttttcaattcaagttaatggcaagcgacgtagaatttt

SEQ ID NO: 6998 - DNA, 123 bp, Bacillus clausii
cccctgcaggacggatcgtagaaccaaaggaccttgctaaagcggccatgtttttattgtcagatgaagcaagtatgattcgcggccaaacgattatcgtggatggcggtatttccttgctgg

SEQ ID NO: 6999 - DNA, 144 bp, Bacillus clausii
aagcatcaaaaacaaacaaaaaccaagtaaggaagcaaaaccaagcttctgaacaaggacttaatgctgaatttgcgagcgaaacagacgtacaagaagtaaaacaacaaaacgctcaatcagcagctaaaaagaaccaacaat

SEQ ID NO: 7000 - DNA, 168 bp, Bacillus clausii
  misc_feature (1)...(168): n = A,T,C or G
aaaaatgcgananganccaacaattgcgcaaaaaacgctcaaaaaccggcaagaaaaaatnaaaantgncaancnggntggtgnannnggacnanaaggnnaattgcctgttttnagatgcagggacgactacttatgaaatgatcccctttttgaaaggcaaacaaa

SEQ ID NO: 7001 - DNA, 159 bp, Bacillus clausii
agaaagcacaacgctgagcgaacttgtttctgaatttggcttagcgagccaactagtggtggcggaagtcaacgggacgattattgaccgtgttgactgggaggccacttctttgagcgaaggaatgaaaattgagctagtccatttcgtagggggagg

SEQ ID NO: 7002 - DNA, 81 bp, Bacillus clausii
aactggagcttttttttattatgtgggtgccaagcaaacaaaacaaaaaagcggatgaacttgcacgcttggccattcggg

SEQ ID NO: 7003 - DNA, 642 bp, Bacillus clausii
tattggtagcctagcctttggaatctataaaaactttacagcaattgatcaacataccgttcatgaaagagaaatcattgaaaccaagatcatggatatgaatgcgattgagagctttacgaaaaactttgtgaaagattactacacatggcaaaatgaaaaagattccattgaacaacgggtggaaaagatcagtcaatatttgacagaggaattacaagcattaaataccgataccgtaaaagacgatattcctactagttccagcgtaggtaatattgatatctggtcagtgtcaccagaaaatgataatacctatgcggttgtttattcggtagatcaaaaaattatggaagataaaaataacaaaatggtccgatccacctatcgaatcttattacatcaagataatgtaggaaacttagtaattatacaaagccctaccttgtggagcttaccgaataaatcagattatgagccacaacaacctgaaagtaatggaacagttgactctgatacggtgcaagaagtgacagagtttttggagacattctttacattttatccgactgcaacagaacaggaacttgattattatgtgaaaaataatgctttaccaccgattggtaaggattatctatt

SEQ ID NO: 7004 - DNA, 159 bp, Bacillus clausii
ccattactatattcgcgaaaagcgtcgttcccttaaaggaacagtggcaaatttgctgttgccagcgttaggagcagcattttgcatttggttgctttattccattgatagacacgcattaacgatcggctttatctggacaatacttgggcttattta

SEQ ID NO: 7005 - DNA, 503 bp, Bacillus clausii
ttagcgattgcattccagatcaaccatatggcatttacaaccaggaatcaaaagcagctgctttgccgaaaataacagcgctagttaaagagatcgcggccgatgccgacattgatgcgatttccattagctgtgcagctgatccagcgcttgatgtgagccgagcagccgtatccattccagttataggtgctggcgaggctggggcgcatgccgcatgcatgatcagcgacaagattggtgttcttggcttaacaaataaaatacctgaagcaattgagacagtgttaggcgaacggctagttggccaccttgtcccggacggtgtcaccaatactactgatttgcttaaaaaagaaacgacagctgcagcaatttcatcggcccggcagcttattaaccaaggcgcgactgctatcttgtttgcttgtacaggctattcgaccattcatttaaaagaaaccattataaaggaactcgcagtgcctgtgattgatttagtt

SEQ ID NO: 7006 - DNA, 333 bp, Bacillus clausii
tggcgaaaggcggccggatcggcaaaggaaaagcattgctaggttcgttgctcaaaataaagccaattgccgctctgaaagaaggcacgtacacacctgttgcgaccaaacggacttacaagcaagtagtcgagttttttacagaaaaattccatctagagacggctggcaaaaaaattggcgctgtcggcattgcccatattgaagccgagcagcttggcaaaaaaatcgttgatagcctgaaaaaggtccgcgccgacctgtctgtgtcgattctcgaaacctctccgattattagcacgcatacgggtccaggggcgatcgcgttaatgt

SEQ ID NO: 7007 - DNA, 126 bp, Bacillus clausii
gcgcccaattgctggcttgtttgcagccggagaaatggttggcgggctgttttaccataactatcctggtggttctggtttaatggcaggcgctgtgtttgggcggcttgctggcgaacaagcagc

SEQ ID NO: 7008 - DNA, 282 bp, Bacillus clausii
gggaactggccggtgaaattagcccgacattggaaaaaatgggcgagaaaaaccgcgcatttattcaagggcaaattgcctttttgaaagaacggatggaacgggaaatacgggaacagcatcaagtaggactgagcaaatacgatgaagcgattacgtggctacgtccgaaagatgcaccgcaagagcgaatcttacattcgttcattctgttaaatacagcagggatagacatcttttcccgcttgcttgagaaaaacccaccccatacgggcgcccatc

SEQ ID NO: 7009 - DNA, 151 bp, Bacillus clausii
atgtttttaggggaataccggcatacaattgatgagaaaggccggatgattgtgcctgctaaatttagggaacacctcggcactccttttgtgattacccgcgggctagacaactgcttgtttgtttatccccaaagcgagtgggacaagt

SEQ ID NO: 7010 - DNA, 833 bp, Bacillus clausii
atgcatacagtttggaaaggcagcatccagttcgggcttgttcatattcccgttaaactgcacacggcaaccgaaaacaaagacatcaaaatgcgtcaactccataaaaagtgccatacgccaatctcttatgagaaaaggtgtcgccactgcgaggaagcagtagaagcagatgatattgtcaaagcatacgaatacgtgaaaaacaaatttgttgttgtcgaagcggaagagcttgagcagtttcgaaaagacaacgaagacaaagcggtgcaaattcttgattttgtccagttggaggaagtcgatccgatttattttgaccgttcttatttcttagcgccaggtgatggtggctccaaagcctacgcactgttgcaaagggcgcttgctgattctaaaaaaattggcattggcaaaattatcattcgcgcgaaagaacatttggcaattgtccgcacgtacggcaacgctttaatgatggagacgatttattttcctgatgaggtgcggaagcttgctgatgtccctaatttgccagaagcgcctaaagtagaagaaaaagaactaaagacggcgttgcttttgattgaccagcttaccagtgaattcgacccagagtcatacacggatgaataccgggagcagctttttgatctaattgaacaaaaaaagcaaggaaacaaaatggttgtttcggaaccaaaagaagcggaacgggacacgaatgtgaccgatttaatgtcagcgctagaggcgtcactagagcggacaaagccgaagcggaaaaaagcggctgcatcaaaacgaaaaacagcaacaaagaaaaacgc

SEQ ID NO: 7011 - DNA, 433 bp, Bacillus clausii
  misc_feature (1)...(433): n = A,T,C or G
atgagaggctatttntcatccttttccctgaaagattacaaaaatatatggatgaagcaatggaagtttactttagaaatgaaagtggtgaagaagatggaacatgaactagccggctcattgggagctagacgattttggtcgatggtcaaaccttttttgccgaaggtggcttggctcgttcttgcagttgttcttgtcattggtgaaacaagcctgtcgctcattgtcccgctattgacgatgaatttcgtggacgaaatgaatgcagttggcttaaacggccaaacggtgtttttgcttgcgtctgtgtttttagcacaacttgtgatgtccggttttgcccnttatacgatgatgtacattggccagaaagtcgtgttcgcgctaaggaaagaagcttggcaacggatgctgcacttgcctgttcctt

SEQ ID NO: 7012 - DNA, 567 bp, Bacillus clausii
atgatggaagcgaatgttagagctgtcgcgcaaggaagcgaagaccagcaagcgattatgacccatttgaaacacttatctagtgaaataaatgcagaacaagctgcagacacagttaagaaatctttagaagcaaaggaaggagctataaaagctgctgatgaaagagcaacagaagtaatcaattgggcaaataagcaagttgaggaaaccggtttgttatctcgcgaggaagctgatcaaattattgcagaagcaaagcgaagaagagatgaagagattactgctgcagaagatgcacatataggagttgtaagagaagcgcagaaacaagcaaaaggacatatagatcaggtcaactgggaaacaggcgaagtactgtctacttgggacaattttgtaaatgatctaagagattttgtcaattacgttactggcaatattaacaaagtattagactttttcggaatcccgaaaatcccaaaatgggaaggctcaaaatctccatctaaaacaaaaagtacagagcgaatgccagacttagggccgacaccatatgcaacaggt

SEQ ID NO: 7013 - DNA, 340 bp, Bacillus clausii
atggtttctgcaggagaagatgcccatcattatgaaccaagtgcccaagatgtagcggctgttaatgaggcagaagtatttgtgtatagtagtgaagaaatggaacattgggtttcaagtctattaaacacagtcgagaacgatgatctcgtcatagctcgcacggcagatggtgttgatttagttgatactagtggatcaggtcatgctcataaccacgatcaacatggagacgaggaaaagcaagaagctgctgtaacgatcaacattcaaggtgttgcggatcattatcatactggcaacatgattgaattaacggcggaattagatgcagaggtag

SEQ ID NO: 7014 - DNA, 230 bp, Bacillus clausii
atgggaagctcgcgatccagcgtgcttcttcgttgcaaaaagcgtcacagcttcgagacagaagccaaaaaattggcggccattataaatgagccgttcaaaaaagctccccgtgctaggatcgggaagcttgatatgttcgctcatttcactgtttgcttttctgtggcccgttgcaaggcaggcaagaagttgttccaagacaagagaatcaatcgcttgttcgcttg

SEQ ID NO: 7015 - DNA, 340 bp, Bacillus clausii
atgctttgtcctgttcttttggcttctgccctgttgttctcaggctgtacaacgattggctttcatgcgccgacatctggttcagaaaagaaattaccctctgccagccagattgacgcctatccgaaccgcccgattgaaattattgtcccgactggagccggcggggacaccgatttaggagcacggcttcttggccgttatttaggtgaagaaatggatacatcgtttattgtcacaaatattgccggagcgggaggaagcatgggctccagggaagtgctcgaagccgatccagacggctataaagtcttgtttttccacaacaacttgctcatca

SEQ ID NO: 7016 - DNA, 459 bp, Bacillus clausii
cttaaatcctggtccgctcctgtttgagcaaaatggcgaagtgatgtacggaatttttgctgcgctccttttggctaatgcttttatggcccttttgcttattatcggaatgcgtttctttatccgtgtccttcatgtgccgcgacatgtgctgttgcccattattgtcgtcctttgcgtgattggcgcattcggcgtaaacaaccggctgtttgatgcgctcgttcttgtgctttgtggtgtcattggttacatcttcgccaaattaaagtttccggttatgccgattgtgctcggttttattctcggcccgattttagaaaccaatttgcggcgtggactgatgcattccaatggcgactttcttccatttgtcacgtcaccgattgctgctgcctttctattgcttgccgctggttcgtttttaatggcaatccgcaaaaatcggaagcgttcagc

SEQ ID NO: 7017 - DNA, 333 bp, Bacillus clausii
  misc_feature (1)...(333): n = A,T,C or G
agaacgcctagttgtttacattgtttccgattccgtaggggaaacggcggagcttgttgtaaaagctgctgtcagccagtttagtggctccaatgtggagcttagaaggattccctatgtagaggacaaagggacgatccaagaagtggtgcaaattgcacgcaaagccaaggcgctgattgcttttacgcttgtcgncccagaaataagggactttntgatggaaaagcgcaaaggcggcgaatgtagaaacggtggacatcattggaccagnactttcaaagataccgacttaaccaatgcaaagccgcgctatgaacctgggctgatcta

SEQ ID NO: 7018 - DNA, 300 bp, Bacillus clausii
tcacccatacagaattagggaggcgagtcgtgtgcacgattacatcaaagagcgaactatcaagattggcaagtacattgttgagacgaaaaaaacggtgcgaaccatcgcaaaggaatttggcgtctcaaaaagtactgtacacaaggatctcaccgaacgtttgccggaaatcaatccagagcttgcaaatgacgtaaaggagatacttgagtaccacaagtccattcgccacttgcggggcggtgaagcgacaaaagtcaaatacaagaagacaattgaagtgggagaccagccaat

SEQ ID NO: 7019 - DNA, 924 bp, Bacillus clausii
atgatgcgctaccacttgatgaacggagcgaaccaccttgcccaagaacagcgagccatcttagataaaaaccgcacgaatttgtccgcgatcgaagaactgtcttaccgtctgttcaatggcatcctcctagtaaaccgcaaccgcttaaaggaagcaaaagaaattttgcttgacttgcaaagtgaagactattcttccaaatacatttttgtccgtgaagtcgctttcgtgcttgcacagtgttttacacagctaaatgagccggaaaaagcaatcatttatgcaaaagaggcgcttcaaatttttaagcaagaggacaattacattcgcgcttttcacacgcaaatgttgctaggggtcaattatacacaaatgaatatgacagaggaatcccttcgcctctataaaatccttttgcgaaacacacgcttgtttagccgcgacacgctctattaccaagcaatgtacaattacggcgtcttgcttaaaaaaattggcaactatgaacaaagccatgaatgttttacgaaatgcagcgcttattacgacaaagacagccaaaattacgtattcagccttctcgcagacatcgaagttctcttccagttgaaaacggacaaaaaacaaattgaatcaaaattaaatgaaattattgaaattagtgcaaaacgtgggtacaaacgctctgagcttcaagcccgctactatgcgcaccgcttaaaagccgacgatgcgatgtacaactttatcgaacaggaactgctccctcatctcgataagcttgataataaagaagaaccagtccactatgcaattgagctggcgcaatggtaccagaaaaacggagagtacgaaaaagcaaacgaatacttaaataaatatgccatgaaagtcaaaagacgtgaattttccattggatag

SEQ ID NO: 7020 - DNA, 81 bp, Bacillus clausii
cctttattcctttcacgaagacgtcgaacgtaatggctacgtcgcgatcgacttttatgatggcagcattttgtatgactt

SEQ ID NO: 7021 - DNA, 210 bp, Bacillus clausii
atgagctttaatttgcgcaacgcgattatggcgaatatacaaggcagttcccaacaagaagtggaagcaaccatcgtcgatgccatggaaagtggcgaagaaaaaatgttgccgggactcggcgtgctgtttgaagtctactggaaacatgcagatgaatcccaaaaagacgagctttgtgctgagattagcaaagggcttaatgaataa

SEQ ID NO: 7022 - DNA, 342 bp, Bacillus clausii
tcgtcctaatctttcggctactgatagtagctaccattgttgtcatttcctatagtttaataaaatatacattgcagcctgaacgaaagctaaaaaaagcccagaacgcgcatcagttttattttttggacgatagcacgaatgtgcgcaaaaatttccaactaacgtttaaaggaattatgtttgaaggagaaaagtatttagaagcgacaaaggaatcatttgaagtcattcgcgtttatataaaagcagatacagatagactccgcggcttaactttttctgacttccattttattgaagaagaagtcctcttacgttatccagaggcgacaattgaat

SEQ ID NO: 7023 - DNA, 569 bp, Bacillus clausii
atgatttcgcaaaatgacaataaagaattagtaggtgaagcctaccagctcggagtggaatttttcattcataaaccaatccatgcgattgaagtagagtctgttttatcctatgtaaaacgccagcttcaaccttcccttccagaaatgcaactggcattaacgcatgtgagccatgcgactcatccccatgtttctctgcaacgagcagcgcggcggacacttgcagagctaggaatttcaaacgaagcgggctctaaagatttcatccatgcgatggattatttggccgagacagggagcgagcccctttctttgcgtaccttatataaaaaaatggccttagcccgcttttccaatcctatcgatcaagaaaaagaggcaaaggccattgaacaacgaatgcgccgggcagtagcaaaagcactgacaaacattgcttcccttggtctaactgattacgctcatccaaaatttgagtattacgcgccccttttcttcgattttcgtgaagtgaggcagcggatgaaagaaattgatttagacatggctcatagtgtcgtacgcat

SEQ ID NO: 7024 - DNA, 280 bp, Bacillus clausii
  misc_feature (1)...(280): n = A,T,C or G
atgcgcatgctnctgctcattccngggctgctgntttccactgtttntatgccnattcccctcgngctcaccatcanctcgacattcgtcgaanncggcagcttttcttnagtcggttattttcgttttttaggtgatgcctactttttaganattttatggacnnctctttttgtcgctctattaacgactttttgctgcgtcattcttgcttttcccgccgcttattncatttctnncgttaaatggcggcaaaaaagcaatcatgntcatgctcgcc

SEQ ID NO: 7025 - DNA, 430 bp, Bacillus clausii
ttggctgtgattcaagcatcatccaatgatattgatatgctggcccgtcttataagagcagaggcagaaggcgaaggcgaggaaggcatgcttatggcaggaaatgtgatggtcaaccgcgtgcgcgtcgactgtcttgatttcgcaaatataaggacgattccacaaatggcgttccaatcccctggtggatttgaggcggttcagaaaagctatttttatcaaagggcacgagaaagggaacggcgcttggcacggcggctcgtaaacggggagagaacccacccagccagcttttcgctctggtttttccggcctgaaggtgcctgtccggcgcaatggtgggggcaatggaatgccgggcgtttcaaaaaccactgtttttaccagccgctcgaagcagagtgcgccgacgtgtttagcacatttt

SEQ ID NO: 7026 - DNA, 462 bp, Bacillus clausii
acatgtattcatacgacgagaatgaagccaatcgccagcaacaaggatacggccaatatggaggccaagggcaaggccaacaacaaatgatgcaacaaccgcaattttcagcacaagggtaccaagtgcctggatttgtgcagcaacaacaaacaccgcctgctgggcaaggaggcatgttgccgttagagcaatcgttcattgaaaacattttgcgtttaaaccggggcaaatttgtgaccgtccatcaaacatttgaagggaacagcgaatggaatgcgcgagtctttcgcggcaggattgaagaggcagggcgcgaccacattgtacttggaaacccggagacaggcgagcattacttgctgttaatggtcaacctcgacttcgttacatttgatgagccaatcgcctatacatatcagtatggatatgaaccaggcttgtctcaatacccgcctcgtt

SEQ ID NO: 7027 - DNA, 360 bp, Bacillus clausii
aaaactctttttgctattaggcgcactggcgatggcccttggggtagcgattggcgcattcggcgcccatgggcttgacggaaaaataagtgagcggatgatgagcaactatcagactggcgttcactaccacatggtgcacgggcttggcttaattgcagccggcttatttgctctaaaactaggcagttccgggcttgtgaatggagcaggctgggcgtttttagccggaattgtcctattttcaggcagcctctacgtcatggcattaacgggaattacgaaactaggggcgattacgccaattggcggcgttgcgtttatcgtcggctgggtattgctaggcttggcagcaatgcg

SEQ ID NO: 7028 - DNA, 603 bp, Bacillus clausii
ttgcgattaggcgctatagcgcagccgattatagagcgttgctgcaaatccaaaaagaagcgtttccgccgccgttcccttcagagttatggtggaccgtagaacaagtcgaagcacatgcagctgttttccctgcaggcgctttgcttgctgaaatcaatggcgaagtcgctggttcagccacttcccttctcgtcagtaatgccgaccgctctcatacatgggaagaaataagcgacaacggcctcatccgcgcttcccaccaacctgatggagacacactgtatggcatcgacttatgcgtccgtccccgttaccgtggcaaaggggttgccgcagcactctatgaagcgcgcaagcagacggtcatccaacttggtctgacacggtttgccgctgtctgccgtattcctggctatcatgccgtttcaacagaaattggaccagaacaatatgtttccgaagtaaaaaacggcaagcgcagcgaccaagtcctttcgtttatgatgaaacaaggacttactcctacccatgtgcttaacggttatgtagaagatgcagaatcgttgaactatggcgtttttgtggagtggcgccctcctg

SEQ ID NO: 7029 - DNA, 594 bp, Bacillus clausii
  misc_feature (1)...(594): n = A,T,C or G
atttattttgcttgatccgtatgcaaacgcttttaataaagaagccaatggccaagggcaccaagatgatgtgacagagatgggcccccgcatatgggagcgtaagtatgaaattgactcgctttgctacccgattcaactcgcttacctgttttggaaacaaactggtataacaggccatttcgatgcctcattccgcgaagcagctgcatcaattatcgagacatggcaagtggagcaacgccatgaacaaaaatcgccgtatcggtttgaaagaaaaggtgttcgacaatcggatacactgaaccgtaatgggaaagggacagaagtatcgtataccggcatgacgtggagtggattccgcccaagcgatgatgcatgcttgtacggctatttggtgccggcaaacatgtttgccgcggttgtgcttggctatttgggtgaaatatgcgatgctgtttggaatgacctagtcctcaaacaaaaggctgttgctttaaaagctgagatcnaggaaggcattgaaaagcatggcatcttccagcatccctatcatggcacgatgtatgcgtacgaagtggatggaaacggtag

SEQ ID NO: 7030 - DNA, 315 bp, Bacillus clausii
atggctaaatcaatcatgtttacgatttatggtgctaaacaaaaatgtgcttcttgcgttcatttgcctagtgcattagatacaaaggaatggctcgaagcagcgctaatacggaagttcccgcaggcgccgcttgcgtttcattatgtcgacattgacgaaccgcaatcatcggacgaaaaacagcgcttagctgcggcgattttaaacgaagagtatttttatccgctcgttgttttaaatggcgaagtagttgcagaaggcaacccgaatttaaaaatgattgctgaaaaagtggaagcgcttctcgcctag

SEQ ID NO: 7031 - DNA, 172 bp, Bacillus clausii
  misc_feature (1)...(172): n = A,T,C or G
atggaatggacattggccattttgctcgtagtngcgattgccttgcttgggctttcgtttttcaaagccgaaaaaccatcgaaagtggacgagcaaatcgagcagctttccatttcgtttatgcaagagctgcatcngctaaaganccaaatncgcgatatggaactcgacg

SEQ ID NO: 7032 - DNA, 381 bp, Bacillus clausii
  misc_feature (1)...(381): n = A,T,C or G
atggacattggccattttgctcgtagtngcgattgccttgcttgggctttcgtttttcaaagccgaaaaaccatcgaaagtggacgagcaaatcgagcagctttccatttcgtttatgcaagagctgcatcngctaaaganccaaatncgcgatatggaactcgacgctggaaatcnnnggncatganccnggagcgcnggcncgatcatcatngcatngnaantngcttacagaaattnttgatgggcgatanncgcngntattgnccggaaggcattgcaatcgaaacagagctcgaaacccatgaagtagagcgcctgttggccccgtacgtttacaatggcacaaaagaaagaaagaaggctgcaaatgagtcctaa

SEQ ID NO: 7033 - DNA, 491 bp, Bacillus clausii
  misc_feature (1)...(491): n = A,T,C or G
tatctgcgattgcggccggtgtgaaaatcggtntttttgaacttgtagggatgaggctccgtcgggtagtgccagcgcgtgtcgtcancccgctcattaaagcagnaaaagcgggccttgacttggatacatcccgattggaagggcattatttggcaggggggaacgtcgaccgtgtcgttaatgccttgattgctgcgcagcgcgccaacattgacttaagttttgaacgggcagcagcaattgaccttgctggacgtgacgtcctggaagcagtgcaaatgagtgttaacccgaaagtcattgaaacgccgtttattgctggtgtagcaatggatggaattgaagtaaaagcgaaagcgcgaatcaccgttcgtgccaacattgaccgcctggttggtggtgccggggaggacacggtcattgcccgtgtcggcgaagggattgtttcgacaattggttcacaagacgatcataaaaaagtgcttgaa

SEQ ID NO: 7034 - DNA, 903 bp, Bacillus clausii
atgtcgataatattgccaggacaaaagcatacgaggcatttggcaggcgccatcctgaaattcgctgggcacggcttgctggaatcgtgtccaggaatgcaggctggaatatgactgaccttgcaggtggtccactagctgcgatcgtgccaaaagagacgagacaagcgattgtctctgtttatgagcgtgccaactggctgatctttgcagatgcctttcctcaattgcaattatatgcaaaatggaaacgaacgaagaacccttgttttcaagagttggaacatttctttgtgtctcgttttatgatcgaagaatggcgtcgtttttgggaagaacgtgatgaaatcaggttaatgactgccttgattatcaatgaacagctcatgttgcagacgcgttttttaaatgaaccagcattggaatcttttttccattctgttttttatacgttaaacgagctagcccatttcagccatgtcatcttgccaacgccaactagctcaggatacgctgagccggtgacgaattttgccgatccaacagcgcgtattacccttggcaagcgaattggcgcggtcctttaccatgaagagaccgagtcaaccattttccaattcacaaaccaacaagagccaactgggtcgcggaaagagtatgaccgattggagaatgcgttgccgctacggcttgtttatccgcgctttcgtcacaaagcagcatctcgcaacgattgggccgatagccaggacctagaggaagtggaatcgttctttaaaccaattcgtgttaagcctgtattggcagagaaacagcggaaatgggcgaaatgggaattggcattgttagcccaagttgctcgctggcaaacaaaataaaaactgcacctttttccggtgcagt

SEQ ID NO: 7035 - DNA, 270 bp, Bacillus clausii
aatgtccaaatgagccggaacgccaactatgtagagcgttgcagcagagaggatattatgcttccccagaatacgcaattgaccatctgtcgattgatgttgccctcgttccttaccgcgtagcgctgatgcgcaacaccactctcacacaagagcggaaaatcgctaggtaccttgaaagaaaaggctggacgctccttttttatgatgatacccaggttgatggaaatttcgatcgactcttataccaagtggacacgcttgttcacc

SEQ ID NO: 7036 - DNA, 231 bp, Bacillus clausii
  misc_feature (1)...(231): n = A,T,C or G
tagcccggtatacggatcgaccagtcggcagctntttcttcctcctcaattccattattgttgttgcttccggactactgcttgatcctgaaaaagcattatttacattaatatccatatacgtcacttctcgctttattgatgcgattcatacacgctacgtgaagctgacagccatggtcgtcacaaaaaaacccgatctatcaaataaggcgattcatgaacggctga

SEQ ID NO: 7037 - DNA, 204 bp, Bacillus clausii
cggaacacggacggtttcaatcaagtctgcgccaacaatcgacgttcgcttgtttatcgatcgatcttcggttgaagtgttcattaatgatggggaaacggtaatgacgagccgaatttacccgcaagaaacaagcactggcatgaccgtatttgcagaaggagggagcgtcgttatgccaacatgcaccgttcacaaacttaa

SEQ ID NO: 7038 - DNA, 531 bp, Bacillus clausii
tttgtctaaaaacggctttgaaagtgatgacgttgccgataagaaaaaccacggcggcccagatcgagctgtctgcctatatccgtacgaacattatgcaaaatgggagaaagaatttggaaagcctcttccgccagcagcttttggtgaaaacgtgacggtgacgaatatgctagaaaaagatgttcacataggagatatttttcaattaggagaggcgatcattcaaattacacaagcacgcaacccatgcagtacgatcgacaaacacacagggtttcactcgctattaaaacgaattgtcgaaacaggatataccggttatttagcacgtgtgctccatgaagggattgtacgagcagatggggaagtagcccttcttgacccacaccctgacaaagtgtcggttttgtatgtctgtgaaacgtattttcgcaagccaacagacaaacaggcgatggaacgaattttagcagtcgatgctttagcggacgaatggaaagggaaaatgcgaaaaaggttggaaaagtt

SEQ ID NO: 7039 - DNA, 417 bp, Bacillus clausii
ttcaacataaacgaatcattattgtaggcgccggaccatctggaatcggccttgggattttattagaaaaattaggttttgactcgtatgtcattttggaagctgatgtcatcggctcatcttttctccattggccagccgagatgaaactcattacgccttcttttacaggccaggggtttggtgcgctcgatttaaatgcgattacccctggaacgtctcctgcttattcgtttcgaaaagagcatctgacaggcgaagagtacagtgattatttaaacttactggctgatcattttcacttaaatgtggaagaagaacaggctgttttgaatgtgacgaaagccaatggcatatttacgttacaaacttcacaaggcacatggacgtgtgatgcattaattttgggcaacgggt

SEQ ID NO: 7040 - DNA, 203 bp, Bacillus clausii
  misc_feature (1)...(203): n = A,T,C or G
acaagcctntcctatnaattacaggtggaagcagtggggtgggcaaagnaattgctaancagtttgccgaggaaggagcgtttgnggccatttgagcacgaaatggcgacnaattaacgcaagccaaacaggaaattgaaacattccctggncaagtggcgacctatgaagtcgatgtgcggaaccgggctgatgtcgaaaag

SEQ ID NO: 7041 - DNA, 777 bp, Bacillus clausii
tgttgctctccatacaaccggttcaagtgttccacaagtttggccacaaattaaatctcttttagaccatggttattctgttgtatcttcttgcgaggaactttcgtttccatgggtgagatatcctgagttagctaaggagattgatcaatacgcaaaagataaaggactttttgtcattggaacaggcgttaacccaggatttgtcatggattctcttgctgtatttacatcagcagttactagagatatcgagagtattcacatttccagaaaagtggacgtttccaaacggcgcatacctttgcaacaaaaagtcggtgttggtaaaacggtggaagaatttaatgcacttgcagaagaaaataatattgggcatgtcggacttgaggagtcccttcgattaattttaaatgggctgggtctcagtcagaaaaaaataaaaaaatcaattaaaccgacagttacttctaccgacctagagttatcatctggtcatgttggtaaaggaagagtaagtggtttacacgaaacggcagtgagcagtggtactattcctattaccttagatctggtgatgtcagtcaatgtggaggaaatcgaccgcatcatttttaaaagtaaggaccttggacatttggaatttaccatacctgggggattatttggtgataccgttacagcaaatgtgctggttaatgtagcgcaatcactaatgtttcatcgtcaacaaggtttgagaacaatgactgacatccacacagtccgtaatataat

SEQ ID NO: 7042 - DNA, 300 bp, Bacillus clausii
atggaatatgcatgtatgtcagcagggttttcacctaaaatcgttgcaaaaggggccgagtttatgagccgggctgtattaatttctaacggtattggcatttccattataccggaagatatgattcagctatacagcgcttatgaaattaaagctgtgcctataaaagacatctccgttatgagttctatttcaatggtttggaacgaatcaagtgataatgacattttaagagatgcaagaaagataataaatgaaagtttttcagcacctattagctcagcttataaccatatatga

SEQ ID NO: 7043 - DNA, 378 bp, Bacillus clausii
  misc_feature (1)...(378): n = A,T,C or G
ttgtgccaacgcttttatttggcatccctgggtctgggacgacagcgattntgctaggngggctcaccttaatgggcttggaggcagggccacgaatgcttggcgccgatttgccggtaacgttatcgattgtatggacgctcgtttttgccaatatttttggcgcactgctgtgcatgctgcttatccggccaatctccaagattagcatggtgcctggagaaaaaattgtcccgtttctcgtcgtcctgcttgtactaggcgcttaccaatcgaacttctcatggggcgatctcattgttttcgtcgccattggcctcctaggctacgtgatgacgattctagattggccgcgcccgccgctcttaattgggtttt

SEQ ID NO: 7044 - DNA, 324 bp, Bacillus clausii
atgctcgtccgcgatccacaatggtgggagcatctgcaaaacggagcgtataaagcaaagaaagccgttttgtacatagacgcggcgggagagccgagcgcctatatgatctatacaattcaaaaacggaaatttgcaacagaggaattgatctttggcgaccaagaaggcttaaccgctttgtttgcctttatcggccagcacgattccatggctgacacagctgagttaacggtgccagcagcagaaggcttgtcgtattttctgccagacgcaaaaacaaaagctgagacgattccatactttatggccccgcattgttga

SEQ ID NO: 7045 - DNA, 327 bp, Bacillus clausii
ttatttcattttttattgggcgattatccggtttgatattaaaacaccaggcagggaagaactgcaaaacgttgacagtaccctgcttaaagaaaagcgctatgacgagattgcaagtaaggtagtggaagcgttgggaggaaaagaaaacatcctgaacgtggataactgtattactaggcttcggattgatctaaaagaagttagggatattgacaaagagttattgaacagcaccggctgttccggattctttttcccaacagcgaagcatattcatatcgtttatgggacgcaggtagaatttatcaaaaacgcagtcgatga

SEQ ID NO: 7046 - DNA, 375 bp, Bacillus clausii
cgttgcgagtgccaaaaggcacatacacacttaaggacttatcgcttgaaagtgagacgtatcaacggctccgacatgtgtatgcccgtgaggcaaacaaatccattcacgtttcctttgaggggagaacactacgtctttcctacgacaataaaaacggcgacactcatttgactgtcccaatcccttatgagaaagggtgggaagtgagcgtcaatgggaagaagcagcaagtcgaaaagaccaattatgctttcctcggcacgacgattgcagaagggaaaaatgagattgtcttttcttatttgccgccttattttcgcacatcgcttcttctaagtggatgtggattgttggcgacagcgacgtggatat

SEQ ID NO: 7047 - DNA, 171 bp, Bacillus clausii
gcttccgcgctgactttattgcactcgatttggatgacttctctttatcgccacgaacagatttgttggcaaatctcgtgtatgcgatgcagcccacagcgattgccgacgtatttgtggacggcaagcatgtagtggcgaataaacagctcgtcatgcaatctgaaaaag

SEQ ID NO: 7048 - DNA, 168 bp, Bacillus clausii
ttactcctccagtaggcaatattttgtttgttgggataaaagtggcccaaaggaagctggaaaatgtgatgccgcacctctttcggttttatgccgccattttcgttattcttatgttgatcacatatgtttcatggttttcaacattcttgccaaagctggccggct

SEQ ID NO: 7049 - DNA, 258 bp, Bacillus clausii
atgggttctcacaagtgcttgccccaggcgatccagaagcgaacacctatgaaactaggcaaaaagaaggaattcctttgcctaaagacgtttggacatttattgaaagccaccaaagcggcgccaaaagcagccaagactcttaacgatttccgtctccccttaaggtttttcttagggggtttttcgagtctaaaagagaaagatgccacgtctatttttttagtcctcgtcaacacgaactcttcaaacaaatag

SEQ ID NO: 7050 - DNA, 378 bp, Bacillus clausii
attgacgaaagagttgattaaacgtaaaacagagtgggatcgtttggagaaacaacacttgttttgcgggtgggctgcgctcattagtggttgcacatttgtaattcttttgaatgaacctcaaactgggcgtatcgtctttcccaaagcgttgctggcttcgccattgtcaacagctttgctcgtcgtactctttttgtctgttatcggacttgttcatttatcaaagaaggcggcaaaaaaagaaaaggaatttgaggcgctgcgcaacgagtttatcgagcgcagcgaagaattttggccaactgagcgtagtgcagccgagaaagaagcctatttaaaagaaatgcaaacgcgctactccatcaacttgtttta

SEQ ID NO: 7051 - DNA, 215 bp, Bacillus clausii
atgtttttgccagcagctattgctgccaacgctgatctcatcacccgttttacaattggagttgtttgtgtgtcttccgtgctgtttttttccgcggtcattccgacgatcttagcgacagacattcctattagcgtgccgaaactgcttgtcatctggtttgaacgggttgtgttaagcatcttgttggctgcacctattgctcatttgttttt

SEQ ID NO: 7052 - DNA, 351 bp, Bacillus clausii
atgccaccaaggacttttgcaaatgtggacgtgcgcaatggccatgattatgcccctttcggaactattaaacatggccgtgattatgtgacagtgttaagcaaactggtaggcgaacaaatgaagaaacaggctgatgattactttccaaatgcatacaaaggggtgaaaagcacacaacctttctatgttgatgagcatgcgctctatcttgtctttgatgtatatgagctggcgccttatgcggctggttttccgactttcaaaattccctttgctgagattgaaccaatcattgaccaatcggggccgttttggcagtcattccactatcacaatcagccaaactga

SEQ ID NO: 7053 - DNA, 480 bp, Bacillus clausii
tctatttcttgcttccgtttgtcaacaaaaaagccaaaccaaaactggctgtttttagcacacttgtgcttatctccatcgtttacattattacgtatgtaatcgttgtcttaaatttaggggaacgggaagttaaaacacttgtatggccaacgatttcgtttatccaatcgtttgaaactgagggaattttcatcgaaagaatggaaggatttttgctaagcacatggatcatgcaatttttttccacgagcgtcatttatagctttttgtcagggtattcccttagtaaatatacaaagctaaaaaagtcttttcctgggatggctgttgccgtcgctattagcatgatcatttccttatgttgccaacatacgctcgatacaaggatcctcagtctgataagtttctatgggttcgaagtggtgttgctgcttccatttgtctattttctcatttactcgattaagaggaaggtgg

SEQ ID NO: 7054 - DNA, 271 bp, Bacillus clausii
atgaaacgcctgtttttagcaagcgtctcaattatcttgttattgtcaggctgttgggatagccggaatatggaggatgtgacgttaagccttggcattggcgttgatgtaacagaagaagggcttatttcggtcttaaaccaagtggtcgtgcctccagctcaacaaggcggctcttcaagctataacaacgtcattggtgaaggcccgacctatcacgctgcaatccgtgatgtcacaacgttggaattccctgtttatacccaacatc

SEQ ID NO: 7055 - DNA, 315 bp, Bacillus clausii
aaaagtggtcattccccgggagcatggcggttgggcgatgatcagcgtgccttatatcatcggcatgatggcagcacagccagtggtgctccatctgccgctcttcctggcgtggctgttgctgtatttagcttcttatccattgttgcaagctttaaagagggggagcaagaaaaaaagctggttaaaatggggattcggctatgctgccagcgctgctgcgtttctcattccggttgtgttgctggagccttgggtgctaggattcgcgcctgttctgcttgcattcatcatggtccatatctggcatgttcg

SEQ ID NO: 7056 - DNA, 462 bp, Bacillus clausii
gaaaagtcggcagcatggtatccatgtttttttctgttgataagttgacggaatatgtgttgcctgaaattaaaaaattccttcaggacgaacagacaaaagaaacggtgcaaagcctgcttcaaagtgagtggcaccgtatgctcaaccgaccgctcgcttcttttcaggcagagaactatgtcgatcagttggtcgataaagctgcagaagagcttgaaggcaagatacctgttctaaattggtataacgcacctttgcgtacatggacaactccttatgcagaaccgctcgttgaacggggtgtccctgtcattgtcggcatggtgacggcttacatggaacaacatattgctgatatccttagcaagctccgcctggagggaagtgattgaagcgcaagtagccctcgttctcaatggccgcatttagaaaaattaattatgaacattacgagacggg

SEQ ID NO: 7057 - DNA, 179 bp, Bacillus clausii
ttgggctattattacggaggatttgaaaacaactgctgctgccctcccccgccttgtggaggatacggttatggacctggcccttactacgggccgagaggatttggcggcggcggctttgcgattgcgattgttgtcgtgctcttcattttgattattatcattggcggcgccggctt

SEQ ID NO: 7058 - DNA, 315 bp, Bacillus clausii
gtttaaggaattaatcaaaccaagcccttccattcagctggtcctaagcgggcactaccacggcaccgcccagcggtttgaccgtattgatgacgatggcgatggtgtaaatgaacgaactgtggtccagattttatccgattaccaaggatatgaaaaaggcggaaatggctttatgcgccttttgacattccaaccaaaatcccaagcagtgacaattagcacctattctccttatacaaaggaagactcattagaaaacgaggactttcataaagcgccgatgacgtttagttttccaatggatttttagcc

SEQ ID NO: 7059 - DNA, 180 bp, Bacillus clausii
gtcattcaataacgttgatatttccgtctttcttaccggaccagggctttcgacgctgcctatccaaatgctgacgtacgttgaacattattttgacccaacggttgcggctatttcggtgatgttaatggcgttgacagctatattgatgtttgcgattgaaaggttagtcggcttgtc

SEQ ID NO: 7060 - DNA, 783 bp, Bacillus clausii
gacttgttcaaggaattacagagtttttgccgatttccagttccgcccatttgattattgtccaatccctgttcggcatgacatttgccggctttagctttgaaattcttcttcatcttgcttcagttcttgcggttattctttattaccgccatgatttgattgagattattcgcggtttttttgcctatttcacaaagcgaacaccgcaaaataaagcaatgttttggtttgctatttatttagttatcgccacaggcattactggtgttgctggcatcttgttcgaagattacataagcgaaacgtttaaagcgcctatctttattgccttagcacttgcggtcaccggtctattcttaatcattatagaacgttttgtccgccacggaaaccgcacagaaaaagaaatgacgatttgggattcaattatcgtggggcttggccaatgcctggcgctcattcctgggctttcacgctctggaacgacgttaattgtcggcatgtttgctggtctgacaaaggaaacagctgtccgcttttcctttttactatccatcccggttattttagggtcttccgtgttggcaattgatgatttgatttcaggggaattgctcgcgagcacaggcttatttgagcttgtcgcttcctttgttgtcacgtttattgcctcttggcttgggattgtctttttcttgaaccttgtccgcaaaagcaaacttgtctattttgccgtctattgttttatcgtcgccattctcgtctttattttccaagata

SEQ ID NO: 7061 - DNA, 132 bp, Bacillus clausii
cgagtacggctttgattacgtatgctttggcaagcgggagcacttctgttgcggcccttttccttggcggagtgatcccagggattttatggggattaagctgtatgcttgtcgtctacttttatgcgaaaa

SEQ ID NO: 7062 - DNA, 114 bp, Bacillus clausii
tcgttgccgttctgactggcaatggcttaaaagacccgacaacggctatagatctttccaatgtgcaaacaacgacggttgaagattcaaaaacagcgttggccgattatttaa

SEQ ID NO: 7063 - DNA, 762 bp, Bacillus clausii
aaacactcgttggggtaaaagaagcgattagagtagaagaaacgaaaattgaacatcagttagctaaaattgaacaagctttaatgcgcggcgaagtccttatttgtcttcaacaggcaccgacagaagcattgcttgtcccagcagagcaagctgaaactcgttcgattaacccgcctgaagttgagtttagtgtagttgggccaaaagaagcgtttgttgaaccgctgtcgacaaatataaacttagtgcgcaagcggctgccgattccagaccttgtcataaccgaacggatcgttggccatttaagtaaaacaaaagtagcgattctacatatagacggcattacaaataatcaagtcgtacaaacagtaacacagcgcattgaagacatcggctttgatgaaatcatcgatagttcttatatcgcgcaattgatttcagatgactccaattcgatttttccgcaactgattgatacagaacgccccgaccgagttgctgcgttgctcgccgaaggaaaagttgccgtaattgttgatggttcgccccatgcacttactggtccaacttcatttgttgaatttttttctgcttttgaagattattttttgtcatggccgctcgcatctgcttttcgcctgatccgtttatgtgctgtgctgttttcgattttgtcgactgcgttatatgtggctgtcatgacgtaccattatgaaatgattccgacacaactgctgaatacactagtttcctcgcgaa

SEQ ID NO: 7064 - DNA, 164 bp, Bacillus clausii
gcattggttctccttatgacgggaatcgctgttcgctcgctgagtgcaaccatttctttgtttgcaggcactgttttacttggcctctcgattgcggtgtgcaacgtgctcattccaagtctagttaaacgggacttttctaataacgttgggctaatgacagg

SEQ ID NO: 7065 - DNA, 234 bp, Bacillus clausii
  misc_feature (1)...(234): n = A,T,C or G
cgactatgactgntatgaaccacaaagcaaaagcgatgggtttgtttctcaaatcacgcagagaacgactttcccctgaaggggcgggcctaaagtacgcaagcgggcaacggaaaacgcctggactacggcgagaggaagtatccgtactagcaggcgtaagcgtcacctactatacgtggctggaacaaggacgggatttgaacccttccagagaggtgatcaacagcatcg

SEQ ID NO: 7066 - DNA, 201 bp, Bacillus clausii
cggtattctttctgaagcgcccctaaccgagcttgcgccaaaggtcgaatcgttcgttaaagcgctaacggcattaggttataagcattacaatccgattatgtcactgtcgacgttatctttgccagttagccctgccctgaaaattactgatttcgggttaattgatgttaataacggcaaagtcgttccattgtttgt

SEQ ID NO: 7067 - DNA, 435 bp, Bacillus clausii
aagcgggggaagcatgttggcggaaaacaaacagaaagaaccggttaaattagtcgatgaaaatgatccatcgctaaccttcttaaatacgcatgttgatggccatgatggcgaagaaggttcagactacttgctggacaatcaagatgaaaaccgttttaacgaggaaacggcaagcgaattttcagcagacgaaaggttgcgagaacaagatccagaagaagaggcagaccgaacagatgccgggaaagggataggtacattggcgctcatcctctccattacttccttgtttcttgtcccattattgttaggcacagccggcattatttgcggcgctgttgcaatttcacggggggcaagagggttaggcatttgggccactgcaataggcattgtttctgttctctctacgcttatcttttgaccctattt

SEQ ID NO: 7068 - DNA, 564 bp, Bacillus clausii; identical to SEQ ID NO: 6949

SEQ ID NO: 7069 - DNA, 354 bp, Bacillus clausii
atggaatttgaatgaacatttaaaaatggcgattgccgcactagacgacaagaaagcgatgcaaattaccgcactagatatgcgaggcatttcacctattgccgattattttatcatttgccacggaaattctgaaaagcaagtgcaagcgattgcccatgaattgaaaaaagtgtcccaagaagcagggcttgatataaaacggctagaagggtatgacgtcgcccgttgggtgctgattgacatcggcgatgttgtcgttcacatttttcataaagacgaacgtctctattacaaccttgagaagttgtggggggacgctgcgcaagttgatttacaagaggtgctgaacga

SEQ ID NO: 7070 - DNA, 615 bp, Bacillus clausii
tgaagaagagattgagaatgatcgccatgaaaaaaatgctcgacgaacgccagtttccagaagagtatactgatggcctatttaaaattgaggacacttctgccaacattgatgtagacagcgagtatactgcgtttccggttgaaaaccgtgacatctttaaaaatggcttaacaacaattgtgccaattaaaggtggcggtcaacgtcttggtacgttgattctatcccgtttaaaccgctcttttagcgatgatgatttgatcttggctgaatacggggcaacggttgtcggcatggaaattctccatgagaagacacaagaaattgaagaagaagcgcgcagcaaagcagtggtacaaatggcgatcagttcactttcatacagtgagttagaagcagttgagcatatttttgaggagcttgacggcagagaaggattgcttgtagcaagcaaaattgctgaccgtgtgggcattacccgttctgttatcgttaatgcattgcgtaaacttgaaagtgcaggcgtcatcgaatctcgttctttaggaatgaaaggcacatacattaaagtgcttaatgacaagtttctattggaactagagcgcatgaaag

SEQ ID NO: 7071 - DNA, 129 bp, Bacillus clausii
actatgaattgattgattcagccgaacttgatgcgatattggacaaaggtgcagacaaagcaaaccgcaaagcacaaaaaacgctcgtaaaagcagagcgtgcgatgggcttaggcagaaagagaagat

SEQ ID NO: 7072 - DNA, 119 bp, Bacillus clausii
atggagacaatggactcattcgcgtacttaattatgaaaattttaacggtagttttgttagtcgggacgctcggactttccttttttgttgggaaagtatacaagaaaacgaatggcta

SEQ ID NO: 7073 - DNA, 333 bp, Bacillus clausii
gcctgcaaaagaataccatttgctttccccgagtcctgccgagttagcaggactgacccgcaaggaaaggcagctgaagcaactgttgctgatggtgcttgaccaattgcagacaacaggctcagatgcggaaataaagtattggtgtactgagtgggaccctctgacatacaaaaaacttcagcaaaaaggccgtacagaagtgtgggaacaattgctgagcggcgttcgtgtaggttggagccaacgccattataaactatgtgaagcgatggttaaaggccattcctttttcgagaaattatgggagttggagcatccagagcgggtaaa

SEQ ID NO: 7074 - DNA, 432 bp, Bacillus clausii
atgggaatgaccggcaaccggatcaaggcgacaacaatagagaaaccgaagttgagcaacaaagcaacaatgagcaaaatggcaatggaccgtttgaaggacgagtagaagtagccgacgaagtggcagaacgaatttctgaactcgacgaagtagaacgggcgaatgtatttgtcacaaatgaaaacgcctatgtagcggtcatgcttgccaatggctcggaagacgaagtcactgatgacgttgaagataaaatttccgaacaggttagggaaacggatgagaacattcgcaatgtgtatgtgtcttctaaccctgattttgtcgagcgggcaacgaactatgcggaccgcattcaagaaggagagcctgtagagggctttatcgaagaattcaatgaaacgatcgaaagaatattccctaatgccaagt

SEQ ID NO: 7075 - DNA, 549 bp, Bacillus clausii
atgggatttaaccgctttagcatgggtgtgcaatcgttggaagacgatgtgattaaagcggtcggccgcaaccatgccagaaaaatgtcgattgatgcgattaacaagttgttgttgtctaacaaaccgttcaatgtcgatattatttttgggttgcctcaccaaactgcgaacagtgttgcccgtgacatagaagtgctctgcgatatgggtgtgccgacgattacgatttatcgtttgcgcaatgccgataggcaaaagatggggattggcaatgtgtcattatggaataatgaccgtgtgcgggaaaaaatggaagccgaggggctgtttccaacattggagcaaacttaccaaatgcgcgaggagattttgaaggtgttcctcaaatatggctatgagcctagcccttgcgggtggtggagtcgaaaaaacacttaccctgaaggcaatattccacaaatttcgaaaaataaatgggagcgctatgactccatgattgcctacggaccaggcgtatatggctggctaaatgacaaggaaggcact

SEQ ID NO: 7076 - DNA, 178 bp, Bacillus clausii
atggtttactatttgactgcttttcaaaaagacagttcagaagtgttaaatgaacggtttgaagcagcaacggacgacgaagccatccgaacagccacattacggttaacagaagcgcaggcggaaaagctcacccatcggttgacgagaagcggcaagctgctgttattctgccgat

SEQ ID NO: 7077 - DNA, 249 bp, Bacillus clausii
tgctgaagaagctccagcataccgagcaatctttgacacggctgctggatgatatccgccatttggcggtggagctgcgcccctcttcgctagatgatctcgggctggaagcagcctttcgctcccatttcaagtggatggaaaagaattacggactgctggtgaagttctcagcagagcttgccgcagctcgctacggcagcgagatcgagaccgttgtttatcgtatatgtcaagaggctgtgctca

SEQ ID NO: 7078 - DNA, 189 bp, Bacillus clausii
ttttcctctgtaccgatcatccacttttgcaccaacaattgttgcgaaaccgagcgccgcgtcagctcgtttatgttggcgaccaagcgcaagcaggccatgtttatgtgccggctaaaattgaaaaagggttgctcacagttagcatctcgacagcaggagcaagcccaagttacaccaaacggataa

SEQ ID NO: 7079 - DNA, 287 bp, Bacillus clausii
catggagctggcagattaatgagccgtacacaggcagcgggccgttttacaggaaaaggcaagaacagacgccgtagcggcggagcgattagctctgagcaaatggcagctgcgcttgctgcgtttggagtagaattgcgcggcggaggcacagatgaaagtccattcgtatataaaaaattagatacggtcctctctgctcataaaaatacgttaaaagtaaaacatcgcttaaagcctgttggcgtttgtatggctggcgagaacgaatttgacccatacaaaga

SEQ ID NO: 7080 - DNA, 137 bp, Bacillus clausii
  misc_feature (1)...(137): n = A,T,C or G
atgaaggcggatcatcggccgctnnatatacaagngatcgatcagnnaaaggaagaaatcagccactacagngaagggagtaagctcccatctgaatatgagcttgccaagcagctaggngnaagcaaagaaacatt

SEQ ID NO: 7081 - DNA, 132 bp, Bacillus clausii
gcaaacctttgtcagacccaaaattagcggagcagttgagaatcgaaaaaggagtagctttgtcgcggcgggtagtagcaaaataccgcgatgaacttgggattttgccatcttcgaaacggaaacgctaca

SEQ ID NO: 7082 - DNA, 235 bp, Bacillus clausii
atgaacgtcgatttttatacgaaaaaagggtgtcccttgtgcgacaaggggtacgcattgctaaaagaattagccgattgttactcgcttgtaattcaatgccatgacatttatcaggatgatgtgcttttagagaagtaccaacttaaaatccctgttgtttgtatagacggccaagaaattggctacggcttattagagaaagagttgctccaaaaacagatcgaacgcattc

SEQ ID NO: 7083 - DNA, 204 bp, Bacillus clausii
  misc_feature (1)...(204): n = A,T,C or G
gcgtgccgaacgtgatgaatggcacgttgtcggtatcacagggcaagtccatgtccgcatagatgaaacggtcgaagaaggcgataaaatcagcgcaattggcggcattgcgactaaagacgaaaacggccnatttattgtgatgaacattacgacaccttacgattctgacaagggttacggtgttgcggttgttttcatccg

SEQ ID NO: 7084 - DNA, 528 bp, Bacillus clausii
tgagcttgacttagcaagcgaatatttagtcatggcggccacgcttttgcacattaaaagtcaaatgcttttgccaaagcccgaggaattgttttacgaagacgaggggatggaagcagaagaccctcgggatgaactcgttgagcagcttttggaatatcgggcttttaaagaagcggccgaacaattaaaagaaaaagaagcacagcgcagcttagtccatacgagacctccaaacgatttggacgcttttttaagtgaagaagaagaacggaagctccaaatcgaaggcgtcacacttgccgatatgcttggcgcgtttgagaagcttttacagcgcaatgcatggaatgcaccaaaaacgaaaacggttcagagtgaagaacagtcgattgaacttcgtatgaacgaactgttggacgagctatcggcccattcaggcaaggctccgttccatacgctgtatgagactggcaatgtgtctcagctgattggcacgtttttggccatgcttgagctcattaaaac

SEQ ID NO: 7085 - DNA, 144 bp, Bacillus clausii
tttacgtctactatctgtttgaaaccgcctttttccaaaatcgtatcggctacgcgtctgcacaagcatggattttgtttttaatcattttcgcgttgacgttcttgtccctctatgtgtcaagaaaatcggtccactatgaat

SEQ ID NO: 7086 - DNA, 141 bp, Bacillus clausii
  misc_feature (1)...(141): n = A,T,C or G
cgaagaaatggatgacgatttcaatagcgccaatggaataagtgtcttgtttgaccttgctaaagaagccaatatttatatgagcgaagcacaaacgtccnaaaaagtgctcaatgcttttttggagtttgtttaccgagt

SEQ ID NO: 7087 - DNA, 198 bp, Bacillus clausii
  misc_feature (1)...(198): n = A,T,C or G
agtcgtcgatttgtccgtcatcgnncggtttgagtacattggtatttcgacttggctatttgttgtgttgcctaccatttgcttgctgctttgggcagcaagccgcattgcnaaccaagcttttttcatgaagtaacgctccggattgcgtctattaattgctttgctatttgtttgctccttnttcgtcgtagggcg

SEQ ID NO: 7088 - DNA, 369 bp, Bacillus clausii
atttacgtgtcttgcgcaccagaaaatcaatccgaaatgcttttattgccttgcttgaagaaaaggagtatagcaagatctcggttaacgccattgcaaagcgagctgaaatcaaccgtgtcacgttttactcacactataaagatattcatgatttagtcgaaagctttttaaatgaacttctagcagatattcaccaaattttgacggctaaagcgaatgtggaatcttaccagccaggcatagcacgggattctttggttttgttgctcgaacatattgccgagaatgcgcaaatctataaagcattgcttgtgtcaaaacacatccctttttttaccccaaaactaatggaattaatgaatcaac

SEQ ID NO: 7089 - DNA, 711 bp, Bacillus clausii
tctcatacatgaaagctgaaaacttaaagctaaaaagaacatttgcgcgaaaaatgattggcatcgtcccactcttaacagttgctttttcttttattatgaacatggaatactttgtgtatctcaccttcaattggtggtcgatcatgtttatgccgatgatgattgctttgttttgtgctttggttcacgtccgggaaaagcaggcatccaactacaacggcatttattcagcccctgtcgatttgcggctcgtttggctagcgaaagcaagcgttattgccctttattcccttgcttcacaactgatttttcttgtggtcatgtttctgatcgaagcggttgtgtccatttttccagttggtcctttccctgttatcgctgcttgtttcttactgtgggcgacaacattatggcaaattccgttttgtctcatgcttgccaaaaaattcggctttgcgttttccttgatcattaacctttttggctgcctagtattaggcattatcgccgcctcgaaagcttactggtgggcatgcccgtggagctggccgatccgagcaatgagcccaacgattggcatccacccaaatggcttgccccttgaagagggcgacccattgcttagcatgacagtcatcccgatcgctatcatactttctttattgttgttcgcagcattgcttatgatctctcaaaagtctttcgctt

SEQ ID NO: 7090 - DNA, 396 bp, Bacillus clausii
atgtggttagaagaaagtaaattaaaagtttatgctcaaacagcggactttcttcgtatggaaattgattttagtcattatggaaaaggagaaaatattgatgatattacgttaacgcctacaaaacggacaaaagagatgatggaaaggtggaaggctgtttctaaagctttccctacgattgaatttcctcaaaaagaagtagaggaaggaaattggataaaagtatatgaagaaattactaaaagcattggaaaaatgcgaaccgtacctcttgtactctcaaatggagaagaggtaggcggaacggaaagcctttatttgtatgtacataatggaaatatagaagaagacaactttaaaaatttattaaaggaaaaggggatcattgaataa

SEQ ID NO: 7091 - DNA, 117 bp, Bacillus clausii
ctttgaccaagagttctatttgattctcaaccttgctgttggcggttggtatggcggcaacccagatggctctaccccattcccttccaccatggccggtgattatgttcgcgtgta

SEQ ID NO: 7092 - DNA, 470 bp, Bacillus clausii
atgacctatttaacatcgctttccgtgtggcttatcccgttgctcatcggttttgtcgtccttgtcgcttcgtttaagcgcgtgccgacgtatgaaacatttgtatcgggtgcaaaagaagggtttagcatggctgtttcgattatcccttatttagtcggaatgctcgtcgctatttatgtgtttcgcgcttcaggggcgatggatgctcttgtcggtgccatggcgccggtactaagctgggtcggcattcctgccgatattgtgccgctcgcgctaatgcgcccaatttcgggaacaggcgctcttggcttaatgactgatttaactgctgtccatggccccgactcttacattggccgcttagctgctacgctgcaaggaagtacagatacaacgttctatattttaacggtttattttggtgcagtcggcatcaagaaaatgggcgatgccctaaaagtcggact

SEQ ID NO: 7093 - DNA, 135 bp, Bacillus clausii
cattcgaatgtcgtacggttctgcggcgcctccagatattgtcagcacgacgattttagcttctggctgcgccatgctaggggcgatttgcattgaccgccttttttatatgcgccgggcgcgaaaggagcgtaa

SEQ ID NO: 7094 - DNA, 423 bp, Bacillus clausii
cggaaatggagtctaaaataacaaggaagcaagttaaggcagcactcgaagcaggcgaccaactagaagaagtgaaaatgcttcgcgtcgatcctgaaacgggagaaaaatttgatacggctgccgatatggttgccgcataccagcgacgaacgaaagagaaaattgacaagatgcaggcacaaatattgcgagaagtgcatgtcgatgattacggtgctgtaccggatggcgtcacggactccaccgaagcgtttaaaaaggcgctcggtgacggaaacgtcaaggtgcatatgtcggctggtgtgtatcgggcaagaattaaagcgcctagcgactcaattttggttgggcagggaattgacgtcacatatgttaaattgccggatgatgcccctggtgattcttatggtggtaccaatg

SEQ ID NO: 7095 - DNA, 117 bp, Bacillus clausii
aaaaagcattgatctttcaaggtggttgggatggacatgaaccagagcaagtcgcctctattcttgaaggcattcttattgaagaagggttttccgttaatgttgccgattcattgg

SEQ ID NO: 7096 - DNA, 459 bp, Bacillus clausii
atgtacaattacggcgtcttgcttaaaaaaattggcaactatgaacaaagccatgaatgttttacgaaatgcagcgcttattacgacaaagacagccaaaattacgtattcagccttctcgcagacatcgaagttctcttccagttgaaaacggacaaaaaacaaattgaatcaaaattaaatgaaattattgaaattagtgcaaaacgtgggtacaaacgctctgagcttcaagcccgctactatgcgcaccgcttaaaagccgacgatgcgatgtacaactttatcgaacaggaactgctccctcatctcgataagcttgataataaagaagaaccagtccactatgcaattgagctggcgcaatggtaccagaaaaacggagagtacgaaaaagcaaacgaatacttaaataaatatgccatgaaagtcaaaagacgtgaattttccattggatag

SEQ ID NO: 7097 - DNA, 790 bp, Bacillus clausii
gtgcaaaattggtttcatatttttcctaaaaatacgggcttaagcctctatgtttggattatcttttgtgtcttgcccttttattttgtgatttcatcggcaacgtttattgaaattacaatcggcagcattatgatcatgctggtttttacgacataccgactggctttcattaaaaaaggctggaccatgtacctgtcggtggcaattgaaatggccattaacattgggatgacggtttattttggatatatttatttttgctttggtttttggctttttttcatcgggaatgtccaaaacagaaaagggttctttgctttatatgctgcacatgtaacgactacggccgctgccacaacgattggctttaacattcagaatgagacgtttatcgtccagttcccgtttatagccattgcgttaattggcgttcttttattgccgtttaccatttcgaaccgccataaacgggagcgacttgaaagtcagcttgagacagcgaatgaaaaaatagcacaactgttattagcggaagaacggcagcgaattgcccgtgatctccatgatacgcttggccaaaagctttcgttgatcggtattaaaagtgacttggcgagaaagtggctaccgatcgatcaggaaaaaaccaatatagagctacaggaaattcaaaagatcgcccgaaccactcttaatgaggtgagagagattgtatctgatataaaacgtagccgcttaagtgatgaaatagaacggataaaagaaattcttacggcggcggaagtgg

SEQ ID NO: 7098 - DNA, 186 bp, Bacillus clausii
tacggagcgagaagagcaagtcccttaagcttattgctgaaggacgcacgacccagcaaattgctgacgagctgaagataacaaacggaacggtgcgtaattacgtgtcggttattctcgataaactcgaagtcggcaaccggattgaagcgatttcgtactacaagaaaaaaggctggttaagat

SEQ ID NO: 7099 - DNA, 553 bp, Bacillus clausii
atggcacactcttttaattccaagcatataactatgtttactaggaggtgtagagggatgactgattttttctttcaaaaggaagtagcagaaaaatacgaagcctataatgacattttagagcaactattaggatatcaatttgtctttacccattttgacaaagacgagcgccagaccattcttgactttggctgtggaccaggcaaaatcgcaacgcgctttgctgagttgttttccgcgaccgtgattgccgtcgaccaatcggcggaaatgattcagcttgcttccaagaaacacgaccataaaaacgtgcattatcgtttagtgaaagacccaaaactcgcttttttagatgacaactccattgacggtgctttttcctgtttcgttttcattacgattggggatgaagcagtactaaaccatattttgcgagaagtataccgtgtattaaaaccaggcgctccatttgtgctgctagataccaatcctaattccacaggtcatgttttttccacatgccgtatcggcgaaaaaggcaaaacctaca

SEQ ID NO: 7100 - DNA, 336 bp, Bacillus clausii
tccactcctatcattttgccttgcctttaataaaccggaattggctaatttgactgggaaaatcaaccgcccccgtgcgcctaaagaccatgttgcccaaatgaatgaaagcgatggctggtcttttttagaagaaagcggcgatgcccaagcaaaagaaacgggccagtattggctgaagccaaaagcagcggaaattcctgccttatcaacggttatgttttctaattttgaaattcaattgcctatggcagcaacaagctctgtggcgatgcaagtgaacgggtttgtatacggcgacgaacatccacaaggaatccctgctttgaatgcgat

SEQ ID NO: 7101 - DNA, 90 bp, Bacillus clausii
gccatccattgtcgtcggtttgtttggtttgctcgtatttgtacagctaacaggttggagttactcgattttaggcggtgcgcttgcgct

SEQ ID NO: 7102 - DNA, 539 bp, Bacillus clausii
  misc_feature (1)...(539): n = A,T,C or G
ttgacgtgggcctatatgatgattgcgctgatnatcattcaacgcctcgtggaagtaagggtagcgagacgaaacgaacgttggctgaaagcacaagggggcgttgaagcggggacagcccactatccatggatggttacgctgcattgtggtttttttatttcgctgctgatcgaagtgacattatccaatatagcattttcgcgttggagcgcgattccccttgccatcgtcgtcattgcccaaatcatacgcatctgggcgctttcctcccttggtaaatattggaacacaaaaattatcgtgttgccagaagcgccagtcattgaaaaagggccctaccgctttttgcgccatcctaattacatggttgtagtggcggaaatcgcgtttgtcccattgctgtttcaagcgtattggacggctattgtgtttagtctattaaatgcagccatgctgacggttcggattcccacggaagaggcagccttgcaaggagagacagactacggcgaacgatttaaggagaagaagcggtt

SEQ ID NO: 7103 - DNA, 398 bp, Bacillus clausii
atggtatcccttgttctagctgcactggctccggccatggcattgttttcatatgtctatttgcgcgatgtatacagcaaagcaaaaatgtttctcgttctccggattttcattatcggcgcgctgctagtcgtgccgattttggtcatccaatttgcctttactgaagaaaatgtctttccccatccagctgctaaagcgtttttgctttacggttttctggaagaagggttaaaatggctcatgttgtttgtatttgcctaccaacatggacagcttcagcgcccaggggacggcattttgttcggtttttccgtctccctcggctttgctacagttgaaaatggcttatacatgatcgcttatgggttagaggcagccatcccgcgaactgtttt

SEQ ID NO: 7104 - DNA, 548 bp, Bacillus clausii
tgttgatcgtttgccaattgcttttgattaacgccggagcgagaacgtttttttctactacaagtacaaaccaagcatctgaacgctttatgagcagcgagtcatacgattcgcctcagcaaggggaactgatcgaacaagcgttaaaaaagaaaaagcatccattggcacgaatcgaatggatggtcgatttccgcaacaacactccgctcattcaaggtttttatggcaatagcgcctattcaagtgtgctgaacggaaacattctccatttttactatgatcatttgcaaattgacatgggaagagaaagtgtcagccggtattatggctttggtgatcgcgccaacctccatagcctcatgaacgtgcaatttaagttagttgacaaaaaggaagaggctgctattccttacggcttcaccctttactatgaaaatgatcgttatgcgttatatgaaaatcaatggctgctcccatttgccagggcaacgtcaaacgtcttcctggaggaagacttagaaaagttcagtccacttgttcgtgaa

SEQ ID NO: 7105 - DNA, 346 bp, Bacillus clausii
ctgccttttaagcattttttataccaacagttaaaacatggtcagtggatttattcgctccagtttggtttaggtgcaggcacgttttcgcaactcgcctattatttttcaacgagtatggtttattccttctcttgcctccttgtttatgccggggaaataagcgggctgattgccaacgttgacctgttgttctggggaaaggcagctgtgtttatcaatgcagctaggttggcgcttgtcctctttttagcgacgatggtattccactacatgaaaatgtctcttccctatgcatttttagggtccgttttttacggggtgagtgtcatgtacttcacacacg

SEQ ID NO: 7106 - DNA, 257 bp, Bacillus clausii
taacaaaattcagcgcgaaagtcgaaagcaaaggaatgctcaaacgctatttacagcatgcggaagagcaggcgttgaccggagcaaaagggccggtccatttgtccgttccgttggatattttgattgaggaagtggacgaatttacgctttctcgtttaccggtgcaagaccatctacgctcaggaaacattcaactagcaattaaagcattaaatagagcaaaacgtccactcatgttagttggaaaaggggcc

SEQ ID NO: 7107 - DNA, 588 bp, Bacillus clausii
atggcgattataaatatggtactaaatcaactatttgattatacctatttctatatttggaataatttttttagttctttatttgttgttgcggtagtggtacttttactagacaactttaaagcaaaaaacttgtttttcttcatcatttggcaactatcaacccttattttatgtctcgttttagcagaaaaatatgaggtattaagactaagtgatgcagcaggtacatattactttttaggttcagtatttggtaatatcctctttgtggagggcacttttttaggggttgtacttggagctatattttatcttactttatcgaaccgaattaatttaattattctatatagctccttctccttgtgtttttatatgcttcatttaaaggtaagcaattacggaaacccagtcattcacacatatttgtttccgtttgcagactatcaatggatgatggttttcgcccttccatttttattgctctataatggcgacagagggattggcttaaagtatatcttctatattttttatccattacacttaattattctgtatttattggctgtgtctcgattgtag

SEQ ID NO: 7108 - DNA, 355 bp, Bacillus clausii
gtgttatatattaagattcaggaattacataagagaaagtttaaagtagcgcaaatcgctaaggagcttaaaatctcaagaccgactgtctataagtacttagaaatgacattcgatgaggcaaaggcgtatactgaacagcccttgggaaagaagaaaaaactagatcactataaggactggatactggcctggctcgaagagtatccccacctaagtagtgctcagatccatgattggcttttagaaagataccccgacctagtggtcggcggaagtactgtaagaacatatgtgaggggggtgcgagaagtttatcagattgagaaaaaggggattgtccggcaatacgaac

SEQ ID NO: 7109 - DNA, 488 bp, Bacillus clausii
atgaaaacagtggaaacattctcatcgcggtcttttgctacaatggttctttacgcaacaattagcacggcgatgctcggccttccaggctcattgagcttttttatccagcaagatgcttggcttgttccgattatcggcagcatcgttggcatcccaattatttttctttacacgttgcttgctcgctggatgccttctgatgtcatttttgacatgaacaaacgtactttcggcaaagtcgtaggttggtttgcttcctttttctatattttgtttccactgcttcatttcccagcaattatgagctatgccgtcacctttattaatcattttttgttgccgtcgacgcctttttttggatgctacttgctatgtttgtccattattgggttcggcatcatatgcggaattgaagcaatagcccggacagcatcgctatgtttgctattctttttcgttaaactcacactgctgattgggcttat

SEQ ID NO: 7110 - DNA, 327 bp, Bacillus clausii
atggcctttcaattttcgttacaaacagcgatggatgtatgcaagcaagaaaaagaagcagcccataagcaatacgaagtggctgttgacgcatttgaatctgaggcaatggcgctgttccgtttgctaaagcaaaaagaagatgtacaagcggcgaccgagaagatgctggttgaaaaagcgtcggtttccgatttgcttattagccaggcgtgtttagacggactgcagcagcaaattggaaaacaacagctgcgaactgaccaagctagggttgatatgcttcaaaagaaagcggacgttccagcaacatgccgtctcgtataa

SEQ ID NO: 7111 - DNA, 354 bp, Bacillus clausii
  misc_feature (1)...(354): n = A,T,C or G
atgggcaatccaatattaaaccaaattggcnctgtattcattcctgtcagtgacatagacaaagctaaagattggtactgtgatatttttggatttaatggagatggggagattctgtttggtcacctttatgtcattcaactagaaggaacggggattgtactagatagcaaaatatattcgccagaaaaaacgtttcaaacaccagcttttcacttcaataccaataatattgaagaagcttatcaatacatgcagagtaaaggcgtgaaacttcttacaggaatagaaancaaccattactttaattttgaagacttagacggaaatatgttaatggtttgcaagtgttaa

SEQ ID NO: 7112 - DNA, 354 bp, Bacillus clausii
atgggcaatccaatattaaaacaaattggcactgtattcattcctgtcagtgacatagacaaagctaaagattggtactgtgatatttttggatttaatggagatggggagattctgtttggtcacctttatgtcattcaactagaaggaacggggattgtactagatagcaaaatatattcgccagaaaaaacgtttcaaacaccagcttttcacttcaataccaataatattgaagaagcttatcaatacatgcagagtaaaggcgtgaaacttcttacaggaatagaaaacaaccattactttaattttgaagacttagacggaaatatgttaatggtttgcaagtgttaa

SEQ ID NO: 7113 - DNA, 246 bp, Bacillus clausii
  misc_feature (1)...(246): n = A,T,C or G
tcaaatatttggaagaagtagatgtaattacatccaatctgtattcgagtcatccaccgcgctatgagtatgtattaacggaagcaggcgatgatcttgaacccgtgttttactctttgcttttatggggaagaaaacatctagaccgctgctataaaaagcttgttcacacggaatgcggggctgatattgacatgctttactactgnccttcttgccaaaagaccgtccaaaaagacgaaatgc

SEQ ID NO: 7114 - DNA, 474 bp, Bacillus clausii
atgaacgtgctcattcgcgaatcggtccaacacgatggaccatctgtatgcaaactaatgatggaacaaggaagccctgacgaccaacatcgtttagagcaccggtttaagcgatactccaacgattcacaccattacattgccgttgccgaagaacaagacgaattaattggctacgtgtgggcgcaagattttggcgtgcatttacgtaccggtacgaagctatgccgcctccaggaattgtacgtccttcctgaacacagatcaaaaggcgcaggacggcaactatttaaaggcgttcttcgttggtcgcacatacgccacgctacttggctgcaatggcatgcttctttcagtgcgaccgccttttatgaaaagctcggctatgaacctgtccaccaagagggacaaggctttccctgctatgaaatcgacttttccacaaagcagcgcccacattctcgccatgcatga

SEQ ID NO: 7115 - DNA, 413 bp, Bacillus clausii
gtgcttgctagacatgcatttgcttatctcctctctcacggggtaccggcattggtcgggtttctcggcattgccgtttattcacggatgctctcaccagaacaatacgggcgttacgctcttgtgcttgcagtgagtgcactcgtcaatgccattgtgtttgaatggctgaaagtcagtgtgcttaggcattacaaaagcagcaagcaaagcgaagctttttatatgacagtaaaagcggcttttatagggctaatggccggaacgctagcgctcgcaggcgtaatgttgctcgtttccgattggctgtcgccgccgcttttgtttttagcattgttgctatgttgggcccaggcatggtaccagttgaatttatcgcttttgcgggcagagctatcccctgtgagatatgg

SEQ ID NO: 7116 - DNA, 1203 bp, Bacillus clausii
  misc_feature (1)...(1203): n = A,T,C or G
ttgacaaaggcgccgaatggctggaacagtttggcattaaattgatccgtaaacggggctacggcattgctgtaaaaggcacggaaacgaatattcgccaagcgatgtcggccattttntcggaaaacctcacggaggaagcgttttatgaagccgtctattcaggccaaatgcaaaatgaagtcgctagccgtcttttgcattttgttgacttagaaacaatccgccttgtccagtcgacgatacaacgtgtgaaagaaaagcattttgatgacatggctgaccaatcattcattgctcttgtcgtccatgccactttagcgattgaacgaattaagcaaggcgaacaaattagaatggacgcgggccagcttgaagcattgcatcaggaagatagccttccggttgcacaggagttagccgaagcgcttgcgcaaacgttccaaataacgattccggaagcagagattggctatttagtcatgcatttgcgtggggcgcggattgggcatatacaaggagagccgtttgagcagtccaatgcagaattggcaggcagattaaagcagtttattgccggaatggaacaagatttatctgtctctttagccgaaccttccttattccaaggtttgctcgctcatcttaaacctgctctctaccgggtgaggcaaggaatgaagatccataatccgctgcttgaaaaagtcaaggccgattatgctgctctgtttgccgtaacagctaaacaagcaagtgaggcgtttgcaccccttaagctgcctgaagaagaaattggttttttaacgcttcatttcggcgctgcccttgagcggcgcaaacgatccgtgtctttatcggcgttggttgtatgctcaagcggaattggttcggccaaaatgttggcgagccgtattagacaagaatttcccgaaatttcctctattacaaacgcttctttgtttgatttggacaaatatgaccctgccagctttgatttgttcatttcaaccgtcaaggtggagacgaataacaggcaagcgctccgtgtcagcccgatgttaactgctgacgaagcaagtttaattaaagcaaatatcgatgagcttttaaatgagcaaacgatcacggcggcgccgcctatccgcacaaacgtggaagaaaagcgctcatttgcagacattaaacggatggcatccttta

SEQ ID NO: 7117 - DNA, 267 bp, Bacillus clausii
tacgatgatttacaaaacaactgtaacaaagttaggcactcatgctagcgattttttggcagagaatatattgattttgtttaaaaacaatgcgccagaagagttagcggagtattgtgtccttcatcaggaaaaccaagtaatagacaacatccaaccaggcgatacggcaattttagcaggacaagcgtttgtggttacagccgttggcagtgcggttgaaaaaaatttacgcgccctcgggcatataacgataaaagccgatgg

SEQ ID NO: 7118 - DNA, 348 bp, Bacillus clausii
ttttgttagccattgtctgtctaggagtcggtttccttttgcaaagtgtactcggcttttggcaaatcaagcattttaactaccgctatcggcaatttcggcaagaaggccaagtggcgattggccgctcgaaaggaatcattcgtactggcgtgatcttgctgttgttagtagaccgtaaagcgaatatcattcgtgcggaacggatgcaaggaatgacgatttttgccaggtttaaagagttgccgtcattaaaagggcagccattgttttacatcgaccaaggggtagaaaggcgtttggacccctttacgagaaaagcgctggcggacgcgaaacatgtctatc

SEQ ID NO: 7119 - DNA, 462 bp, Bacillus clausii
atctctttctcacaaccgagctcattgttggcttctttgctctgctgttgctaacaaaagtgcttggcaaaaaccaaattacgcaactaacaccatttgactttatttcggcactcgttatcggcgaattagtcggcaatgccatctatgataaagatattggcctccagtatgtgctctatgccattttcgtatggggctcacttatttattgcattgaaatcattacgcaaaaatttcgtatcacacggggattccttgaaggcaccccggcgattgtgattgctaaagggcgaattcaatatgaggaactccgcaaaaataaacttgatttgaaccagctccaacatcttttgcgtgaaaaaagtgtgttctcagtccgtcaagttgaatacggcattttagaaacaaacggtacagtaaacgtccaactcaaaccgccttacgcacagccaactaacc

SEQ ID NO: 7120 - DNA, 398 bp, Bacillus clausii
atgggttttcgtgaaacaatgagccgaattttcagcacacgtactgaaaccggggaagagcacccagtgaaagagttgcaaacacgctattataaaacaacgaaagacaaggctatgcgcacaattgaacaagtgcttacacaacaaggattgacgataaagcggagcgaagatgacagaggggaaattgtggcacaaacgaaatcagggaaaaaactactgttagttgcatcgattattactgtaaaaccgtaccggaccgcggtcgatttttcttgtgcaacggaaaccgtgcttccaagcgattttggctacagccggaaatttattttagctctttaccaaaaacttgaccaggaattaacgtatgtcggttcagcgctaggccacgagctgct

SEQ ID NO: 7121 - DNA, 1148 bp, Bacillus clausii
gaaaactttgatttgatttgtttggaaatgcggcatgcaaacaaacggatggcgctttttttagttgatggttttgccaaagatatcgcactgacacaaatccaacgggaactttcccatacgactgaagatgaattgcaagaccgatatgatgccttactgcaaagccggattccttatgcagaagttgaaaccgaaagagacttgaaccaagtcgtagagcaagtgttggccgggccagcggctttgctcgttgaaggccttgactattgcctgctgattgacacgagggagtatcctgttcgaagtccggaggagccagatacagagcaagttgttcgtggttcgagagacgggcttgtcgaaacgctcgttatgaacgcagctctgatccgcagaagagttcgtgaccggacgctgcgcgtcgtgttcaagcaagttgggcgacgttctaaaacagatatagccttaatgtacattggcgatattgctgataagcgttatgtcgagcaaatgaccgctgcccttgatgcaattgacaccgatggtgtacccatggcagataaatcaattgaagaatttatctttaaagaaagcagcaacccttatccacttgtgcgttattcagaacggccagacgtatgtgccacccatttatttgagggccatgtcctcgttcttgtcgatgggtcgccaagtgtcatgattacacctactactttctggcacttgcttcaacatgcagaggagtaccgtcaaaaaccaatcataggagcaatgctgaggctagtcagattcgctgctgttttttcgtcgatcttcttgctgccgttatggtatttattcgcaacaaatgcgtttttattgccagatagtttggcgtttatcggcacagaagaaaaggggagcttgccactgtttgcccaatttgtcatcgcagaagcagggattgaaatgttgcgaatggcgtcgattcatacaccgaatgcagtcgcagaagcgcttgggcttgtggcagccttattgattggcgatattgccatccaagtcggtgtcttttccccagaagtgatcctctacttagcgattgccgctgtcggtacgtttgcaacacctagttatgaactttcccttgccaaccgatttat

SEQ ID NO: 7122 - DNA, 564 bp, Bacillus clausii
atgaaacgtatggactccttttatgggatgcacgaggacatgggctgtcgcgggccaattgggactaattttacgatcaagctattaatcgatgatatgttagcgattatgacaaaagaacacatcgagaaagccacatttatcggccaatccatgggcggaaatacggctcaagagttggtgttccaccatcctgacaaagtcgaaagcttggttttgattgactgtacgtggaatacgcaaaaactgacgttcatagaaaaaggactaatcaacatgacaccgctgctcttgtcattgtatccgtggaagatgttagtcaaccaaagcgcacgggctagctcgattaaacccgatgtacaggcctacttacgcgagtgctttcatacggtaggcccgaaggatttcccaaaaatctttcaaggcatgcaagactgcttgcacgaagaagaaacataccatatcccaaaaccatttctacttgtctgcggcgtcgacgaccatacaggcaacataaaaaaaacggcaccacgctgggcgaagcgagagccgggggatcctcta

SEQ ID NO: 7123 - DNA, 196 bp, Bacillus clausii
atggcagtggaaaacaaaatccgagccatccgaaaacaaaaagggattacgcaagttcaaatggcacaagatttacgtatcaccagacaaacgatcaatgcgattgaaaaacataaatacaatccaagtttagaacttgcccttaagttgatccattatttcgatgtcccgattgatgagctttttacattaaagg

SEQ ID NO: 7124 - DNA, 378 bp, Bacillus clausii
atgtatcctcggttagaggggaaggtcgccgcattaatagaggaaaaaagaatggccaatgacgtttatgtcaattcatttaatcatgaatcgatggggacgttgagggagattgcccccgacttggaaattggcttaatcaaaagtgacgcaacgccagccttgtttccttatatggaacaaatacaggcgtcttccattgcaatggagcttcgtttctatacagaggcctttgccgatgagtgtaaggagcgtggctatcagctcattgtttggccagttgacacaaaagaagcgtgtaaaagaatggcaaaaaggccagacgtgctatgtacggtaaatgaattggagctgttcaaagaaaactaccatgcctaa

SEQ ID NO: 7125 - DNA, 282 bp, Bacillus clausii
tgaaaaagacagttacgaccgcatcgctttccattttagccgcatttgccctcactgcttgcaatgctggcgcagacagcttagacgaaacgacggactacagccccgacaatcctgttagcgtcaaaattggcgttactggcacagatacgccgcaatgggacttcattgctgacattgctgctgaagaaggcattgaaattgaaattgttcgttttaatgactacgtccagccaaaccaggctttagccgacggcgaaatcgacgccaatgcattccaaa

SEQ ID NO: 7126 - DNA, 213 bp, Bacillus clausii
tcgctggagcggttatggtggcactgggaatggcagggtgcacgagcgatgatgctagcaatgagtcagacgatagcccggttacttttacgttgtttagcgccgatcctcactcccagtgggacaacatggaaagccctgtaagccaaaaagtgatggaagaaacaggcgttacgttgcagcctgaatttgatgtcaatggaggcgagcaaa

SEQ ID NO: 7127 - DNA, 567 bp, Bacillus clausii
atggggagcttgtcaaccaagcagtggctgactatcaacagaccattgcaggcagggagcggcaacgtccaggaaggccagcatgcgtttgcgccacagctttccaatgaaggcgacaaagtggtttctttgtttgacgattgggcaatcggcgcctataagtttaatggcgaaatgaatgggtttaatagcgaaataaaccaagtatatgctgcccaagatttagccgtcgatcggctgccaaatgcacaggctgaactgattggaaaatatgcaaatgcgacgcaaggagaacgggcagaagctcagtttcggcaaacgttaagtgtgcgccggcatttgtcaaaggacgagcggcctccacagaacatccctcgccctgaacaaccagaggaagcactagagccgattgacgaagacctactgaaagacgcagaagaaacgattgccgagattgaaaagctagtcggcaagttaaaccctgaagaaattgaatttccagagccgccgccaccagaacctgagccaggcgatggggacggagatggcggtgacggcgacgataat

SEQ ID NO: 7128 - DNA, 237 bp, Bacillus clausii
atggcactagcgaacgaagcgaaattcaaatttaaccggttgtatgagccagtgcacgatagcgctggctcatactgcctacatgtcgttattgtttctcatcacactgcttttccaatcgatctagtttggccaatacttgatccagctttttgtcgatatcttcaatttctgggccaaagccttggcgcatttccagttcccgtaaacgagagcggctttcaagatgtttggtaa

SEQ ID NO: 7129 - DNA, 567 bp, Bacillus clausii
atgaaaggaggactgtctatgtttggcttgtccgacttcctgcggcttttgatgtcggtgctgatcattttgccgctgacgacgattattcgtgaatcaggctactacctcgcagccattctccttggcgctaccaagaaaaaactagtgattggtaacggccctaaacttttttccgtgtctacgatcgaagtccgccgctattttttcatgtacagttggatggagtacgacgaactaaaaacaaacagccgtttttggcatggctttatgtatgcttcgccgattttgacatgtatcacagttggcttttcagtcaatgccttcattgctgctgaggttttgccaaacaatatgtttttccaaacatttttattctacattttctattttgtctttttcgatgtgattccagtttatttgcctgatgggcagccgaccaatgggcgcgccattttcgatttactctattatggcgaacgctctgattatttaaaggaacgcggtcagacaaacagacagcaaagcaacaggaaagaatcaaaagaagggaaagggacagggtaa

SEQ ID NO: 7130 - DNA, 245 bp, Bacillus clausii
atgagtattatttggaacttaattgtcggtggtttaattggttgggcggccggagccattacaggaagagacataccattcggcattatcggcaacattattgccggctttattggtgcaaatatcggagctgccatttttggtagttggggccctacgcttggcgactttgcgattttgccagcgttattaggcgctattattttagtggcgattgtcagtcttatccttcgcctcttcagaaa

SEQ ID NO: 7131 - DNA, 99 bp, Bacillus clausii
acgcaaaaatttgcttaggcgggagcttgcctggctaaagcgaggagctaaggcgagaacaacgaagcaaaaggcgcggattcaacgggtagaagcact

SEQ ID NO: 7132 - DNA, 177 bp, Bacillus clausii
aaatgaggcacaagaaattgaacaggccacagaggcactcgtgcgggaaatggtcagtcaaaatgcgttgcagccagagcaaattgcccaagtgattgtgaccgctacaaacgatattgatgctacatttccggcgaaggcggtccggcatttacaaggatggcaatacgttcctgt

SEQ ID NO: 7133 - DNA, 399 bp, Bacillus clausii
tgttgcacccatctagaatcggcttcatgtttcttggcatatttattggtatttttgtaggacttctcccaggtttaagcggaacggtaggcatgtccttgctgctgccctttgtgtttggcctcgacccatttgtcggcatggccttgctgattggcatggttgctgttgtccatacgggcgatacattcccgtctatcttgcttggcattcccggcacttcagggtcccaagcaacgatcatggacggttttcctttagccaaacaagggcaagcctcccgggctatgggagcctcattcttttgttccatggtaggtggcgtaattggcggccttgccctttatttaacgatcccgttcgcccgcccgcttatctctgcttttagttcgccagagt

SEQ ID NO: 7134 - DNA, 286 bp, Bacillus clausii
  misc_feature (1)...(286): n = A,T,C or G
gtgattgccattcattttgaagagcgcggcaactgctcgcgcctgtttgatgaattgaggggctatatggcaacctatgagccatatggttttggcggggcagtggaaaaaaacagtgaagcgacgatcaccgtccgttntgaaaacaaagacgtcgatttttatgagtcgttccatccttttttggcctcgatctttgcagaatatgtcatagaaacaaaggaagatgaatggttaatggacattgctgagaaccttttttattttaccgacgagagaggaaaag

SEQ ID NO: 7135 - DNA, 354 bp, Bacillus clausii
ttaaagcaattatgaccaacgaaaatggcgcagcgacgacagtcaatggctggcttcaggcagcgttgactggcctgcctgttattgacgctccttgcaacggccgagcacaccctaccggggcaatgggggcgctaaacttgtctgagcaacaagattatgtatcgtaccaggcagctgctggcgggtttggcagccgtgcgattagcggatttgtctccgggacgcttgactatgtcggaaatgtcattcgccgcatgtcggttgaggccggtggaatggtgggcgttgtccgcaatccagtcagtgtcgcttatataaaggcacatggggcagtcggcggcatttcaaaag

SEQ ID NO: 7136 - DNA, 126 bp, Bacillus clausii
ttcatacagaaacgattaaaccaagcattttatactacggaacgcctgtcgttttagtaacaacactgaatgaggacgaatccgtcaatattagtccgatctcgtcttcatgggcattaggagact

SEQ ID NO: 7137 - DNA, 435 bp, Bacillus clausii
  misc_feature (1)...(435): n = A,T,C or G
atgagtgctaaagttattgctattagtggggtaactgctggaggaaagactactttagttaatcagttagtaaaggaatttccgagcgcttgtgctatttactttgatcattatgaattggaaaatgctccagatgtgaaagaaattctaaacaaaccagctgattattttaatgcttatagattagttatgatgatgaacgacttgaaggaaatncaagataaatatgattatatttttctagattatccaatcggttatgaaaataaacaaatgggtatgttcatagataaagtcatttatataaaaacccccttggatatcacctttgcaaggtatctacttagagattttcctaattcttctggcaatgaccattttaaaatgggccaaatgttatttagaagaagcaagaccgatatttatttcacatga

SEQ ID NO: 7138 - DNA, 531 bp, Bacillus clausii
gatgagagaatatgaacgcatacgcgctgccattattcgcggcggcacaagcaaaggtgtctttattttgcaaaacgagctgccagaagaccctaaagtccgcgaccaagtcatcctatccatatacggccaggacgcacggcaaatcgatggccttggcggagcagacgccttaacaagcaagtttgcgatggtccgtccgtctcctttgtcagcagctgacattgagtatacatttggccaagtggggattggcactggtcatatcgattacaataccaattgcgggaacatccttagcggcgttggcccgtttgccgtcgacgaagggcttgtttgcgtgacagaaccctatacaaaagttcgtatccataacaccaatacagatcggatcatcatcgcccatgtgcccgtagaaaacggccgcgccaagcaagtggggaactttcatattgacggcgtccccggcggcggcgctaaaattatgcttgattttcaaaacgctgctggagcaaaaacaggtgcctgttt

SEQ ID NO: 7139 - DNA, 654 bp, Bacillus clausii
atgaaaaaaatagggcttgtcacaattggacagtcgccgcgcgtggacatgacccctgaaatgcgcccctttcttggcgctgacgtcgagtttgtagaagcaggcgctcttgattctttatcgcctgagcaaataaaagcgctcgctcccgatcctgatgagcagacgtatgtctcacgcctcaggaacggggacagtgctaaactttctaagcagaagttgcttccacacttgcaagcggaattgcaaaaggtcgagaagcacgtctcgagctcgatcattgtctgcaccggccacttcccaacgattgaacatgaaaagacgctgttgttccctgacaaaattctttgccattttgtccaagccgttatcggtgatggcacacttggggcgattgtgcctttagaagaacaaatacaacagctggccggcaaatggggcgatctccctcttgtttcagaagcggcgacgccttatgcgccgtcagatattgaaggagcggcggcagctttaaaagaacaaggtgctacgttgctcgtcctcgactgcatgggttatacaaatgcccataaacagcgggctcaagcggcgactgggctgcctgtgattcttgcccgcagtgcagtcgcccgggcagcggcagagctagcgtga

SEQ ID NO: 7140 - DNA, 237 bp, Bacillus clausii
ccaacctgccgttgcgacaaatgcgccagttgttggtctcgccattacagccacttctgctgtgcccggttgtggcacaggtgctagtcatgaggttgacattgcccaagcggtacggtttgcaatcgagacagcgaaggaatatacggcgggaactacgcgtttctacgataaaaatgaattcgcccatttgcaacatttgtatggatcaatgaacgttctgcaaacgatgggaaa

SEQ ID NO: 7141 - DNA, 105 bp, Bacillus clausii
gtttcctgatggaacagtaaaatcatttccaattgaaacgaacactgaagcgattgctgcttctattagcccaggattaaagaaaaaagcattggctggaaaact

SEQ ID NO: 7142 - DNA, 390 bp, Bacillus clausii
aaggaatatggaagaaatgttaattgattgtatcgagcttgccattgacgaatatttaatggaacaagattaccaggcaatggttgaaaatttgcgccattatatccgtatcacacctgcacggttgccaatgatctacctcgttcacaaggacatgtttacgttttatgatgaacatttccgggagttgactgctgaagaaatggcttattatttaaagcaagagcttgtatttgaaacaggtcttgatttttctgaaatggtcattagcccgctcgttagcatggcgccaggacatgtccatgtatttactgacgaaccagaccatggcgtcattttaacgattcaagcgatctttcaagaacggctgacgattttccctttgcaaga

SEQ ID NO: 7143 - DNA, 632 bp, Bacillus clausii
cagcgtgtgtattgctccaggatgatccagttgccgcatccacgtacaacggcccgctgtcttcctattggtttccagaggagcttgcccaatgggaaccagagaatgatccagacgcgctatttaacaaaagccatgttccgttggagccagtccgcgttgcagatggggtaaatggtaatgcagacaaggacgcacgccttgtttcgttatccgcgttaaacaggcatacatcaggtgttccgtcgcaaggagcgccggttttctatgaaaatacgttcagctattggcattatacagatttgatggtttattgggctggttcagctggcgaaggcattatcgttccgccaagtgccgatgtcattgacgcagcgcaccgaaacggggtgcccattttagggaatgtgttcttcccgccgacggtttatggagggcagctagagtggctagaacaaatgttagagcaagaggacgacggttctttccctcttgctgataaattgctggaagtcgcagactattacgggttcgacggctggtttattaaccaagaaacagaaggggcggaccaagcaacagccgaagccatgcaagcttttctcggttatttgcaggaacaaaagccagaa

SEQ ID NO: 7144 - DNA, 258 bp, Bacillus clausii
  misc_feature (1)...(258): n = A,T,C or G
attgcatgtttatcttgagaaaaagttgagcgatgcaaaagtgcaatttgaacgtacgattgattgcaaacacactgaattcgatgacctgnacccatatatgaccgaacagccccaatttttttggtataagcgctacgtcgcttggcaagagctccttactcttgttcaagtcgcaaaagacttcgactttaactggcataagctggtttcaaaaaagcaatccaggtatgtggaagcacaagtgcttgatgccga

SEQ ID NO: 7145 - DNA, 347 bp, Bacillus clausii
atgatttttttgtgggcctttttagttggcggtgtcatttgcgtcattggccaactgctgatggatgtcggcaagctgacgccagcccatacgatgtcgacgctcgtcgtatcaggggcgattttaagcgggtttggtttatatgaaccgttaattgattttgccggcgcaggcgtgactgtaccaataacaagtttcggaaattcccttgtccaaggggcgttaatggaagcaaaccgcgtcggcttgattgggattattaccggcatttttgaagtgacgagcgccggcatctctgctgcgatcatctttggatttttggcttccctttgctttaaaccaaaagg

SEQ ID NO: 7146 - DNA, 425 bp, Bacillus clausii
atgatcgcagcagagatgccggcgctcgtcacttcaaaaatgccggtaataatcccaatcaagccgacgcggtttgcttccattaacgccccttggacaagggaatttccgaaacttgttattggtacagtcacgcctgcgccggcaaaatcaattaacggttcatataaaccaaacccgcttaaaatcgcccctgatacgacgagcgtcgacatcgtatgggctggcgtcagcttgccgacatccatcagcagttggccaatgacgcaaatgacaccgccaactaaaaaggcccacaaaaaaatcatgacatccctccgttcgcttcaatcgacaccgcatgagcgatgcaagggatcgactctttttgctgataagacaaaggagaaagcaatgcgcctgttgccacaacgagcaacccgttt

SEQ ID NO: 7147 - DNA, 309 bp, Bacillus clausii
agcacaaccacttaggcgtcaaacgaaatgggcaaattgcaaacatttatgaggctttgcaagctcgccctgctgaggaagtcccagcaacaatggacgaattgatcaatcagccggaatcgctgccagctttagaagcttacatggaaactttagaacaaacagggccttacatgtatacaatcgagtcctgtacgtttggccctgccattccgaacccagagaaaatcatttgcatcggccttaactataggcgccatgcagatgaaacaggttccccttatccagaaacgccgattctctttagca

SEQ ID NO: 7148 - DNA, 104 bp, Bacillus clausii
atgagatggctaacggaagaatcgattgaacatattgccctaggagcggctgttctaggtactgggggagggggagatccatacctaggtaaattgatggcgct

SEQ ID NO: 7149 - DNA, 669 bp, Bacillus clausii
ttacgaaaaagccattctgctctacaataggaacgcagggcaaggagacgtcaacgaactgctgcaacaaacattggcaacactcgcccctgaagtaatagagctgacattgatccagacgcaagcgccaggcgaagcaaaacaacgatgcaaacagttgcctgaggacatcgaactattgatcattgttggcggcgacggcaccgtccatgaatgcgtcaacgggttgatggcaggaaacaaccaaccaactgtggcaattgtgccagctggcacgtgcaatgacttggctagaggcttgcaaattcctacagtagacgacgccctcacggcagctgtaaacggcacaactgttgcgattgacatcggccaacaaaacgacagctactttgccaacttttctggagtaggcatgattgtcgaggcttcaaaagaaatagaagcagaaacaaaagcacgttttggaaaacttgggtatattatcagcgcaattcgatcgatcaaagaaccaaaaccattttcgtacacgatcacaacagcaaaaggagaaacatatagcggcgatgccgttatgatcttagcgatgaacggccaatacattggcacaatcggcctattcttaaaagacatctccctatcagacggcaaacttcatctgtttatgtcaaa

SEQ ID NO: 7150 - DNA, 1149 bp, Bacillus clausii
aaaactttgatttgatttgtttggaaatgcggcatgcaaacaaacggatggcgctttttttagttgatggttttgccaaagatatcgcactgacacaaatccaacgggaactttcccatacgactgaagatgaattgcaagaccgatatgatgccttactgcaaagccggattccttatgcagaagttgaaaccgaaagagacttgaaccaagtcgtagagcaagtgttggccgggccagcggctttgctcgttgaaggccttgactattgcctgctgattgacacgagggagtatcctgttcgaagtccggaggagccagatacagagcaagttgttcgtggttcgagagacgggcttgtcgaaacgctcgttatgaacgcagctctgatccgcagaagagttcgtgaccggacgctgcgcgtcgtgttcaagcaagttgggcgacgttctaaaacagatatagccttaatgtacattggcgatattgctgataagcgttatgtcgagcaaatgaccgctgcccttgatgcaattgacaccgatggtgtacccatggcagataaatcaattgaagaatttatctttaaagaaagcagcaacccttatccacttgtgcgttattcagaacggccagacgtatgtgccacccatttatttgagggccatgtcctcgttcttgtcgatgggtcgccaagtgtcatgattacacctactactttctggcacttgcttcaacatgcagaggagtaccgtcaaaaaccaatcataggagcaatgctgaggctagtcagattcgctgctgttttttcgtcgatcttcttgctgccgttatggtatttattcgcaacaaatgcgtttttattgccagatagtttggcgtttatcggcacagaagaaaaggggagcttgccactgtttgcccaatttgtcatcgcagaagcagggattgaaatgttgcgaatggcgtcgattcatacaccgaatgcagtcgcagaagcgcttgggcttgtggcagccttattgattggcgatattgccatccaagtcggtgtcttttccccagaagtgatcctctacttagcgattgccgctgtcggtacgtttgcaacacctagttatgaactttcccttgccaaccgatttatgc

SEQ ID NO: 7151 - DNA, 317 bp, Bacillus clausii
atgggaagagatgtaaacgacctattagaaaaagcgatttatggaaatccagaaacaaaaccagcggaacgccgtttgtttttgacgacaattttggaaagggtctatcttgcattaacgaaaaagcaagtccaggctgctccagtttacagggaagtcgaacaaacgatggctaaggctaacaacctccatctgtttttaaatggcaacctggcttataacgattatgcggcttacattaaaatagccgtcagccagaacgttccatacacgattgtgaatccgtcaacgccgacaccctttgcccttggtttagc

SEQ ID NO: 7152 - DNA, 510 bp, Bacillus clausii
atggggtttgcatttatggtggccgcttttgtgtttgtgttgggggccgcaattggcgggatcgtcgccacgatgaaatttgtcccgcctattttagggctatccgtgtctagcattagctttttcttttttgcttatgtcggcatgtttctcgcgctggttggcccaaattggcttggcttgcggtttttggacattgtaatcgccatgtgctcgtttttgtttatcatcgccttgttccgttcatatcatcctacttgcggttatcgtcctggtgttagtccagtcggattcattgctgccattctgtttttgttgatgggcgtacaatggggaacggcagggttcggcacgttttttacattaggaatggcaattttgtttacaggaagcgtttttttaggcgtattgttgtataatacgatattgggttggctacgaaatgtttacattgcggcattcttgcctcttatctcatttctttttattgcagtactgaaactgatataa

SEQ ID NO: 7153 - DNA, 190 bp, Bacillus clausii
atgaaaacgcttttcgaagtcaagcagttgttaaagcaatatggcgctttcatttatacaagggatttggatgcagacatgcagttgatgcaaatggaaatggaggaacttcatcgacttggcctaatcgaacgtgtcgaattccaacaagcaatgcttgtattaaaacgtgaacagcgtgcggcaaaaa

SEQ ID NO: 7154 - DNA, 375 bp, Bacillus clausii
  misc_feature (1)...(375): n = A,T,C or G
cgttgatgcgcgaggaaaattggattcacagcatttgtgatgaacctcaagccngggcacgctcgattccaactgtgctcgagccaacagaccgccaaaagacattggttcgtatgcatggacgcaatgtccatggttggaatgggccgagcaaagggcaagaatggcgtgatgtccgctatttgtatgattacaacgaacgggagcttgctgaatggaaaacgcgccttcagtcgctgcgacaacaatgtgagcacatttatgtggtttttaacaacaattctggcggtcatgcggcacacaacgcccgcgcgttgattgagatgatgggcatcgaatatacggacctggcgccaagacaattggacttatttt

SEQ ID NO: 7155 - DNA, 420 bp, Bacillus clausii
cgccaaacatcgcgtgactagccattgtgaccatgaactcgggatttgcggcatttctcccgaggcaaatgaagcgctgcctgccaaaaaaccattggagatttacacctttattgatccgctgtgcgctcaatgctggtcgatggagccgattctaaagaagctcaaagtcgaatatggtcattatttccgaatacgggtcctgcttgctggaaagttgaatgtatggaatgcgtgcgaagcaggcaaagtcaaacatacacgcccaccggtatgggtgaaaggtgtatcatcctcaaatatgccttacgccggggatataaaacttagtgattttcatccatataaagcttcacttgcgataaaagcagcagaactacaaggaccaaaagcaggccaccgctttttgcgcaagcttcg

SEQ ID NO: 7156 - DNA, 283 bp, Bacillus clausii
  misc_feature (1)...(283): n = A,T,C or G
atggttaaagaaatcgagtatgaagcaaaatcaatgcttagtgaagctgcctatcgccagttaaccgaaaaattcagcacaaacgcagaaaaacagcaaaatgattactatgatacggctgactttgcattaaagagcgcaggggcagccctacnagtccgcanaaaaaaagacgcgtccgtctttacnttnaaagcgccagcaaatggtggactgttggagacacaccagcctctcaccaaangcgatgaacagttgctcctaagtggaacgcttcctgaag

SEQ ID NO: 7157 - DNA, 537 bp, Bacillus clausii
ttggattgagagaccttgtttacgcaaaactattagaagacgtaaaagggagtctccctgtatatggacctgtcaaaagtttagccccagccaaaacggcatccattaaccctaactcttcaagctcaacggaatatgctgatgatggtatcctggatgtctttgattcaaatggtgcttatactgtgtcatttacgacagctggtattgatgatgaagtacttgctgatctattgggagctaaatacgaagatggcgggacggaataccacaaggatcgccgatcaccttttgttgctgtgggatataaatctaaaaaagctgatggtacgtttgcgtatatgtggctattaaaaggcaagtttaacaacattaacagagagcacaatacacaagaggattcaatcactccacaaggaaatacgctagaaggtacatttattgaccgtgattcagacggacttttcaaacatgtgttaaatacagcaaaagcgcctgaagagacgattgaaaactacttcaaaaatgtttacggtg

SEQ ID NO: 7158 - DNA, 111 bp, Bacillus clausii
aaaagctacttagcattgaacatctaacgacttcttttcgaataaacgatcagtattacgcagccgttgacaatgtttcacttgatgtcaacaaaaatgaaattttagccg

SEQ ID NO: 7159 - DNA, 423 bp, Bacillus clausii
aacatatgttaaaactgttgttgcttgtggcaatcatcatcgccgtaccgtttgccttttttcagtacatcgggaaagaaccgatgcgtgaagaaaaaaaagcgtctggcaagatcgtgattgtcaatgaggacaaagggtaccaatatgaggagaatgaaccacttattttaggaaatgatattgtgccaacattgcaaggtgactcggaatacgaatgggtagtggctagcagggcctctgcccaagcaggactagccaatcaggaatatgatgcgatcgtttatattgactcctctttttccgagaacattatgtcttttcaagattcactgccgaaccgggccagtgtacaatatgaaatttataataacttaaatgcagaaaaccaagagcgggtgcaaaaagagctagagagtgcgc

SEQ ID NO: 7160 - DNA, 600 bp, Bacillus clausii
gtatgtggagaaactggaagcgcaagtgattgatccagtcatcgaggaagttcacaagcaagaacaagccgttttcaaccgtataggcgcatctccgtccgttattaacagtccgattcagtcgacaaatgtacgggaactgcttacctattacggcgagctggccaaattggattgggcatacagccagcaaggctacttgaatcaagaccggattaagcaaattgtcgatgaagacaaccgtgtccgcgaggttcaggaaaaaattgacgaggcgcggcaatcagtcgattcgtttatgggcaagcgaacgcaattggaagaagcccaacaatcggttgaggaagcagaagcagaatttaatcaatttatcaccgatgcaaacaacgtgctgaacgagttagaacaagcaattgctgaagaacaacaagcgattcgcgaagaagtggcggcgattgcagaaacgggcaacgctattggagcgaacttatctgaaagctatggagcgattgaaacagaaccagcgcctgtcgaagggttaaatgggcaaatggtcgtgaccaatcaacaaatgtcattaggcgaagtccaacaattagg

SEQ ID NO: 7161 - DNA, 315 bp, Bacillus clausii
  misc_feature (1)...(315): n = A,T,C or G
gggctgaacttgaaaaatataaaagtaagcaagttaattttggtcaacatatttcttttaatgctgtcattgctggtttncctattgagaaccccaaagtccctaaagctttaagttttcatgttgcaaatcaaaacatttctgaacgctactatgaaaaatcggcaattctttctttgattcccgatgatattccttttaaccccaatcaaattattactgataatctgaataaatctttgaatatcactcccacttttcaagttcaaacccttcaacgtaatgcactctataaagttgctgaccaatccaaaa

SEQ ID NO: 7162 - DNA, 360 bp, Bacillus clausii
atgtatcaacttgaacttctgcaaccgttctccgattttgtcaatgtgagcgaatatgacgacttgtacgtgataagcgttgctgctggcggcgagacattgagagaaatggcagcgaacatggatatgcttgaacgggcgctaccgacagaaagcaagctggaaatcccagaccaataccaattatcgcaattagattatatgctgtttattgacaaaaacagcttcttgcttgaaaaaacaaacaccgtttttgaagtgatccttgaagacaacgacaccgttattcgcacggacatgtcactcacaaggacttcagtcaatgatagcgggcacattgatatcccttcgattccataa

SEQ ID NO: 7163 - DNA, 258 bp, Bacillus clausii
tggaatcaagcgcttcagtctaaaccagattacgactgaacaatggacgttgccagaagcaattgaaggctgcgcccgccacggtgtgggctggctggctgtttggcgccataaactgcatgagtacggcttaaaggaagcgaaagagcatattcgtgatgccggcctttccctttccagcttatgccgcggtggcatgtttcctgctgctagccaacaagagcggctccagcggattgaagacaatcggcgtgccat

SEQ ID NO: 7164 - DNA, 174 bp, Bacillus clausii
tcgatgacttgctggcaaagggacaaaaggcgcaggaaaatatggaaaacatgattcaagagcggacgaaacaattcttatcgtctatggatgtgccgacaaaggaagaggtcgacgcccttaaagcccgtgtcgctgccctcgaaaaagcccttagcgagaaggacgcagaaa

SEQ ID NO: 7165 - DNA, 180 bp, Bacillus clausii
ctatttttgaggcgttgattctcgaacttgtcattgagttgctaagagaggctggagcacgattgccgactaaaattggccaaacgcttgggatcgttggcggtattgtgatcggaactgctgccgtcgaagcaggccttacaagcaatatactcttaatcattgttgctttgactgcgc

SEQ ID NO: 7166 - DNA, 330 bp, Bacillus clausii
ttgcttcctttacgacacctatttaccaaatgggcaatacaatccggttgattcgttttccttttattcttgctgcccagtggcttggctttttaggagtagcggcttgtttcgccctcattctaagccatttacttgttttaacttcgcttggacaaccttatttagcaccaatttatccgttgagagtaactgatttgaaagactccttttttaggttgccgtttaacaaacagaaaaagcgccccgtaagcgtacgagctaagaaacgcaagcgctttagctccagccacgacggcaaccatttaaaaaagcgcgacatcgaggagt

SEQ ID NO: 7167 - DNA, 465 bp, Bacillus clausii
gtgaaagtcggctactttcgccgtttttcagcttttttatcgttgtcggcgctcaaatcggcgttggcgtccttggttttgagcgaattatcgctacgttttcaggccaggacgcttggttatctgtggtgctggcagggatgacagtccatgtactcgtgtggcttctatacggcatattgaagcgaggggaaggagaccttgtcgcgatccacaaagccgtgcttggaaaagcagttggtggtttgctgaacctttattttatcggctattttgccttgcttgcttacacggtcattcgtacgtatatcgagattattcaaatgtggatgtttgtcgaagtgtatgtatgggtattgtttttgctgctcgtctgtcttgcctattcttatgtaacaaatgggctgcgtgtcgttgtcggtctttgtgtgattggcctctttgtttcagccccattgcttttgg

SEQ ID NO: 7168 - DNA, 147 bp, Bacillus clausii
agccctcaatgacataaaaatgattcaatttgccggtatcggcatagcgatgggaaatgcccaaaaagcagtgcagcaagtagccgacgctattaccgatacaaataataatgatggagttggaaaagcaattgagaaatttattct

SEQ ID NO: 7169 - DNA, 234 bp, Bacillus clausii
acctagaaataaaagggtacggccagccgcatgaacgggtcattgatgcgattttgccgctcattcgcgataaccggtttaaagagcgtctagttgtttcttcatttgaccatatgttgctagcaaagttgcaagcccatttacctttcattgaaacggcagcacttgtaaaagggcctttatttaaagcaaccagctatctgaaccagttaggggcaaaagggctcccattta

SEQ ID NO: 7170 - DNA, 729 bp, Bacillus clausii
  misc_feature (1)...(729): n = A,T,C or G
aaggccaaaaacaagagagagggccgcttccttttcgctatgtgctgctcatttcgtccgtgctattcacgcttttgtccttgcaagggctttggtttgtcgaccaacagctgcgcccnattatttcgcaaattgcccatcgggaaatggagcggattgcgacgtatacgattcagcnagcgttgacngaagagntaggccaaactgacatgaacgatatgctcattactgaaacgaacggagacggtcagattacgtatgtcacattggacactcaaaaatacaacaagctcctcggcaatgtccagctccgtgtccatgaggcgatanatgcaatccaacgcaatgaagacaatacatacggcgcaagcgaaggcacagtggcgacgatccctttaggaagagcgctcaacaactcgttattaaacgatgtcgggccaggcattcccttacggtttgcattaattggcgatgcaaaagtaggcatgaaggacgaaagcgagcagctgggcattaacaatacaaggctgtctttttatgtcacgatcgaagtgggcatggatgtgattttgcccttttctgagacggcagatacagtatcggttgagttgccggcaggtttcgcctttatttctggggaagtgccgcagttttatggaggccaactgccaatcgtcaattatccagctcttgaggcgaatacagaacagcagcctgaggaagaaaatg

SEQ ID NO: 7171 - DNA, 333 bp, Bacillus clausii
  misc_feature (1)...(333): n = A,T,C or G
agacggtcagattacgtatgtcacattggacactcaaaaatacaacaagctcctcggcaatgtccagctccgtgtccatgaggcgatanatgcaatccaacgcaatgaagacaatacatacggcgcaagcgaaggcacagtggcgacgatccctttaggaagagcgctcaacaactcgttattaaacgatgtcgggccaggcattcccttacggtttgcattaattggcgatgcaaaagtaggcatgaaggacgaaagcgagcagctgggcattaacaatacaaggctgtctttttatgtcacgatcgaagtgggcatggatgtgattttgcc

SEQ ID NO: 7172 - DNA, 114 bp, Bacillus clausii
atctagtgatcaaaaatgaacaggctgtcatttcaccgccatggtcaattcattcaggcgtcggcacaagcaattacacatttatttgggcgatggctggcgaaaattacacgg

SEQ ID NO: 7173 - DNA, 252 bp, Bacillus clausii
tgaaccgccttgtaaaggctgtatggcaagtgtgcggttaacggcaagtgaattggagcggcttattgaagaatatggcgagcaggaaaacgagcctctggccacaacagcggagtatttccggcgcctcacccaatgcggccaatgttcagcgttagtgtacgaaacaacgtgccgacatagcgggatgttgatccagtacgctgccagctttcaaaacaaaggttgtccccacccagacggcgggaaatg

SEQ ID NO: 7174 - DNA, 442 bp, Bacillus clausii
ttgagtaaaaatgtttctcgtaccgtagaacaactcgcagagccgattgtccgcgaacttcatttggaactcgtggaagtagaatataaaaaagaagggcctaattggtatttgcgtgtgtttattgacgcagacaaaggggtcaacttagatgattgcgaagctgtgagtgaaaagctgagcgaagtcttagatgatgtggacccgattaaagaggcgtattttctagaagtgtcatcccctggggcagagcggccgctaaaaaaagaagcggatgtaaaaaaagcagtcggcaaaggtgtgtacgtgacaacgtatgaaccaatcgacggccaaaaagcgtttgaaggcgtccttgtatcatttgaagacgccacgcttgttattgaaggaaaaaacaaaacaagaacagtgacctacaccgtgccatacgcgaaagttg

SEQ ID NO: 7175 - DNA, 141 bp, Bacillus clausii
tatcgatcatgagatttttctgcaattcggcgaagcgctgccagtgtacaaaccgacgttgccgccgatagtattcgggcctcgcgacaggcaggtggatggcagcgacgaaacgctcgtgctgcgttatttaacaccaca

SEQ ID NO: 7176 - DNA, 67 bp, Bacillus clausii
atgagacaaatcattgccctcggagggggagggttctcgatggaacctgacaaccctttattggacc

SEQ ID NO: 7177 - DNA, 347 bp, Bacillus clausii
  misc_feature (1)...(347): n = A,T,C or G
atggtcgctgaagcaaaaaaacagggcatccccgttataaagcnccagcaactttcagaagagctagcgaatcttcgtgaaaggcaattcatccccgagtctctctatgaagtagccgccgaactatttgtttttctccattccctcgattctgttcatgattttccaggatcagcccatactaaagcagagaaagggggaaaagagatggatgaaaaacgcaaaatcggcgaagaggaattttccgatgaatttggccaaaatcgccccgcgcttgaaaaggacgtgatcgcaaaggggctgaaagcactgttttcaaaaaaaaacaaaccacgccaaaaaagcgc

SEQ ID NO: 7178 - DNA, 524 bp, Bacillus clausii
atgaatttatggaatattggttgggaaacacaaaccgatcaagcttatcgttgggatggcacgaaacggatggaacgagaaaaaattgtgtttcaatatacgctttcaggctacggggaattggtccacgaaggaacattttataaagtggaagcgggccaagcttttttcgtttcgttgccaagtgcccattgttattactatccagaagatgagacagagccgtgggaatttctttatgtcacgatcgaaggaaaagaagcgttgcgaatgcaaaagcatatggagaacaagtacgggcctgtgttttccttgcaaaaagacagcgaaccaatccgccgtttgtttaaattgtatgccgaaacggcagctggagaaatccaagactcctatacaggctcgcaaaaagcgtatgaatttatgctgtcgtgtttccgctttctagaagttcctccgaaacaagtagtaaaagaaccccttgcaagagcgattcgttatattgaagcgaactatgcaagaccgct

SEQ ID NO: 7179 - DNA, 159 bp, Bacillus clausii
tcaaggtcgcaggaggaatgccaaccgcattattaaagacatgggagcgcgtgtatacagagtggttccctacctcgggttatgaattaactaaagctcctgaatttgttaaaggaaacgatacaaagacagaaatttgggttcctgttagaaaaaaga

SEQ ID NO: 7180 - DNA, 740 bp, Bacillus clausii
atgcagcgttattttattaaaaatgaacagttgacaaatgaagttgtcgaaataactggagacgacgccgcacacattacaaaagtgatgcgaatgcaagcaggtgatgaagtcatttgcgtcaatgaagacggcaaagccgtgcttgttcagctttcgcaattcgatccatctagcgtcaaaggcactgtcctcaacgaagtggacaacgagacagaattgccgatccgggtgacggtcgcgcaaggcctgccgaaaggcgataagcttgaaaccatcgtccaaaaaggaacagaacttggcgcgtactcattcgcgcctttttctgcgagtcgatctatagtaaaatgggatgaaaagaagggcacaaagaaaacggagcgtttgcaaaagattgctaaggaagccgcagaacaagcacatggtcttttcgtgccaaccgtggccaagcctgtgccgttaaaaacggttgccgaggctcttactcattatgatgtctgcattgtttgtgatgaagaagaagcgaagcaaggtgaaaaggcaaatttaaagcgcgcctttgctatgctcaaaccaggcatgtcccttttggtcattgtcggtcctgaaggagggctgactcgtgaggaagtggcgcttttgtcggccaagggcgcggtctcttgcagcataggccctcgcattgtccgtaccgaaacggctgctatgtacgtgttagccgctctttcgtaccaatttga

SEQ ID NO: 7181 - DNA, 231 bp, Bacillus clausii
cttgagcgaattgatgaacaagctataccggaatagcatggaggctatgatcttcatcgatgaagagggcaacgtgattgatatgaatcccgcggcggagcagattattgacccgcaagtcattaggcgaattcgcgccggaactgacgaatcgttctgtcaaacttgcaaaggctacacggatgagcaagaactgatctcttgtgccaattgctacctcgattatcccca

SEQ ID NO: 7182 - DNA, 177 bp, Bacillus clausii
ctttctccttggcggcggaaacgaggaagctgacgtcttgtttgtcggggaagcgccagggcgtgatgaattacaaacgcacaagccttttactggcagagcaggggcgaatttgaatggttttttaaaagaagcgggcttgaatcgtgaggacatttatattacgagcgttgtgag

SEQ ID NO: 7183 - DNA, 482 bp, Bacillus clausii
atgctagcaggcaaacagagttggatttttgacagcaaaccggtcataacggcaacaggaacagtgggcggaccgtttgaagcaaatggcgccattccagaagcgtttgatttattgcatgacgatttatggattggcgaagattcctatgaaaaagcgcagactattctgattgaaggcgcggtaacagaaacgttgaaaaaagcgtccttaaaaaaagaagacgtcaactttatgcttgctggcgatttggttaatcagcttacgccttccagttttgccggccgtacaattggcattccgtacttaggcatgtttggtgcttgttcaacatcgatggaagggctggcaatcggcgcgatgattatggaagcgaacggagctaggcatgtgattagcgtcgcttcaagccataatacagtgactgaaaagcaattccgctacccgactgagtatgggagtcagaagccgccaaccgcgca

SEQ ID NO: 7184 - DNA, 261 bp, Bacillus clausii
cgtattgatttttttggcgacgttaatgacaggtcttggcttttatgatcggattgcgcaaatcgcaggggctgggacggcagtgccagttactggttttgcgaactcgattgcatcggctgcgattgagcaccggacggaagggtatgtgcttggcgtcggtggcaatatgttcaaattggccggttcggttattgtttttggcactgttgccgccttctttattgcgctcatcaaaacgattttaatgaaagcgggggt

SEQ ID NO: 7185 - DNA, 765 bp, Bacillus clausii
cttatgttgggattgggatagcggcactccttttatacaagctggacaaactgaccgcttctggcatgtgggccgcgtgtgttgttgggtggctgacaatagcgggcgtcggtgtaggggggttagtggtgattgccgttttctttggcagctcaattgtatggggtcgtctagactcttcaaaagtggatgtcgatgtggttgccaaacacggcgctcgtgatgcctggcaagtattggcaaatggtggtgttgcgggtctttgctcgttgttggcttggttgtttcctggctatgctgcctttgcctttgctggatttattggcagtttagctggcgccactgccgatacttgggcatcagagcttggaaaatatagcagagagaaaccgatccatctattgactttgaagcgcgtttctcccggcgtatcaggagctgtatctgcgcttggtatggcagccgcttttgcaggcagttttcttgtcgcagcaacggccattttattatggtggagatatacgccattgagccatatttggttactagtctattcagcaatcggctttctcgccaatttagctgattctctttttggtgctgccattcaagtgttgtaccgttgccctgtttgcgggttagagacagaaagaccaaaccactgtggagagaaaacagaaaagataaaagggtaccgtttagcaacaaacgacaccatcaattttatttgcacgtttacaggagcggtgcttggcgttttagcag

SEQ ID NO: 7186 - DNA, 126 bp, Bacillus clausii
aacgttattcaagacagctattgttttctggaattggtgaggaagggcaacaacggctattaaacagccatgtgctaattggtggcgtgggccgccttaaggaaccggtccttgctaaccattatg

SEQ ID NO: 7187 - DNA, 183 bp, Bacillus clausii
tgacttattggccgccaactctaaaagcgaagcggtacaacaggcgaagcagaaggtggaacaagcgagcaccattgttgtgtttactccgatttataaagcgtcatttagtgggattttaaaaacgttccttgatttgttgcctcaaaaagtattttccgaaaaaatcgttttgccgatagc

SEQ ID NO: 7188 - DNA, 608 bp, Bacillus clausii
tatcaaataggggcgacgttgtcgatttttaatgccgcacatgtcccgtttttatttattccgtatttgattttattacttattgtaggagccattcacacgagaatttggcacaaaagcaccacgaatgagctaacacctattgctccgcttccttatttgcaggggatgaactggaaagggttttggtggaaggtatccagtgtcgtgaaacagtttttgctccaagctatgccgatttttttggcgatctgtcttgtggcatctatatttgaaacaatagggatgttatcgatttttagctggcttgctctgcctttgttaactctattttccttgcctgtagaagcagcgcctggcttgatcttttcttttattagaaaggatggcttgcttgtgttgaatgaggggcaagggagcttattaatggagatgtcaatcggccaggtgtttattcttgtatatttggcttccactttatctgcttgtcttgtgacgttatggacaatcagcaaagagacaagttggaaaacggccttttcgattggatggaaacaaatgctgacaagcgttgttagtgcagctattgttgcggtggggctatctat

SEQ ID NO: 7189 - DNA, 255 bp, Bacillus clausii
atgcagcagctcattaaccaaaaaatcaattcgattactgaaccagaatttattcaattagcccacaaacatggctatcaagtaacgtcagcacaaacaaaagcaattttcaaaattataaaggcacaacggatcgacatcgggaatcgagcacaagtcgaccaaattttagagaggctgcgaacggaaacagacccgtatattgccgctgttgtcgacgaattgtttgagcaatttcaacattttttggattaa

SEQ ID NO: 7190 - DNA, 246 bp, Bacillus clausii
gacttttccgaaacactttctctggggaggggcggttgccgctaaccaatccgaaggagctttcgccgttggcggcaaaggatttagcctagcggacacccaccgctatcgttccaatcaggatattacaaaagtaagccatgattcggacaggacgcttgcacaaataaaagaagcaattgaagacaaagtcggttattacccaaaaaggcatgggattgacttttaccacacgtataaagaaga

SEQ ID NO: 7191 - DNA, 540 bp, Bacillus clausii
atggcgcgtttgttgttaacgaggaaatattgggtcggtattgtattgttgctgttgcttgccacttcagtgctcctgattccttttcgtaccgctctcgttttttatgaagaaaacaggacctccatttccgcctatcttccccttaaacctggggatacgtttgagattatttatacacactctattcatcgatcagatgtaagtgaaaaatatgttattttagataaccttactatccagcaatacgaatttgtttttgaagagtttggcatcggcatgccttccaacgcaaacggcaaagaacaattcgtcatggaagacggaaagtattacatacgaaatatggaaaacatctttccatcctttgcactacgaactggaacagtcgtaccagaacaccggctagtgtggggacagcatgctgaacatatagcttggttcgctgattactttgatccaggcgcttggtttactgtcagaatggaacgcctcaatttatggcagcggctgaaaggagaagaaataaatgacaaataa

SEQ ID NO: 7192 - DNA, 219 bp, Bacillus clausii
attattttgttcgaacgactccgttgaaggaccctttcaacttgtttgcgctttgctgcaatactttaggcaatcagcgcagtacagtgaaaatatccatgcttggcttgtccgtaaaggcgcggtccatgttcgcgaagtcgtgtttgacgctgcttgccaggcaaaattaaataaacagctagcggaaataacggcagttagccatgagcatgcgga

SEQ ID NO: 7193 - DNA, 173 bp, Bacillus clausii
ttgaaggttttatcgttgaaggccctgagtatttaacggtgtttgcaggcgagacaggacaggaattacaaacaattcattataaaccagggcgagaagacgatggccttatgtggggcgactatgcgatgaaccggattgagccaggcaatcgtgtcgatcgctttttagca

SEQ ID NO: 7194 - DNA, 404 bp, Bacillus clausii
atggagggtgaaaaaatgataaagatagagaatttagacttagtgactagagaaaaacttctttataatggcaatgctgagctgaaaagaggttttatttatgggttatcagcacgaaatggttctggaaaaacgacattgttgcggacaatagcaggaatccgcagcgaaacaaaaggatcgatttattacatttctaatcatgaaatctattctttgccagaattaaaacggaaactgttttactatgaaagttcagaatggtttgatcctaacttgacaggctttgattatttaacattcattcaaagagaatggtctaataaaaatgcatgtatagatgatgtggtagattattgggaaatgaatcaatatattaaaatccctatcaaaacgtattcgct

SEQ ID NO: 7195 - DNA, 696 bp, Bacillus clausii
  misc_feature (1)...(696): n = A,T,C or G
atgcggattgtaacaggcgaggaaatggcgagcattgatgcaattacaatgaacaaagtgggtctccctggcgctgtcctaatggaaaatgccggacgcggaattgctcgtaagctgttggacctctatggacgtaagcgccgcttttttattgtcattggcagcggaaacaatggcggcgatgggtttgttgtcgcgagagtgctaaaagacgaaggcgcggaagtacaagtattcattgtgccggaagaaagccggtacaaaggagatgccaaactacataaacgtgtattcgagcaaagtggctaccgttggaagtattggaaagacattgagagccaattgccagccatgctttacgaaacggacattattgtggatgcgctcctcggtacaggcgtaagtggccaagtgaaggaaccgtatgcttccgtgatcggcagcttaaacaaattgaaaaatgaaatcgtatcggttgatttgccaagcggcgttccagccggcagcgccgagctgaaccatgaagcaataaaagcagaccgtacccttactttacaatggacaaaggtaagctattatttagaagaaaccaaaccctatttcggagaagtagacgtcgtcccggtcggcattccacctaacacgttacgtcatcttgncttacaacgcttcatttggggcaaaaaattaaagtag

SEQ ID NO: 7196 - DNA, 390 bp, Bacillus clausii
ggaatatggaagaaatgttaattgattgtatcgagcttgccattgacgaatatttaatggaacaagattaccaggcaatggttgaaaatttgcgccattatatccgtatcacacctgcacggttgccaatgatctacctcgttcacaaggacatgtttacgttttatgatgaacatttccgggagttgactgctgaagaaatggcttattatttaaagcaagagcttgtatttgaaacaggtcttgatttttctgaaatggtcattagcccgctcgttagcatggcgccaggacatgtccatgtatttactgacgaaccagaccatggcgtcattttaacgattcaagcgatctttcaagaacggctgacgattttccctttgcaagaac

SEQ ID NO: 7197 - DNA, 316 bp, Bacillus clausii
  misc_feature (1)...(316): n = A,T,C or G
atgattgctagtggacttaattatttggctaaaatgaataaagcggcaggccaatttacatatgggtatttttcttgttttgataaagaaattcatttttataatttgttnagacatgccagnacnctttatgcnatgatcgaagcgctagaaatcactcaggataaagaagccattccggcaattgaaagaggccttgattatttgctaaaggggctacatgttgataagaagcaagggactgcctatgttgtcgacggtgttgaacaagatcagttggaagttaaattaggagcgaatgcagccgccattcttg

SEQ ID NO: 7198 - DNA, 408 bp, Bacillus clausii
catcgtcgcagacattactcctccgggtagcccttgctgcatttgccggcctctgggaatatcagggggagagccaattcgaacaggcgtcaacgccacaaaattggccattgccgcctttattatcccgtacatgtttgtattgcagccgcaattgctaatgattgactcgactcctttccaagtcgcggttgccttcatttccgcccttctaggcatgatcgccattggcgcttgcatgatcggtttttggtataaaaaactgaactggcttgaacgacttctatcgttagcagctgggctcttgcttatttatccagaagggtacagcgatgcaatcggcttgcttttatttgtcgctttaattggttaccaactcatcggcatgaaaaacaacaacaaaacaca

SEQ ID NO: 7199 - DNA, 243 bp, Bacillus clausii
tgaagaaaattccagaaggcaaagacgccgttacgattttattgacagaggaaacaaccaatcgcatccatgttgcaacacttgtcgatgctgcccaaaaaatcggtcgtgatgttagcatcggctcacaaggaagccaaatcaaactggttattaagacaaagcaactatctgatgaaacattgcttgcgtacatcattgaattactggaagcattgatccgtgctgacaagtcaaagaaag

SEQ ID NO: 7200 - DNA, 165 bp, Bacillus clausii
ggaacagccgctgttgttggttgctgcgtatgtaggtgtaattccgttaattttaagtctgacttttcctgtttatcgctataaaaaattgcagccgagggaacgccaaaaagccgctgttttcattgctttgccggggatgttgttcgatgtcgtcgtgttgtt

SEQ ID NO: 7201 - DNA, 344 bp, Bacillus clausii
gtgctcgtcctaatctttcggctactgatagtagctaccattgttgtcatttcctatagtttaataaaatatacattgcagcctgaacgaaagctaaaaaaagcccagaacgcgcatcagttttattttttggacgatagcacgaatgtgcgcaaaaatttccaactaacgtttaaaggaattatgtttgaaggagaaaagtatttagaagcgacaaaggaatcatttgaagtcattcgcgtttatataaaagcagatacagatagactccgcggcttaactttttctgacttccattttattgaagaagaagtcctcttacgttatccagaggcgacaattga

SEQ ID NO: 7202 - DNA, 420 bp, Bacillus clausii
atgcgccgtgaggaaatcggcgtctatagcgaggaagcaccattgctcgctgaattaactgtacaagaaaacatcgcctttttagctgcgttgcaacaaaaaaagcgcaccaaagcgtggcttaaagaagttgctggccattttggcgtttctccgttattggcacttcctaccaaagaactagggcattatgattgtcaggcagttcgccttgcccgggcggctgctgctgagccagctgtctttttagtagatggcccaattgacctggagttgttccaaaaacttcagcaatgggcgagaaaacgtcagcaaacgattttatttgcgacgagttcgtatgaagagccactgtgggctcctcatatcgtcgagctggataatggcgctattcgtgaatggggaggcagcaaatgctaa

SEQ ID NO: 7203 - DNA, 678 bp, Bacillus clausii
atggtagaattacagaaaatactgagtttgaagtcgcttggcttcagcctatctcaaataggtgaactgctgaaacttcccaaataccatcaatctctggttgagatgttgagattgcaacagcaggcattggaagtaaagcttgttaagataaaacaatctcttgacctggtaggccgcatgattgcaatcgttcagaatgagggtcaattggagcacccgctattgttcagtctgattcgcaatatgactcaggaagacatgcaacgggagtgggtggcgaaccatctatccgagtatacagcagaaacgctgtttgatcgatcagcgaaggcgataaacaaaatggatgcggaaacggtgcgcttctctcgtgatgtcaaacgattatcgaaaggtccgagcgattcgcaggaagccgagaccgtgatcggtacatacgtgaactgggcgatgacttacattgatgagaaggcaatcgacaatttcaaaaaattggatgaagagcagtacaccaaacttgatcagttagtggagatgccattcaatgaaagggagacggcttggctggataaggcattggcacattatttttctaaatatatgttgactgaacaaggcgagctaatggtaaaagtggcgaatgctcataaggcggttattaccacggaatcataa

SEQ ID NO: 7204 - DNA, 132 bp, Bacillus clausii
  misc_feature (1)...(132): n = A,T,C or G
gcgatttttgccagaacgatacaagccagggntattatgcgtcggccagttattcctgccactcgatgaacgggttgtttccccatgtcaaccctgctgaactatttgtctttcttggcgttgctgcggggn

SEQ ID NO: 7205 - DNA, 369 bp, Bacillus clausii
atgatcgtcgccacgtttgggaaaaactgtgaagcggttatccatgatttgacgaacgttcaatcttctttgttttatatcaaaggcacagtgacaggaagaaaacatggcgctccgacaactgaagtggtgttaagagaactaagaaagtatggcgatgaggtgccagataaactaggttttacgagccgaacgaaagattttagaacgttaaggtcgtcaatttcgtttattcgcaacgaaacgggcaaagtcatcggcttttttggaattaactatgacatcaccgccttttccaacgtttgtgaggttcttagtgagttttcagcggctcaatatttagggcagccgagccctgttgaccgatga

SEQ ID NO: 7206 - DNA, 334 bp, Bacillus clausii
atgttcacatttttgcaagagcaaattgacaaagaacgccttcctggggccgtcattagcgtgattcaccgaaaccgcctgcttttccggggtgcgatcggttatcgccagttatggccagaaaggcagccgatgagcgtcaataccgtttttgatttagcttctttaacgaaagttgtttgcacgttgccgctcattttacagttatggcaaagtaagcgactctcccttcatatgcccgtagcagaggtgcttcctcctttcggcgctaatgggaaggaaaatgtaacgcttttccagttgctgacccattcagcagggcttcctgccagcg

SEQ ID NO: 7207 - DNA, 411 bp, Bacillus clausii
tgttcacggccaaacgtacgaaatggtcagccgtgatcctgaccaagtcaatcaatggggattgtacgacgcaacgaccattgatgtcgaagaccacgccactgtgtatattaaatttaaaaacggcgcgacgatgttatttgaaacgtcatgggctgccaatgttcctgaagacaaagaaacattaagcatctctggcacgcaaggtggcgtaaacgtgtttccttatgctgtcaaccatgcttctcaaggaatgatgacgactactgtggcggactggatttccggagaaagtgacgaagggctagcacaagcacggcattttgtcgctgcctgcacgagtggaacagaactgatcgtgaaaccgaatgaagcccgtctcgtttcaagcatcatcgaacaaatttataa

SEQ ID NO: 7208 - DNA, 144 bp, Bacillus clausii
tggtcaagcaaagcggcggttgtgaaatcttagcagaatcggaaaaatcggcggcgatttttggaatgcctaaggcggcgattgcgagcaatcaagtcgacgttgtcatggacaaggatgagatcgggcgctatttagctaaaa

SEQ ID NO: 7209 - DNA, 1317 bp, Bacillus clausii
atgaagcttagaaagacattatcgagaaggggattggcttgtgagcaattggaagcagcgcttattcgaaggccatcctaccatccttgttttaaagcacggaaaggattttcatttgacgaccattatcgttatgggccagaagcaaaacaatcatttcagcttgtctggcttggcgtccgcaaacaagatgcgattgtccattatcctcaggaagcaggttgctttttgcagcaggaattaggcacttctgtctggcaagcgctcgtaaaagcattagctgaagcgggcggccaacttagtgaatacgagtttgtccctgttcatccgtggcaatggcaagcgcttaatgaacatttgcttcaacaagcgatcaaaaggagggacgtgttgtacttaggccaatttggcgatacatattgtgcgactcaatctctaagaaccgtcatgaatgtcaagcatggaacgaaagcacaattaaaattgccgctaaatgtcgtcaatacctcttcagttcgcacaatcccgcctcatttgattgctgcggctccagccatttctgtgtggctacaacgcatcattgacagtgacccgtttttaaaagacgaaatcggcgttgagcgcctagcggagtatgcaggggtggcatacgaacctaaaggcaaacaatggaacaaagcgatcctcggccagatcgggggtatttggcgcgaaagcgtgtcctccaaactgaggccaggggagcaggcgattccaatgaacgccttaccattgctagaagaagacggcgcgttgtttatcgccccttttttagagcggtttgggatagaggcgtggcttatgcagttgttcagaataagcgtaatccctgtcatccatttcctagctgaacatggaatcgccctcgaagcacatgggcaaaacgtcatccttgtgactgaaaaggggtggccaaaacgcgtgattttgcgcgactttcatgaaagtatcgaatacaaagagagttttgtaaaaaatcgtgcttggattccgcaattttccacattgcatcaagcatttcaatcaggcaaaaccgacgagttttattggatgtcttcccttgaagcactaagggaactagtgatggatacagtttttgtttatcagctcacagaactatcgtggcaactggaacaacatttccacttcagcgagaagcaattttgggcattggtcgactgcgtcatccgtgattacgctgctagggaactcgtaccgccagagcgtttgcaagctttacgggtagctgctctgttatcgctacagagtcactgctaa

SEQ ID NO: 7210 - DNA, 218 bp, Bacillus clausii
  misc_feature (1)...(218): n = A,T,C or G
atgtcaatggcttatgaagaatatatgcgccaagttgtgctgccaatgcgccaagaactgactgatgcaggatttaaggaattgactaccgccgaagcagtggaagactatatggctgacgctgaangtacgacgcttgtttttatcaactccgtttgcggttgcgctgctggtctatcacgacctgctgcgatttactctttgcnacgtgaccatac

SEQ ID NO: 7211 - DNA, 237 bp, Bacillus clausii
ggtctatgtccattcacctttttgcggtgcttgcataaaggcagaacggatgctgtcggtcatcgaggaaagcaaagaaacgttttcgttttggcaagtcaacatccaacttgcgccggagtgggcgaggagcgcacaaattgaaagtgtgcctgcgttgctttattataaaaaggggcgcttgcaagcgaaagtataccgacttttctccgtgatggagatcctatcgaacatgaa

SEQ ID NO: 7212 - DNA, 141 bp, Bacillus clausii
ccagcacccttccaaaaaggagtggggaatgcctgaagacattgcgaacgcatgcctatttttagcggatgagcgcaatcggtttataaatggcgaaacgcttgttatcgacggtggtatgacgagaaaaatgatgtatga

SEQ ID NO: 7213 - DNA, 324 bp, Bacillus clausii
agaagcattatcaaaattacatttatcccttatacacggagatttcgggtcatccaacattttgtggaatccagaatcaagtagaattacaggtgtaatagattttggtggttcttgcttaggagatcctgcgtatgattttgctgggatactttccagttatggtagacatttttttgatatgtgtattagtctatgtcctaatgatagcgaattatcagaccgagctaatttttataaaagtacattcgctttacaagaagcattacacgggattgagaacgatgataaacaggcctttgaaagtgggattaaaggatttag

SEQ ID NO: 7214 - DNA, 534 bp, Bacillus clausii
atgataaacaactatatgaaaaatgttaaatcgatttatcctaatatatccattgaaaacttttatcttaatgaaatgggacaaaataatgatgtattaattgtaaaccattctctagtttttagatttcccaaatataaaaatggaattattcaattaaaaagagagacagaaattctgcaatacattaaagatatcatttccactcctattccaaatccaatatatcagtatcttgaagaattagagcccggtaaggtcttcactggctatcatctaatcgatggtgtgcctttgtggggggaaagtttaagaggtataaagaatcatgcattggtgaaaggcttagctacacaacttgtttcttttcttgtagagctgcattccatttcggaagagaaattaagtcgagagttgaaactacaggttaataaccctcgtgaagaaataaacaaactgtatgataagattcaaaaaaatttatttgcttttatgagaagagaagcacaaaaaagaaatatcacactcctttga

SEQ ID NO: 7215 - DNA, 524 bp, Bacillus clausii
atgggaatgacgattggaaatgtcggattgataaacatggtgaatgctaccgaagagagcattcgcgatattgaaaaaatcgaaaatgtcggacttgtaatctacgcaaaagagacagcgcctctcctttcaaaattaactatcaacaacatcggtcagacactagaaactagtcatcaagcacgcatcgtcaacggtcgtttgctcattgattccggctttttggaggcgatgctcgaaccatgtacctttctagtgaacggcctggttatagtcgcaaaggatgtgacggtcgagcagctcaaacaggcagcctgccaaatcgttgtgcacggtagcgtttatgctcctcccgctctaaaaggggccgtcaaccttctgttaaaaaccgtctctggttccgttgaaacgtacacagaccacttgcctcaaattgaaaccactagcattcaattgaccaatagctacctaaaggcacttccacctggccaacttcttatcgtcaatggcaagctcgaattggc

SEQ ID NO: 7216 - DNA, 135 bp, Bacillus clausii
tgatattgttttcaaacgctattggatcgggctttccagcaacgaaattagcgaacaaacagcgttaacggcatcaaccgtacgctaccatttagcgaaagcgatcaagacgctgcgcaaacaattagaggagga

SEQ ID NO: 7217 - DNA, 165 bp, Bacillus clausii
tagtcgctgtctcgacgtttattgccattcttgctatttgtaaataccgatatcggctgttaaatgcgtttttgcgccaaccactgctcaggcggctggccgttagggcggtgttaagaatgccatttgttcgtaaccggtttatgcctactctctttaatcgac

SEQ ID NO: 7218 - DNA, 285 bp, Bacillus clausii
  misc_feature (1)...(285): n = A,T,C or G
aaacagaaagggcaatggcaacgttaggcgagcaaatcgataggaaagcatgtgcacaagtttttaaagaagcattaagctcaaaatggagcaaaccgtcagtgtgggtacatggagacgtagctccagggaatttactagtcaaaaaccgaaaactggctggcgtgattgatttcggcagctcaggtgtaggcgaccctgnatgcgatttagtgatggcatggacnttttttgacaaagacagccgaaacatatttaaagaggaaatgggtcttgatgcagata

SEQ ID NO: 7219 - DNA, 271 bp, Bacillus clausii
atggacttaactgcaccgcattggctttattttgtcgggattttgctaattattggtacgatgctgatgcgcaaaaatgtcgttgtccctgcaatccttatgacgtttttagttggttatgcctttagtggttcgatcgcagccgccttacaaaccattttctcagcgagccttgtggcagctggagaattatttagcatttttttgatcatcgccattatgacagccttattgcaaagcctcgactccctaggggcaaacgagcaaatgg

SEQ ID NO: 7220 - DNA, 240 bp, Bacillus clausii
atgtttcttataacttcgcttgtcgccaatccctttaatgttagttttcttagcttttcctttacaaatcaatcttttacagagagagtgaacttccccttctaccatcctactgccttttccatagtcttctcggcatccgttttgcgaaaatcaaataaagcagagtggcggttggaaaatttaggaggccaatcattccccataaccagtaattatggccgtgccgcctggcgttaa

SEQ ID NO: 7221 - DNA, 99 bp, Bacillus clausii
ctttcggatattcactgttatagcaggtgccattctagccgctatagcgattgaatggttcctactgccaaacagtattatcgatggaggcattatcgg

SEQ ID NO: 7222 - DNA, 147 bp, Bacillus clausii
  misc_feature (1)...(147): n = A,T,C or G
aggctctagcttagaggtngctcctgaatcccgccgctattgtcatcatcataattggtacgattgcagctgttttaatcgcctttcctttttcggacattaaacgggttccaaaattgtttggcgtgttgctgtctgaacggaaag

SEQ ID NO: 7223 - DNA, 402 bp, Bacillus clausii
tgaatatacaggtgaagcgctcgcaaaagagttggttccattgcttgctccacgttcggatgtattggttgtaaagggacaactggctaaaagaacggtgtacgacatcctttcatcatcagacagacaggtcattgttacagaaatgatcgtatacgatacaatatgccctgccggtgctggggaacaggcgaaacgtttagaacaaaagacatttgattacgttacgctgacaagcacttcagcggccgtgcattacgccaatgtcgcacctgcagctggaattcgcgccgaaacgattgcctgcattggcccagtcacagcccgagcagcaaagcaatgtggactatctcctctagtgactgctagcgaatatacggttaaagggctaattgatacgat

SEQ ID NO: 7224 - DNA, 486 bp, Bacillus clausii
aaaaaatggatttccaacagcaacaaaatatgcaccaaaacatcgaaacaggccctgtgacgccacaaatgaaccatggcggccatgaaatgtttgatgtacacgaagttctagcaggatcaattaacacaatgaatacgtacacgatgttaagccaacatgtgcaagaccctgaacttcgtgacattttggataggcaaaaagcatttatgaaacaggagtacaacaccactttagaatgcttccaaacaggtcaagatcctgcagtgccgacaaaaagctacaaaatgaaacaaggcaatgattttacgtatggcatgaagccaggcggccaaccgaaaaaaccgatggaatccacggctgaaatcaacgatgaaaccattgccctttcgatgttaaatgcagtaaaatcagttgctcctatcaaaacaagcgcggcaatggaagcgacaaacccagtcgtccgccgtgtgcttgccgattctt

SEQ ID NO: 7225 - DNA, 483 bp, Bacillus clausii
atggatggaagtggagaagcacaaaaacggattggcgaaattttgcgacaaaaaaggtttttcgccggacaaggcgatgcttatgcggcatcggatatttctaatctggaaaggaggcttcctgttgtggaaggggccaatcctgatttactggatgccagagtagggtatttgccaaaagcggctttgcccttcctaggaaaacatattgttctgttcattcttgtttccaacgtgagcatggcaatatcaattgttaaaaggattttcaatcatagaaagggccctcttttactactgacttctatatcttgcgctgctgcgctagtccctttgaacactcgttcgggaaagcggtttggcattgtgtactatccgttcgatttgattgatttaatgggtagtgctgtctctatctggtttaaggatgacttcacatgcatactagaacataaaagcatgcggcaacactgcataagatga

SEQ ID NO: 7226 - DNA, 228 bp, Bacillus clausii
atgcaggaaatggccaagatggtaaaggaaaatacaggggagtacggactctatgttcaacagccgccagatagctgggcggagtattcgcttgttcgttcaaatggcggggatttcctcgattttagtggcgacgaagttgtatcaaccattggttccccggaaagtgtggaagtgtttgatatgcttggacgcatgattgaagatcaacatgccctttcatgtgac

SEQ ID NO: 7227 - DNA, 153 bp, Bacillus clausii
  misc_feature (1)...(153): n = A,T,C or G
tttacagtcgatcntntgacagcattggctccttcgttggcgcagtggcgaatgtcgtcatgattgctgtaattatcccttncgtgcttttctatatgctgaaggaaggcaagaaggcgccgatgatggtcattaaccagtttccggcaaggg

SEQ ID NO: 7228 - DNA, 525 bp, Bacillus clausii
tgtcgagcactttgaaggagatcttagatagtcttaaagaagcattaaatgaggaggggaaaattaaatcacttctcacatcacaggaatgctttttttcattcaatgagccagttactgaaaatcatctttcacaattcgaaaaagatcaaggcatcaacatcccttcagattttaaagagttcctgtctctccataatggagcaaggatttatgggaatttgctttttggtgagcctgcgggtggtggcttaaggctgtttaatcttgatcaaatgaaagaagctcagaagtatcttgacactaaagacatccctattgcatttctacttgaagagtgtcatttaattatcaataagaaaaaagttagagagagaaatccaaactatctttatattttggaagatgttggtgaggctagacctttgaattcaagttttgaaatgtttctggagagatacattctttcacaaggatcagtattttgggagtggaatgccagtgcggaagtgtattatcgttctt

SEQ ID NO: 7229 - DNA, 455 bp, Bacillus clausii
atgaaagcggaaaagcaggaagctgatgcagatgaccgtgagctcgaacaggaagaacaagatgcggaagaagcggaagaaacggctttttctttcactgcttacaaggatcctgacggagaagagccgattgtgcaaaaaccaacagttgaatccgaggaacaacaaacagcaccagctggcgcagaaaatgcccaagaagatagagagcaagtgttggacatctctgccgctttggaagcagcacttgaaaataaacatgaaacatcaccgccttctgagccggtgttgccaaggtcaacagaaaatgaatgggacgttgaacaagagaaagaagcgtcagtggaaacgactgaagatgaggggatagaagccggagcagaagagattcgttatgaggaatctcagcagcaggaagaagcgctagcaggcgatgaccaagaactagaagaagt

SEQ ID NO: 7230 - DNA, 177 bp, Bacillus clausii
accttcaccctggacatgggtagatcacccggtttcgagtctacggcatcgtacttaggcgccctattcagactcgctttcgctgcggctccgcttcatcagcttaaccttgcacgataccgtaactcgccggttcattctacaaaaggcacgccatcacccgttaacgggctctga

SEQ ID NO: 7231 - DNA, 223 bp, Bacillus clausii; identical to SEQ ID NO: 6991

SEQ ID NO: 7232 - DNA, 435 bp, Bacillus clausii; identical to SEQ ID NO: 6992

SEQ ID NO: 7233 - DNA, 365 bp, Bacillus clausii; identical to SEQ ID NO: 6993

SEQ ID NO: 7234 - DNA, 558 bp, Bacillus clausii
ctgcggtcgcgattgtgtatgcgttgcttctgtcttttgcctacaaaagcctaacattgcggcagttgccaggcatttttaaagaagccgttgaactaaccgtcgtcatcatgttcctaattgggacatcggcgatgctttccctagtcatgtcatttactggcatcccgagcgcaattagctctgcgattttagctttgacggataaccctattcttattttgctgttgattaatgtgattttgttaataatcggcattgtcatggacgtcacaccggcgatcctgatctttacgcccatctttttaccagtcgtgatggagtttggcatggacccagtccattttggcgtcattttaattgtcaacctttgcattggcaacattacgccaccaggaggaagcgctttatttgttggcagcaccatcggcaaagttaaaattgaagaagtcatccgccccttgcttccattttacggcgcgatcatcgttgttttactgctcgtaacgatgtttccttttttaagcacgtggctgccgactctagcgggattaatgg

SEQ ID NO: 7235 - DNA, 428 bp, Bacillus clausii
atgactactaaacttgcccttacagatgaccaaaagaagaaattaagaaaaaataaaatcaagatgtctgctattcatacgatagatcccatcgatttagctgaaatgttagagatacctttagaaaaagcacaacaaatggtagccagcgcacaatttcaacgtttgccctcaattggccctgtcttagcagggaacttagtcaatcttggtttcttgcatcttgatgatatgaaggggaaaagtggcagtgagttaaccgatttgttggaacaacattgtggctgctggattgacccttgtgtcgaagatcaacttagactagttgtccactttgcagaaaatccccattcggacaaaaagtggtgggattttacggaggaacggaaaagataccggaaagaacacggatatccagctgatcggcc

SEQ ID NO: 7236 - DNA, 373 bp, Bacillus clausii
  misc_feature (1)...(373): n = A,T,C or G
atggtggtgctctaccgactgagctatggaagcacaaaaatggctccacaggcaggattcgaacctgcgaccgatcggttaacagccgatngctctaccactgagctactgtggaacgaaaaaaatatatanaaaaaagcccggcaacgtcctactctcgcgggaggaagcctccaactaccatcggcgcaaaagagcttaacggccgtgttcggcatgggaacgggtgtgacctctttgccattgtcaccggaccctacttcagataagctttggatttcttcgagcactcttgtcctcgaacttctcgcttctcttcgtagttcttttttgacttcagataagcagcgtaatctctttcgtctcgttcgtg

SEQ ID NO: 7237 - DNA, 330 bp, Bacillus clausii
  misc_feature (1)...(330): n = A,T,C or G
aacaaagaaaacatgggggttgctatncccttgcctccgtgccgctagtcatgacgcttggaaactcgatgttgattccagtgctgccgactattggaaaacaattgcaaataagttcttttatggttagtcttcttattactgtttattctgtggttgcaatcgtgtttattcctattgcgggctatatttctgaccatgtagggcgaaagccggtcattatcccaagtttaattattgccgggattggcgggctaatggccgggttagccgcatggaaaatggacaatgcttattgggtcattttaattggccggctgttgcaaggaa

SEQ ID NO: 7238 - DNA, 561 bp, Bacillus clausii
tgatgccattcaagacggcattcttgtcattgacaagcaagggattgtcaagaaaattaatgacgaatatacacgcatcacaggcgtttgtgcacaggacattattggcaagcctcttctagaagtcaggccagaagcacaacttgtttccacgctaaaagacaaaaacgtacgtgtcggcgtttatagaaaagtcaatggccgagaatacttagtcgatatggcgcctatttttgacggcgaccaagtggtgggagccgtctcaatctgtaaaggcaaacaagaagtgctggatttgacaaggacaatcgaacagcaaaaacaacaaattcaatggttgcagcaaaaagtagaagccagttttcaagcggcccatcattttgaatcgatcattggatataatcaagggttaaaagaggtaacagcgattgcccgcaaagcagcaaccggtccttttccagtcttgattacaggagagagcggaacagggaaaggagctttttgcgcaggctatttcataggagggagggaaaagtgccttacagccatttgtacccaaat

SEQ ID NO: 7239 - DNA, 753 bp, Bacillus clausii
atgtctgacatagcgttcattcgaaaaatagaagcgttatcaatgaatgcacagcctgcccttaagacagtgaagaaaggcggatggattttgcgcttcgccaatggttatacaaaaagagcaaactcgattcatccactctatcctttttatggggagcttgaaaagaacatcgaggcctgtgaacaaatgtaccgcaggaaaaatcttcctgtagtttataagctgaccgcggctgcttgtccacgcgatttggatagttcgctagatgcaaaggggtatgattatataggggagacgagtgttcaagttttgtctttagcaaaaatcggtgaaaagccagaagcttatgtcgaaagttgccaccgactagaccgaaaatggtttgatcattattgtcgttggaatcatgtttgcgaagcagaccagcagacattaaaacaaatgtttaacaacattgccgccgagacgtgctacatgcttataacggacaaagacgggatcccttgtgcttgccggttaggggtcattgaagataggtacattgggttatttgatattgtgacaaagaagaaggaacgaaaacaaggatatggaacgcagctaatccaacgtttgcttcattggggaaaagaaaatgaagcagcctttgcttacttgcaagtggtccgtgaaaataagccagccctcgcactctatacgaagcttggctttgaagaaatgtatgcatactggtaccgagtcaaaagctga

SEQ ID NO: 7240 - DNA, 291 bp, Bacillus clausii
ggcccctgagcggttgaaaggcgagtttttgtcaacgttgccaacagggaaagaacagggcattgatgcagaatttgtcgtatggcgcggcatttttggtccgccggatatgacggaggaacagctcgcttattatgaatcgatctttaaacaagcttccgaatctgaagcgtttgcggaagtgcgcgaggcgtatgggtgggatgaaatgtacatggattctgagacgttccgtgcatttttggaagaacaatcagaagatttggaaacggttttagatgaactaggctt

SEQ ID NO: 7241 - DNA, 150 bp, Bacillus clausii
cctttttgagcaagggtttactacaaaagaaggtggacatcgcggtttcgggctctcactcgtgcaagcggcattaaaagaattaggtggctttcttgaagtcgaggcgaataagccgacagggacgatcattagtttgtatattccaaa

SEQ ID NO: 7242 - DNA, 111 bp, Bacillus clausii
aggcggtttcgacacagggaaaccttatttcgggcaattaatggcaggaccacaattccttgcccattttgtccaaatcgattattggatgaaggcatataacattcaaat

SEQ ID NO: 7243 - DNA, 393 bp, Bacillus clausii
  misc_feature (1)...(393): n = A,T,C or G
ccagaagctaggcatccaatttacagacgaataactgatggcaatgccttatattttaacgctcgttttaaagcgaattggcatcggacatgtgttgccgccatttccgatcgaatacgatggactctcagatacgaaagagtaccaagcaacagaggaaattttccgccatntaaaagacgtgcctaagcaggagcggctattcgtaacgctttacttgctgacgacaagccgttattggactgaatgggtaaatgcggaggaggcgctgcctgatttagtgccagcattggccgatgttttaaggctatttgaaaaaagcgcctgtatttatttgcaggaacgggatttgctgttgaacaagttgattcagcatattaagcccgcgtacta

SEQ ID NO: 7244 - DNA, 1236 bp, Bacillus clausii
  misc_feature (1)...(1236): n = A,T,C or G
atccattcgcgcaggctttcgtgaaagcaaccgccttttctttttgctgaccaactcgcgcagctttacccggagcgagncggccgcttgccataaagaaattgcggaacgggtgcagcgcatctctgaggaagagggcattccgtatgtactcgtaagccgtggtgattcaacgcttcgtggccattatccgctggaaacagacgtattaaaacagacgattgaaggcatgtcggaaattcgttttgacggtgaagtggtgatgccgttttttaaagaaggaggccgattgacaatcggcgatgtccactatgtccaagacggggagtcgctcgttcctgccggggaaaccgagtttgcgaaagaccggacattttcgttttcagcttctcaccttggcgagtgggttgaagagaagacggaaggcgagtatacaaaagaacagacgatctatattcgtttacaagatttgcgtgaaaaacaagtcgactatgtcaaagagcagcttatgaaagcgcaagggtttcagaaaatcgttgtcaatgctgtcgagtatagcgatgttgaaatctttgtaactgcctttattaaagctctaaaagcaggcaagcgtttccttgtccgcagcgccgcttcgctgacaaaagtgcttggtggtgtggccgataaaccgctgttaaagaaagacgaccttgttgacgaggcagcaacgaacggaggccttgttatcgtcggttcccacgtgaaaaaaacgacagaacagttgcggcaacttcttgatagtggtctcgttgaaggggttgaattggatgtccatctagttctttaccctgagcaatttgaacgggaagttgccagagtccgccgtgaatgcgaggcggctattgccagtggccggtcggttgtctgttatacgcggcgagaacgccttgatttaggtgacaatcaggcagaggaagaattgaaattggcagtaaacatttctgatgccgttacgagtattgtcagtgacttacaagttaggcctaaatacattgtcgcaaaaggcggcatcacatcgagcagtatcggcacgaaagggttggctgttaagcgcgctgaagtgctagggcaaatacaaccaggtattcctgtatggaaaacagggaacgaaagcaaatttgcaaatgcgacctacattattttccctggcaatgttggccggcccgaaacattaaaagaggttgtagaagagtt

SEQ ID NO: 7245 - DNA, 507 bp, Bacillus clausii
tagtgttgttggcatggttgatcgcccacttttattaccaaaagcgcgttaatacgaacgcaaaagaggctatttcccaagcatctgtcgacacacacaaccaagagaaaacaagcacaaaagcagagcatgatagcgaggggattgaaatcggcggatggcttggcgattttcttgacagccaagacgctgactcggcgcatattgtctttttcggttccagctccattgagaacgaaaacggaaaaagctggccagagcttgtgatggaacaaattgataatggggctgcttcgcccactatcgattacgaagtgatttcagtcggaagcgacacaacaagcgaccagcttctggcagaagggtttgccgacaagattgcagaatctgagcctgatgtgcttgtgctcgaatcactgacgcttaacgacaacggcaatcttgctgcatctgactcaattgcccacctctctgcttttattgacgccgtttccgaacaaattccag

SEQ ID NO: 7246 - DNA, 684 bp, Bacillus clausii
atgcagccaaacacgtaccgcaatcaagaagccaatatgaatggggacaacaacttcaacaaccgcaactatccgtattatgggccgaatgcgtacaacacgaatgataaaacattctttgacgacaatcgcttttcaaataaaaaccaacgcatgaaccggactaatcagtataataaccagtataatcaaggacgcaatggctacgttcgtggtataactgggaacaaccgtccaggaatggttgatgaaaatggttttcttaaccgaagagcagactacggcaaccgcggcatgaatttccaacgggctacgacgaaccaagatggaaaccgcggcatgaatggacagcgttctacgaaccaagacggaaatatgcggcaggggatggaaacagaagaagttcgttaccatcgcaattatgacggcgaccgggcagaacaaatccgcgaagaagttgaaaaaattgacggtgttcgggaagcgcgcgttattgtcaatcgcgacgacgttgttgtaggctatgagcaagacgaaaaagcagacgatgtgaaccagcgtgtcgaaaaccgtgtccgcaaattggcccggcgaaggcaaaaatgttggtgtgagtacagacaacgacatttttacgaatatgcaacgaatggacgacaggctacgctcaggcgctgcttttga

SEQ ID NO: 7247 - DNA, 372 bp, Bacillus clausii
gtataactgggaacaaccgtccaggaatggttgatgaaaatggttttcttaaccgaagagcagactacggcaaccgcggcatgaatttccaacgggctacgacgaaccaagatggaaaccgcggcatgaatggacagcgttctacgaaccaagacggaaatatgcggcaggggatggaaacagaagaagttcgttaccatcgcaattatgacggcgaccgggcagaacaaatccgcgaagaagttgaaaaaattgacggtgttcgggaagcgcgcgttattgtcaatcgcgacgacgttgttgtaggctatgagcaagacgaaaaagcagacgatgtgaaccagcgtgtcgaaaaccgtgtccgcaaattgg

SEQ ID NO: 7248 - DNA, 108 bp, Bacillus clausii
acattgtcggcggagttgttcgcgattatttgcttggcaaggatgtcgacgacgttgatgttgcgacgcaagcatcccctcatcaagttgccgacattttttctagag

SEQ ID NO: 7249 - DNA, 261 bp, Bacillus clausii
agttctgagcctgttgaaacgatatgaagacaagctatcgataatcggtgaacgttccggtctccatatcgtgctcgtcgtaaaaaatggaatggatgaacagacactggttgagaaagcattaaccgccaaggcaaaagtgtatccattatctgcttactcccttgaacctgtaatccacccgcctcaaattgtactcggctttggaagtattcctgaagacgaattggaagaagcgatcatgacagtgttgaatgcgtg

SEQ ID NO: 7250 - DNA, 324 bp, Bacillus clausii
atggaacaggagattttgcggattcacgaaaacgtaaaacgcacgaccgttggccgccagacaaaagaacggcaaacgttgttttttggaaaacctcgagtgatctatgcgctgttaatttcgatattaattatgtatagcgtccttgaaccaaatggaggaagcaccaccattgaaccgttaattgacttttggcgccaaattccaatccactcattggtaaaggcccaagtggtggccgtctatttttcaagcgatgttttttgcacattggctttttttccatttgttgatgaacggcatgggcgcctttactttttttaa

SEQ ID NO: 7251 - DNA, 273 bp, Bacillus clausii
atgaaaggcgttgttagtgaaagtggcgatttaagcatgagtgccaaagacctcactaaaataaaagagctcggcattcaacagttcgaagagcaaatgcaaacactagttaacaggttccaacagcgcggcatcgatccgattggccttggcgacgtggccagtagcaaaatccgccatttgaatatggagcaatggcatgacacctacccatctcttgatattgatgtcaacgtcgatctaaccgtgatcggaagcggcattacagattaa

SEQ ID NO: 7252 - DNA, 1043 bp, Bacillus clausii
atgaacggcattctggcaattatgcaatttgtttggccgtttattgtgtcgcttattcaaatggtatggggcaatattcaaggagtcatttcgggagcattgaacatcatcatggggctagtaaaggcgtttgcaggccttttcactggagatttttctttgatgtgggaaggcattaagcagcttttttctggcgcacttgaggcgatatggaacgtcgttcaattgttattgtttgggcggcttttaaaaattgctagttctttgtttaccggtttaatgggtgttttttcaaaaatgtggggagcaataagcaatttgtttttgacagcattaaatggaataaggtcgtttttctccaccatttttactcctattcaaaacgtagtcatgacagtaatgggctttatccgcaatgccatttcaaccggcttaacaattgcctcgaatgtggttcaatctgtgttaacggcgattaggacagtatttttaactgtatttaatgctgttcgtaatgtagttacaacggcgattagctttatacagagttttatttcaaccgggatttcggcggcacgtacagcggtaacaagtgctcttaatgcgataaaaaccacatttacaaccatttttaacgctgtccgctcgagtgtgacaaccgcgatgactaatatcaaaacggctatctctaacggaattcaaagcgcatggcaagcagtcttgaattttgttggccgttttcgcgaagcggggaaaaacattgttaatagcattgcagaaggaattactagtgcaattggggcagtaaaaaatgcaatctctaatgttgctggaaagatacgggatttcttgcctttctctcctgctaaagaaggaccactgcaagacattcaccgtcttaactttggcggaccaattaaagactccattaatcgagatgtgcctacaattgaacatgcgtttgaaaaagcattaacgctgccttctcttcatgatattggttcttcactaggacggcgattggcgcggttagatagcaatgt

SEQ ID NO: 7253 - DNA, 354 bp, Bacillus clausii
tatacctaccgatatcgcatcgctaaaaataatggcccatgtatacaagaaaaaggacgtttactccatattcgctaaaacagtggaaagcttagtcgacaccgttccatatattgattgggtcggcatttatatgtatgaaaatctcgaccataagcttgttgctgcctcctgctttgaaaatgatttgcgctgggaatgcaacggcgaattaaaatttcccgttaaaaatgcaaacagtacggaaatcggcgtcatggtcgtgcgcacgaaagaagcgatcgccttcgatgtgacagatgtcgcaacgcttgaaacgattgcaagtgccattggccatgaatatagcctcaa

SEQ ID NO: 7254 - DNA, 312 bp, Bacillus clausii
gaaggctgatcgttggttttgatccgctatggtccgtggacggtgttgttctgtcgcctgatttccccttatccgtagtttaatatcgattccagctggtatgtcaggtatgaacatttggctatttatttgtttaacgacacttggcacagctgtttggaataccattcttgttcatttaggggcttctgttggtgagaactggcatgatattgttgaagcgatgagtgtcttttcagatgtcgtttatgtaggaatagcgattgctgggatagcgatcctactatggtatattcgcttgcgcacgaaaag

SEQ ID NO: 7255 - DNA, 380 bp, Bacillus clausii
gtgacaaaaacagaaattggcatattgcttgtccgtgtcaccgtaggaatcatttttctattccacggactggataagtttaatggcggaattgaagggacgggcgcgttttttgattcaatcggcattccagcagcaatggccagcgtcgttgcctttgtcgagatcattggcgggctcgcccttattctcggattaggaacccgtatcattggcgctgtgtttgcggccattatggttgtagccatcataaccgccaaatgggaagcaggcttgcttggcggctacgagcttgatcttattttgctagtaacttcgcttttgcttgtgttaaacggcagcaaactgcttgccatcgatcagctttttggaaagaaaaa

SEQ ID NO: 7256 - DNA, 537 bp, Bacillus clausii
  misc_feature (1)...(537): n = A,T,C or G
atgtctgacatagcgttcattcgaaaaatagaagcgttatcaatgaatgcacagcctgcccttaagacagtgaagaaaggcggatggattttgcgcttcgccaatggttatacaaaaagagcaaactcgattcatccactctatcctttttatggggagcttgaaaagaacatcgaggcctgtgaacaaatgtaccgcaggaaaaatcttcctgtagtttataagctgaccgcggctgcttgtccacgcgatttggatagttcgctagatgcaaaggggtatgattatataggggagacgagtgttcaagttttgtctttagcaaaaatcggtgaaaagccagaagcttatgtcgaaagttgccaccgactagaccgaaaatggtttgatcattattgtcgttggaatcatgtttgcgaagcagaccagcagacattaaaacaaatgtttaacaacattgccgcccgagacgtgctacatgcttataacggacaaangaccgggatcccttgtggcttgccggttaggggtcattga

SEQ ID NO: 7257 - DNA, 309 bp, Bacillus clausii
tccgctctatgaagcgattttgttttactatgatttacagccaagagcaatcgagcaagtcggccagaagttaatccgtgtagagacagaccaaggcatgtttgctttaaaggagacggatattgaccgaatgcgcgcggatgaatttgttcatgcaatccgcaagttgacaaagcttcgtttcaggcaatttatccctgttctgccaacgaagtttggcgagtatacgctttttgctagagataaaagctattatttaatgccgtgggtcaatgaggttgactatcacagccgcgtctcgattgaaga

SEQ ID NO: 7258 - DNA, 711 bp, Bacillus clausii
atggatcgcatgattcgcacaaaagacggaaagccttttataaaagttgatggccgatacatcacggttcatgaccacatcgcccctagctgtttgcaaaaaggctatgagcagcaatggggcacgctattaggagcaatggtggcgaacgggaggaaggaaagcaaggacagggaagaaagggccaaacctttggaagaactggagtgccttctgccaagcctcgaacctgaacagcaaaaggttgtaaaaggattgtggaacgaagctgagaagcggcaggcaaaagctgaaaaactagcaaaggaacagaaaaagcaaccgctaatggatcggattgaggcgcctgaacagtctggaatcctctttcatatccttgtagtgaaagggacgactaagcctcctgaagtagggtacggttcaatgatgcgctttttaaagaactggtacactgaacatggacaagaatcgttttgtgcgttgctcgatgcattggatgcacaagcagcactgacaacgccagaaaaaaaggcgctgttggcagaagggctgcaagtgcatgagcttgacccgttgttgtcgtacgcatcaggcaatcgcgacaaagagttggcagagttagtgaaacgtgccgtttccgattgggacaaaacaaggacgtttgtctcagcatttgctagttggctagatgaaaagagggtgaaagtatga

SEQ ID NO: 7259 - DNA, 345 bp, Bacillus clausii
aaacgaactgttgttgtttaactttgaacaagctagtttagacacaccagcacgggacttggccagcttttgccgacgcagctttccttacgcattatgggaagaggatgaagtgttccgttggttgcaccgctatgagcaacatttgccattgcttgattctgaaaaacatcttctttgtgcgtacttactgtatccagatccaatttattacgcaataggcgattacaggcatggcggaaacgaactcgaacaggtccggcgccttgagaagcgcatcattgccatgcgcaaagttcagcgttttgtttccaaacttgctccagccgaagaaaaaaaggaagc

SEQ ID NO: 7260 - DNA, 327 bp, Bacillus clausii
gtgaacctgggatagaaaaaatgccctattttttcagctgaagagctcgttaaacggatgtatttcgcctttttgatgaagagatcacggtttattcggaaaaagaagtgatcgtctgtgtaaatggtttaggttcaacgactttaatggagttgtatattatcacgaatgagtttattgatcttttggaagacaatgaatttctagtgttagatacggttgttggtaacttttgtacgactcaggaaatggctggcttttcactcactgttcaaatattgacagaagaaataaaagaactctatcaaatggaagcgatgagtcccc

SEQ ID NO: 7261 - DNA, 269 bp, Bacillus clausii
atgggcatgaaacagcagtttgatggttggcgggaagacgtcgagccacttctttccattaaacgggaagagttccacgaacttggctacaaccgggtcacagaagatgatttgtggaattatgcagtggacaagcttcgtcgtaaaaaagaatttacgcctttctacgcatttgttgatgaacttctgtcgattcagccccaagggtacatgacatggttgacagtccatgcgtataaggagccgattgactggttcaaaacatttga

SEQ ID NO: 7262 - DNA, 115 bp, Bacillus clausii
atgaacaagcaaacctttctaaaaggcacttttattttaattgcagcaggctttatcacaaagttacttggtttcattaacagaattgtcatggcaagaatgattggtgctgaaa

SEQ ID NO: 7263 - DNA, 843 bp, Bacillus clausii
caaacattcagtcccagaagatgaaatgatgtgtgtcgtgattgactgcggcggaacgggctagaattggactatacccaatgaaacgaattcctacagttgatattctcgcttcttctccatcaggcccattggcaaaacatatcaaagaagacattttcgtctctggtgttacaccgaaagaagtgtccttggcagaagcaacagaggagaagcacgattcagcccctgcagaggaagaaagtcgtttcaacccagcaaataaagaagaatttaaggaagagtacgaaaaagtcaaaaatgagcatcgttcccaaaatgataactggctcatgcgattttcaaaaggaatcggaaaagtcactggtgtattttatcaggccggacgtgattcaattgaaatgcttattaaaaatatcatcccgttcatggcttttgtaagcatgttgattggcattatcaattacacgggaatcggcgatttgattgccaatacgatgtcaccgcttgctagctcgatttggggcttaatcatcattgttatgatctgcacactgccatttttatcgccagtgctaggtccaggggcggtcattgcccaggtaatcggtgtcttgatcggtagccaaattgcgcttgggaatattccgccgcaatttgcgttaccagcattatttgcgattaacggtcaagtgggagccgatttcgtaccagttgggttatcattaggagaagcgaagccagaaacagtacagtatggcgtgcctgccgttctgtatagccgcttgattacaggcgtgttggctgttgtcattgcctacgtggctagttttggcatgtatt

SEQ ID NO: 7264 - DNA, 602 bp, Bacillus clausii
atggaggtgctcgcagcaaaagacaaccataccgtaaccgacatgcaagcattgcaaatggacgtcgccaatttgcaagcaaccaacttgcttcctcttctgacagaagcgttaccagctgagggactgcgcgctattgacgaggaggggttaaatgttctggcggactggaaccaatttgacgagcgcgaagaagctggaccgctattgttccatttttggatggaagaaatcgagaatctgttgtttgccgataaaattcctgctgaaatcaacgagcttttttacggccgggctggtgttgtcgatgaattgctaagacgtgcagcaactggtgaaccaggtccatgggtagaaaacgctggcggttttgaaacagtcgtccttcaaagttaccaagcggcaatagacaaagccgctcgtatacaagggaacaagccagcaaagtggcgctggggtgactttcaccaagttgaatttagccatccaatggcagcgatcacaccgttgaattacttatttgatcgggatcctctttcagcagacggcagccatattacgacgatggcggcaggctacaacccgcgaaacgggccttgtca

SEQ ID NO: 7265 - DNA, 822 bp, Bacillus clausii
atgcgcttgtttcgtcctgttcaagcgccattgttgcagcaagaaagcgatcatagctaccaatatgctgagtatgcgccaagctttgatttatccgcctatgttgcctgttattggacgagctcgtttcaaggagggaaagcgcgacaccatcgtattcttccagatggatgcgtcgatttaattgttacgatcagtgacaataacgcgcaggcatttgtggccggttttatgaatcgatttgacgttttgccgttgacagagccaacttcttctttcggaatccgcttctattcggattcggtccatacattactgcgccaccaccctgctgattttagagatgaaggcattgaactagagctagtatggggaaatccagcctttgaaattaccgagacaatcgcacaagctcgcgatatgaaggaaagaattgcagtcgttgaggcgctcttacgaagaaaactagataaagcgtatcgacccgaacgcttgtttgagcgctgcatgggtcatatttttgcaaacaaaggtatgctctctgtccgtaagcttgcagaaatggaatattacagcgagcggactgtgcgccgtacgtttgcccatgagctcggcgcttccccgaaagaagtattggaagtcgtccaattccagagtttgttagcaggcttgcagcaaaacgtccatgcacgtcttgctgatttggctctattatacggttatgccgaccatgcccatttgtcgaagcaatttaagcgtttttacgggttggctccgcagacagtaatggcacaaattgcgtgccaaacaacaaatcgttaa

SEQ ID NO: 7266 - DNA, 343 bp, Bacillus clausii
atgattgctacaattgatgcgatggacatgcttcaagcgtcagatgagctggcagcaatggtgctgcaatcaagcgtgtttgctaactatcgcttatcccgtgcccgttttgaagaaaaccatgctgcacaagcaaaggtagaacgatttaaaaaagtaaagcaagcccatgaggaagtgcagcggtttggcaaatatcatcccgattataagtcggtatccgcggaaattcggatcgcaaagcgcgagttggataaagatgaggtcacttttccgcttttaagcaagctgaaacagaacttgagtcgctttctaaaccgtaactcagtcgccattcatcgcc

SEQ ID NO: 7267 - DNA, 262 bp, Bacillus clausii
  misc_feature (1)...(262): n = A,T,C or G
ctgtgttaaaaactgtacatcatgcattggagattttaaaaatgtttacgaaagaaaagcctntttggggaggcagggagctgtccaacgctacggggatcaatcatacgaaaatttatcggatacttgaaacactggaagcccaaaactttctaacgaaagatacagagacaaagaaatatagcctcgggtttgccgtgtgggagctaggttcgattatgtacgaccagttaaatgtaaaagaattgatccgcccaagcct

SEQ ID NO: 7268 - DNA, 306 bp, Bacillus clausii
cagggttggccttgttccatactcgtttaaacgaaataaggcggccagtgtttgtcttcttagatctaaaaacagaagcgcaagttgcttcaatggctgatggcaatgaaagcattaaacgagcgattctcatgcttgctcctgaacctttagcagaacaggagcttgcgtttatgagttttgttagcattttgctgattggctcagatgacgaaacggcacttttctatcaagggagagagcatgaaattacacagtttcttgaacaaaagtgccgcgagtttatgatatcgtatataaatgaag

SEQ ID NO: 7269 - DNA, 390 bp, Bacillus clausii
aaaatccttttcaagatggcggcgccggcgtcacttctattgctgctcttactcaagatccattacctggctaccattcaaagcttgcgagcttaataaaaaagatcgcggtacgcgaatgcctaccagtttccacagttagccttcattggtttaaacattatattgatgtggctgttcagccacttatccatttgtatgatgaacttggtttggcacttgaagcacaccaacaaaatagcctactcaacatttataacggctacccgagcgctttttattatcgcgacaatcaaggctattacttggcaaattcttataaagacgttctgttggcaaaagagcctaaattaaaggaagccgaaggactgttttacaacgatgccctca

SEQ ID NO: 7270 - DNA, 465 bp, Bacillus clausii
atgtccggtgtttccacaatctcgtttgtgacttcattcgattgtgccgactgctcttcatccgtttgcaagttgcgatattggatgtcggcttggttcacaaccgtttcacctacgtggctttccaatgttttcacctggaattgcacggtaacaccgtctggtaattcagttgtcgtttccaaattgccgagctcaatcatgactttgtcgccagcaaaatggccagcatcgtcatcttcctcgtccgttaaatcgcctgtgtttggcccagcgacaattttcaaagaaccaggaacgtattccgttccttctgggatcgcatcttcaaaaacggcatcggccgcaatatgctctccgacatttttaatcgtcacgtcatatgtgaggatattgcctgcaaacacttctccctctggagagaccgttttttcggcttcgaccacaggaccttcacgtggataa

SEQ ID NO: 7271 - DNA, 390 bp, Bacillus clausii
atgagcgattacacacaaaaacgaaacttgttaattagttctggggaatcgccactcattatcccaaaaacgtacccgggggaggaggcttcatttgtcccttctggcgtgattttgcctgttagtgattatatggataaaatgccccattttaaagataaaattgagaaatgggaaatggaagatgaattagaaacgttgcggcaaagtgacggaaaattttatcttcttccaggcttacatgagaacgtttggccagagtatacattgattgtacgaaccgatatttttgaggaaaataatatcccgctgccaacaacttgggatgaattatacgaggcaatgaagacgttaaaaagacatttatcccgatgtcaatccattttctga

SEQ ID NO: 7272 - DNA, 226 bp, Bacillus clausii
  misc_feature (1)...(226): n = A,T,C or G
atggttccattgaaatttttaaaggacaattgtgatttcatggaagcgctttacaaggaaaacgctataatganggcattccganggaggttganggatgacaacgtatcggttcccaaattcattcttttttggcacagcagcctcagcgacgcaaatggaangagcggcttctacaagcggaaaanggaaaaacatatggggattattggcatgagcaagaacc

SEQ ID NO: 7273 - DNA, 210 bp, Bacillus clausii
atgttcttaacggaacgaaaattggcagcacggctaaatgagctaaaagcgtaccgataccgtgatcccattgtgatacaatcattcgccatggaggaaggggacgatgctgttggcacctatccaagagtgccgagtgagggtgcagaaacggttacacttggaagccgttggggtggtcgtgaccgctatgtttggctatacacgaca

SEQ ID NO: 7274 - DNA, 365 bp, Bacillus clausii
  misc_feature (1)...(365): n = A,T,C or G
atggggcgtttgcttttaccaaaatgccgctatgaaacagtgacagcgctccgctttctcttggctttgcccttgctcaacgtccttgttttgacctcgccagatgcatggaacgagccagcttctgctgcagctctcgtctttattagcataaacttactaacttcagcacttttgccaagcttggtctcgatgctactctattaccggggcttgcaggcaattaaagcttctgtagctacgattgccgagcttagtttcccaatggcaggcttgcttgtctcctgggtgacgatggaagaaaacgttacgtttccccaancccttgggtttgcgccgatcttgggttgtccttttatcacaat

SEQ ID NO: 7275 - DNA, 406 bp, Bacillus clausii
  misc_feature (1)...(406): n = A,T,C or G
atgcaaatatacggcattgctattagccggtgcgataaccgcgaagatatcgcgatgttcgcggaacaaatcggctttattttgcatagtgaaacacacccccaccataatttttgcgangtggcaggcgtccgctatgaagatttgcaatatgagcctctcgccccgactgcccaccactatacacgccacatgcttgatgttgcccaccgtggttctctcgccgaaatattgggtgtgcttctgccttgccccgtggaaataccaagcgatcggggactatttgttacgaaacgtttcagccaaaagcgaaccatccatttttcgactggatttccttttaccgctcaaacggaaaaatgggtgttacgaaacaattttgttagccgcctccaacaacttgcgg

SEQ ID NO: 7276 - DNA, 549 bp, Bacillus clausii
atgccacgcttgactggctttgtcaataaacatgtgatcgtgcaattgtttacagacgacggcattgaggggattggcgaaatgtcagacttctctcatttgccgaagtatgcggttgacattgttgatttggagcgtacgttaaaacaaattctcgttggcaaaaacccatttgacatagcccctatcaatacagagttaaatggaaacttccctgaagcgatgtactactatgaaaaaggcagctttattcgaaatggcgttgacacagcgctttatgacctttgtgcaaaagcgctaggcgtgtctgtgtccgatctattaggcggccgccaacgtgagaaaatcaaagtatgctttccgatttttaggcatcgctttatggatgaagttgaggcgaatttagagctcgttaaaaagcaatacgagaaaggttttgacgtatttcgcctttatgtcggcaaaaactttgatgcggacgaggcctttttagcaggggtttacaacgagtttggcggcaaagtaaaagtgaagtcccttggattttag

SEQ ID NO: 7277 - DNA, 372 bp, Bacillus clausii
atgcataaagaagacggaacgcttttatttaccaacaggcctgatccgtttgaattgccacaagaagaggactcggggcctgtttacaaagaaatggtgaaaaacggcgaaactttctactacaaagtagagcaggacgcagacagaggtctctattatgtaggagtggtgccacggtctgaaattacggaattgagttccctcgtatacgccaccattgcattattaatagccgttgcgtgtgtaacagttgctgttggttatttcgtcatgcgccgctatgctaggcggatgcaacggattgaggcatcgatgcagcttgttgagcaaggagatctatcggcgcggattgacatgagcttgccaaattaa

SEQ ID NO: 7278 - DNA, 510 bp, Bacillus clausii
atgaaagggagacggctgcgcagccgcgcaagataccaaattttcaaccggattttggccatgtattcgattattattttgcttgttattagcttgctcgtcgtgctgatcgcaaaatatgtagcggatgacttcataactagatcccttgaagccaatgaaaaacaagtcgaagctctggcggtttatatggctgaacgggaacgctcgcttgcaactcacttacgggaattgtatttttatccagagcttgtcgagtcgatagctgttgccttaaaaaatgaccctgaaacgtatttggaatacagactggatcaatactcactgcagcgctcatttgtgccaagcaacgtcgaatcgtttatgcgcggattttattatggagacggcgccattgatgccatcaccttgaccagttatgaaacggatcaagtatatgcctatgtgtttcaatatggcgaaattggaaccggattcagaatgagggagagcagcaagcgattactttaa

SEQ ID NO: 7279 - DNA, 1235 bp, Bacillus clausii
atgggcaaatgctcgtctgattcggctcgccaccgcaataaacggcggaatgcaaacgaatgtttcggcgtttgcggcgttgaaggcggctggtcccttagtgccgacgacatgaagtggtacttggattggttgttcgttcgcggtgtcaatctcattatcccccatgctttttattattccattcgaggggaacggagaaacgagaggccgccagatgtcggaccgaataatggttggtggccggaatacgccaagttctcccgctatatgaagcggctgtcctggctaatgactgattccttaaacagtgccaaagtggctgttcttgtcggcgattctttcttgccgtggcgtatcgttaagccgctgtacgaatctcaaatcgaatttaactacttagaaaaacaattgttgaacgattgctgcgaaattagcaatggaacgattcaaattgccgggtattgctatgaggcgatattgatcgagcgtggctatcagctggcccgttctatttggcaacgcctccagaaatttgttgaggaaggaggctgcataatccagctcactgcaaagggtgttaactctccacacattggacaatggcaggtgggacaagaaacggaggttccggcgttgctaactggaatgatcgggagcgattatgaaataaagcctgctgcttccactatacggatcagtcgaatcaaaaagcagggtcggttattttatgtcatcgtgaacgaaggggaaacagcatttcaaggaaagttgcgtatggatctaggtgggcttatcgaatactggcgtccttggacaggagcgtgtgacgccgcaatcggtgaacaggcggcggattatctagccatacctatatccgtagagcggagagaatgcttaatcattgccgtagatccgagtcggcctcagcaacagggcagaaagcagcctgtaagaaaacaaaaggcaatattagatttatctcaaggctggcgcgtgatcggggggccgtggaagggggaattagccgggctatctacatggacgaactgggaaggcttgtcaaatttctcgggaacggttgtttacgagactacattcgagatcgaagagccgtcccaaattcctttatggccgactagatttaggcgacgtgtacgaaatcgcgcgattgtcagtgaacggaaaagaagctggcgttcaattctggaagccttacgtgttcgaaattggcc

SEQ ID NO: 7280 - DNA, 1418 bp, Bacillus clausii
  misc_feature (1)...(1418): n = A,T,C or G
atgctaagcgcaagggaattttatttaacaaataagctgttgaatacgaaagctccgattagaatcaaagatttgtcaatcgagtttggggtgagcacaagagcgattaagtatgaccttganaatgttcgcaaatggtttaagttgcaggggagaacggtgaattcccagacaagcaaggggatttggcttcaatgcagtgatcgggagcgcgctgaattaagacggattttggcacaattcaaacgttcgcaaatttacccagatcaaacgatgcgtttcagaaggattattctgtccctattatggacgaatgagtataaaaccgctgctcagttatcggagatgctagcagtcagcagaaacacaattttaagcgatttgaaccatgtagacgagtttttaaaatcatggaatattgagttggagcgaaagcaaagaacagggtatcgccttcatggcaatgaacttcagctgcggctgatgcttgagcatattatttacaacagcttagatgattatcaaatctataagctaacgactcgaattacgaaaaaagagcggcaaattgagattggcacgatattggaagagccattaaaacctatttatgaaatggctgaaagtcatatgagcgcgttctattcgccatccttggcgtctttgttgcggctctctgatttgttgagattcctactgcggctcacgttttcggtgaaaagattaacgatggggcgtacgattcatagctatcggatgttggagcgttctcatgatcaagatgatctctccttgtttctggtgaccgttatggagaaagtctacactgatatgcagttgccgttgctcgaggaagaatacgcgtatgtatcaggaaatatagaaaaagcatctggacaaatggacatcgtcgacattaccgagaagatgatcgagtatgtaggcgagcaagaaggaatcaactataaaaaggatcctaaactttatagcaatctgctttctcatttgtcactgaggcttcaaaatggctcattttatttaaatgaaatgaacccaatggaggacgaagtgaaaagaaaccatgcgtctcttttccaaagtgtcaaggaagcttgccgcaagtatgtgaaacaacacacattggtagcccaagattcttttatctcttttattgttttgcacttcctcgtttcttatgaaaatacatttaaaccgaaaaagaaagtaaaggttttatatgtatgttcaacaggaagaggggttgcccggttaatcaaaaatcgggtagaaaaagaaattcctgccgtcgatattgtctgttattgttccttgcttgaagtggaagagatttgtcaggctgaagaggtggatttgattatcagcgtttttcctgttgaagccgccgggggatcctctag

SEQ ID NO: 7281 - DNA, 825 bp, Bacillus clausii
atggcccatattcccgaatcgttatgggctgaaaaaccagaaacgattagcgcttggcttgatcgcaacatcgctaacgaacaaactgtctttatttgtgatgctgtctcaatggaaacgctcgaacgcattgctgctttttcgcagcagcagccgaaacgattgctcttggctggttctgccggcttatcgaatgcacttgcgcaaacgatggtgtccggcacgaatacaccctttgctggccaccctgttagcagcgaccccatcctttatctcgttggcagcatgagtgaagtgagcaagacacaagtggcccacttgctcacgcacccgcaaacagaagggattcgcctccatgcggcaacagcagcaagcaatgaccgccatacacaagcaaaagagtttgagcgagtggtggccgctgctgaaaagacattagcggtcggcaaaatacccgtcattttttctgggacagagcgccaagaagtcgctgaagtatacgattatgcgaaaacaacaaacacggcaattagcgaattggcgaaacgaattgccgatacgattgcagcgatcggctcgaaactaatggatactcgccatttccaagcgattattatgaccggcggcgataccgcgaaagcactatgccggcggctaagcatcgatgaattgcgtttgcttgatgaatttgaaccgggcattcctgttgcccagtttactggcgaacatcgtcagacatacgcgattacgaaagcaggcgccttcggcaacgagcagactttctcgaatctataccgccactttactaaggaggaaagcaaatga

SEQ ID NO: 7282 - DNA, 96 bp, Bacillus clausii
  misc_feature (1)...(96): n = A,T,C or G
agcttttgcagaatatcgagttcgccaacatctccagttctttcgcttctggcacagncgattatgtccaattgtttgagccacaaagcatcgctt

SEQ ID NO: 7283 - DNA, 593 bp, Bacillus clausii
  misc_feature (1)...(593): n = A,T,C or G
atgaatttacgtcaaagttgcagcaatgatggaggattcataatggttgtcaggaaacacatttcgtttggcgcattgctcatattgcttgcagcattggcggcagcgccgttgtttgcggtattcgtacagacatttttccgagatggctcgttttctctcgatacgtttttggctacgctacaacatggccgagttctgtcaacgatgcgccattcgtttttgcttggtttgtatgtaatcgccgcaacgacgtgcatcgcccttcctcttgcgttaatccgaaccaaaacaaggctggccaagcacgattggctagatctcgtctttacgattccatttatgacgcctccctatattggttccatgggctggattctgtttatgcaaaacaatggctattacaaacagctgtttgcaacaacagcgccgtcctccttttttaacatagcgggcatggttttnattatgagcatgcacttatacccgtttttgnattngatgctaaaaaatgcgctagtccgaatgaatggtccttttcaagacgcaacgctcctattatgggacgaancccaatcagnaacctggatccg

SEQ ID NO: 7284 - DNA, 402 bp, Bacillus clausii
gaaaaggagaggtgggtaaaatgaagcgttatacaattgatacaagcaaacatagtgacatgattgacattaccgcccaagttgaagcggctgtcaaagcaagtggtgtccattcaggtatagccattgtccagtcgttgcatacaacggctggcattaccgtcaatgaaaatgctgatccagttgttgtcattgattttttgcgccgccttgatgaagttttcccatgggaacacccacaggaccgccacatggaaggaaatacggcggctcatttgaaaacatcgactgtagggtcgtcacaaacggttttaattgacggtggccggcttgtgcttggcacatggcaaggcatttatttttgtgaatttgatggcccccgtgcaaaccggtcgtttgttg

SEQ ID NO: 7285 - DNA, 108 bp, Bacillus clausii
tcattcgcgaccccgcttaccgctggtttgcgcgaaaccgttaccgcttcttcggcaaacgagagcaatgcatgatcccctcccctgaaataaaaacgcgctttttag

SEQ ID NO: 7286 - DNA, 198 bp, Bacillus clausii
tcagcattcggatggtttactagtcatgctgatgtggggaatttttgggtttgcgttattgttatttagctactttatttttgaatttctaacaccaggttttaaagtcgacgaggaaatcaaaaacgacaaccgcgcagttggcttgctgtcactgctgctgtctgtcggcctttcgtttgtcattagtgcaagtat

SEQ ID NO: 7287 - DNA, 109 bp, Bacillus clausii
gtggcgaggattgcaatcgttgaagacgatgcatggatgagagaagagttaatggatattttgaaaaaagaaggatttgatgtcgtagcggttaacagattccatgaac

SEQ ID NO: 7288 - DNA, 231 bp, Bacillus clausii
gattttatttgccgacaatgctgagccaaaacttcggccgaatccttttcatcgcaagcgaagagccgtcatgccttcaggacttatgcctcaatatgccgcgactaaatcgatgctgctgttcattgggaaagaacgtgtccaaattaacagcaggtgccgaagtgacagtcaatactatcctgccaggtcctacgctatcggaaaatgtagctcaaatcattgaagggc

SEQ ID NO: 7289 - DNA, 387 bp, Bacillus clausii
  misc_feature (1)...(387): n = A,T,C or G
atgctgagccaaaacttcggccgaatccttttcatcgcaagcgaagagccgtcatgccttcaggacttatgcctcaatatgccgcgactaaatcgatgctgctgttcattgggaaagaacgtgtccaaattaacagcaggtgccgaagtgacagtcaatactatcctgccaggtcctacgctatcggaaaatgtagctcaaatcattgaagggctgttccttggaggangaaccgtcgttgtccttttccgaaaaagaaaaaaaatttatggcctccaatttgcctcagtccgaaattcagcgcttcatcaggccagangagatcggcagactcgcagcttttatgtgcagccctcacgcctcagccttcaaaggctccccgattag

SEQ ID NO: 7290 - DNA, 202 bp, Bacillus clausii
atgggctactatgatgaccaacaagaaacgcgctaccgtgagccaaataaaagctcaaaaaaagtggctggtttgtccgcgtttggcggtgccattatcggcggtgcgcttgtgttaattgcttcaccaattatgtcgagcctcggccttggcatagatgattcagcaagcgaaaacaacaacgccaatacagaaccgaata

SEQ ID NO: 7291 - DNA, 790 bp, Bacillus clausii
  misc_feature (1)...(790): n = A,T,C or G
atgaattggagtcgggccaaatccatttttattgtcacgtttttgctgttaaatgtgtttttaggcatacagttgctggacaaaatccaacaagtgcctgatattgagcaatcaagcgacatcgaaaagcggcttgcggataacaacatctctctcccgtcgaaagaaatcaacattgttggcgcgaaaggcgttgtccttgaaggaagatggacaaccttttcagaagcagaactagacggtcttacagggcagacggcgacgttgtcccaatcacnggaattgattaaagcggcttttgatgaaccgattgatctatcggatatcctggcaacgacaacaacgaaacagcggaacaaaccgactatgctgcttttttagcccagcatattttgcacgggtatgactatgtgttttcaccgcgagaagnatcgtacctttatntaaccagctatataaccaaacgaaacgttcgtcaacgaggacgcacctctcattttagaactcgatgaagacgacaaggtcattggctacacacaacgccatttcacctttgaagaaaacccagatgaacggaaaatgattacgtacatggaagcagtcgaaacgctgctaaacaaccattttattaaaagaaacaatagcattgttgaaattgattttggctattatagcctagctgaacaaacgcctcgtttcttttcgcctatgtgggaagtgacggtgaagggcaacaccgatgaggaggacgatgtacgcatttatttagtgaatgcgattttaggcgaac

SEQ ID NO: 7292 - DNA, 957 bp, Bacillus clausii
tcggacaattacattctcaaatccagtgtatatccaatcgagcggtacggcagtcggcccaaaagaaggagcagggccactggctggctcttttgactaccgatacacggatatttattgtaatgaaaaaagttgggaaatggcagaacgtgcattgatggaaaaagcgattaaacaatgtttaactaagaaccatttatcgatagactctgttgatttgtttgttgccggagatttaagcaaccagacgaccgcttctagttttgtcgcccgtgatttgcaattgccatacatcggtacatattcagcatgcgccacctctgttgaaacgctaatcattagcggcgtatgggtgtctagcgggttagccgatttggtactcgcagcggcaagcagccattacggcgcctgtgaaaagcaattccgctatccaactgaatttgcagtccaaaaaccagaaaccgcccaaacaactgtaactggagcaggtgctgttctactggggaagaagcgtacgcaaattcaattaacagaagcaacgattggccgtgtccaagacctaggcatcaccgatccgatgagtttaggggcagcgatggcaccagctgcagctgaggtgacaatcggtcatttgcacaaaacgaatcagcaagtaagtgactttgatttaattgtgacaggtgatttggcgatatccggaagtgaaatttaccggaaacttttgcgagagcaaggcatttatataaccgggcgttatgaggactgcggcgtcatgatgtaccactctaagcaacaagcattagcgggggggagtggcgcaggttgttccgcatccgttgtatatgggcatatttaccatcgccttctcgccggagaactaaaacgtgtccttggcgttgcaactggggcccttctaagttcgatgaccggtttacaaaagcaatcgatcccagcaat

SEQ ID NO: 7293 - DNA, 333 bp, Bacillus clausii
  misc_feature (1)...(333): n = A,T,C or G
cggtcnagtcagaaagtccaactgaggccacacttttgacgaatagcattgcgactgtttttcaagagcaaattcccgatattatgagcatcgacaatgtgagcattctttcggaagcagaaataggcgaagacccaacgccggtcagcccaaaaccattgttaaatattgcaattgcttttgttgtcgggcttatggcggcagtcggtttggccttcttgcttgaatacttggatacaacaataaaaacagaaaaagacatcgaaaacatcattgatttgcctgtgcttggcgctgtctccaatatggacagcgttgatgcggctgcaaaaa

SEQ ID NO: 7294 - DNA, 414 bp, Bacillus clausii
ggacactcttgcttttggcagacccgtctgaaaaacttgtccaagactattgcccgcgtggcacatgctatgtagcagaggatgaagaaggcacaattattggcgaatatgtgttagtgccgacccgtccagatacggttgaacttgtcaacgtagctgtagaagaggctcaccaaggcaaaaaaattgggaaacagcttgtgtctcatgcggttgcaactgccaaaaaagcagggtataaaacaattgaagtagggacagggaactcaggagcgagccaattaatgctttatcaaaaatgcgggtttcgcatcactcatgtggaccgtgatttctttgtgcgtcattacgaacagcctattgaagagaacggtttgccatgtgtcgatatgatccgcttgtcgcaagacttat

SEQ ID NO: 7295 - DNA, 510 bp, Bacillus clausii
  misc_feature (1)...(510): n = A,T,C or G
atgattacatttgtcgtgccaacgcttggtgaacgatgcaacgaatttaaacgattgcttgtcagtttggataagcaaacggataaacggtttgagttgattgtcgtgtctcaaggcaattacgaccaagtagagcaatggctgagcgctttccagttgcgctcgacccatattcaactaggggaaaagggcttatctagagcgagaaatgcagcttggccagcgctgaaaggcgacattgtctctttttccgatgacgattgctggtacccgcctgatgcagtcgaacgggtacacagcgcgtttgcgcaagagggcgctgatgcctactgctttcaaatttatgacccgatccaacaaagcccgtataaacactataatancatcgcctggtactgtnccgaggacgacgcgtttggaaaaagtccctccattgagctgtttttccgccagtcagcgattgaatcgctgcgctttaatgaagccttcgggcttggtggaacgtatcca

SEQ ID NO: 7296 - DNA, 213 bp, Bacillus clausii
acaccggatcaattgaatttgtcggcaccgctcttaaatttagaagccagggggcagcttctcatctaatcgatacgatcatgaaaatgacaccgtttgagcaatacattattgaggaagtagccgataccaacttgcctgccatgaaattgtatcgcaagctcggctttgaagaatacaaacgaaaacagctttccacctctgcggctaaga

SEQ ID NO: 7297 - DNA, 132 bp, Bacillus clausii
  misc_feature (1)...(132): n = A,T,C or G
gcaagtaatatgnaattgcangctttgaatcctactgaaaagctttaaagaagcgcgtcaaagagatgtgtaagaaattgcttgccaataccgttattgaagactaccgctttgaagtgaagaaggttgtcc

SEQ ID NO: 7298 - DNA, 890 bp, Bacillus clausii
atgacggtcaaaatcaatgaaaaccgtatttctcagtattattttgatagagcggatacagttgcaaacacgggtattttgttccggtcgtctcatacagcaaatggctggggcgaattttaccgaattgaaacaacggccggtgcacaagcgaaagttgacgctcatgcaaacaacaaaaataatccccatgggacaacgaaggctcacgttggtctgagtaacgtcccaaactggagtggagcaactcaagccgaagcgcgagcagggacaaatgactctaagatcatgacaccgctacggacaaaagaatcaatcgatacttttgccagccaagcgacaattatccctgcattatctgccaatacaacaggtattgattaccccttggggctgaccacgttcatgcattcgaaccttggttatcctacaaatcacggtacaatacttaacattaaagtgtctaacttacggtttacccaatggtatttccctcattctataagacatgaggaaatcggagcttacttccggcatttttacgacggggatggctggactgactggcagaaagtagcaacatacgcagaggtaatcgatctaattgatgagcacgccgcgagaacggacaacccgcacaaggtgacatcacagcaagtaaatatcatatctcctcgaagagcagatatacctggttcagattatccaacaggagttactctattttcccaaactaacggacttagtaatgggtatcctgaaaatcttgctgttatagtgactgacaaggtagaaaactataggatggtccagacatgctatagagctaatggtgattctataaatgcaatgtggttacgcaagtggagacccgatctacccgatacggg

SEQ ID NO: 7299 - DNA, 381 bp, Bacillus clausii
atggatttccatgataagcgcaatcaaaacagctatagcggccgcaatgccgattcacggtggcttacgactattgccaaccatctgtcacggaaacacatcgatattgccgctgacattggctgtggtggaggaatctacacacgagcgctggcaatgatcggcatccctcatgtcatcggcatcgattcgtcagagcaaatgctcgctgatgccaaagaggcctgtcgagatttcaaacaaattgagcttaaaaaaggggattgtgaggaccttccactcgcaagcgggtcgattgatttgcttttggcaaagaacgctcattcaccatttgccaagcgtgcagcctttttttcaagaagcgtggcgcacattagctga

SEQ ID NO: 7300 - DNA, 642 bp, Bacillus clausii
  misc_feature (1)...(642): n = A,T,C or G
gagcaaaggacttatcgcaaattggcgctgcctgccctgaccatcttgtccatacgaagcgattgcctttgtttatcgattgggtgcctgatgcaagtgacgaagaagggttgaagcaagcggtgcttaacggaatagctgcatacaaagaggaatatattcgctattttgagcgcaaccgccgtgaaggcgacacgatgtttgaaccgtcgccgcgcgtgttgctcattccaggcatcggcctgattagcagcggcaaggcgattgaaaatgcgaaagtgagccgcgctctttatgaacgagcgattgctgtcatgcgtggaacgagtgcgttaggctcatttgtttcactaaatgaagccgaatcgtatgaaattgaatattggccattggagctttacaaactatcgcttgcgccaaaagaagcaattttttcgcggaaagtggcgtttgttacaagggggagcaaggggcatcggcagcgaaacgtctcgggcaattcgctgctcaaggcgcacacgtcgtgttggctgaacttaatcttgaaagggcagaagaaattaccngcagaaataaatgggcaatccggtgctggccgggcgcttgccctaaaaaatggatgtccaaatgaacaagccattc

SEQ ID NO: 7301 - DNA, 468 bp, Bacillus clausii
  misc_feature (1)...(468): n = A,T,C or G
atgggtggagtgatggaacagaaagaactatttgaactcccagagctagataaacannaaacaaaggaggctgtagaagaagcgtttgttaaataccggatgtacaaatacttgcnattcgatgatcgggaagctgctattacatctccctttaaagacgttgtagtcaaaacgagtgggaccagcgataaaactgctgataccgccatttataacgcagacatgaaggaataccaaaagcgtttttgcgaaaagcttgaacgcgtcgtgaaacatcttccttcattagaacagtttcttgttgagaagcgttacatggacagaaacgcggagtatatgaccgatttaaaaatgtacaactttgtatttcaaccgcctataagcgctaagttttattacaaactacagcgcaatgcattctataaaattgcacttgcaatgaacttcaatgtagagaaaaacaaataa

SEQ ID NO: 7302 - DNA, 283 bp, Bacillus clausii
atggtggccaaaatgcagattccggttctcgcgttgtgggttcgaatcctgctaggcgcgtctttaaaaaacacatcagtcgatgtgtttttttatttttgcaaaccggcgcaacagccaaaacagaaaaagcccgttccaaacagggaatgggctagcctatttaaagtaatccaaccatttttaagccataatcaatgccattttcatgcacaggctttgttacgtagcgggcttgtgctttcactttttcaggcgcattgcccatcgctactccatgctc

SEQ ID NO: 7303 - DNA, 601 bp, Bacillus clausii
atgatgagcaaccttacagctaaaagctttattgatgagttgcaactccatcagaatgaagcggacaaagaaaaaatgaaaaaattctttaaagggtcagacaaaaacacgacgtgcttagggttaaacatgcgtacggtgttccaaattgccaagcaattcacggacatgcccctgacagaaatagaacagctcttagaaaacgattattatgaagtaagaatgggcgccgtcagcattatggatttccaggccaagaaaaagaagctcacagatgaacatagacaggccttgtacgacctttacattcaaagacatgaccgtatcaacaattgggattttgtcgaccgcgccgctccttctgtagtcggaacatatctactggataaaccaaaagataagctgtacgaaatggcgcattccttgaatatttgggagcggagaacggcgattgtaagtacgtttagctttattaaaaacggccatttggaagatacattttctattgccgaaatactcatcaacgataaacaagagttaatcaacaaagcggtcggcagttttattcgtgaagccggaaagagagacgaggaaaagttaa

SEQ ID NO: 7304 - DNA, 930 bp, Bacillus clausii
atgccagtaggcactgtggactttggccagcctagtgttgtgaatgaagaaggtggtagcaagcccgctccagtggattcgacaagttgggatttaggcaaaaccacgacgggtgcttcccatgcagcgttgaccgaggcaacatcgagtgcagaagcaggtgagcggttagagaaacttgcacaggtgccggaggaaaaggacagtgctagcggtaaacctgctgtaagccaagatgaacttaaagacatagccgttgatagtaaaacaagtgaaaaggaaccgtcactccggcaagtcgctcctcctcctttacaggacatagagacggaaccgactaaggaagaaaaccgagcatttagtgataaaaatcaacaaatggctcctgaccgtccggcccctttgccgcaaggcggcgacaaaacagagcctgaaaatagggcggagtcgctgaagcaggaacaagaagttgcacctttaacaaaggagaaggcaaatccaagtgacgtgataaaagccagcacgaacgatgcagagtcgcaagtcgtttcaaattcaagcgtgaaagacgagtctcctgctaggacagaagcagagcagacccaagtttttaaaaatgaaccaaacaagcttgctaatcatgaagaaaatgagttacatactgggcgaaataaggcgacaacgttagccgattctcaggcagaaggggaattcgtacaagcagactctaacaagcgaatcgttcgtgaaaaggagccaagcactgcgccgcgcatcatagagggtcctaacaaacaaccgcataacggcacaggaatggctagcactcaaacaggaattgaaggaagcgttgctgtagaagccacgaaactaccaagtgggaaaagtgcgctgcctcctatgctggctaagcagctcgaacgagtgcta

SEQ ID NO: 7305 - DNA, 240 bp, Bacillus clausii
gaattgaccggatgctaaaccagcttacgctcgctggaaagcttgatgatgctgcagggtttgttatcggcagctttaacggctgtgagccgaaaaagcgccaacattcatttacgctgcaagaagtattggacgattatttttctggatctggcaagccgtgcataagcggctttcaaattggccattgctcgcctgcattttctgttccatatggagccagggccgttttagatacag

SEQ ID NO: 7306 - DNA, 681 bp, Bacillus clausii
  misc_feature (1)...(681): n = A,T,C or G
ttgggttaggaattgtcgcggcaggaatcggactcttatttgccctctttattaaggaagtgccgcaagaaatagagaatcatcgatctcaacgtttagggaaacaagtcaaggcagtgttgtcaatcaaacacctgctgccgttaacgtttgtttcattatttacacacgctctgttgtttatttctatttttgggtttacgcctgtttatgcaaatgccccacggcgttcgtgtaaggcccagcttattttgctaatggctgctttctttattccacacgctgctgcatctttaggcattgcttttttcaatgtttcaaagcgcaatgaaattcggttgattgtgctctctctcattgtcgcttgcttcacttttttttgtatgccgtttgctacgacactggcaacgatcagtctgttgcacggcgttattggcttaacagtcggcgtagtattgccgcttttgctctcacaaattgctncactcccgcagcctaccttaaaaacgtctgttatgggtttctaccaatctgtctatgcaatcggcatttttattggcccgtacggcgcaggctttgttgctgaacatattggcatcgctcatattttcacattagcaggaatcgtctcgcttctcgctttggcgattacaatgccacttttgcggcgagccaagaacg

SEQ ID NO: 7307 - DNA, 564 bp, Bacillus clausii
atgattgtcccggttgtcgtactggcaattgctgggcaacttagttatcccttttcgtttgcttggtttgaactgtgggtgagccttataattgccggaggaatcaccgtgctccttgctggctatttctccaagcgcatgtttgcccctttaaaaaaagcagaacaacagatcaatcttgatgcaattaaagaagggaaagctgcgagtcagctcgagaagctgcttgaggcgcttacggtaaaagacaatcaagaaaagaacaaccagctaactgcaaaaacaactaccgtttccgcacaattgcaagcatctgccgctgaaacaagcgaaggggtagcggagattgcagaagtgatgcaggaagtagcggcaggcaacacaggacaagtagaagctatccaaaacgtgaacagcacagctgcggaaattgtctttaacgtaaaagaagtattagaaagcacggaatttgtcgcccaatcttcgcaaaccgctttaactcatactaaaaacgggaacaaagccgtcgaaaatattgcagcccaaattggatctgattggtga

SEQ ID NO: 7308 - DNA, 174 bp, Bacillus clausii
atggatattcgttatgaagtcgggccaagagattttaaaacgtatacaacagaggaaataagaaaagctttcttagtcgaatcgctgtttgaagagggtacgctccatttaagctactcccactatgaccgattaattatcggcggcgctgttccaagccgtgaagcgattgcc

SEQ ID NO: 7309 - DNA, 348 bp, Bacillus clausii
  misc_feature (1)...(348): n = A,T,C or G
aacgaaaattgaagttagatcattagaaggtgaagaagaaaaaggcgaatatgtagaaggctatgctctgaaattcgaaaagtggtcagagcgcctttggtatttcaaagaaattttgtcaagaggttctcttgatgaaacggacatgtctaatgttatcgcttgttttaatcataatgagagctatccactggcaagaaatacggcatctggtgatactggaaagcttgaattagaggttgataacattggacttaaattcagatttaaaccaacatccacttcttnactcaaaagatttgagttgaaaatattcgcgctggaattattgatcnagtgttccttttc

SEQ ID NO: 7310 - DNA, 237 bp, Bacillus clausii
  misc_feature (1)...(237): n = A,T,C or G
atgcccaaagtcgggctgagtattatggaaatcatgcatcgcatttcangactaaatacngatggaatccgagcatttgaagagatgaacgcgatacctaccgtggataggcatgtaattttctctggaatnacacttttcctggatattttagaagaataccaacttgccaaagctggagcattgaaaggaggtggtgtaaaatggancaagaatcaaggagataacgccagctaa

SEQ ID NO: 7311 - DNA, 378 bp, Bacillus clausii
  misc_feature (1)...(378): n = A,T,C or G
ttggcacgtggcacataacaggnggatttcaacggactttaccattggccattntattaccgatcgtttcngatgccaaagtngtgatnatagcgattgnaacgtgatgggttgttgcaagacggcgatgccatgttcgccttacttatgggtcgnttccccatatatatttgccgagtatgaaggggggcatgcggagattgatttcccaattgagccgcagatttgggccaatcaaggcaatgtcattggtttttccacccatgacaataagcattatgctgcttatgcgccagatggatttgactggcaactgcaaggaaataagtgggaaaatgccgcatcgtttatctctgtggcgaaacttggccccaggaa

SEQ ID NO: 7312 - DNA, 84 bp, Bacillus clausii
ttgatttatttgactttatgcttccacattacaaacgggaaggaaaaagccaagttgtcattggaatcggctgtacaggcgggc

SEQ ID NO: 7313 - DNA, 589 bp, Bacillus clausii
  misc_feature (1)...(589): n = A,T,C or G
atgaaaaagaaggtcgttgtcataggaggaggaactgggctttccgtaattttgcgcgggctgaagacatttcccgtcgatattactgcgattgtgactgttgcagatgatggcggtagctcaggcattcttcgcaaagagcttgatatccccccgcctggggatgtgcgaaatgtgcttgttgcccttgctgaagtggaaccgcttgtggaagaactgtttcaacaccgtttttcaagtggagacgggctaagcgggcattcactcggaaatctgctgctagcaggaatgacatctattacaggtgattttcaaaaagggatttcggcgataagtcgagtattgaatgtaagagggcgtgtgcttccagcagcaaacgagagcattgtccttcacgcggaaatgcacgatggctcaattgtctcaggagaatcaagcatcccccttgcggctaaagggattaagcgcgtttacttgtctccggagcatgtctcgcctctacctgaaacgcttgacgcccttcangaagccgatttaattgtgcttgggcctggctccctctatacgagcattgtcccaaatttgctgt

SEQ ID NO: 7314 - DNA, 159 bp, Bacillus clausii
aagaggaattaattgtttttaaacgctttcaattataaacggtattgtgcattatggcaattggcgttgcagtggcagagcggagtctcgttatagccattgttgcgattttaggtattttcctttcaatgggactcggctttagccgcaggaaaaaaa

SEQ ID NO: 7315 - DNA, 390 bp, Bacillus clausii
ctgtcgcgggcaataaacggggctacaaaaaacacccccattttcaagtcgggttgtttgatgaccatctctttatttggctagcgtttatttacgagctgccggaaaaaggcaacatcgccaaaacctttttggaaaacaaaccgcttatagaagaggtcgtcccttctgattatgtcgtttccgttgaccacacaaaaaaagaagcaaacccattgtcagagcttaatttaacccaatctcttgaacggttccgcgacgttaaaaaagcagaatggctcgttggacgccattttgcaaaagggagcgaaacagtcgagaatggcgagcagcttatggacgctattcgcgaaacagtcaaaacgctgttgcctctttaccagctctcgc

SEQ ID NO: 7316 - DNA, 882 bp, Bacillus clausii
atgagcccattaatggactggttcttgcaagaacctttgttagaaaaccagctgatctcgttttctccaggaattggcggcgtcttgttgctcgtcgcatcagcgatcctgcttataggcgccttagttgcagcatggtggtttaaaaagacagtgatcgtcggaatgctgttagccgtatggacacttgtcacttacagcgggcttatgattagcgctggccctggcgacattccagtgaacttgacggtgcatgatacgattgaagaggcgattgcggtcggccatgaaaacgaacaagtagagttattggccgtatttgaagaggaacaagaagaagtttttgctgtttaccaaattaatgaacgccatttagcggcggaacggttgaaagtggaagacgatggctaccgcaagtatttggatgcttccgtcgaaattgaaaacggctttttaacaggcggtgaccaatttatggacacatttatgtttaccacaaatgattgggtagacaatgaacgggcaagtacgtatgtttctttagggtatgcagacaaagacattgaatctgtggaaattgagcttgatggcgaaaggcgtgaggcgaacgtcaaaaaccatgtctttatccatgtagaatcgaccaatgaaacgtttccagaggcccatcgctacttaatcaacccgattaatggcaaggatgtcgaagtggaaaaacgccaattttatccacgaagggcattcccattaatagaaaggaaggaactagcgtggcgcaagacagacaacaatccatccaggcagaagccgcgctctggcggaaacgtttggcaagaaacgacgcaaccgagcccatgtctgccaatgaactcgttgagctag

SEQ ID NO: 7317 - DNA, 297 bp, Bacillus clausii
  misc_feature (1)...(297): n = A,T,C or G
atggaaattaaggttacgaaacctgcgataaattggtttaaacaagagttttcggaagcagaagaacctgtcccgattcgtttttatggccgttatggtggctgtggatccttgcaaagtggtttttcattggggatgagccaaacggaaccaactgaaccggctgtcgtttatgaagaggacggttttttgttttttattgaagaacaagatagctggtattttaaagatcagcttgtccnggtgaaatatagtcgtaagaaggacgaaatcgaatttgaatatgaacaacagtag

SEQ ID NO: 7318 - DNA, 103 bp, Bacillus clausii
atgattgccgataagtttgatgtatttttatttgatttagatggggtcgtttatataggaccagacccacttcctgaggcagtagagtcgcttcaacaattac

SEQ ID NO: 7319 - DNA, 921 bp, Bacillus clausii
  misc_feature (1)...(921): n = A,T,C or G
caggtcnnctacttttnncagctgagtttcnnagctatgtnnncgagcgtnnattcnacgttcacctttgccgaagagcggatccagaatctaaagggatgattgnnaatgtagtgnnatacatanaaggcaacttcgctgncagtcgtgtgtttagagatatagaagattggaatgaacgggcaaggcaatggctcaagcgtacgggaaaccaccaggttcaccagacaacgaaaaaangaccagcagaagtgtttctcctcgaaaagcaacacttacagccagtctcttcgttactttcatatgaaagtacccataaccaaagtataacaagaagtgttagtaaggacaatacgatccggtacaagtcaaaccgttactctgtcccactggggacttatcaaaataggagtgagaatcttgtgtggattgaaataagggaagaagatcacaacgccctgatcatccgcaaagaagcaaatggtgaagtgattgccgagcataggatcagctctgaaaagggaaagctgattcaaaaccgtcaccatactcgtgatcgctccaaaggtgtggaagagtttaaacaacgtctcctctctcactttaaagatcaggttcaggcagctgcctatttagatgagattagccaaagatacccgaggtatcggagagatcagtttacaattattcataaggtgagccaacaatacccggctataattgatactgttttggccaagtgcacgacagaaaagctttacaatgcgaatgactttcgcgatatcgctcatcaccttgatgctttacgagatgagccgattgaagaagcacaatctttttacacgagtccgccaaaccattctcatctcaaagcctctacccgttctctaaatgcctatactagcattttaggaggtagaa

SEQ ID NO: 7320 - DNA, 858 bp, Bacillus clausii
  misc_feature (1)...(858): n = A,T,C or G
tgatgtttatggcaagcgggccaatgtttacagcaaggggaggaggcggagctgttttttgggtaacgcttgtcttgctgttggcggttaaagcatggaatatgttancggtgtggtatgaacaacgtctaacatccagaggagaacgggcttcacatattgttttaaggctattgttgaacacggctgttgcgtacttgctgtttgatcaagcgccttactggctcacgcttgcattgcttgtgttgatggcgtnattgtgcgtcttttatttccgaatgctgaaaacaaagcatgtactaanatgggatcgtttaattgaaatcgaaagcggaatggttttgtttttttaccggattgccaatgcctttacggatgtgcctcaacttcggaaaaaagtacgggcaaggacctatatgcaatgggcaattcctctgcttggcggcgacaagcgcgctgtttaccaatacttatatgcccggtcgtttattcgtgccaacgattattttggaacgtatgtccgtttattgctagtaggntcccttatcctttacattcttccttcaggctggatgcaagttggggttgctttcttgntnacccatatgacgatgatgcanctttcgacgntgtntttccatcatgccacangtatgtgggtcgatttgtacccgattaggccangggagcanaaaacggctatgtcgcagttagnattgcgattgttggctgtgcttgtgcttgcatttgccctnattgtctgngcctctacttnagtcatttttggcttgcttacacttgnngctactggngcactggcattttacggcagccagacgctcattcatcgcaaaagag

SEQ ID NO: 7321 - DNA, 258 bp, Bacillus clausii
  misc_feature (1)...(258): n = A,T,C or G
aacgggcttccaagatggttttgcgattccacatacacagtctgactcgattacaagaccagcaatnatataatcgtccgcacggaaacaggaattgagtgggaatcatttgatgggaagccacgcattcttttttatttcattgctcgtgccacatggagaagcaggaacaacgcatttgcaggcgttagcggctctgtctcgggctttaatggatgatgagtcgcgccnngcgttccttactgcgcaatctagtaa

SEQ ID NO: 7322 - DNA, 162 bp, Bacillus clausii
tgcagcaatcatgacatatatgtttggcgtgcaagtgccagcaccccatggaggctttcttgtactgccagttgtgactggagcggttaagtgggtgatagcaattttaacagggtcggttattggcggggtcttgttcgggctataccgtaaaaaaatagc

SEQ ID NO: 7323 - DNA, 348 bp, Bacillus clausii
  misc_feature (1)...(348): n = A,T,C or G
aaatatcattggcgcccaccaagctcttctttattttgaagacgtccgcattatgaaagatntgcgcaactctgttaaccggcttgtaaattgtgaaacggctaatttaaacaaaaccgttggggctgnccttngncaagtagagaanattctatttattgataaaacgattggcttggaaaacttgccgccaaaactacaggaagtcgattaagcttcccgagtgaagcatcaagatgtgacgttgaaagaattaggggaaatgatgcagggcggaaaagtgagcaagtcaggtataaaccaccggctccgtaagattgacgaatttgcggacaagctccgtaacgg

SEQ ID NO: 7324 - DNA, 306 bp, Bacillus clausii
atgcctgctttcccggtaagtaagccgttatcttctatccgactgattggtttcgctaaatactcctctatccaattaatcatttgctcatttatatcgcctgtctgcttaaaggcccataacgctcctgctcccccatttaacacatttcgttttccattttcatattcatattgcctaatgtcgccattgattaagcgaccgtcttgcgttaaatttttgcttatcccccttttaagcccggcaatgattgaatggatgtcatcattcttggtccttttacttatgactaaaggagtcgcttct

SEQ ID NO: 7325 - DNA, 309 bp, Bacillus clausii
cgttgataccgtcccaacttttgttttctttaacgacaattcggaagaagcaggcattaaaatttccggccagtatccattttcgatttatgtccagttattggaagacatgcttggcttcgtaccagtaaaagccactccaccgactctcgagggattgttgcaaacatatggttttttagccactgcggaagtcgcaatggtcctggatttgagtagtgaagaagcagaaaaaaagctaaagacactcatgttacaacaaaaagtagaagccgtcccttatgaatacgggactttttggaaatggtt

SEQ ID NO: 7326 - DNA, 195 bp, Bacillus clausii
tttttgaccgtatcgcgcttgctgtagagcaaggcgtgaacgccggggaaatcaaggctcactataaccggttcaaaggggtggtacctgctaagtctgaagaaaaacagctattccgggaagtagatgagcaactgggtatttcctgttataaaatcgtgaagcgagcactggaagcagcggaacatgagctta

SEQ ID NO: 7327 - DNA, 426 bp, Bacillus clausii
acgtagaacgacaaatccgccgaatgatacgtggcttgctgttgcgggcaataaacggggctacaaaaaacacccccattttcaagtcgggttgtttgatgaccatctctttatttggctagcgtttatttacgagctgccggaaaaaggcaacatcgccaaaacctttttggaaaacaaaccgcttatagaagaggtcgtcccttctgattatgtcgtttccgttgaccacacaaaaaaagaagcaaacccattgtcagagcttaatttaacccaatctcttgaacggttccgcgacgttaaaaaagcagaatggctcgttggacgccattttgcaaaagggagcgaaacagtcgagaatggcgagcagcttatggacgctattcgcgaaacagtcaaaacgctgttgcctctttaccagctctc

SEQ ID NO: 7328 - DNA, 468 bp, Bacillus clausii
aagaaaaagtgctagtattgctaggcttgattgtttgtcttttgttgattgtcggttttgcgacgaacggcctttcaaaaccagaaacggtccaaggcaacgcatctgatcaagaagagagcaaacatgagtcgcaagagatcagtgatatcgagattacgttaaatggttattctgtaaaagaggagaacgaggaagaactgttagttaaagtcgatttaacgattgaaaacaaacgggagtcgaccgttaatttttcgttgatgaatttgacattaatggacagtgaacattatgcgtatagccatgaatcaaatgtagaaacaaagggcattctcggtggccaaatttctccagggcggtctgtaagtggcgaagtggcctttattgtcccgaaagatacttcttatgaactcgtttatacggatcattttcggacgggccaattgttttttccaattgaagtaa

SEQ ID NO: 7329 - DNA, 324 bp, Bacillus clausii
  misc_feature (1)...(324): n = A,T,C or G
aaggctcttcatggaagtattacgattataaagacaatgaacttcctgatcaaggctggaaaatccatattagtacttacataaaggaagcaagggcagtcttaaaaacagtgagcaacattatgtttaagtataaagtggcgtttaaacatttgaaaacggaagagttcctcattaatacgaattccaaaaatgccgatagggctaggtcgggaaaatttatcgccatttacccgaaagatgatgaagaatttctgtatttattggaagcgcttgaaacggaactacgttcgtttgaaaagggcccttatattttgaatgacn

SEQ ID NO: 7330 - DNA, 277 bp, Bacillus clausii
  misc_feature (1)...(277): n = A,T,C or G
ttgcttcaagctttagatgaaaccgggcgtcttatttgttttacagataagcgcagtcattcagaatggcggtacttacaaaaatcagggcgttttcgttgtccaatttgcaaccaacaagtaaggatgcgacttggaacaaaaagacgttggcattttgcccaccaaaaaagtgagacgtgcccttctggaagagaangggagtcggatgagcatgttcgtggaaaacaattgctttttcactgggcgggcaggcagaacaaagcaacacnattgg

SEQ ID NO: 7331 - DNA, 947 bp, Bacillus clausii
cagtcaagcgaaacaatggaagcgttttatgaaaaagaacaacaattttgggttggctcgacaggcaatccagccaaaacagacagccaggcagattggcctggcatggcgcactggtttcccgcaaaaagcaccgctacgtccgtaccatttgtgactcattttaatacggggagcggcactcagtttgtggcagaaggaaaaaccgtttcggaacaggaatggaataaccgcagccttcaagatgtgttgccgacatggcgttggattcagcatggcggtgatttggaagcagcattttcttgggaagaagcgtttgaagggggaagctcgttacaatggcatggctcattagcggaaggagaacaagcgcaaatcgagctgtaccaaacagagttgccgataagcgaaggcacttcgctaacatggacatataaaagcgagcacggcaacgatttaaaagtaggtttccgtttagatgatgagaaggaattccgttatgtggaaggagaacaacgggaatcgataaatggatggacgcaatcgacgtttccactagatgcgtttgctggtcagacgataccagggctggcatttgcagcagaagggaacgagactgggctggcagaattctatattggacaactggcggtagttgctgatagcgaaaagcctgccgctccaaacgtgaaggtacaccagtacgatccagatccaagtggtattcagctcgtttgggaaaaacaaagcgacgtccaccattaccgcatttataaggaaacaaagcacggcaaagagctgatcggcacatctgctggagatcgaatttacctagaagggctagccgaggaaagcaaacaaaacgacgtgcgtctgcatgtggaagcgctgagtgaaacattcgtgccaagcgatgctcgaatgatcgacataaaaattcgctcatt

SEQ ID NO: 7332 - DNA, 664 bp, Bacillus clausii
atgaaacgggcacgattaatttataatccaagttctggccgtgagcaactaagaaagaacttagcctacatattagaacgcctggagaaggcgggttatgaaacgtcagcacacgcgacgacagcagaggaaggctgcgcgacacgggctgcccgccaagcaggagaacggggctttgatctcgtcattgctgctggaggagatgggacgatttttgaagtcgttaacggactagcgggactggagaaacgcccaatgctcggcattatcccagcagggacgaccaatgatttcgcccgggcgcttggcatttctcgagatattgaaaaagcatgcgacgttttgtgtgaaggccactttgagccgattgacattggccgcatgaaccagaagtattttaccaatatcgctgccgcaggaacgttaaccgagttgacatatgaagttccggcaaagctaaagacaatcgttggccagctcgcttattacattaaagggctggaaaaattgccacaagtcaagccgacttttgtcaaggtcgaatatgatggcaaacagtttgaagacgaaatcatgatgtttttgatcgccaatacaaactccgtcggtggttttgaaaaattatgcccagccgcttccattcaagatgggttgtttgatttta

SEQ ID NO: 7333 - DNA, 396 bp, Bacillus clausii
tgtttacgttgatgcggattcttgcccagtaaaagaagaagtcatttcgcttgcgcggacattcggcaaaaaaatggtctttgtttattcttatgcgcataccatgagtttgccaaaggatgtagaaacggctattgtcgatacgagtaaagaagcagcagatctttatttgctgcaatctgtccaccgcggagatgtctgtgtgacgcaagatcatgcgttagcgtcactccttcttgtaaaaggtgtgatcgtgttgtcgccccgcgggcatgtgtataaagaagaggaaatgccagctatgcttgcatggaggcatacctcacagaaagcccggagagctggggaaaagacgcgtggcccgaaaaaatttacagcatctgaccgcgccgcgtt

SEQ ID NO: 7334 - DNA, 366 bp, Bacillus clausii
agcagtcggggcatcgattggtgatttgtttattgctggaatggtccctggcatccttattggcattggtctaattttaactgtttatataattgccaaaaaacggaactatgcaaaaggagacaagaaaagtggaaaagaaattggcacagcgtttgtaaaagcgattccggcactgattatgcctgtaatcattttaggcggtatttatacaggtgtgtttacggcaacggaggctgccggtgtagctgttgcctacgcctttattgtaggggtgtttgtctatagggcgatcacgtttacgaaaatcaaaatgattttgtcacaagcatcgataacgacggcaaccattatgcttattttggc

SEQ ID NO: 7335 - DNA, 456 bp, Bacillus clausii
cgttttacttgtatcgttactcgtcctcttctttatcggcgtgccagtagcgattgcgctcggtttatcgacgagtatggccatgattgtagcaggcgatgttcctttattaacgcttgcacaacgagcgtttgtgtcactcgattcgtttccgttgctggcgattccattatttattttggctggcgtcatcatggaatacggcggcatttcgcaacggcttattaacctcgccaatgcccttactggccatttaacaggaggactagccgttgttacggttgtgacaacaatgttttttgccgccatatcaggctcaagtgtcgctgcgactgccgctttaggggcaattttagtgcctgcgatgattagcagaaggtacgaaaaagaattttcaggaagcgtgcaagctgtatcagggacacttggcataattaagccgccgagcatccccat

SEQ ID NO: 7336 - DNA, 444 bp, Bacillus clausii
agatactagatgcttgctgtggtagcagaatgttctggtttgataagagtcacgaagatgcaatttatatggacaatcgcgaattaagtacaacgctgtgcgatggtcgaactttggaagttaagcctgacgtattaggtgatttcagagatatgccatttgatgatgatagtttctatttagttgtgtttgatcctccacatttgctaaaagcaggcgaagaatcgtggttagcaaagaaatacggaattttatcagttgattggaaggttgatataaaacgcggttttgaagagtgtatgcgtgttttgaaaccaaatggagcacttatttttaaatggaatgaggaccagattaaaactagtgaaattataaaagtaattggtcaaaggccgttgtttggtaatcggagagcgaaaacccattggatggtttttatgaaat

SEQ ID NO: 7337 - DNA, 489 bp, Bacillus clausii
  misc_feature (1)...(489): n = A,T,C or G
tgtgcatatttttagttatgccgctacagcccttgcaaatgcctggtgatacggattgggaggtcgagcaagcgagtgtcatcgtcaacgtccgtacaaatacgctcgcgttaattgaagccaaccacattgcggaatttcatcctgtcgccactgggaaaaaaggggatgaaacgccccttggacagtttacggttttagttaaagtagaacagccttattaccgcaaaaaaaatattcccggtggagatgcccgtaatccattaggaagcagatggatcggttttgatgccttaggaacggcaggccggacatatgggctacatggcactaaccgaccaggttcaatcgggtatagcgcgtctgcaggttgtattcgtctcgcaaatccgacgattgaacgactttacgaaaaagttgacatcggcagcaaaatattcattgtcaacgaacatcgctccttccaagcgattgcnaangaancggggc

SEQ ID NO: 7338 - DNA, 693 bp, Bacillus clausii
atgcccgtctatgttcgctatattgaccttagtgggtatacgtacagttatagcttgccagagcgtccaaatgggtatgcggtgtttgtgatggcggacgatgactctccttataaagaaaaggcacgtgtgcttgcaaacagcttgattgaaaaaggttacatggtattaacagccttccacctaaaagcacattggggttcgccaaaagcggttgctcatgccagacaggttatttcccttttcctaaaacaagaaacggtgaataaacggatttttatttgtgctgaaggggcgagtgccctaattgccaaacaactactagcggatgcaacccttgaagtgagggctgctgctttaatcaagccagtgttgtcattagaagcggcccttcaagcaatcaataaagacgaattggctggcaaacgttttttaaaggaagtcaaagcagcatacgagataaatggacaaatcgatgtcgcatatttgcgggctcttgaccagcagcagcgtttaatcgatcgcaaccgcccacttgcggcaacacgtatttatcaattattttctgaagcaacagcacaaccgaccaacctttcaagcgcccaatatgcagactattactttttagcttctttacaaaacccagctgaattaagcaagcaaatggcttccttttttgcttctttccattga

SEQ ID NO: 7339 - DNA, 252 bp, Bacillus clausii
cagataaaacatgtaaggtctctggagacatcggaaattacttcccaacacgcgtggcaaatcattaaagagaagtttactctgcgacaaatgttcactggctagctgctgatgagaaggtggcaacatgcatttacacgtaccggtatgaaggataccataatggcaagtttgtttcaggcagtggcagggcaacgaatgttttcaccgtctacgatggcgaatggaaattaatacatgaacatttaagca

SEQ ID NO: 7340 - DNA, 197 bp, Bacillus clausii
ttctacacagcccagtccagactattcggcactgaaattatgggtgaagtggtcaagacctcactaggcaccttaaaaatagcgcaccctgaagaagatttatttgaggtagcccttgcctacctagcttccaagaaagatatcctaacagcacaagagcggaaagatgttttgttctacatccagaacaacctctg

SEQ ID NO: 7341 - DNA, 294 bp, Bacillus clausii
  misc_feature (1)...(294): n = A,T,C or G
ccaagaaaagtacgagcgccttgagcgcttaaaggatgctcatcaaaacaggcagaggcaatttcagggtgagtggcaatcgcttttccgacaagcgacattgtttaatgctgcgcttatggaacanacgcnncantggctggaaacccttcanccaaacttccgtgtcggttggtttttttctaaaaagaaaaccgaagaagagcggatgcggctccttacacagctaacacgagcgttagacgatcaaatccagtctcagcttgtttttcatgtcaaacgttctttgcaaac

SEQ ID NO: 7342 - DNA, 363 bp, Bacillus clausii
cgtcgacgtggttgtgttaggggcaggaaatgccgccctttgtgcagcgattgctgcaaaagagcaaggggccagcgtatgtatgttggaacgggcgccaaagaacaagagaggcggaaattcgtattttaccgacggagcaattcgttgtgcgtatggtagctttcaagatttgcgggccgttctcccggacttggatgaggagcaagtcgagcaaatcagcatgcctgactatggagaagaagcgtttatggccgacctgctgcgcttgacggaggggcagacagatcgaaagttagcgaaccagctcgtgtcacgctcttttgatacgattcaatggatgatgaagcaaggcgtgcaatt

SEQ ID NO: 7343 - DNA, 791 bp, Bacillus clausii
atgcagcactgtcgagagacggatcaaccaagggattgccgacacgttggcaagtggagtatgtaccaaggatctaggcggaacagcaagcacgcagcaatttacagatgttgtttgcgagaagatcgaggaggcggaatgatcatgagaaaaacagacgtcgacgtggttgtgttaggggcaggaaatgccgccctttgtgcagcgattgctgcaaaagagcaaggggccagcgtatgtatgttggaacgggcgccaaagaacaagagaggcggaaattcgtattttaccgacggagcaattcgttgtgcgtatggtagctttcaagatttgcgggccgttctcccggacttggatgaggagcaagtcgagcaaatcagcatgcctgactatggagaagaagcgtttatggccgacctgctgcgcttgacggaggggcagacagatcgaaagttagcgaaccagctcgtgtcacgctcttttgatacgattcaatggatgatgaagcaaggcgtgcaatttgcagtgaatgagaaccaatattatgagaaagacgggaagcgccatttttggggagggcttccgttgaagacaaaaaacaaaggagtggggctggtccaagctttgtttcaacgtgccgaagcacttggcatcgacatcaagtacaacgcaaagacaacagcgttaaaacaagaaggccaatcaaaaaagataattgttgaaatagcgggagaacctgttgaaatcacagccaatgccgtcattttcgcctgcggaggatttgaagccaa

SEQ ID NO: 7344 - DNA, 402 bp, Bacillus clausii
ataaaatctattttgctgacagcgacaaaaccgaaattgaagatggtatgagaattggcattgactcaaaatcggctgaccaaagaacgttagccgaagcggaagcacaaggaaaaaaggtaacatttgtagaaacgacgtacatgcacttgctgcaaagcttagaagctggattgatcgatgcgaccgtgtggaatgcagacgaagtgcagcgtccgacactttatgcaaaagaccttacctcttctcttgcagtcagaaactcgcaggagattagtgaaacggcgcttgtcgcccatggcgataaacaaacaatttcttatttgttaggattaatagacaaacaagaactgttaacgatccagaagcaagtcgttgaaggggagatcattccttcttatt

SEQ ID NO: 7345 - DNA, 330 bp, Bacillus clausii
tgtatacacgtttgcagattttaaaagaagcagggacaatcacggacaaagcataccgtgtcaccacccaagtagtggacgagcaagttcctgacgacttgcatgagaattatgcgatgttagtgacccatttggcaatggcattgaccagaattgaacagaatgaagcgttgactggtccaggggatgcggtcatggaggaagtccttgcttccccacacttgcctgcatctaaggaagctgtggaaaaaatcgaatcccttgttggcgaaccgctccctaaagaagaacagcagtttctctatatgcattttgtgagcacattttcgt

SEQ ID NO: 7346 - DNA, 504 bp, Bacillus clausii
  misc_feature (1)...(504): n = A,T,C or G
atggcaacagtggtagggccagtttcggcaatgttgaagatacagaatggcatacacttgaatttgatgtggttgtgttgccaggtcaagcaggggaaagatattgagaatacagccgttgtcgatggcgacaatatggacgagccagatgggccgcgagaagaagtcgaaatctacccacgtgagccaaagcttgagtcaagaaaatcagcaacaaatgcggatgaaagcaaagacggctatgaagttggcgacacggttgtgtacacgattgaagcgcgtaacacggtagaagatagcttgtttgaaaacctcaccattacggacgaacttccagaaggggtaacgtttgtggaaggcagcttggaagtcagccatggtggtacaggaagctttgaagacggaacggtaacggctgagttgggcgaagtcacagacaccgantggcgcacanttacgtttgaagcaacaattgatgctggctatgttagccaaaccatccat

SEQ ID NO: 7347 - DNA, 282 bp, Bacillus clausii
atgttcatcaggagcaagagatcaacaggtgccattttcgacaatcaacccgaccgcaatcaagtgagaaacgtcacagtgacaacgattccgctgatcgtcgtatcattgataaccgtagcaagtacaaaacaattgctaatgaggaaaacgacaaacgcagcaagcctcacgatcataacgaaaataaatacgacaacggccaagacggcgggctggagtccgttgaagataaagaggaatttacccattcagctacgtacagccaagtattttcgctaa

SEQ ID NO: 7348 - DNA, 102 bp, Bacillus clausii
aacctaaggaggtgttcgatgtggcagtaatctccatgaagcaattgcttgaagcgggtgtccactttggccatcaaacacgccgctggaaccctaaaatgg

SEQ ID NO: 7349 - DNA, 486 bp, Bacillus clausii
atgggcttggaggcagggccacgaatgcttggcgccgatttgccggtaacgttatcgattgtatggacgctcgtttttcccaatatttttggcgcactgctgtgcatgctgcttatccggccaatctccaagattagcatggtgcctggagaaaaaattgtcccgtttctcgtcgtcctgcttgtactaggcgcttaccaatcgaacttctcatggggcgatctcattgttttcgtcgccattggcctcctaggctacgtgatgacgattctagattggccgcgcccgccgctcttaattgggtttgtccttgctttgagtgctgagcgctattattggatatcgattgaaccgtacggttggtcgtggatgagcaatccacttgtcattgcccttgctctatttattgttctattgttgtcaggcggggcgattatgaaaaagtttagtaaatccgttgagtcaggaaaaggggtctcctcatga

SEQ ID NO: 7350 - DNA, 1110 bp, Bacillus clausii
  misc_feature (1)...(1110): n = A,T,C or G
gcatacgcgctgccattattcgcggcggcacaagcaaaggtgtctttattttgcaaaacgagctgccagaagaccctaaagtccgcgaccaagtcatcctatccatatacggccaggacgcacggcaaatcgatggccttggcggagcagacgccttaacaagcaagtttgcgatggtccgtccgtctcctttgtcagcagctgacattgagtatacatttggccaagtggggattggcactggtcatatcgattacaataccaattgcgggaacatccttagcggcgttggcccgtttgccgtcgacgaagggcttgtttgcgtgacagaaccctatacaaaagttcgtatccataacaccaatacagatcggatcatcatcgcccatgtgcccgtagaaaacggccgcgccaagcaagtggggaactttcatattgacggcgtccccggcggcggcgctaaaattatgcttgattttcaaaacgctgctggagcaaaaacaggtgcctgtttccaacaggcgcacgaaaggattggcttgattgttcatatggcnaaaattgcaacgagcattgtcgatgttactacgccagtcgcttttataaacgcttctgatgtaggaatacaggagtagaacttcctgagcagcctgactcaagagcaactgtttctgcttgaggaaatacggggcgcagcggcaacgaaattaggttttgttgcccaaccgtcagacgctgcccgtttgacccctgcaagcccgaaattgatcatcgtttcagaagcagaagaatacgaaacagctgccaggcaaactgttcataaggcaaatattgatttcgtcggccgggcgatgtcgatgcaacagatgcataaaacatttcctgtcacaggcgggctgtgcactgctgttgcttctaaactacagggcactgtcgtccacgaatgctgttctgatcatgctcaaaatgaggaaactgtccgtgtcggacacccttctggcacaatggagtttcatgtgtccgtcaaagaagcaaaagacatcgaaccaacgattgaaaaagcagctgtcgccaggacggcacggcgtataatggaaggatttgcgtacg

SEQ ID NO: 7351 - DNA, 312 bp, Bacillus clausii
  misc_feature (1)...(312): n = A,T,C or G
cgtattttaaagaccaatatacggatattgcgactgtccagcaaatcaaaccaggcaatgccgtttgcggcgacgggcatatggtgatccaaaaaggcacatacacagtatgtgccgttgtcgatggtttagggagcggccaaggggcataccattctactataacggcactacaaacngtgcaaacgtatcatgctgaatctgtcgatgtgattcttgaacattgcnatanggctttaactcatcaacggggcgctgttattacagtcattaaaattgattacaaaagcaacatcctccattatgcnaact

SEQ ID NO: 7352 - DNA, 162 bp, Bacillus clausii
ttgttgggaaacatgcaactgagctaataggagaattgctggccgtccgagtatcagaagggaccatttcagaattacaaacattgattcatgcacacccaaccattgctgaaggtattggcgaaagtgcactggcgtttagtaaacgagccattcaccagt

SEQ ID NO: 7353 - DNA, 399 bp, Bacillus clausii
atgttcgagtttcctgaaattgctgaaggaaaaggcgatccttccaatgtaggtggtgcaacaagccccgtttggtccgtttcttcagccacagaacaccctgaccttgcagttgagctgattaatgaacttacaagcattgaaacagccgaagattatgtaaaccgaacgggcagcattgccgctattaaagacattgaaacagatgacccatttattaagcgaattgatgaaatcgcggctaatgccaatgacattcacatgccttatgaccaaacattgccccctgctcttgctgaactacatctagatacaacacagcaactattcggtaaaacgcttacacctgaagaagcagctagccagatggaggagaaagcaaaagaattgttagattaa

SEQ ID NO: 7354 - DNA, 591 bp, Bacillus clausii
  misc_feature (1)...(591): n = A,T,C or G
tcagtgaagggttaggcataattgagactgctaatacatttggcaaagtgctaagcccgatttttggggccgtacttgcttctattatttggtacttgccgtctttttcatttcctattttttgttttgtctccatttttcttgtcttatttttagtagaaagcccgcctttagcgaaaaagccgacaaacttagcgcgttttttaaagtcgatgaaaaagatctttaaacgggaagggcgctggctttatgtagtattttttgttggtgggatgtgcatgtacattttattcggcgtccttttttatttgtcatcgtttttagaagagacgcaccatattgatggaattaggaaaggcgttattttagcgtttccgttaatggcattgtgcttgacgtcgtatgggacagggcgaatcattggccaagaccaaatcaaaatgaaatggatgacagtagcaggattgtgccttctggctgtttcgacgttggtcgtttccgtttaataaggaattgtatgttatgctgaaagcactttttggcaccaggggttagcattggcgccgnnctacccgaacctggatcctttgt

SEQ ID NO: 7355 - DNA, 378 bp, Bacillus clausii
agtgaaagattctcattaaagtctccgtcgatgtagacctatacgacgaagctggcaaccatatttgtacgtcatgtgagccatttgaatttacaaaagtcgaaacgttctacttatgcgcgccagaaggcactgaagtgtgcgctttcgtcacagcaggtcaatgtgatgctgaacttatctttgacggctcttatatgcagctggacctttctttctccttctgcctagatgtccatgtattagctgacgttttgctggaaattgaagcggcatattgcaaacctcggttggaatttcctatcagcgatgttctttgcaaagaaacgaaattcccaccacaatgcccgactctatttcctggcaaaaaaagcaaaa

SEQ ID NO: 7356 - DNA, 387 bp, Bacillus clausii
atgccgattctcacgtacattgttttgtttttgccttactcgttccagtacacaaaggcagcattatcacagctcgaccaatcgattgaccatgccaattccatttatggcccgacggcagcgagtattcttgtgcgagtatggctcccccttctcgcacaaggtgttttggccggatggatcatgacgtttattatttcgatgcgcgagttagttggttcgcttttaattcttccaccatctgttcaaacaggcgctacgtttatttacagccaatttgaacaagggaaacgtttccctcgggatggcgatggctgtggtgaccgtattaatgacagtcgtgtttttatatgtggtccaatgggctgcagcgaaaggcgctcgtaa

SEQ ID NO: 7357 - DNA, 362 bp, Bacillus clausii
atgcttggtagcgtttggtatgtattacaagtcggaaaacacatgattttcttttccggcgatatgtcacttgaatcgccgctgcttgtaacggattaccctagaaaaatgggttacgacgtcgctttgcttgatacgggccatagcggcatcacgatgccaagggaaaagagtatggaagcgattcttgcttccgtgcatgaccctgctagacgttatacgattcccgtttcgatttcaggcaaagcgtttgacttaatgtacttgctctatacgcacctaccagacagaatcttttttattgaagcttcttttgaaaaaagcgcacatctttatttgcagtttggcgataacatcaacag

SEQ ID NO: 7358 - DNA, 813 bp, Bacillus clausii
  misc_feature (1)...(813): n = A,T,C or G
tagtcgtcccgcaaacgttgcacgcttccaaaaacaggacagtgtgatgaagcaggcacttgagtatttagtagaagggggaccaatcaacgatattcttcctaacggcttccgggctgtcttgccagcaggnaacagaagtcgatatcgaccacttaaaagaagaaaagttggcaattgttaatttttcaagtgagtttaatgactacaacctcgcagatgaaaagcggatttttgaagctgttacctggacattgacgcaatttcctgacgttgaagaagtgaaagtcgaagtaaacggttatgagctcgataaaatgccacaaagcgagaaaccgcttgtcggaaaccttagtcgcgcagatggcataaatgtcgacacaagcgaagtcgtcgactttaccaatagcacggacattaccctatatttccttggggcaaatgacgaggaaacgtactacgtaccggtaacaaaaagggttgaaaatgtcgacaatgagctagaggcggcaatcaatgaattgattgaagggccatcgctcatgacaaatttgctaacagaaatgtcaggcgatgtggaactccttaatgaacctaaactgcaaaatggcgaagtcgtcttagactttaacgaagccattcaatcagccaacgaaggcagcgccattccgaccagtgtattggaaagcttagcgctcacattaacagagcaaggcggcatcgaaaaagtgtcaatccaagtgaacggagaggcaggcgtaaatgaggcgggcattgaagtggaagaagtcactcgccctgagctcgtgaatg

SEQ ID NO: 7359 - DNA, 222 bp, Bacillus clausii
  misc_feature (1)...(222): n = A,T,C or G
ttagctccaatcatctcggctgnaatcgatcaaaaaaacattaggaaaatctgcgggnaaaagtactccgcgatcgacagctccttgaggcaaagcgtctactacggtactcaaatgcccatatagcggagattgcgagctaccttggtttccgagactcttcatacttcggacgatattttaagaaaaatatcggtgtcacgcctacttcttttcgaaaag

SEQ ID NO: 7360 - DNA, 1356 bp, Bacillus clausii
  misc_feature (1)...(1356): n = A,T,C or G
tgagcagcagcaaacagagtttgtatctatgctggatgaaacaaaagaaatgggaatgaatgcagtcgttgtccaagtaaaaccgacagcagacagtttttatccatcagagtacgggccgtggtctgaatatttgacaggacaacaaggccaagaccccggttacgatcccctcgccttcatggttgaagaagcccataaacgcaacttagaattccacgcatgggtgaacccgtaccggattacgatgaaccatacagacatcaaccgtttagccgacggccaccctgccaaagaacatccagattgggtcgtcgcctatggaaaccaactttattttgatccaggcttgccggaagtacggcaatttctcgtagacgctgtccgtgaaatcgtccagaattacgacatcgatgcgattcatatggatgattacttttacccttacccgatcgctggccaagacttcccagatgatgactcctttgcggaacatggtagcgactttacagacaggggagattggcggcgccacaatgtgaatacgcttgttgcctccctccagcaagcaatcaaagacgaaaaacattatgtgaaatttggcattagcccattcggagtctggcgcaacagcagcaacgacccaactggttctcatacacgagccggcgtagaaaactatgatgatctttacgccgacacccgccattggatccaaaaccgctccgtcgattatattactccgcaaatttattggaacattgggtttgaggcggcagcgtttgacatccttacagattggtggatttcagaaacagcgggttcccatactcatttttacgtcgggcaagccgcatacaaagtaggcgtcaatgatgtaccggcatggcatgaccctgaggaatacccaaggcaaattgcttatatgcgcgagcgcccagacgtaaaaggcagcatccactttagcttaaaagacttgcgtgccaaccgcctcggcgttaaagaccggcttacagaaacagaatatcagcgcccggcgctgattccagaaatgccgtggctggctggaactgtgccgaaaaaaccgacaaacgttgatttagtgaatcaaaagaatgggactatgctcaccatcgctgatcctaaaaatgagcatgcggcttattacgccatttaccgatttttgacggccaaaaaanccggttctttggaaagcaataaaaacttaatcgccactgtccgcaaagatggacaggaaacaacggtatacgatcacgaagcagcggcaaatcaaacgtacacatacgtcgtcactgcgttggatcgccttcataatgaaagcaaaaacggcaagaa

SEQ ID NO: 7361 - DNA, 426 bp, Bacillus clausii
  misc_feature (1)...(426): n = A,T,C or G
cgagtggagtgggcgaatgagagaatcccgcgctcaatttttactgacagatgatccaatggaattggcgagcggcgccccttttgcatccgatgaagatgcacagctgatcacatttgaggaacggcaaagtttgctggacggcgagacagttgtgattcgtcgcgaacatcctcgttttcaacaagagttgcttgggattgcccttccgttnatcagtgaaaataaattngnaggcgcgatttttatttcgatcccattagctgttgtttatgaggcgtttgttgatatccagtgggcgctttatgcagcagttttgttcgntgctttctttgtcgtcgtttcaggcaagcgcntgacgaaacatattgtagagccgctaagggaaatgaaagcaagcgccaaagaaatggaaaatggtcantt

SEQ ID NO: 7362 - DNA, 327 bp, Bacillus clausii
ttttggccattgacactaacagcggcgccgttgacgaacttgcccagtttgatgaagccctgactgcagtgacagcgcttcctggccgtgacgctgtagcggttgctgatacggagaacaatgaagtcaagttggtcagtgtagaacatggcgatgtaatggaggcgtttgcactagatggttcgccatcggagcttttggctgatgaaagtggactgctttttgtcctttgtacagacaaaagcaacgtttttgtatttaatttggagacaatggaacaagtcaattcttttccagtcagcgaaacgtccggcagggctttttttt

SEQ ID NO: 7363 - DNA, 267 bp, Bacillus clausii
  misc_feature (1)...(267): n = A,T,C or G
cccannacactnttggcggcaaaggtttaatanctgtacanttaaaatgggacgcggttgaagatgagcgtattgcctttaatgtgtatgaagtcgacggtgattccaagaaacaagttgcttccaaattaacagaacctcattttacgattggaaaaatgaatccattctctttgccgaaataccaagtggtcacctatagacctataaacggatnccgaaggggctgcttctgaagcgcttcgaaccttcgttttcattttcatt

SEQ ID NO: 7364 - DNA, 363 bp, Bacillus clausii
cttattatttcaatttaacacaagtcgggccttcctttgtcctattgccatgggctttaggagaatggaaaacgggccacattggccaggttgttggcgttggcgtcattgcgatttgctcgattggggttgcgtttttgtacaaatggatgctgcaaaaagtaaatagcatctggcctggagtcggttttggcgtattgatatgggtaattgttttttacattcttaatccttttattccacaattaaaaccagtccaatcgtacacaattaatacactggttacaacattatgtctatttatcctttacgggctgtttatcggctattcgattgcttatgagtatgcggaacaaaacgaag

SEQ ID NO: 7365 - DNA, 129 bp, Bacillus clausii
cttttggtttaaaaaagggcgatttgctttttacaggcacgccagaacgtgtcggggcaatcgctgatggcgatcaatttaaccttgcatgtcaaggagaaacaaaggggactttttttgtaagaatgg

SEQ ID NO: 7366 - DNA, 573 bp, Bacillus clausii
  misc_feature (1)...(573): n = A,T,C or G
acccttcattggaccaagcaacagaagggttccgcgcagcgcttgaggactcagcgcttaacgtaaaatttgacgaaaacaacgcgaacggagatgccaatacgttgcaaacgatcgctgacaagcttattggcaacgaagttgaccttgtatttgccaatgctacgccagcagcacagattatggcctcttcgataacggaagtccctattctgtttacttctgttacggaccctgtaggggctcaactcgtcgattcattagaagagccagggggaaatgtgtcaggcacggttgacttccatccagaagcaattgaaaaatcgatcgcattaatggatgaagagttcgacctcgaacggattggcatggtctataatgctggcgagcaaaactcgcaacaccaagtgaacttgccaaagaagctgctgaagctaggggaatgtccattgttgaagcaactgtgcaaacgtctgcttgacgtgcaaacggcaacanaaagcttaattggcgaaatcgacgcccctttatatcattacccgataatgatgttgttgcctggattaaatgccg

SEQ ID NO: 7367 - DNA, 258 bp, Bacillus clausii
  misc_feature (1)...(258): n = A,T,C or G
ttaatgaaacagatgaaatgatcaaccagaaggcacgcttggtgcttgaactcggaatgacacccgttntatgtattggagaatcaatcgancaaaaagaaagcgtcagagatcattatacgacaacaattagtatccaacttaacggacaatcgattcagcaaagctcgaaattgtcattatagcttattgaaccaatttggtcgattggtcaggcggaagcagcagctccagaatatgttcataagattcataaaa

SEQ ID NO: 7368 - DNA, 492 bp, Bacillus clausii
  misc_feature (1)...(492): n = A,T,C or G
atgattgaatactttttgcaagagcgctcagccatggtcattgatggaaactggggagctattagcattttgacaaacaagcccgatgagatgaacgtcggcattgccccgtttcctctaggtgattcaggaacaatttcgactgtgtacggtaattcatggtcgttgaatgcggacttatcggacgaaaaacgagaagcagctgaaacgttcttaaagtggatgtttaatgaagatttttataaagatctaattggtgtagggcgtgtcgtggctgctgaagtggagatgcctgaaaatgccgatcttgatccactctttttagacatgcttgaattatcgcaagatgctccaccagcccctgtctatgatgcggttcttccacaggcagtaaacaacgtgctgcaaaatgagcnacaagccattaccattggacgctcgacaccagaggaggctgcacaaaacattcaaaacacagtagatgcccaataa

SEQ ID NO: 7369 - DNA, 235 bp, Bacillus clausii; identical to SEQ ID NO: 7082

SEQ ID NO: 7370 - DNA, 1083 bp, Bacillus clausii
tatggggaggacgatacgttctgaatcggttggggcaaaaatcgcagaatggtatagttgccttctttctaagtcatatgaacaggcgattattttaaaagaagaggtcaaacagcttttaccagcgatggatccaagcgacaagtttatggccttctactcactagtcgaatttaaacatcagattttagtcagccgttacgataaaaacgaatgccctgaggaaatagagccgatttctgaaaagaccgaaatcgatgaccttctcaagtatctttattactttgttagtggccaatacgagtttacgcaagaacggtaccggtctgctgtaaagctgtttcgcaaagccgaacgactactagaatacgtaaacgatgaggcggaggaagcggaattttatcaatatattggccttgtttattatcgtctcaaccattatttgattgcttcgtcctacatggaacaagcaaacgtcctattcgatcggcttcaatatcatgagccagcgataaactgccaaattatcactgcttgtattcatcaagaattaaacaaccctgaaaaaggcgaagctatcctaaagcaggcgttagagcgtgctaaaggcattccaattgtatatggacaagtgttgcggacgctaggtttaaacaagcaaggccaaaaaaagtttaacgaggcggaaacgtattttaaacgagcgcttgatattcctgagcacaaaaacacgattttcggtgccaaatctagatacaatttaagtaacgtcctctttaatcaaggaaaaatcgaagaagccctcccccatttccaaattgcaaaagcaggtgccgcctactacaaaagcaaagaatacaacgcacgctgcttgtttacggaaggccttcacatcgaaaaaaattatgatttggttgacgaagcgattgcacagctccaaaaagaaggaatggactttgaggtaagtgaacttgctgaagaagccgctcactttgcagaaaaggaaggaaatattaaactggcattgaaatatatgaaagtggcccatggtgcacgcttataccaacatactttaggagttga

SEQ ID NO: 7371 - DNA, 378 bp, Bacillus clausii
  misc_feature (1)...(378): n = A,T,C or G
tcccagaaatcgaagtcccagacgaaaaagcaccccaacncttnagcaccgaagacctgcgcctcggtcagaaaaaagaaggcgacgcctcctngccaaaataagcgccgacagctacgtcatcgccctggcgatcgaaggcaacatgaaaacaagcgagcaacttgcaaagaatattgaacagctcggcacatatggaaaaagcaaaatcgccttcgtaatcggcggttcatgaggattgtctaacgacgtgtacgcacgggcagacgaactgctatcattttcaaaaatgacattcccccaccaactgatgaaactcgtgctatttgagcaactgtatcggagttttcggattatgaggggggagccgtatcataa

SEQ ID NO: 7372 - DNA, 138 bp, Bacillus clausii
ctgcacagaacatatcgaactagcactagacgtcgccgtagacgaatgggaagttgcacccaaaatcgaaaaaaccacagacgccaacgacgccacatgtagctactgtggaaacaaagccacatacactgtggcaaa

SEQ ID NO: 7373 - DNA, 696 bp, Bacillus clausii
gggaaacggatgaaaaacggcaaaaagagcgagaggatgtctcctaccggttgtttcgccaagatgcgaaattaatgaaacgaaggcaagaatatcaagcggcatcaggctatgaagagacgccgcatttttttgagatgagaggccgtgtgctccacttagatggggacttaaattatttaaatcgttgcacggcgttatatgaaaaattcggcgtccccgtttacggcgtccatatggaagaaaaagaaatgccaacgcaaatgccctcgcttatggaaatggtccaaccagatatagttgtgattacaggacatgatgcctattcaaaagctaaaggaaaccgagatgaattaaaggcttatcgccacacaaagtattttgctgactgtgtccgtattgcaagaacgacggtacaaagccgtgatgacttgcttatttttgccggggcctgtcagtcccattttgagacgttaattaaagctggcgctaattttgccagttccccagaacgagtgaacatccacgcgcttgatccagtctatattgcatcgaggcttagtcgtacttcttttttagagacggttaatttatgggaaatattgcgcaataccattacagggcaaaaaggaataggcggcattgaaacacgtggctccatgcgcctcggtttgccgttaaaagaacaagatgaaa

SEQ ID NO: 7374 - DNA, 630 bp, Bacillus clausii
tgccgcttaactttgtagatggcttcaatttggttggcgaaccggttgttgttgcgtttatggtctttccagcgattgctgttgctttgcagttctctgtcaagaaagggattgtcacgtttttggtggcagcgcttgcccggcagctgattgtattttccaatgaaaaaggccttcttgaaattggcggttcatcggttacccttagtccggaagggattgccctcgttgtaggaatggtgtttttaatggcgtttgccatgcaggaaaaatcggatgacacaagcatggaacaaatggcgacattgtttgtcgaccgggtgaaccggattaaaaagtttgcggttgtgctcatggcatcaggtgcgttgcttgctgcagctgcaaacttgttaattgtatctggagatccgatcacactgaatttgcttgcagatggccggattaatgagggaggcattgctgcactagcgaaagcacttggctttgtgccactcattgccagcaccgctattgctacaggcgtatatggcccagccgggtttacactcgtttttgctgtcggtatcttttcgccaaacccgtttattgccgcggcgattggcgcgattgtgatcttgcttgaagtcc

SEQ ID NO: 7375 - DNA, 297 bp, Bacillus clausii
atggcaacaatccgcatcaggtgtacttacaaacatcggcaaaaggaagatttgctgcaactggatgtccgcatgttaggctttactctttataaattggaagcgcctttaattgaatggaacgaaaaagaaggcacggtgtcgatcagggaaaaaaataaaagccctgttaaagaaaacaaacaaaaaaagaaatggtcgagtgaaacgatcaagcgctttattaagaaaagcaaagagtggattgcacactttcccagctataaccggatcgccgctcgttttttaaaggcttga

SEQ ID NO: 7376 - DNA, 539 bp, Bacillus clausii
atggaaaggcgattacccgctgccggattcaagcgctatttacgaaaacagccgccggtgatggttcctgcaacaagggaggcggcccaagaaaaaggggcaagcgcgattcgttatgctgggttttggatgcgattatgggcgtttttatttgatttattgatcgtttcagctataaatgctgcgctaattcaatcgtggctgccgtttttacaaacaaacgaccatttctttgggtttgcggttacaacagttattgccccagctattctttacgcactgttgtttttcgcttattttgcaggaatgacgaaagctttttcgcaaacgcttggaaaaatggtgtttggcttaaaagtggttgctgcagacgggtcgccgctcacatggcgaacattgttctttcgagaaggcgtcggccgctttatccagcaagcgcctttaccacttcgtttcccgctgcttgcttatattgttgttgcatgcacgcctaaaaaacaaggcatccatgatttgtttgccgagacatatgtcatcca

SEQ ID NO: 7377 - DNA, 378 bp, Bacillus clausii
agagaaagaagataaggaagaaaaagaagagaaagaagaggaatcagaaaatgaagaggcgaaagcagaggatgacgttccagcggaatataattctgctttaaataaagcagaatcgtatgcaaaaacgatgagcatgtccaaaactgctatttatgaccaattaactgcagaaaacggtgaaaagttttccgcagaagctgctgagtatgcaatggatactcttgaatttgactggaaagcaaatgctttaaaaaaggctgaatcgtacgcagaaacgatgagcatgtcaaaacaaggaatttatgaccagctgatttctgaaaacggtgagaaatttactgccgacgaagcacagtacgcaattgacaatttaaa

SEQ ID NO: 7378 - DNA, 438 bp, Bacillus clausii
atgggattttagccatttagacacgtatattgcaggttatgaagtctatgcaagcgaagtacaagggtttgcaggaagcccagaaacactcgtttaccgaggggttggcaatacttatagctttcatggcgaaccgaacaaacagtattatttccgtgtccgtgcttttaactattacgagcgttactcgcctttgtcggaagaagtgagcgctacaacagcacgaattgtatcagaggacattttctttggcgaggacttggctgtcaaacttcgcgaactaagtaaggaagcgcaaattattgccgatgggtcgattcaattggatcaactggaagagtcggtccgcgaacaattaaagcaagatgccaagcagtacaccgatgaggaaatcaaggccgttaccgagcaaataaacagcgaattggctgaaaaagc

SEQ ID NO: 7379 - DNA, 294 bp, Bacillus clausii
atgtaccctcatagtaatgggatgtatggattatcccagagaggatttaagcttcatgattataatcagcacttagtgaactttttaaaaaaagaagattattttaccgtgttatgtggcattcagcatgaggctggcagttatatcgatcacgataaaggtgcgaaaataattggctatgatcaagatatcacttctgataatacagggttgtcggaacaagagcttgtaaaatgggattatgaaaacgctcgtcaagttcgacaatggctgcagcaatctgacaagaaaaaa

SEQ ID NO: 7380 - DNA, 429 bp, Bacillus clausii
atgaaaaagcattaaggtcgatatgtcactagatgatattttaattaatatgattgataaactaaaattgcttgttcactttgatcgactgagctttttgatgttaacaaatgaaacgttaagattaagtcatgtttatcctgaagatcactattcgttagaaattggctcaaccattccaaaggcccagtccctctattggtcagcattagacaaaaggcaaacggttctccaaagtttaacggatacgaatcacgctttttacgagaaaccatatttagctgtacttgagcttaaatccattttagtcatacccatttacagtaaaaacaaacggattggcgtattgagtatcggtcggaaacaagaaatagactggagctctgacgacctagcgtttttagagcaattaacagatcatttagccgt

SEQ ID NO: 7381 - DNA, 438 bp, Bacillus clausii
tttgaggaagcgaacaggagcggacttaaagccaattgatgtcggtggcgcgtatgacaaactcgtagcccttttaggcaaccaagtagacattgtcccgatcgcctacggggtaacagccgattatattgaaaatggcgatttcgcctcagtcggcgtcctgtcatcagaacaacatgccctatatgacaacacgcctacttttttagagcaaggcattgatatagagtttgagaaatttttcttctttgcttttccgcaagaaacgcccgatgcgattgtcgcccgcttttctgaagcactaaaagaagtcgtagaaaacaatgaagcctaccgcgagcaggctgaatcgtattacaccatcccgacttatatcgcccctgaagaagcgacacgatatatggatgatgtgagtcattcctacgagcgcttgataga

SEQ ID NO: 7382 - DNA, 98 bp, Bacillus clausii
  misc_feature (1)...(98): n = A,T,C or G
atggacgttttaaaaatttcgccaagagggtactgttacggcgtagtggatacaatggtgatggcgagacaagcggcgcnaaacttggacttaccaag

SEQ ID NO: 7383 - DNA, 258 bp, Bacillus clausii
  misc_feature (1)...(258): n = A,T,C or G
ttttgcgtattcccgtncaagcagtggaaggggagctaggctcaaaagacgctgtcatccaagttggaacgttgtacttgctaaaccatgtttatcaacaagacaacgatnaagattcgttaagcggcgttgtaccggcggtggccgaggggcttgtaaaccagtttcaagcgcctgttgacaaggacggggaagtctccgacaagtaccgctcgttagcggaaaactnagtagcagagcttgagcaaacgcttgctt

SEQ ID NO: 7384 - DNA, 357 bp, Bacillus clausii
  misc_feature (1)...(357): n = A,T,C or G
atggcggcttccattgtgattcgtttcgcctttacaaaatcgagtattagccaaccgcaaaaaatagctaaagcaatgatgagcgcttcacccattttcactccccctcccgctattactttagcaactttcccccatgtcgcaatgatgatcaagcaagcgtttgctcaagctctgctactnagttttccgctaacgagcggtacttgtcggagacttccccgtccttgtcaacaggcgcttgaaactggtttacaagcccctcggccaccgccggtacaacgccgcttaacgaatcttnatcgttgtcttgttgataaacatggtttagcaagtacaacgttccaacttggatga

SEQ ID NO: 7385 - DNA, 558 bp, Bacillus clausii
aaatccaaaaagaagcgtttccgccgccgttcccttcagagttatggtggaccgtagaacaagtcgaagcacatgcagctgttttccctgcaggcgctttgcttgctgaaatcaatggcgaagtcgctggttcagccacttcccttctcgtcagtaatgccgaccgctctcatacatgggaagaaataagcgacaacggcctcatccgcgcttcccaccaacctgatggagacacactgtatggcatcgacttatgcgtccgtccccgttaccgtggcaaaggggttgccgcagcactctatgaagcgcgcaagcagacggtcatccaacttggtctgacacggtttgccgctgtctgccgtattcctggctatcatgccgtttcaacagaaattggaccagaacaatatgtttccgaagtaaaaaacggcaagcgcagcgaccaagtcctttcgtttatgatgaaacaaggacttactcctacccatgtgcttaacggttatgtagaagatgcagaatcgttgaactatggcgtttttgtggagtggcgccctcctg

SEQ ID NO: 7386 - DNA, 531 bp, Bacillus clausii
  misc_feature (1)...(531): n = A,T,C or G
cagacaacatccgtgaagcggttgaagtggaaggcgctgcttatgcagtgccaatcgacacacacccgttcatcctatacattaacaacgacttagcggaagaagctgggctgttggatgaagacggcagccttaaactagatgagtcaccacaaggctttaaagccttttttcaacaagcaaaagaagcgcttcctgataaaacgccgctttccatttcaaccggaggggtcgatgtgtaccgctggtggtggacggtttattttcaaatgggcggcacgccgattttctccgatgacttgcgggaaccagaaattacgcttgatcgggaaattgcgatcgaagcagctacctatattcacagcttcttcggggatgtgatcccgatgcacattggcgatttttatgaaacgttccangctggaaatgctgtcggtttgatgacaggcgtgtgggcgactggaatttgggaagggagcgacatgaactttaccgcccgtccctttgcctcaatcttttgaagtcgaagcn

SEQ ID NO: 7387 - DNA, 140 bp, Bacillus clausii
tcgatcatgagatttttctgcaattcggcgaagcgctgccagtgtacaaaccgacgttgccgccgatagtattcgggcctcgcgacaggcaggtggatggcagcgacgaaacgctcgtgctgcgttatttaacaccacat

SEQ ID NO: 7388 - DNA, 664 bp, Bacillus clausii
gtgtgggagaactacttcaaactagtgtagaacttacaattggcctagttgcgttactggttttaactaaagtgatggggaaaacatcgtttgcgcaaattaccccatttgattttatttcagcactcatattgggggaacttgtagggaatgccatctatgatgagaaagtcaaaattggcgcgattctgttctctatttttatatgggggcttctgctttatattatagagtggctcacacagcaatttcggaagtcgcgaaaaattctcgaaggaaacccatccattattattcaaaacggccacttaaatcgcgctgagatgaaaaagaaagaatttgatatgaaccaacttcaacatttgttgcgtaaacaacaagctttttccgtcagagaggtcgaacacgctattttagaaacagatggaaccgtcagcgtattaaagaaaccacagtacgaccaaccaacttacgaagacttaaatgttcctgaaaaaccggtttatttaccggtaacgtttattaatgatggcaccgttgactgggaaaacctccataaagctggctttaacgaaaactggctcaaaaaacagcttgatcagcatcaaatcgacaaatttgaggacgttttttatttggaatggaagcaagacgaaggcattta

SEQ ID NO: 7389 - DNA, 186 bp, Bacillus clausii
  misc_feature (1)...(186): n = A,T,C or G
aatggaagttcgaaacaanttggttgtacctggtgctgagcaagccnttgaacaaatgaaaaacgaaatcgcaagcgaatttgntgtaaacttnggcggtgataggacttccngtgcaaacggttctgtgggcggtgaaatcaacaaaacgcttggttcaaatggcagagcagcaaatgggcggac

SEQ ID NO: 7390 - DNA, 138 bp, Bacillus clausii
gcacagaacatatcgaactagcactagacgtcgccgtagacgaatgggaagttgcacccaaaatcgaaaaaaccacagacgccaacgacgccacatgtagctactgtggaaacaaagccacatacactgtggcaaaat

SEQ ID NO: 7391 - DNA, 110 bp, Bacillus clausii
atatcacgattctatccgtcggccaactaaaagaaaaatacataaaacaaggcctcgacgaatacaaaaagcgccttagcgcctacgccaaaatcccagaaatcgaaatc

SEQ ID NO: 7392 - DNA, 762 bp, Bacillus clausii
ggtttaaacaaatccattgcgatgacggctgtctttcaatttacttgcgcacgtctttgtccagtacggatcagcaaaaaggtgagtggaagatccgtttaaaaaatgggctaaaaaaactggaagaatacttggaagctagtgagaatgacgcggaactcaaaagttttaagagactgaaaaagcttgccgaaaaacacattaaagaattgtcgcctaacctgccgaaaagtatcgtttttatcggttctgcaagcggcgacctgtatgtgaagaagctacaagtcccggtagaaaatgattttaggtgggagcattaccctgtagtcgaccaacttgagaacttagaagcgaaataccctctttctggcattgtgatgattcagaaaacagatgtattagcagttgagacaagtttaggagaagtaaacgatgaattgcattatgcttgggatgtagaagcagaagattggaaagaatacattggcgcacgccctgaaggcgagacaggggctgcccttcatcgcgagtcgtacgcaaatcggtttgatgccaaccagcaacgctggtttaaaaaaattgccaataaaatcgagaaacaagcaagaaagagaaattggcaaacgattcatgtcgttggctcaccagaccaaacgacggcgtttgtcaaacaatgttcgacggctgatgttgccgttttaaaaaagaatttggctaagttaaaagcacacgaaatcgtcagagaagtaaatgaatctgccg

SEQ ID NO: 7393 - DNA, 570 bp, Bacillus clausii
atgatttcgacaagttatgaagaacaaagaaaagcaatgcgagaaatggcttattacctttcagcagaagaaggcaaactggtattttttgatgagccagataaagcctaccatgcatttgtagtcgacttttccgatttcacaggcaaaggcttgttgaaaacaggaaaattagtctttcaagtgtcggatcctgtcgcagaaggggcaaaaaaagagcttgatttcacggagagcatagttgtcgactatacagctactgcaccagcgatgcctgtttactcgattcttttccatgaagaaacagaaaacatgcaaatagaaaaagacgggaaacgatttaagttaaatcgagtattccattcaggcgaccggattgtaattgacagtgaaaaatcagcaattcgttataacgatgaatgggcgatgcctttgcttgatctgcgttcaggatttaaagatctatttttacatcctggcgaaaatcatattgccgttcgaccggaaaccgcgacagtagaaatggcatataaggagaaatggttatcaagggagaaggggatagaatga

SEQ ID NO: 7394 - DNA, 389 bp, Bacillus clausii
  misc_feature (1)...(389): n = A,T,C or G
atgcaccattcacttaaatcacttgcttcaagccttttgctgctagtgcttctaggagcttgtgcaggtaatgttgataacgatgccaatgacaatacagaaaaaagcagtgagcccgctgtctcaagcgcgtttccgcggacattggaagatgcaaacggagactttactcttgaaaaagagccgcaaaaagtagcaattgcccattggggatttgtcgattcttttntgctttttgacacgccttcagctgctgtggtgctgcctttttcagcagaacaatctgttctaaaaacggacgtgttcaagcnttatgtnnaaacgttcgatgaactggaggtggtangcgaaaaaccatcaagtgaatttgggaagcgttggctttgcct

SEQ ID NO: 7395 - DNA, 379 bp, Bacillus clausii
atgaggagcaacgacgaattgattcgcatattgggatctatccgccatgactggctgaatgtgctccagctaataaaagggaacttggcgatcggcaatcatgagcgggctgaggctgttcttgaggaggcggttgaacaaacgacaaatgagagccgcctgtgcaacatggggatgccaaaaacagcgcttgttttacttgagcaaaaatggcatcaatcagcttatgagattgcatacgaagtggacggtcctcttttaaacttggcaaaatatgataatgctttttctacatgttttgcccgctttttttcactgctgtctgaatggccgcagctagatgggcctagttccgtttttgttacgtacaccttttttt

SEQ ID NO: 7396 - DNA, 388 bp, Bacillus clausii
atgtcattcgctccaactaaatggtctaactctatattattgccatcaagccatttgccattgctatctttacttaataagagttcatcttttaatttatcattcgttaactttaagcggataaagttccaatttcttgtcagtataacctcgtattcaattttgttagattctaaagggtcaatgatggtacttgttacacttatattgttcgaagaatacttaacctttaaatactcaagtcccttatgctcgatattctcccatatgtataacatttgtaaaaatccctcccatacttgtcattacatctcacactttaggcagtatcctacacggagcaaacatacgttcttttattgtatacttactagactatattttcaat

SEQ ID NO: 7397 - DNA, 126 bp, Bacillus clausii
tgcaaggcagcgaaatcgttgtgccagaacaggcagccactgtccaccttaaagtcagcgtccgttacgatacattctcgtttgcttattcttttgatggcagccattttgaggatattggcgttt

SEQ ID NO: 7398 - DNA, 786 bp, Bacillus clausii
  misc_feature (1)...(786): n = A,T,C or G
tccgccaggcaaacgccaatatggaggcgcagcgttccgagattgaacgtgccactgaaattgctgaggcagaaaagaataaccaattgaaagtagctgcgtaccgcagcgagcaagancaagcaaaagcgcaagcggaccaagcctaccacttacaagaagcccgttcaaaacaagaggtaacggaacagcaaatgcaaatccaaatcattgaacggcaaaagcaaatcgagcttgaagaaaaagaaattgcccgccgcgaacggcagtatgacgcagaagtgaagaaaaaagcagacgccgaccgttattccgtcgagcaagcggcagccgcccaaaaaagcaggcaattcgctgaagcagacgccgacaaataccgtgtcgaagcaatggcgaaagcggaagcagaacgtatccgcgtagacggcctggccgaagcggaagcagaacgagcacgtggggaagccgaagcagaagtcattcgccttaaaggtcttgcagaagcggaagcaaaagaaaaaattgccgaagcgtttgaaaaatacggagaggctgctaaacttagcatgttaatcgaaatgctccctgattacgctcgcgaagtagcagcaccgctcgcgaacatcgataagattaccgttgtcgataccggcgcaggcggccaagggagcggcgctaacaaagtaactggctacgcaactgatttaatggctggcctccaagaatcattaaaagcatctagcggcattgatgtaaaagagctagttgaaaacttatcgaagaaat

SEQ ID NO: 7399 - DNA, 168 bp, Bacillus clausii
ggaattagcgatcaatatggccatcagtgaaaaagcaggcgtagcctggtcgtcgttagatcatacagggattgatgtgccattgtacgcttacggcgccggggcagaacggtttagcggcacgatcgacaacaccgaagtgccgaaaataatgaaagcagcactagg

SEQ ID NO: 7400 - DNA, 231 bp, Bacillus clausii
  misc_feature (1)...(231): n = A,T,C or G
atgaaggggaaaaatgtctatttgcgtgagtttaaaatcgatgattggcatgacgtacatgcgtatgcttcgctggaacgagtctgccggtnccagacatggggccctaataacgaaaaagattcacaaaactatgttaaacaagccgattgtcgatgctcgcaaatgtcctcngacgaagtttgcattttgcnnnttgctttnaaaaaaatanggancgcgtggtccgga

SEQ ID NO: 7401 - DNA, 495 bp, Bacillus clausii
  misc_feature (1)...(495): n = A,T,C or G
ctctaccgagtgtcgaaaagcgcactgcggtccaagcaaagacgattccaggcgtaacggtgcccgtttacaaaatggtggaagcggaattggataccagtctttatgaacggacaagagtaactgccacgggctatacggcaggagtcgagtcaacggggaaaacgcctggcgatcctgcttatggcattacttattctggattgccggtggagcgcaatacgtattcaaccattgctgcagatcctgctgtgtttccgatnggctatatnttatttgtaccaggttacggntatggagtagtggcagatacaggatcggctataaaggggaaacacatcgatttatattatcctaccgttgcggatgtctataacgagtgggggaaacaagagcttgacgtgtacatgattaaaaaaggaagcggcgaattgacgcaaaaagagcttgatgatttaaatagcgatgcgtctanacatgtgtttcgtagtcgca

SEQ ID NO: 7402 - DNA, 129 bp, Bacillus clausii
  misc_feature (1)...(129): n = A,T,C or G
cttgttgaaggaaattaaaacgtggcctangaaagaaaacgaacaaaaactaaaggagttacttggccatcagccaattgaagtatttttcggcgcgttgctgggaattatcctggcgttgctattgca

SEQ ID NO: 7403 - DNA, 420 bp, Bacillus clausii
atgaagcttgtactaattgcttgctgtctgttgcttattcaatcagcgttgactgcaatccaagttcgctattaccaaaaattgatgaaagcactagttggaaaatatagaggggaaaaggggtaccaccttttctcaggacaatcccgccgtcgaatcgggcctggttctatcgttctcttagtagtagatgagtcttacatcatccaagagtgccagtgtatgcgaggggtaagtattctgtctacttttaaagagatggaagaatacgaaggaatgcacttgggcgagctgttggacaggcttcacacttcagaaaaaaaacgtaagtctcctgcattgcaaacggccttacaggctgctggcgagcaagcactaacggcgatttcaaagatgaggagaacgacctcgatttcttaa

SEQ ID NO: 7404 - DNA, 508 bp, Bacillus clausii
atggactggattgaatggttcggcgagcattttatcggcatgtttaatgcaggtggagaacaattcatgaatctccttactggcattgtcccaacgctagtcgttttactaaccttcacttacgcactaattaaatttatcggggaggaacgggtcacgaaagcgatccgtttcacttcaaaatatgcactgctacgttacaccgttatgccaatcctatcgattctactacttacgaatccaatggcttacacatttgggcgctttgtcgaggagcgccaaaaacctgctttctttgattcgctcgtgtcatttttgcatccggttacagccttatttccatacgcaaacgctggggaactgtttgtctatctcggcatagcaaatggattgacacaagcaggttactcgacgtcggagttagcagtgcggtttttcctggtcggtattctggttatgctgatcagagggttactgacggagcaaatcacaaaatacctgatgaaga

SEQ ID NO: 7405 - DNA, 1008 bp, Bacillus clausii
  misc_feature (1)...(1008): n = A,T,C or G
ataaagcactatttatcaccaaaggttcatgcgggtgggggactggcctccncnttgaacccaaanggaanaagacnaaagtcctgtccatcaccggcgggggaattcacccntgtcgcccaacgcattgctgaaattgactggggcagaagcagtcgatggcttcaaacattcagtcccagaagatgaaatgatgtgtgtcgtgattgactgcggcggaacgggctagaattggactatacccaatgaaacgaattcctacagttgatattctcgcttcttctccatcaggcccattggcaaaacatatcaaagaagacattttcgtctctggtgttacaccgaaagaagtgtccttggcagaagcaacagaggagaagcacgattcagcccctgcagaggaagaaagtcgtttcaacccagcaaataaagaagaatttaaggaagagtacgaaaaagtcaaaaatgagcatcgttcccaaaatgataactggctcatgcgattttcaaaaggaatcggaaaagtcactggtgtattttatcaggccggacgtgattcaattgaaatgcttattaaaaatatcatcccgttcatggcttttgtaagcatgttgattggcattatcaattacacgggaatcggcgatttgattgccaatacgatgtcaccgcttgctagctcgatttggggcttaatcatcattgttatgatctgcacactgccatttttatcgccagtgctaggtccaggggcggtcattgcccaggtaatcggtgtcttgatcggtagccaaattgcgcttgggaatattccgccgcaatttgcgttaccagcattatttgcgattaacggtcaagtgggagccgatttcgtaccagttgggttatcattaggagaagcgaagccagaaacagtacagtatggcgtgcctgccgttctgtatagccgcttgattacaggcgtgttggctgttgtcattgcctacgtggctagttttggcatgtatt

SEQ ID NO: 7406 - DNA, 469 bp, Bacillus clausii
atgacgtatttgcaagctgggtatggactcgacaacaatggctatatttcaagtgatgtctccatacataaaattcccgaagtatacgagccgtgcattcaacactctgtcgaacaactatcccgcttatttccaaatcaattacacagtgtctatgtttatggcagcgtcgcaagaggagatgcaatcgcgattaagtcagacttagatcttttagctgtgttcaatagtacactaaatgctagtgagaaaatgaaagtaaaaaaactctcaacgacactgactgaaacataccgctatttagtccgcgatattggtatagcagtggcagatctcgatcatgtgatgaacccaatcaactattacgaactggcttttctaaaagaactctgtgtttgtatttacggaactgatcttcgagactgcttcggcccctacaaacttactgccgagatcgcctataagtttt

SEQ ID NO: 7407 - DNA, 732 bp, Bacillus clausii
atttggcacatacagaaacatgcgcttcgatcgggctagttttttgggccaaaaaaatgctggaacttgaagcagacagccgctatggcgatgtcatggaacgggcgctctataatggcaccatcagcggcatccagcttgatgggacgaagtttttctacgtgaatccccttgaagtgtggccacaagctgccaagcaccgccacgatttaaagcatgtcaaaacagagcgccaaccgtggttcggctgtgcatgctgcccgccaaatatagcgaggctgctggcttctattggccaatacatttatacaacgaaaaatcaaactggatttatccacctttacatcagaaacgaatcgacgctcacaatcggttcaggtgaagtgacactgaaaatgaagtcttcctttccatggcagggagaggtgggactggaagtgaacccagacacgagcaggccatttacgcttgccttccgtattccaaactgggcaagcgattatcaactcactgtcaacggccactttgtcgatgtggaagtccgcaacggctacgcttacgtggagcggacttggcaaaaaggcgaccatctttcgatcgagtttccgctggaaacgaaagtgatccatgcccatccacaggtaagagccaacgctggcaaaattgcgctgcaacggggacctatcgtgttttgtgcggaagaagcagacaacggcagcaacttgcaaagtt

SEQ ID NO: 7408 - DNA, 267 bp, Bacillus clausii
agaagtacttgggctgtttgctgatcctgacacagtccttttttgggggcaagcggctgtctttgtaaacgcattccgtcttgcggctgttgtattcattacatcactcgtattttgttatatgaacataaaggcaaaatacgcctttatcggagccgtgttatacggcggaagtgtgatgtattttagacacgctgctttttgggaattttttgcggatgcttatttatggttgcctctactcgtacttggcgttgagaaaatcat

SEQ ID NO: 7409 - DNA, 240 bp, Bacillus clausii
  misc_feature (1)...(240): n = A,T,C or G
tacaggggtttccaattgacnaatagacacgctgtattcattaccagcaagaaatcgatgtcgttgcaatccaatttgcttgctgtggccaattttatccgtgttataagtgtcatgctgagtcagctgggcatganattaaaaagtggccaaagagtgagtttggcgcgaacgcgatttactgtggcaaatgccgaaaaacgatggcgattagcgactatcttgaaaaaggggaatgtg

SEQ ID NO: 7410 - DNA, 135 bp, Bacillus clausii
aactggtgattggtacaggggattacaacaacaacccaacatggttgcaaactcaaaaaacagaattgagtttattaaggcgagtaaattgaaagaaaaagtttgcaccccgtacgataagcgcaattttggcgt

SEQ ID NO: 7411 - DNA, 108 bp, Bacillus clausii
aagaagaagtaggcgatgccgctctatttcttgcaagtgatttagcacgaggcattaccggagaaattcttcatgtagacagtggctataatattctttcacttgctt

SEQ ID NO: 7412 - DNA, 343 bp, Bacillus clausii
atgatctcaccatttgaatggatcgtgcttgcttttgcgacttaccgctttacacgtttgctcgtatgggatgatattaccgcatggcttaggcgcccgtttattaaagaaacagaaatgttagaagaaaatggggaaaaggtgttgtatttagaaggcaaggggagagggctgcgcaagtgggtaggaagcctactatcctgttattggtgtacaggtgtttgggttgcactattcttttatggtggatatgttttttttccactgttattttggccactagccgtttttttttccattgctgctgtggcagcaattttggaaacgatgacaagaaagttgg

SEQ ID NO: 7413 - DNA, 137 bp, Bacillus clausii
ttttttttgagatggagtctcgctctattgcccaggctggggtgcagtggtgcaatctcggctcactgcaacctccgcctccctgggtttcaagcgattctcatgcctcaacctccctagcagctgggattacaggt

SEQ ID NO: 7414 - DNA, 327 bp, Bacillus clausii
tgaaaaaggattgtcgccggttggcggagaaaggcaagaaggggaagacactagccaagaaggcaaaaaagcagacatttcttttaggcaagtcgtagttaaacgtgaattttggcttgtgttgttgccatttgccatttgtggctttacgactacggggttaatggatacccatttgattcctttttcccataaccatgggttttccacccaagttgccggcacagcggtcagcattttagcagcatttaatgtcattggcattttagcgtcaggtgttgtcgctgaccgttttagcagccgaaagtttttgttgtggttatattt

SEQ ID NO: 7415 - DNA, 219 bp, Bacillus clausii
ttatcgggaacaagccacctatttagaacggacttcccattggattgagcgagtcgggcttgaatcaattaaaaaagtgattttcgacgacagcatcgaacgagcagcgctaatcgaacggatggaaatggcggctattctaggcaccaaaagaatcccgtgggacggaaatggttgagaggtgaagaaaagcaacagccaattgtttgaaaaagaaaa

SEQ ID NO: 7416 - DNA, 354 bp, Bacillus clausii
atcaactttatgcggaagcgaaagcggtgatacaccctcggaaattatctgatgtggttgaagtcggcggtgtcggagcagcaattgaaactgcgagcggcaacatttatacaggtgtttgtattgatacggcctgttctatgggattttgcgcagagcatgctgctgctgcggcaatgattacggctggggaaagccatattaagaaaatgattgccgttgattgggatggtggcattttacctccttgtggaagatgccgggaatttataagccaaatgaatgacgcaaatggcgagactcaagttatggtatcagaagaccaaatcgtttcgctgcaagaactattgcctt

SEQ ID NO: 7417 - DNA, 672 bp, Bacillus clausii
ctttcctcatacccttccattcctgcaaggctttgatagtctttcttttaaaaaacctgtcaccatttttgtcggcgaaaacggaacaggcaagtcaacgttgattgaaacactggcagcgttaatggagttaaaccttgaaggcggctcaaaaaaccaccgctttgaaacagaagcaagccattcctctctctaccaatattgccgcttaactaggggggcttatcgcccacgcgatgcttacttttaccgggcagagacgttttataatttggctacagatatggatcaatttgcagaaggagaaggagtgttatcacaaaaactatttggccgcaatttacatacattttctcgcggtgaggcaatgacaacgctaatgaacgatcgctttttcggcaatggcttttatttgatggacgagccagaaactgggctgtctgtaaactccgggcttcaaatcctccttgccatcaaggaacggatcgctaaaaactcgcaatttattttcgcgacccattcgccgattttgatattggatccaggagcgcaagtgtttcaactaagcgaaggcggcattgaggaaatcgctgcggaagaaacgcagctttttaacgattggcgcatgattatggaacgtaactcctattttattcaccaacttttttctga

SEQ ID NO: 7418 - DNA, 113 bp, Bacillus clausii
atgtctaaaggtaaaaaacgttctggcgctcgccctggtagtccgcagccgttgcgaggtactaaaggcaaacgtaaaggcgctcgtctttggtatgtaggtggtcaacaatt

SEQ ID NO: 7419 - DNA, 173 bp, Bacillus clausii
tgtctcatcatggaaggcgctgaatttacggaaaacattattaatggcgtcgagcgtccggttaaagccgctgaattgttcgcgtttaccttgcgtgtacgcgcaggaaacactgacgttcttactgacgcagaagaaaacgtgcgtcaaaaattacgtgcagaaggagtgat

SEQ ID NO: 7420 - DNA, 122 bp, Bacillus clausii
tggcttcccttgctggtcagattggtcgtcttattaccatttcaactaactccggttatcgctaggcgactaccttcgagatggacgccgttggcgctctccgtctttctccattgcgtcgt

SEQ ID NO: 7421 - DNA, 624 bp, Bacillus clausii
attaaaaatcggcatggggggaacagttgcaacttacatacaaaaagggtacaacgtcgcttttcttactttaacgcttgctgagctgtcgtcgaatggcgatatagcgagccggcagcaggaagcaaaagcagctgcgcaacaattaggagtgagtacacgttatcaattggagtttcctgatagggggctgacatacataggcgaggaaaaattggaggaagtggtcgacatcatccgcctgacgaagccaacgctcgtgtttatgccagcggctgaccgccatccagaccatggtcagtgtggggctttaatcaaagaagccatttttaatgcgggcattcgtcgttacggcaatggtgaaccccataaagtaaaagctgcgtacagctattttattaatggctttgccaagcctgactttgttgttgatgtaaccgatagccactctgctaaagtggcggcgcttcaagcatacaaaagccaatttgttgcacaaggtggggtgcagacgccattaactgatggttatattgaaacagtgattgcgagagatcgtttgtttggcaaagaggtaggggtggcattagctgaagggtttgttgccgagaagccacttgtgat

SEQ ID NO: 7422 - DNA, 150 bp, Bacillus clausii
  misc_feature (1)...(150): n = A,T,C or G
ttggccgcccaatcgatcgccgcgtgacagtaaatacgcttggtttgcgtaaattgcaccaaacggtcgtacaagcaagcataatgcagcgatccgcggnaatggtaaacaaagttaaacatttgattactgttaatgaaatcgatgcgt

SEQ ID NO: 7423 - DNA, 519 bp, Bacillus clausii
atgacacatggctccaaagcttggtcccattggcacaaggcaggcttaactcagctcacaaatgcttattttactaagattgccaagcatacatttatcgactactgccgcaaaacaaaaaggcagccttcgcaaaaacctttggctgaaacgagcgctgccacatttaacgccggctcagacattgattatttgcttaaaccgcttgtgtcgagcctgacagtcaagcaacttggcatgtttttgcttgcagacgtgtacaaatggccgttaaaagacattgcccaggcgtgccagcagtcactaggatcggtaaaagccactctttttcgggcacggcaaaacgtttcaaaacatgtgcgcgaacatttggagaaggactggcaactggcagacgagcaagcgttgcatgtccaactgcttgttaaagcactggctgaagaaaataccgcattgattgtgcaattggtaaacgagaccgttccagcgtctattttgcatggccaagcatatacttaa

SEQ ID NO: 7424 - DNA, 132 bp, Bacillus clausii
ttacggtgatttataacgaaaaagcagaagcggaaatggggaacgaaattaaagtacactatgtaccatcacaaggactaaagttaatggcaccaacaggagtgcttgcctatgcccagcgagtccgctcaa

SEQ ID NO: 7425 - DNA, 336 bp, Bacillus clausii
atgaaaggaggttatgccatgtttcttgcgccacgacgtccttatcatcagcagatgagccaccacaatcaggcgtttttgcaacggcaacagcctggttttcaacatcccccatatcagcgccgaccttatcgccaaatgccacagccgttccagcaaagtggattcccgcaacaggcggcgcctaaaaagaagtcgatctggacagctccatttacagacgatgaaggaaaatttgacctctcccgaacagccacttcagtcgataaatttgtaaaaacattccagcaagtgtcgccgtatgtatcaagaattagcagttttttcactagatag

SEQ ID NO: 7426 - DNA, 588 bp, Bacillus clausii
  misc_feature (1)...(588): n = A,T,C or G
atgnaagatggaggaagtggattattacgaagtgacgtggcttttttgctgctgttgatcgaacatggcgaaaagttgtatggccattggcaggctttagaaaaggaattgcacgaagttatgagtgaaatcggccatagccacagcatccatgaactgttgaacgcgctgaatgaagaaaacggggtttcgtactacaacaaccaaatgatagtgagcacacaacacggaggcgaggaaatccgtgttaatttaagtgccactgtcgaagcgtattacaacggcttatcgatagtcgagcagcaacaggaaaacgtgcaagcgtttgtgcgcttgtataagcatgaggtcgtagaggatgtcgaaaaccgaaaaaaggcgctcgtccatgcgtttaacgagatggaaagcaatcctaaggcctatcagcacttgttaaataaaagccatgcgccagcgggcagccgcattgaacgaattgtcgtccatgaccaaatcggcggaatcacattgcctgaagggccagtatgggaagcagctttggtggagcaattggaaaagcagcgcaccttccttgaaaagatgcgt

SEQ ID NO: 7427 - DNA, 585 bp, Bacillus clausii
aataggttgaacaacggaatcggcacggtactcacgcaaagatgggactgcttaccgcggtgaacttggtcactttcaaaaaaggctgcaacatttgcaattagggcaagaatggctttcagatgcccaacaggcgaaagagaaagcaaaaaccgctgtggccgtcactgcgtttgaagcttatgcgcgctgtccattccgctatggtctggaatggcttttagggatcaagccgccagcaggtcaaagcgaagggcttccggcaaataagattggaacccttattcatcaatgcattgaaacattgtatcgccataaattgaatgtcattggcaagcctttttccaccctttcggaagcagaaaaagacgaagtgcctcattggcttgtatcagaatggcgccgccgctttaatgaggacattgtgccatttgtcccttatatgaatcgtttcgagcttgaacaagaagaaacatggtgggccaacaagctccgtctttggtgggaagcagaacgggcgcggttttgggatcggaaggagttggcggatgcttacattgaagggctggaagtacccattgttct

SEQ ID NO: 7428 - DNA, 204 bp, Bacillus clausii
  misc_feature (1)...(204): n = A,T,C or G
ggaaacgttatgggagacacgggcgatccatccaagcaagcaggaattttttgttgatctatcgaaacggaaagggcgctcgattttaacatcagcttttctgaaccacgggattggctaaacttgtacggtcattgagaccacactcgaacnggacggcccgatcattgagaaggatcgttggacgttatggattgccgagaa

SEQ ID NO: 7429 - DNA, 639 bp, Bacillus clausii
  misc_feature (1)...(639): n = A,T,C or G
ccatttgttcatttgtgggcggnacggtcagcgttgtgttgttaatgctgtttgcgccaatgttagcaagcgtcgcaatttactttggcccgcctgagtattttgcgcttatgcttctcggtttgacagctatcgccagtttaagcgacggctcaacattgaaagcgctgacatcggcggttcttggttttatggttgtgacgatcggaattgattcacaaacggggacaacccgttttacgtttggcagtgtcaatttgcttgatggtatcgattttcttattgttgctcttggtgtcttcgctttggctgaagtgtgttttcttattttaaaccggaaagaatcgatgagtggttttaaaaacatcggcagcttaaaattaagcaaatctgattttaaggaaatgacggggccgatgacaaggcagtctttcctcggctttcttctcggtattttgccaggggcaggcgcaaccatttcatcgtttatcgcctacatttctgaaaaaaggcttgctnaaaaaccagaagaatcggcaaangctcgattaaangacttgccgccccagaaacagcgaaacaatgcgggaacaagcgggcgcatttgttgcccattgctcacccttggcatacctgggt

SEQ ID NO: 7430 - DNA, 333 bp, Bacillus clausii
  misc_feature (1)...(333): n = A,T,C or G
atgttttatattatggctgctttaacgaagccgcggcatggttacgctattatgaatttaattgaagaaacaacaactggcgcgatcacgataggcccggcttcgatgtatacgattataaagaagttattaaaacaagagtggatttacttatatgacggatcggattcaagacgtaaaacatatttacttaccaaaagaagcatagaagtgctagaggaagctgtggaaaattcgaaaaacggtcattcaattggcagaaaaaggattacaggaagctggaaaaatgagacnaaccaagtatatgatgtcaggtgggttagccttttctga

SEQ ID NO: 7431 - DNA, 309 bp, Bacillus clausii
  misc_feature (1)...(309): n = A,T,C or G
acggaatttgtatgaccagtataagctttactgtgacgagcgttttactgttgggccgtatgaaggtttcagagcaaataaccaagcctatatcattttgccaaaggatgaatgcatggccgaggaagtggagatgatggcgttttgcgantntatgcgccaagcaggcgatgagtcagtcctggaacttgtaccaagtcgcgtcaaccagtcttccgccttaattgatggcgttgagtcanacgtgtttaaagtcccngcattcaatgaatttcgcggcgtccggattcaatcggattgggatttagg

SEQ ID NO: 7432 - DNA, 445 bp, Bacillus clausii
atgtattttgttgacaggcagcggatcgaacaaacgcttgattatatggaacatttattaaaaatgatgaaggaagaggcgtttggtacgagtgataaggaccgcctcgcattagaacgaaccgcctctgtgctgattgaagcagttattgacgtcggcaaccagatgattgacgcctttattatgcgtgatccaggggggtacgaagattttatcgacatcttgcttgatgaaaaagtcattatagacgaaacggcagcaggattaaaacagttgattcgccgccgtaaagcgcttgtctatcaatatgcaagccttaaggcgaacgacgtacggagctggctccaggaaagccaaccaagtttggaggctttcccgcctgctgtccgccaatatttaaaaaatgaacttggcgtcattaccgcatttcttccagataaagaca

SEQ ID NO: 7433 - DNA, 600 bp, Bacillus clausii
  misc_feature (1)...(600): n = A,T,C or G
atgacggcgttngtgtactatccgtccgacagtagcgaagggaaggctacctcgacgtacatgtttcccgaagtctacgacatgcttgatgagcagccacttctcactgcgttgaaggatgcttactctatcgatatcaagacccagtgttacgacgaccttgctctctcggggaaggaaaagcgctatccggtgttattctatgtttgcggcgggggcggttctccagaatggggtactgtgatcagtacagacttggcaagcttgggatatgttgtggtaagcatcggccatcagaatagcacgatgtataagcgtaaagacgggcgcctgtttaatgtatcaaaggatttttcggatgtcattatggcgttttctgaagatccggagatggtggcgttggctagtaagatggagatgcggcctgacgatgaaacggccattgagatgtgccaaaacgtgcttacactgccgatccttgccaagttaacagagtatagcgaattacaggcagaagatgtaaggtatgttagccgattatctttacaaactagacccgggagagctgaaatccatcctttaanggcaaatgttgcttga

SEQ ID NO: 7434 - DNA, 252 bp, Bacillus clausii
  misc_feature (1)...(252): n = A,T,C or G
aattaccgaccaaggctatattaccaaccatgatcctgatggctacaatttatacgggattgaagtaatggtgcaccctgattttcgccgcatgaaaattggccgccgtatatatgaagcgcggaaagatttgtgccgggaaaaaaatttaaaaagcattattattggtgggcgcatcccaaactactacaaatatgcggacaaantttcaccacggggatatgtagaccaagtaacgatgcattttattta

SEQ ID NO: 7435 - DNA, 222 bp, Bacillus clausii
  misc_feature (1)...(222): n = A,T,C or G
tcaagccgtttgccgataaagttcagcctttagcgtcaaaatggctgccaatcgcaaaagcattcttagtgaaaaccnatcctcgggatttgcatgtcagtcagcttgaacaaacggttgagaacttagatgtggttgcaattaagtccttttatccttcatctggaatgaagcgccagcgtgaaacgtttaaatcggttcgttatgtgctaagcggtctat

SEQ ID NO: 7436 - DNA, 360 bp, Bacillus clausii
atgaatgccttttttgcttttacttatcaagaaggatcgttgtttttgttttacttgctcgttggattatgcatttttggctttgcccttgtcggcttccatcctcttatttcaattgcgattctatcaccgtttttacaagaacaagttgcggcctatccttacggcatcagcctattgctcattggcgttggacttggcacagtcatgataggcccatttaatgttacgccaacgattttggcgatgcagctaaatgccaatccgtacagcattattcgcaagaactttgcgtttgcttttagctatttgtggtttatcgttgtgatcgcctattcatgtagcctgatgattgcatga

SEQ ID NO: 7437 - DNA, 438 bp, Bacillus clausii
  misc_feature (1)...(438): n = A,T,C or G
ttgccggtgcttttctaatgattgccgccgattttataaacaancggaacaataaaaagaaacagcaagtngacgatatttcttacaaacaagcactggcgattgggctattccaatgccttgccctttggccaggctttncccgttctggctcaacgatatcaggcggcgtcatgcttggcttaacacaccgagcagcagcaaacttcacctttattatggcgatcccgattatggttggcgctagtgcgttgtcactgatcaaaaactgggacgcccttgagataagcttgctgcccttttacgcaaccggctttattagcgcctttctcgtttcacttgttgtagtccggttctttttaaagctgattaacaaaatcaagcttgtcccgttcgcgctgtaccggattgccctgggattgctgctgttgtttttgt

SEQ ID NO: 7438 - DNA, 636 bp, Bacillus clausii
  misc_feature (1)...(636): n = A,T,C or G
tgaaatttggcattagcccattcggagtctggcgcaacagcagcaccgacccaactggttctcatacacgagccggcgtagaaaactatgatgatctttacgccgacacccgccattggatccaaaaccgctccgtcgattatattactccgcaaatttattggaacattgggtttgaggcggcagcgtttgacatccttacagattggtggatttcagaaacagcgggttcccatactcatttttacgtcgggcaagccgcatacaaagtaggcgtcaatgatgtaccggcatggcatgaccctgaggaatacccaaggcaaattgcttatatgcgcgagcgcccagacgtaaaaggcagcatccactttagcttaaaagacttgcgtgccaaccgcctcggcgttaaagaccggcttacagaaacagaatatcagcgcccggcgctgattccagaaatgccgtggctggctggaactgtgccgaaaaaaccgacaaacgttgatttagtgaatcaaaagaatgggactatgctcaccatcgctgatcctaaaaatgagcatgcggcttattacgccatttaccgatttttgacggccaaaaaanccggttctttgggaaagcaattaaaaactt

SEQ ID NO: 7439 - DNA, 963 bp, Bacillus clausii
  misc_feature (1)...(963): n = A,T,C or G
agggggaatcgacatgacatcattcgcgaaagtacggagccaacagccgttagagtggggaaaaaaggcgtgtgaggcgattatgagcaagtacgagccggttgaaatgccgccagccaaccgctggcactaccatcaaggcgtgtttttatgcggcgtgcaccggatttgggaaatggatcacaacgaagcctactttcagtacgtgaaagactacgtcgatgccttaattgatgaagacggcaacttcctgtttcgccgtgatgagttagacgcgattcaagctggacttttgcttttgccgctgtttaggcgtacaggtgagtatcgctaccaagaagcggcccgcaaactcagaggcttgctccatacgttaaaccgcaatcgctttggcggcttttggcataaggataaatacccgaaccaaatgtggctcgacggcctttatatggctggcccatttgcagtccaatacgggcaacaatttaatgagcctgaattgattgatcttgtcctgaggcaagaagagctgatgcgcaaccatacgaaagacgaagcgacaggcctgtatgtccatgcttgggacgcaagcaaacaagtagctgtctgcgacaaagaaacaggcaagacagaggaagtttggggccgtgctcttggctggtatgcaatggcgcttgccgacttaattgacttgcttggcgagaatcatatgaaacgccctgtgttagaaagcgcgttccagtctttaatggcccgcctcctcacttaccaagacgaacaaacagggctctggtatcaagtcgtcgacaaaggcaaccagcctgataactggctagaaagctcctgcacgagcctgtttgtctatgctttggcaaaagggtacccgcctagggttggttggcgagaagccgttttttccatggtgaaaaagggcttttcagggttgttgaattatgcggntga

SEQ ID NO: 7440 - DNA, 186 bp, Bacillus clausii
tacgagcgcgaaggaaaaaacaaaattgctccgccttgctcgcgaattgagcattagcgaatttggctcacggcaaatgttgtacgaacgctattttttcggtgatccagttcgtgtcgcttctggtctttaccattctgcagattgtgaaaaacggaagtacgtagaatgggtgcaaaccttttt

SEQ ID NO: 7441 - DNA, 576 bp, Bacillus clausii
  misc_feature (1)...(576): n = A,T,C or G
agcttgctggggccatcactggtcaaatgggtgggtctagtacggtgtgcgactatgcacttcctggttctgttgtaaaaaagagcgcgattccaggcacattgacaaaatcagaacaaatagggcggctgctgcttcataaaagcggagatggcacacacccgattaaacggctgcttgctttccttaacggctacaagctgctaactggcaaacttactgacatccagcgtacactgacgggcggttttacccgggggatttgcgaagtcgaaggcatccatgacgatgcaggacgggtggtaacactccattttcaaaatgaacaattgttagcgacagaaggggagaaaccgctggccattacgcctgatttgattgcgatccttgatgttgaaacggggcagcccattacgactgaangattgcgctacggcacgcgggttacggtcattgcatttccgtgcgatccgaaatggcgtacgaaaaaaggaattgaaacagcagggccacgttattttggctatcctgtcgagtatgaacctgtagaaaaattgcangaangtggaagcaaat

SEQ ID NO: 7442 - DNA, 225 bp, Bacillus clausii
  misc_feature (1)...(225): n = A,T,C or G
caaatcctattancttgccaccgccttttacaactttagaaccaagatcaaagatgcctttgccaagcttaccaatttcaggggcaaataatantgctgttcctagcccctgttggctgtcatcaccaaacgcgagcatgccaagaccagctagagatgcaataccaccgattttgccaagcgctccaccaaaacgaccaacattttttgtaccagcaacgactt

SEQ ID NO: 7443 - DNA, 389 bp, Bacillus clausii
  misc_feature (1)...(389): n = A,T,C or G
atgaaagtgaatggcgaagcgggcaattacgagcaacaagtcgcagtcgcacaagcgcttcatgacgaattggaagaggcttatccaggtttgagcagaggggttttggctgactctgctcaatcaacgacagaggatccaaactcagtgtctgtctatgtaggcgggcaggaaaatggtgatgaagaaatagacatggcggtcgttctcgtccaagaaatggcagaaaagcttgagatcaaacaaaaacaggaacggagcggaagagtcgtcgatttcgatnagcggggaggggttatgatcattacgacaacggcgtttgtggatcgtntggaaggggccgagacgaacatgctcctgttcacgcttgagagcaatagaaacgatag

SEQ ID NO: 7444 - DNA, 124 bp, Bacillus clausii
atgaacaaattcgaacaggacgttcaagataaagcaaatgacatcgtcccttcaggtatcggctttattgcttcatttgcttttttcacaatcatcttccttatcgccaatattgtcgacgtgg

SEQ ID NO: 7445 - DNA, 438 bp, Bacillus clausii
  misc_feature (1)...(438): n = A,T,C or G
aattgaaaacgatccgcctttatgtggataacccaacgttgttgaataactggacgtttataccagttgaagggtcgcaaatggctagttggtacaacatcgcaaaagcggatgtaggcttttaccaatggttttatttgcaagatgagacgcaaggtggcggctactatttaagtttaatgaaacggattaattttattgaatacggcacattcggattgctcgttattacaattgcccctgacctgttggaaagcattatgcaacaggaaacgcaccagacggtcgttgtcgatgaacagaattccattatttcgtcgtctgaaccgtcattcattggcgaaaacctggacgancttgtcgtaatgacagaccggggaaaaggaaagcatggattttacnaangccaagcaaatgggganccgaatcacataatgg

SEQ ID NO: 7446 - DNA, 498 bp, Bacillus clausii
atgaatgtctttttgtgggcgtgggaccctagtgatgcacgcttttttttagaagctgcacaaagggggagacggatgaagtcggcaacagcagggatcgcaatcgctcttctgctcgctggatgttcaaacgccaattttagctcacagcacatccagcatgacaaacattacggacaaggtgcttttggtccaggaccacttaattttgagcatatgaaacatgaaacgtatgatccgcgcctaacgaatattggcacaagctatcgagacgcaagtgtgcctcaccgtacgctcgccgacgatgctgcgcaagtggaaggcatcgttgagagccaaggattccgttctggcgccgcgattgtcaacggcggcgatgtttacgtaaaagcgtacccgccaccatcctggagcaaagaacagacgagcaagaggatggagaaactcaaacgtgcatttgaggcagaaatccctcgctatcaagtccatgtccgttaa

SEQ ID NO: 7447 - DNA, 87 bp, Bacillus clausii
gatttatgatggagaacaaattcaaattggcggcaacgaaacgtactatccagtttgtcgcaaatgccatcaacacccgcctttgaa

SEQ ID NO: 7448 - DNA, 522 bp, Bacillus clausii
tgaacatcctgtacttaaatccttcctttctattaaagaacaccatctgctttattaaaaggtgttagatcagccaaataaagaaaacgttagtgaattagacttagcatttcgcctatttttctacgagttacgtctgttaaagtatgtttcaacactaattagaaattatacaattgatgttattaagcgatacaggaaccatttcaaaaagcacgtgtatattcttgataaagaggctcctactgacaacgtctctaacactttacaaagctattttgccgtagattattcgaccgatccagcagtattgtttgataaaaaatgtgaatcgatttgtcagtgtgttggtaataagcaattaaaaattgctcttaagggtttaacaaaaaagcaactccaagtattagagttattctatatttacgacatggataaccaaagtgctgcccaatatcttaatgtctctaatcaaaatatttcaacaatccataatcgggcactagagaagttatacaagaa

SEQ ID NO: 7449 - DNA, 270 bp, Bacillus clausii
atgagtcggtacggcccttgctgcaaccggatccgtccaaaagcagaccgctttcctgtgcatcggaacaaatacgaacgaccgtacacggtaaataccgtatcgccattgtttttatttgtttccttaatgtccagcaacctttcaaatagaattgcttccatcaattggcgtcgtacacgcgatgccgccttagaacgtggggctgcctgcatgtgcataggcgacaccttcctttttgcccgtgcttttaaacgggtttttaattga

SEQ ID NO: 7450 - DNA, 486 bp, Bacillus clausii
atgaaatgtaagtataccagatttttggaagaaaccgagtaccaatctgtcagaatagggtgtggtgtgatgcaaggaaacaacaaaaatctcttattcgtttatgggacattgcgaaaaggcggcgccaacgaccattacttgcagcacagcgagttagtagagggtatgtgttggatcacaggggaaatgcacaatacaccatttggctatccgattgttcgttttcgcggccaggagaaaattagaggcgagctttatgctgtcaccagcgaagaacttgtccgtattgacaaattagaaggctacgatccaaaaggcaaaagcgaaaatgagtatgagcgtgtcgaatgcactgtctatacagacgaaagcgaggcaactgcttacacgtatattgctggaaaaggtttcgcccctatcaatgaaccaatcattggtggggattggctcgtttttttggcaagaaagaaaacgggacgttga

SEQ ID NO: 7451 - DNA, 234 bp, Bacillus clausii
aagctgatgattacaaccgctcaagtggcgagatccatgatctcgtgagcagattagatggttacagagaccagcttcaaggaatgtgggatggccaagcttcagaggcgttcattcaacagtacgatgaattgaagccatcctttgtccgcatgggcgacttgcttggcgaagtatctgaacagcttcgcaacagcggacggacacttgaagaaacagaccaacaaatcgcgg

SEQ ID NO: 7452 - DNA, 238 bp, Bacillus clausii
atgtacatcactgtaacagttgacatgaaccgatactcagggaaacggtttgatttgcgcctctctgatcaatatacagtcaaaaaagtcattgatctcgtttggggcattgagaagctgaaagttccacggcgtgatggaagctggatccgtgtccaaaacaaagaaactcatgtctacgggagccaaatacttgctgaacgtggtgtaacaaatggagaccgcttggaaatcttat

SEQ ID NO: 7453 - DNA, 933 bp, Bacillus clausii
agaagaagcgattttatttagaagaacaaacaggtgcagctttttacagggacgcagaatcgaatacatatacattaacatttcaaaccgcagaaataaagctgtcgaattcgctagaagcggagttgttaaaacaacaagatccgctgctcgagcgtacaattgctgaagcagaagatgagcttgtcattaccgttcatccgcaagagacaatgcagccttttagcaagtttcggaaaaaaggcgattacgccaaacaaatcattggccactcacttattcgcgcggttgccgagcatcacagttccaggctgcatttaattgtctgtccggagaacttattagtaacagaggggcttgatgttcactttatccattatggcattaaagaaagcctcccgccatatgaaaagaacgaagaaaagctgtttgctgagcttaagacaacgttgcttgtgttgcttgatggcgagtatcgctttgttgagtacatgaattttacggacacaatgaaattgtcggcaagagcaaaaaaattgctagaggctgatacaatcgaagcgcttttgagctgtgtagagacatggatccaagaagaagagcgacgcgctagccagatgcatatggtgccaaagcaaaaatggcgcttgcaaaaaagcttgttttttgctgtcacaggactgcttattccggctattgtttttaccgtctatgcgctttttttccttcatccgcgtcacgacgcctttattgccagcaatgaggcctatattaacagcaagccaagcgatgtcattactgcattggaaccatataacccgagccaaatgccccgcgttgtccagtaccagttggctcaatcgtatgttgccaatgaagacttgaacatggatcagacggcaaatgtgcaaaatacgttgacgcttcaagctg

SEQ ID NO: 7454 - DNA, 165 bp, Bacillus clausii
ttgagcagcacgttgaatggatttccgattgtattgaatatcttcgcagtaacggtattgaagccttggaagcaacggtggaagcggaagaaggttggagcaagcattgtcaggaaattgctgattctacgttggtaacaaagacggactcctggtacatggggc

SEQ ID NO: 7455 - DNA, 651 bp, Bacillus clausii
  misc_feature (1)...(651): n = A,T,C or G
caaacaaaaatggaaaaagattgtcttaacggtggtacttattggtactgccgtttttctatgtcttcttttacttggtaacatttgcccaagctgctggattanttgatgatacggtatcggaagacaatctgtattccaaatacccacttgaccattaccaactcgatttttatgtggacacaggttgggattggctgccatggaactggaacgaaggaataggaaaacaagtcatgtatgggctctatacgattacaaattttatctggattattagcttgtatttgtctaatgcaacaggctatttaatccaacaagcttattctctcgatttcatttcccaaactgctgatgccatagggaaaaacatgcaaacattagctggggattactgcaagtggttttggcaattccnggcttttatgttaggttttttgcttcttttcattttagtgattggggatttacgtggcatatacanggattaatgaaacggggaaacgacgaaagccattcgggcgatcctaaacttttttagtcgttttttattttgtcggcctcctttattgcctatgcccccaaccttatattggctaaaaattaatgaacttttccggcagatattaatcagggcaagtttagaattaa

SEQ ID NO: 7456 - DNA, 105 bp, Bacillus clausii
cgaaactaaacgaacctgatccagaatcagctggcgtagtgcaagaattgttaggcgggcgctttggcgaaatgtcgacactgaacaattatatgttccaatcgt

SEQ ID NO: 7457 - DNA, 156 bp, Bacillus clausii
acgagtgggagcttcgtgctgcgacagaaaacaaagcgagccaagctgtcgccgaacgcctaggttttacaaaagaaggcgttatccgccatgctgaagtcgtcggaggggcgcgccacaaccatgtcgtttatggtctgttaaaaaacgaatggc

SEQ ID NO: 7458 - DNA, 99 bp, Bacillus clausii
agcagccttgaaaaaagggagagccttacgctcttcttgccggcaagtcgcttgggatgatttttgaaaatgctttaacgcgtacacgcgtttcctttg

SEQ ID NO: 7459 - DNA, 180 bp, Bacillus clausii
taggcgccgatcagccaagctccattattgaagtgtgtgaacacaaccggcctgggcagttagcagatgtcgccactgtttttaaaaaagagcgtatcaatattgttagcgctgtcgcttaccctagcaaaaaagcagataaatatatgctttcatttcgtgtccaaacgattgatccca

SEQ ID NO: 7460 - DNA, 258 bp, Bacillus clausii
atggcctattttggttcaacactcgaccatttaaactacatttccgatccaactggcccagagctttatgtcggcgatgttgtgaaaaacaaagtctattatgaaaacggttacttgcatttgcctgaacgttcaactgtagggctcggaatggagcttgattgggaaaaagtcgagcagtatcgggtcgagtcgctcaattgggaggatgtatccgtccatcaactgcaagatcgaacatcacaaacgcgcgcttaa

SEQ ID NO: 7461 - DNA, 156 bp, Bacillus clausii
ttcaagccacgctagctgaattaaaaagcgattttgtccgcatccaaggcgacgtcgaaaaaattgagacaactggcggcaatgtcgcacaagcagtaaaacagctaactgctttagaagaggaaattgcaagtgtgaggaaacaacttaacgagg

SEQ ID NO: 7462 - DNA, 1293 bp, Bacillus clausii
  misc_feature (1)...(1293): n = A,T,C or G
tcgttcagacaggggaatcgctctatggcattgcccaagcttataatacgtcgccccagtcgattgccaccgccaaccaactggatgcccctaatgaacttgttgttggccagacgcttgtcattccgatctacggaaggtactattttgtccaccctggtgatacattaagcgccattgctgcgcgctatggtttttctgtccaacagttggccgaaataaacaaccttatgccaaatcaagttctccctgncggntntcgtctttacttgcctcctgccgcaaagcaggaaattgaaacgaatgcctatattgaaccaacacaggatacgattagcgaggcgttgctcgcttctgcccgtgaaacagctccgtacttgacgtacttagcgccgttcagttaccgcatcactgctgaaggctcactgttgcctgttcccctaggcagtcttcctgatatagccgatgaaaacaacaccgctttaatgatggtgattacaaacttgcaggaaggggcatttagtggcgaacttggccagactgtattagaatcacctgacatccaaaacgcgttccttgaggcgattgttacagaagccaatcgtgttggccgcttttctgatgtccacttcgattttgaatttttacctccagccatgagggaaccttataatgcctttctaagaaaggcagtcgacaggctccatcaagaagggctgctagtttccactgctcttgccccaaaaacaagcgccgcccaaacagggcaatggtatgaagcccatgattatcgggcccatggtgagattgtcgattttgttgtgctcatgacctatgagtggggctactcaggcggaccacctcaagccgtttcgccaatagggcctgttaccgatgtagtcgaatacgctttaactgaaatggcgccagataaaatcatgcttggtcaaaatttatatggttacgattggacattgccgttcgaacctggcggagaatacgcccgggcaataagcccccagcaagccattgcattagcgcgtgaacacaatgttgcgatcgagtttgacacagacgcacaggcccctttcttccactatattgacgtgaacggtagggaacacgaagtgtggtttgaagatggccgttccatccaagcgaagttcaacctaattaaacaacaccaacttcgtggcattagctactggaagctcggcttgtcattcccgcaaaactggctgttgctcaatgaccaatttacgatccgcaaacgccgttaatatacgtttaggc

SEQ ID NO: 7463 - DNA, 213 bp, Bacillus clausii
tatataatgcgatcgcctacttagagaagacggttgattcgattattaagcaaacgattgggtttgaaaacataacttgcatccttgtcgacgatggttcaaatgacggatcaagggaattgttgaagagttactcagaaacctacaaaaatatcgttagcattttcctggaaacgaacaccggtaccccagcgtttccgagggaacttggga

SEQ ID NO: 7464 - DNA, 204 bp, Bacillus clausii
ggaagcttcctctccaaaaactaaacaatctttttgcaacggatattcctgacgaagagaataacctcgctggctatgtattaaaacattttggccgccttcccgctgaaggggagcaatttgaagcaaaagggttactcttttctgtgcttgacgtagatatagagcgcaagcgcatagtaaaagtgcgtattctcaagcaag

SEQ ID NO: 7465 - DNA, 472 bp, Bacillus clausii
  misc_feature (1)...(472): n = A,T,C or G
atgataaaagcagagcttgttgagcagttgtgcaaagatcgtcaatttgccaatgaactgaatcaactccgtcgggtgctgtctcttttaacattgaagcgttcattggtggcggttcatgatgcggttcgagagcaacgagcgggggatgatgccatttcccacttttcgccgctttatatgtgggacaagcaaatcaatggggccatttgcgaacagcagcaacaagttgcgatgatcgtcaagacggttaaacgcgctgcaaaagaattacctcccttggcaacagttatcgaaaaccgaacaaaagcatgcacagtcactggccacgcttgcacaaagcttgccgcttgctggaaacgaggaggaagcggttgcgatgatgaacgaagcgctcccaagcagagtccaaaaagcatggcaagaatcgttgccgtctctgtacgttttttatggcacaagggncatataa

SEQ ID NO: 7466 - DNA, 210 bp, Bacillus clausii
gttcaaatggattagttatatagaaggcatctcgttgctgctattgctgtttgtagcaatgccactaaaatattttgcgggtattcctgaagcggtaagcattgtcgggatggcacatggcgttttgtttattgtttatatgctgtttgtcgcttcctattttttcagccgcgcttggtcatttaaaactgcgctgttggcaagcatcgc

SEQ ID NO: 7467 - DNA, 618 bp, Bacillus clausii
  misc_feature (1)...(618): n = A,T,C or G
atggttggaaaatcaaagcaaacaaaaggttctttttcccntattcgaccgttacagcggctaacatcaaccgcaaagaccaataaagaacgccaaaatgacagtacgaaaccaacaactttgagccagaaagtaggtcaagtaacaggaagaatgcttggtgcgaaaaatcaattccgtgcgaatataaaacaccgtaaggagcaattgcatgatttacctactactgctcaatatgcggtgatgcaaggaaaagaacagcttacaaaacctgcccgtgattttaaagaaggtatgaagcaagcaaaggaaaagagacaaaaaacacatgcagagcgtcaagcaaaacatcgtcaaaccattgcagataggcggcaagcattggataagaaacgtaccccttctcgaaagactgctagttatgaacgaccagtcacgcatgatgtcaatgaatctgcacatcaagatagattaaagaacccaactgttcaacaaaaagaaaagacaagacctgtcacaaaaagcgagcatatgaagcaattcaaattacaacgacagttatcgagcccagacagaaaagagtattttacagatnatcccnaacaacgtgttccatag

SEQ ID NO: 7468 - DNA, 963 bp, Bacillus clausii
atgaatcgtaagcggttacaatgggttggagcactagtggtggtgttggttttgtttgtatacagtagcggtttagcatctgcacaaagcggctttcacgtaaaaggtacagagttgttggacaaaaatggcgatccttacgttatgcgtggcgtcaaccatggacattcttggtttaaacaagatttagaggaggaaatccctgccatagcagaaacaggggcgaacacagtgagaattgtcttatccaatggacagcaatgggaaaaagatgatgcctctgagcttgcccgtgtgcttgctgccacagaaacatatgggttgacaaccgtgctggaagtccacgatgctacaggaagtgataatcccgatgatttagataaagcagtcgattactggatcgaaatggctgatgttctaaaggggacagaagaccgggtaatcattaacattgccaatgaatggtatggggcgtggaggagtgacgtttgggcagaggcatacgcacaagcgatcccgcgcttgcgcagtgctggcctcgcccatacgttaatagttgatgcggcaggttggggacagtaccctgcctctatccatgagcggggagccgacgtatttgcctccgatccattaaaaaacacaatgttttccatccatatgtacgaatatgcaggagcggatagggcgacagtttctgaaaacatcgacggtgtacttgctgaaaatcttgctgtggtaatcggtgaatttggccataggcatcatgatggcgatgtcgatgaagatgcgattttggcctatacagcagagcggcaagtgggctggcttgcctggtcatggtatggcaatagcgggggtgttgaatacttggatttagctgaaggcccatcaggtccattaacgagttggggcgaacggattgtctatggggaaatgggcttaaaagtaattgatcacttgtaa

SEQ ID NO: 7469 - DNA, 474 bp, Bacillus clausii
atggcctatgcagggccgtggcattggcgccaatacgcagaagacggagagtttgaatgggacattgttgaagtgccggcagggaaagctgggaacaaatcgcagttgcttggattgccgatcggcattggatcgcaaacagaccatcctgaagaagcatggaagctgttagaatttttaacccatggcgaaggccagtccatccaggcgaacatcgttggcgccaatccgtcagtcattcgtgaatcacaaacatttgcggaaggccaatgggaaccagaaaatgtcgaagcattccagacgatcatggaagaaaacacagttgtgcaaagcatgtttccagacaagttagaggctgtctctaacattcagcctgtgatcgaccagatcatggatgaaacccgggatgtggatgcagagggagctttagagaaactagcagaccggcttcgtacagaatttgagatggactaa

SEQ ID NO: 7470 - DNA, 104 bp, Bacillus clausii
atgagtcgcttttgtaaatttggaaagttacacgttactaaagggaatgtagataaattattaggtatactactgacagtttccaaggagctaaagaggtccct

SEQ ID NO: 7471 - DNA, 108 bp, Bacillus clausii
tgttcgtgctgacttgcaccatatcataaaaatcgaaacagcaaagaatggcggaaacgtaaaagaagttatggaaataagacttagaagcaaacttaagagtgtgtt

SEQ ID NO: 7472 - DNA, 411 bp, Bacillus clausii
atggtctgcattagacccagacgcgtgccatccaatgggttttggcgatatagagcaagatgcagcgcaggtaaagaaagagatccaagtttctgaagagctcatttatattaaagattctggggacgtaggggtggaatcgaccgacacgaaagcagcgattggtaaacaagtagccatccaagctgccatggctttaattatccgcatctctttagctggaaacgacaatgtcggagatattacacaagaaattcttcaggcctcaaagacgaagcaaatcactcgccaaaagacgattgtcgacaattccagaaatgttcaaatctcaacgacggatacgcaagtggcggtcaacattcaaatccaaatcgcgattctcttggctattatcgtcgaattggatatcct

SEQ ID NO: 7473 - DNA, 211 bp, Bacillus clausii
  misc_feature (1)...(211): n = A,T,C or G
atgagaaaagagaaanaattntagtcagaagagcggcgggctgcgattgttgagtggctaaaaaagganaacgccccgttaaaaggcantgatctcgccaagcgggcaggtgtcagcaggcaagtcgttgtccagnacatgtcgcttttgaaagcgaaaggggaaccgattttcgctaccgcacaangatacatgtacttggccccggctt

SEQ ID NO: 7474 - DNA, 771 bp, Bacillus clausii
atgcgaaatgttgcttacttaagggggctcggcttccagcctgtgctcggcgaacatgtctatgcccgtaccggatttttatctggtccgccacaagaccgcgccagtgattttatgacgatgatcgaagacccttcgattaaatggattttgccgacacgaggcggcgtaggcgttgctggcatttttccataccttgattttgataccatacgcgccaatccaaaaatcatttcaggctatagcgacattacgattttattaaacgtgctttaccaggatgcagacttgattggcttccatagtttgcttttgcttgattttcaaaacggcacgcctgactacaatttcaaccagttcttctcgtcaaccatgatgccatcaagcccacgccttctagaaaacccacctggcttcccgcttaacggcctcgttaatggaagaggaagaggcccgcttgttggtggcaacctcacctcttttgttgacagccttggcacgccttatgaaattgatacagccggaaaagtcatttttttagaagatacgcatgaaccagtcaatactgtctaccgctatttggcacacctcgaagctgctggcaaattcgctgattgcgaagcgattattatgggcacatgcacgagctgcccgatcgcctacaacacaagctatgacgaattgatttccggttttcttgtgcctttaggcaaaccacttgtcacgaatcttcaatcaggacatggttactacaaagccagtgtgccaatc

SEQ ID NO: 7475 - DNA, 573 bp, Bacillus clausii
  misc_feature (1)...(573): n = A,T,C or G
attgtctttgaataccatcggccgcagaatcgaccgtttgctgaatgaagaactcagcatgttcgttgcgcagcttcctcccccgcgttccttcagccagatncagacgcgattgagacctaagcatggcagaatcgtagaccagaagcggctaggcggcggctctcattccacaatgggcacaattactgatatctcaccgattctccgtcttcttttctccagagcaggccagccctacgttggagaatcaaacatgttctcctttaacgatccccaaggtatgtgtcccgaatgtaacggtattggccgcaaactgaacgtcgacatggacaaagcagttgatctgtcaaaatcgttgaacgaaggggccattaaactacctgattataaagtcgacggttgggactggtcattggttgtacaggcaggaccctttgaccctgataaaaaactgagccactattcggacgaagagctagaaaaactgctttacagcaaagcgaaaaaagtaaagatggactttgcaggaaaagcancaaatgtcacagtagaaggcgtgattgagaagtt

SEQ ID NO: 7476 - DNA, 303 bp, Bacillus clausii
  misc_feature (1)...(303): n = A,T,C or G
aattacggaaaatgattttaagcctattgtaggtcatcgctttcaatttcgccatgagccatccgaatggtgggatggtattgtcgaaggcgaagtgcttgttgtcgatgaaccgaatcgcttgtcttatacttgggcaaccggagaggaaaggcataccgtcactttgacgcttcaggatttaggggacggaaaggtgaaccttcatctcgaacaaactggattttcgaatgtncatggcctcgaaggcgcgaagcatggttggagtgcttgggccaacgaacttccacaagtgttggaaca

SEQ ID NO: 7477 - DNA, 495 bp, Bacillus clausii
  misc_feature (1)...(495): n = A,T,C or G
atgaatgacgatgtcgaatcggttcatttgtctgttctagaccagtcacaaacggcagaaagcagagaactaattgaccgtttaacaagccaaggcgactttaacattatgagttatgaacacaacgtcagtgttctggaacacctcctggataagggcgacattcatgcaggtcttattattccagcggattattcaaaagagcttgccacggatacagcggttgtacaatttttattcgacggttccgatccgacttatgcacaagaggcgttgttccgaagcgagtcgcttttgctaaactatgcacagacagttcagacggaacaattggtccggagtggagcagaagttcctaatagcccattaaagcatgnaacacaggtgttttataatccttccatggacagtatggaatttaatattccagctttaattggtctcatcatgcaagaggtcacattaattttgactgcatttgcccttgttccgtga

SEQ ID NO: 7478 - DNA, 402 bp, Bacillus clausii
atgaaatatccaagtgtgcaagaagtcattaggattaatcattatgtgatcatgaaatactcacctgatgaacaaattggcgtaaaggaaatgaacttactggaatcggctctccatcgtccaaaacaatcagtgcttggaaaagatgcataccctactatctatgagaaagccgcagctttgtttcaatcattggtgcagaatcattgtttttataatgctaataaacgaacggccttatggtcggttgaatacttccttgttacgaacggctatgaattgacaaatgatcaagtagagttcgaacgatttacagtagcaattgcgactgatcatttagaggttgcggatattagcaaatggcttcgcaagcacagttctcttcaagagcataaaggataa

SEQ ID NO: 7479 - DNA, 282 bp, Bacillus clausii
aatcggtgcgtctgctttgtttggcgtcgctggcttgctaatgacagcgcttatgggcacagggctaggcgatgcttggtggcaatacaacccttgggcttgggggatacggttatccgggtatgcggggatcgtcgagtttgaacaaatggaacccgctttcttatcatttcttcaacaagaaatgcgtattgggttcatgatcgtcgcatctgttatactattcgtaacggttataagcagtatgtggtttcatcgttgggaaggaaaaaaggcgtcaga

SEQ ID NO: 7480 - DNA, 222 bp, Bacillus clausii
ttacaacatttgccggcagcatattggcaaatgtgttgtcattacagaacacaatggcaaacgccattatggccggatcacgcgagtggacaataaacacgtctacttacagcctctcggcaaccgcggctttggctacggctggggttggggctggggctggggttatccggttgcccttggcgctattgccggtcttgccttagcgggcttattcttctg

SEQ ID NO: 7481 - DNA, 159 bp, Bacillus clausii
tcgccgctttttgcattcgttccgttacgcaagcgcagggctcattgatgtcattaagcatgagcagaacatgcgtatccacttaattagtggggcggttgtattgattgctgattgggcgttgtctgtttcaattgagcggtggctcgtgcttttgct

SEQ ID NO: 7482 - DNA, 435 bp, Bacillus clausii
aaaaagcagtttttatctggtcagggaagacatgctcacagatgcgatgcagcgtacgcttgaagccaaggcgattctttctgcggggaaggtccgcaaaatcaatgaagctgtccatcgtgtcggtttaagcaggagtgcattttacaaatacaaagatgggatttttccgttccatgccattgcaaaagaacgaatcatgacgttctctatcaaccttgcagatcgatctggcaccttatcgcaattgttaaacattgttgccgataccggaggcaatattttaacgattaaccaaacgatccccttgcaaggcagagcaaatataaccctatctgtcgatacagccccgattgaaatagacataaacgaactgtttgaacggatggaggcgcttgagtctgttgaacgggtggaactagttggttcacgatc

SEQ ID NO: 7483 - DNA, 501 bp, Bacillus clausii
  misc_feature (1)...(501): n = A,T,C or G
acttgacaaaggcgccgaatggctggaacagtttggcattaaattgatccgtaaacggggctacggcattgctgtaaaaggcacggaaacgaatattcgccaagcgatgtcggccattttntcggaaaacctcacggaggaagcgttttatgaagccgtctattcaggccaaatgcaaaatgaagtcgctagccgtcttttgcattttgttgacttagaaacaatccgccttgtccagtcgacgatacaacgtgtgaaagaaaagcattttgatgacatggctgaccaatcattcattgctcttgtcgtccatgccactttagcgattgaacgaattaagcaaggcgaacaaattagaatggacgcgggccagcttgaagcattgcatcaggaagatagccttccggttgcacaggagttagccgaagcgcttgcgcaaacgttccaaataacgattccggaagcagagattggctatttagtcatgcatttgcgtggggc

SEQ ID NO: 7484 - DNA, 117 bp, Bacillus clausii
aaatttagagcattaccgcattttttatacaacggctaaagagcaaaactttagcaaagccgcttcctccctatttattacacagcctagtgtcagccacgccattaaacaattgga

SEQ ID NO: 7485 - DNA, 507 bp, Bacillus clausii
  misc_feature (1)...(507): n = A,T,C or G
cggaagcatcggtacgattagccgatgccgaaattgagcaagcagaaaatgaagccgcttctaatgtgcaactagatgctcttaacagccaacgagaccaagcacaagcccgtctagaacaggctcaataccaacaatcaaaagcaagcattcattcaccaaaagacggcgccgtttntgagtggctaatcgatgagggcgattttgtgcaaactggcactccacttgtaacgattttgacagacgctccttttgaaacaaccatttatgtaccacaaagtgaacttcccgagttttctgaaggtatgtccgttcaaataagcgctgttgctttgcctggagaaacattcgaaggcactgtcgactttattgaaaatgaagcgatatacagttcgcaaacgattgaaacaaacgaagacaaagccagccaagtttttcctgtgcacattactattgaaagcaacgacgaacaattnaaagccnggatggatgttnaaatttggatta

SEQ ID NO: 7486 - DNA, 99 bp, Bacillus clausii
agcttgatgaagtcgacggcatcggcgaagcaagagccaaaatgattaaggacggattaaaccgcattcaagagcagctattcgttgatcgccacattt

SEQ ID NO: 7487 - DNA, 105 bp, Bacillus clausii
  misc_feature (1)...(105): n = A,T,C or G
attggagaggcaaattcgatttcttaaaagagtattgcgaagtagtctatttgccgcgtactgctggtatttcgacgacaaaaattaagacggnaattgctagag

SEQ ID NO: 7488 - DNA, 310 bp, Bacillus clausii
atggaaagcagacgtttttttccggcggtatgtattggcacattcgtgagcatcagcattgccgtcgcattcagtatactcatggctacattgctttatttgacttcactgactgaacagtctgttcgttgggtaatggtaggctgcggttttttagccttgtttgtaggtggctttttttcaggagctaaagcaaaaaacaaaggctggttagccggtgcgtttacagcactcttgtttgtcggcattatgctggcaatcagttacttaggctataatgaatccatcacctccagccagctgcttctcc

SEQ ID NO: 7489 - DNA, 456 bp, Bacillus clausii
atggtcctcccggattccgacggggtttcacgtgtcccgccgtactcaggatccactctggaggaaacgaagtttcagctacagggctgttaccttcttcggcctgcctttccagacagttcacctactccgtttcttgatcactccgttgttaagtgtcctacaaccccaagaggcaagcctcttggtttgggctgtttccgtttcgctcgccgctactcaggaaatcgcatttgctttctcttcctccgggtacttagatgtttcagttccccgggtctgcctctcgacatcctatgtgttcagatgccagtaccatcccattacggatggtgggttcccccattcggaaatctccggatcgaagcttacttacagctccccgaagcctatcgcggttcgtcgcgtccttcatcggctcctagtgccaaggcattcaccgtgcgccctttctaa

SEQ ID NO: 7490 - DNA, 123 bp, Bacillus clausii; identical to SEQ ID NO: 6990

SEQ ID NO: 7491 - DNA, 223 bp, Bacillus clausii; identical to SEQ ID NO: 6991

SEQ ID NO: 7492 - DNA, 435 bp, Bacillus clausii; identical to SEQ ID NO: 6992

SEQ ID NO: 7493 - DNA, 365 bp, Bacillus clausii; identical to SEQ ID NO: 6993

SEQ ID NO: 7494 - DNA, 96 bp, Bacillus clausii
aaggacaacatggccatgtggccatggttggtgacggcgttaatgacgctcctgcacttgctgcggcaacggttggcatcgctatgggcgggagca

SEQ ID NO: 7495 - DNA, 351 bp, Bacillus clausii
ttccggcccgtaccctcttccttgcctaccttcgcgccagccaaatcaacgacgatagcgtttgtgtggatcttcattcccgtaacgctatggctacaggggaatcggccgaacgaattctagccgtatctgcttggcgcgaaacgataaattttacagatgcggaacgcgctgctctggcactcagcgagtcgatgactcgactgcatgatcagattgatccggtgccggacgaagtgtataaagaagcagcccttcactatgatgaggcggcactggctacgctcattacggggatcgctacggctaatctatacaaccagcttaacgtctcaacgcgtcaaataataa

SEQ ID NO: 7496 - DNA, 155 bp, Bacillus clausii
  misc_feature (1)...(155): n = A,T,C or G
atgcgcttagagcgtttagcaatcgataaatttaaggtgtttttaacctatgatgatatggatgaaagagggattacaaaagaagacttgaggcaagangttccgaaagtncatgacttattccgggatatgatgctggaagcagatgacgagtt

SEQ ID NO: 7497 - DNA, 386 bp, Bacillus clausii
atggaacggtataaccagttggcacaagcttttgcgtacacgcctattcgtgtttatggcgtatataagagcatgcttgaagccaatcgcctttatcgtggccatgttgaccagccaacggcttatggcgggcttattcttgggcttcgtggcagcgcacgctttacctttaatggttctaattcaatcgaagtcagccaagggaaagcaatcattggcggctatcaaatgcgcttagagttagaagtcggtgaaacgggttgtgaatacgcgcttattcacttcttgccagaagatcggcgcctgcccgaggcaactttgtttcaaaaagcccatcaactggagtacctatttgaaccgagtatgttgcaaatggttcaaatagt

SEQ ID NO: 7498 - DNA, 207 bp, Bacillus clausii
agattttcttaggagggcgtcttgaccaagcaaaaaaagagggcatgaatgaacatgtcgtaagtgacgttgcttaccaagttggcgaatatttggctgggcaagttgagccgaaaaacgaacaagaacgtgttcttgccgacctttggaaagtcgctgatgagaaagaacagcatgctatcgctaatatgatggtaaaattggtag

SEQ ID NO: 7499 - DNA, 294 bp, Bacillus clausii
atgatcaaccaactggacccaaaactcattgtaacactaggggcgattgctcttaaacgccttgtcggcccaaacatcaaccttcaagatgttcacgggaaaccattttgcacccgtttgctgcaattgccatcgcttgaatctagcaaactagtacgaggagaacggcaacaacacgtttttccgacattccatcctgcttctgtcttttacaatccaacattagcaacagcgattacaaacgatatgcggcaattgcggtcagtgctcgactggttacatgaacaagggtga

SEQ ID NO: 7500 - DNA, 201 bp, Bacillus clausii
  misc_feature (1)...(201): n = A,T,C or G
catttcagattatacgctactgggcggaaatggctgaacattcangtttaaaaancacgcatgagctgtattcangcagaaacacgtttgggaacccaatccaacgtntctttctccatcctcatcacgacaattatcatttggttcatcatctctttccagcggttccccattatcgtttaaaaaaagcgcacacgatcc

SEQ ID NO: 7501 - DNA, 140 bp, Bacillus clausii
  misc_feature (1)...(140): n = A,T,C or G
gacttanacaagaatggcgcggttagaaaaagaatagataagttaaacaaggaagttgaacggattgagaaaaagttaaacaaccaaggctttcttgcaaaancgccgtcccatgtcgtagaagaggaaaaagcaaaaca

SEQ ID NO: 7502 - DNA, 501 bp, Bacillus clausii
tgttcggcgcagctccagcgacggtcgctttgtttgccgtcacccggggatgggtgaacggcaaatgggaagaggtgcctgtgttcaaaacgttttggcaaacgtacaaacaggaattttggcgcgccaacggcgcagcgcttgctttgtttcttgtcggttttctcctgtactggaattttacgctgtttgctggccctgggctcgcgatgatggtcgttcgcggcttattgctgattgtgtcggtgctgtacggcagcatgctgctgctctatttccctacgtatgtcggttttgatttaaaaggcttgaaccgtgtccgcgctgcattgctcattagttgcggccatcctttgcatttgattttgttaggcgcctccttgtacggcctgcaatttttgtttatgtcgatgccaggtttgattttgttttttggcgcagcaagtgtcgtttatgtgatttcttgggtagccgagcggattttccgctcgatgaaacggt

SEQ ID NO: 7503 - DNA, 844 bp, Bacillus clausii
atgggttatcagaataacggtcagaccggaggcacgaacataactggccaaaatagcaaaggagcgcttaaggtggccagacacttgctcgtatacgattatgattggtgggtgttaggggcaaaagcgaaaatcattcaacaatatcatccttatttggacatttgctccttgaaagaagtggaggaaaacgtgaaaagacaaggccaagttgccaaaatcaattttggctatgaggttatttcagccttagggttaggaattgctcagtctttgttgctgctaggggtacgggttgattctgcccagatcggatcatataactacattaccaagaaccacctgtcataccgagaatggaacgatccttttaaagccaataatgatttttttcatcggatgatgaaagcctctcgttatggggcaataagccccaaactagcgcatgaggtaaagaaacggcttcccaaaagacatgtctcgtttatacgcccttttgttgataccgaccaattttgcccgaagctcgacttgccttcacttgatgaacgaaaactggtaatcgggtgggttgggaatgaacaccggaaagtaaaaaactaccaaacgttgtacaaagggattgtgaaagcatttgccaatgaccctgatatcgaatttattgaatcaacacggtcgtcttatactccgttaaaacaaatgcctgctttttacaacaggttggatcttcttttaattacctcttcaaatgaggggggccctgctccggcaatggaagcttatgctagtggggtgcccgtattatcaacaaatgtaggctacgtgaaaacggttgccggtccga

SEQ ID NO: 7504 - DNA, 699 bp, Bacillus clausii
gctcatcttactagtgatgttttgtccaaatgctatttgcgatgccgccaataaagatgtcgctattattattgatgattttggcggcaatgtgaaaggagtagacgcatttttaaatggggatatccctgttacagttgctattatgcctaatatgccctactcaaccgagcaagctattgcagcacacgagaacggattagaagtaatcattcacttacctcttgaacctaaaaacggcaaagcttcttggctcgggtcaaacgggattactgtggatttaagcaacgacgaaattaataaacgcttacgcgaagcttacgaacaaatcccatatgccgttggtttaaacaaccatatggggtcaaaagcaatggaagacaaacgggttgttggtttaattgtggaattcgctaaaaccaatgggttataccttgttgacagcaagaccacacctcattccgtcatgccagaacttgctttaaaagcacaaatcccctgttttgagaacaagctatttttagacgatacgttctcaaatacccagcaagtacagggtaaaatgcaaactttcgcagccaagggaaacatgcatcaacacccaatcgcaattggacatgtcggtgttaaaggggaacaaacttatgcgggcattaaagctggcctgccgcatttgaagaaacaaggctacaagcttgt

SEQ ID NO: 7505 - DNA, 366 bp, Bacillus clausii
atgatgatcggcaccaacggaagtattaatagtacagctgtcgtatttccggaaatctccgtcaagctaaagaaagcgatggaacagcaacatttcgaagcagtgaatcattaccaaaacctaatagccgaagctatgcaactatatgatataaatcactcattcttttcaacgattaaagaggcggtgtcctatagatggtttaacggtgaacgtgtctatcataagaaaccttttcatttaattaacgccaatacaaggtcagaagtagaaagaatcgtcgataacatcaatcgtaaatggaaagaagaactgattgattgcaattcgagtaagttaaatgaaatcagacaggggtgcgtataa

SEQ ID NO: 7506 - DNA, 243 bp, Bacillus clausii
atggatcgcatgtttcgggttttaggattttggacgggcatatttgcggtattattttatattgggcatatgaatgaaatggctttgctgttttttgcgcaaaccgtcattttgattgcgctaggctatctagggctgtctgagagggtatatgtttatatttttgctggctattgcacgttattttttgttggtttcacgtattattccgtgtttatccttgttccaagtttcggacattaa

SEQ ID NO: 7507 - DNA, 114 bp, Bacillus clausii
  misc_feature (1)...(114): n = A,T,C or G
ncaaagcatacacaacaaactgctaacactcccagaagaaaccattgtcgcttctggacatgggccgttgacaacgattggccaagaaatggaccacaatccgtttctgaacgg

SEQ ID NO: 7508 - DNA, 426 bp, Bacillus clausii
  misc_feature (1)...(426): n = A,T,C or G
gctcgacgatgtcttgcccctgaaagaacgggaagcaatgacagatgaggagatggtcgcttatttggggcattgcctaatcgaccctcaccacccgcgcccatcgattgaaacgctgcttcatgcctttttgccatttaagcatgtcgaccacactcacccagatgcaatcattagcctatgttgtgctgaaaatggccgcgaactggcagaagagctattcggtgaccgctttgtatgggtgccttacattcgccctggctttgcgctgtctaaaatgattgcagaacaagtagacgcgaacccgaaagcggagcttgtgctaatggaaaaacatggccttgtcgtctggggagaancagctaaagaaagttatgaccgcacgatttctgtgattaatgaagcagagcaatttatcgagaaaaa

SEQ ID NO: 7509 - DNA, 219 bp, Bacillus clausii
  misc_feature (1)...(219): n = A,T,C or G
gtagcgccatatacggaatcggtattacgatactggttagcctgttcttaaaagaaacacgcattacgccaagcaagtttgtccttgcccttacaagcggggctcgtactgctcttggcgtagcagcagcaacggnttgcgcaggcnttattgtcggtgtagtcaccaaaacgggattaggccttaagcttggcaacggcattgtaaacatggctggca

SEQ ID NO: 7510 - DNA, 180 bp, Bacillus clausii
ttttagacaacacacgagctatcttcatgtatacatggacgccgaagaagcgaaaaggaatatacatagccactgccaaggcattacacccgtaggcgtttttgcccactacagtggtgatcggaaagaggaagtacggaacgctttcaaacgggtccatgaatgccgctgttatgtgaa

SEQ ID NO: 7511 - DNA, 188 bp, Bacillus clausii
atgaagcagcgttcgatcatttgtttgcttgcagccatggttttagtcgtttatgcatttgattacttgcccatacatgaaaaaggaatcgggcaaatgtttgcctattcttggcttgcgttcgctgcgcttgtcattgctggaaatggggtcgctgtgttaggcggataccggcaaaaagcgcagaa

SEQ ID NO: 7512 - DNA, 666 bp, Bacillus clausii
tcagtttaattatcgctaaaatgctaggattggaacatcgctttgtatctttttacatgacggttcttgtaggcgttttgctcgctgcgtttatttgcccgcgcattccgccgctagcgacaatgaaaaatacatatcacctcggccaaccaggagcgattgaagaaacggcggaaacaggctctttatggaaaagcgcatttgcccgtggcgttgataaggccaaacaagcgccccatataagcacagtgttaaaaaaaggagcgttcaacgcattggatatttggcttggcatgttgccacttgtaatggcaattggcacgcttgccttaatggtcgccgaatatacacctgtatttacgtatctttcctatccacttgtgcctgtattggaatggatgcagattccagacgcagaggcagctgcgccagccatgcttgtcggctttgcagatatgtttttgccagctatactaggagcagggattgaaagcgagttgacgcgttttgtcattggcgctgtttcgctcattcaacttgtttacatgtctgaaattggtgtaatgcttattcgttcaagcatcccgatcaacttctggcaactgtttgtcatctttattcaacgtacagtgattgctttgcctgtcgttgtgttgattgcccact

SEQ ID NO: 7513 - DNA, 534 bp, Bacillus clausii
atgaaaaagaatcgaacggacattattgcttatattttctttgccttgcttgttgctgcccttctagaattggtattaagtgttggaccactcattatgctaatcattgcagcaggctttatttattatgggcaaaagcgaatgagccgtagaaaagggcgtttcgctttttatatcgggatcatcatgtttgtattcacgttgttctcctctacgttttttatcattacactatacggtttgctcttttattcactatatttgttttgggaaaaaatgcgtaaaccgcggcgcgtgaatgttaacattggcgatcaaccaacgggtgaagctgtgccgcaaaaaaaagcgctgttttttaaaaacttgatctttggcgatcagcgtgctgaagatcaagtttttagcagtgataatatcaatattctttcgggcatcggtacaacgaatgtccattttgaaaataccgtgttgccagtaggggacacgattgtgatcgttcgcgggtttatcggccgtattcactatatgtcc

SEQ ID NO: 7514 - DNA, 518 bp, Bacillus clausii
atgggaaaaacggctgttctaacagactcgacagcttacttggataaacaaacattggaagaactcggcatttacacgattcctctttcggtcatttttagcggcaagaactaccgggaagaaatggatctgtcaacagatgcgttttatgaaaagctttctaccgaggaagcactgccaacaacgtcgcagcctgcgattggcatgtttacggagcttctgcaggaacttaaagatgaaggatatacggatgtcgtttccgtgcacttatcgtccaaaattagcggtacgctacaaaccgcactctcagctggagaaatggttgagggcattacactccacggtgttgactcagaaataagttgtgccccacaagggtttcttgcccgaacggctgctaagttggctttagaaggtacacctccagaaaacattgttgccgagcttgaaaaaataaaagcgcaaatccgtgcatattttgttgttcatgacttgcaccatttgcgtcgaggcggacg

SEQ ID NO: 7515 - DNA, 558 bp, Bacillus clausii
  misc_feature (1)...(558): n = A,T,C or G
atgtttatggatttaaaacaactcagtgaccctacatatgaagaaagtctcgaaancgataatgaaacaggcagtcccgaagcaacatttgaacataccaagttggacaaagcggaaccagcgcagaagcaaacatattcaaaagaaacaacaacatttgctggagaggatgattcgagtagccgcggcacagaaacgacaaatgatacgttgaatgatgattctttaaataaattggaaggccttgcagccaataatgaggcggaaaaggatggtggcagcgtggcagaaacagaatcaacatcacaagatgaaacaggagaacgagagaatgaaagcagtgatctagatcaacaagaaagcccggtcaatcaggagataatccaatggaacaatcacggccaagtagtcgacattaacggcaaccgctttgcgatcgaaaccgaatacggccccaaatggtttgtccttagcgaaggtttagagacaagttttgaatccgtgcgtactggcatggttttaagcatctactttacagaacaaaatggccgaaaatga

SEQ ID NO: 7516 - DNA, 632 bp, Bacillus clausii
atgagactcggaatgtttgacaacatcgatgcgagtatttgcattcatgccatcggtggagcatttgaaaaacggactgttgaaatcaattgtgatttagcaggttttttgtataaatattatgactttattggcgaagcagcacatgcaggcttcgatccgtttgctgccaaaaatgcttacagcatgtcaacgttgtttaatgttgctttaggacttgtacgccagcagctaaaagacagtgaaaatgtacggatgaacccgattgtctcagctagcgatatgtccacaaatgtgattcccaacgcgattcgtatcggctccgatttgcgcacaaagacgttagcctatatgggagaagtcgctaaaaaaatggacgctgctgcacgtggaagcgcccacgctcttcaaggcgaagtcgccattcatacgcaaatgggttacctcccctttgtacaagaccgttacttgtccacctttgtaaaacaggcgtttgcaaaaacggaggaagtagaagagttgctcgaaaacaacgcgattagcgcagcaggtgatattggcgatttgtcgtacatgatgccatgtattcaaattggccacagcggttttgcaggcaccatccacggcgacga

SEQ ID NO: 7517 - DNA, 650 bp, Bacillus clausii
  misc_feature (1)...(650): n = A,T,C or G
atgattcaaggcattattatccagaacggcttcgtgattgacccggaaactttaacgattagcaaaaaagagattggcatcgtcaatggtgtttttactgcagtagaagatgtgatacaggcaggtggagaggttcagtatatcgatgcaaccaatcattatgttgcaccaggttttatcgacttgcatgcccatgtgtttgaagattataccgagctgggcattgagcccgatttagtagggatcgatcagggagtcacaacaatcgtggatgctggcagtgcggggtatgagaactatccactttttaaggaaaccgtgatcgagaaaagcaagacagaaatattggcctttttaaacctgtcacgaaagggcttatgtaatggcctatctgagcttgccaaattagatgagttaatgacgctaaaagaagcaaacgaaattttccaacaagagcagagccttgtaggcataaaagcgcgtatgagcggttctgttgtgaaaaacagtggaatcaagccattagtccatgccagacagttggcagaccggcttggcaagccaattatggccatatcgggaatcaccgncgctttacaggagatttttncccttcttaaacaggggatattgtcacgctgcttttcatg

SEQ ID NO: 7518 - DNA, 684 bp, Bacillus clausii
acaattggggacaccatcgctagtgaacatttgggtcccagacggttataaagatacgcctagtgatcggctaacgccacggaagcgtttaaaagagtctttagatgcgatttatgcagacgaatacgacccaatgcttgttcttgataccgttgaaagcaaattgtttggcatcggttcagaagcgtacgttgtcggctcacacgaattttatttaaactatgcgaaccaaaacaacaagctctatttgcttgataccggtcatttccatcccacggaagtcgtttctaataaactatcagcaatgttgttatttcacgatcaattggcattgcacgtttcccgccctgtccgctgggatagtgaccatgtagttacctttgatgatgagctccgagaaattgcgattgaaatagtccgtaacgatgctcttggcaacatccatattggccttgatttttttgatgcaagcattaatcgtgtcgctgcctgggccattggcacgcgcaatatggcaaaggcgctattgcacgcagccttaatgccccatcgccatttaaagcagctgcaagatgaaggcgatttcacatcgcgcctagccatgcaagaacagttaaaaacgtatccgtttggcgacatgtgggatgagtattgcaaacgccaaggagtgccgcagaaacggag

SEQ ID NO: 7519 - DNA, 279 bp, Bacillus clausii
atgatggcctgtgtccgctgcgagctgttcatctatgaggcacagtcactaaaggataaacgatccgttttgcaaagcgtgcttcgcaaagtgaggcaacgttgcaatgtttcagcagcagaaacagggtaccaacaaacttggcaacgcgcagagctttcgctttgcgcagttgctgctagtaaaaaaagcgcagaagctgaactattacgcgcattggcgataattgatcaggcagaagcggcagagcgcacattgaccaactgggagtgggcgtga

SEQ ID NO: 7520 - DNA, 414 bp, Bacillus clausii
taaaaaatgagggcggttttacaataatcgagcatttgattggcttgcttgtgctatcagttgtggtattctgcttgccatcgctattgcagctagctggttacagcgatcctggtgaaccgtttgacgcgcagccttttttaaaccatgtagctaaagaagcaaaagaagctgaactcatcacttggaaggacgacgccttattgatttataaggatggttcggctgttagttatgaatggcggccccaaaaacggatccaacgttttcgagacggcaagggagtggtcataatggcagaagcagttgaacgatttggctgcgagaaaacgggttatggcttaagctgttcgattacttttgaaaatgggaaaacgactacacgttcgttttggacggcaaaggatgtggctt

SEQ ID NO: 7521 - DNA, 279 bp, Bacillus clausii
cgtatttacttgccaagttggagctggaagcggctactcgcttgcttgaagcagaagatatacgcgtcatgctcatggacggagcgctctaccattatcggatcgacgccccagaggaatgggaagcattgcgggcgcttgcgttaaaaaacgatacgttgcttgttggcgtatcagaagaaatcacaacggaaaatttagttcagttgccggcctttgcctcatttgcgaagaacccgtattcttatgacagagacttgctgtttggcgtgttaaacc

SEQ ID NO: 7522 - DNA, 114 bp, Bacillus clausii
ttttgaaaaaagtcgtcgtgcaagtcataccgagcttgctcattttaacattgatcatttttttccttgtttatgttgctggtgatcctgtttctgtgatgcttcctgaaaatg

SEQ ID NO: 7523 - DNA, 179 bp, Bacillus clausii
gtgcgcacgtatgttgctgatgacgagagagactggttgtgcttgcgggtgcttgcttttatggacacgccttattatgacaatgtcctgcaagtgaaagaaaggtaccgtaatcccgcaattgaattggtttgcgtcgaagcgggccagctagtcggacttattgacgttgagcttga

SEQ ID NO: 7524 - DNA, 588 bp, Bacillus clausii
  misc_feature (1)...(588): n = A,T,C or G
atggatctattttaccgnntttgtggttttccctactttacacacatgttcaagttggcgganactggtgaagatgaaggaccgatttcgaacctctcgatgatttcagagtatttagcacgctatatggagcaatcccaatcaatgcttactggttcaaggttaatcgaagaccgtttttcgaacgacttttttggtcgctatgtgtatggattatttcgagtaggcgaatcagaagtagagaacgaagaaacaccattcccaaaaggacgtataccttttttaaccatccatcagtcgaaaggattggaattcccctatgtagtactcggcagtcctggtaaaagaaactggggagtgccgagagtagaggagcttgttaggccattaattgaagcggacagtgaaccattggaaagaatccctgagtttgatacaatgaggctattttatgtcgctttatccagggcagaaaatgctttgattattacccacttacgaggtccaggtcaggtggtagaaccagctttcaaaaagcttttttctgaaatgaactacccgatgataccaaatattgatgttcgataa

SEQ ID NO: 7525 - DNA, 126 bp, Bacillus clausii
ttcatagttcagctcgggaaatgtccttagataccgcattaaatggtgtgtcagtcccccttcatccaggtgcttataagtactatcaagaacaaggcgtcgacatccctgacgaattacgcccac

SEQ ID NO: 7526 - DNA, 518 bp, Bacillus clausii
  misc_feature (1)...(518): n = A,T,C or G
atgatgagtgtgaagcagccaaacgttgatatagaccagaacaatgaagaagttcaagagtctgttagtataggccgggaattaaaaggcaaacagcaaaaaatcgttgcctttacaggcattcttttatcggggtttgctgtttatgtcaatagtttcatcaatatgcaggaaatttaccgcaacgttctctttcttgcattgctttttgttttagcgtttttgctttatccagcaacaaaaaagggagcaaatgaccggtttacaacagtggatatcatcttaaccattgctagtatcgctgggtctgtttatattttgttattttatacgacgattcacgtggaccgaatgtcgcaggcggttacaatggactatatctttgcggggatcaccgttgttttgctgttggaggcggcaagacggacgctcggcctctttattccgcttttaacgagtttagcgatcatttatgctgtgtttggtccatactttncagggatttttggacacgcggg

SEQ ID NO: 7527 - DNA, 89 bp, Bacillus clausii
cttcgccagcaattgcgcaaacttggctaccgcgatattaaaaaaattgcttattgctcgcttaaaggcaaggaatcgttttttatcga

SEQ ID NO: 7528 - DNA, 93 bp, Bacillus clausii
taaaaccacttggttcattgttgaaagggacaaaaggaatctcaggcggaacgattcttggggatggcacgattgcattgattgtcgacattg

SEQ ID NO: 7529 - DNA, 234 bp, Bacillus clausii
aaaaaagaagatcatctcagcagctagaaatttatttcaaacaaaaggtttttcagaaacctcaatgaatcaaattatagaagctgcacaatcaagtaaagggaatttgtatcaccatttcaaaaacaaagaaaatctgtttgtatatattcttgaagaagatgctaatcaatggctgaaagattggaaaatagaagctgaaaaaaaacaacataattcaaaccatattttata

SEQ ID NO: 7530 - DNA, 354 bp, Bacillus clausii
gaaacctgacaaatcgagtcatagcattgccgagattgtccaacatttaatctactggaatcaaacatggcagacacgctatgaaaaagcggacgcaagtagagtacctggcattgaaaagaatgcggatagctttcttgtccccaaagataaaaacttccaaactttgcaaacggagctgctgggcattttgttgcgttggcaggacttaattacagaaaagcaattgtcagagaaggtaaaaggctatccggtagaggccgaatggtgggggttaattgcaaatacaacaacgcataatgcctaccatatcgggcaaattgcgtttttacggaaaatggataagcccgtgat

SEQ ID NO: 7531 - DNA, 175 bp, Bacillus clausii
atggggagaagacgaggcattatgtcagatcgcttaaaagaagaacttgcaaaagagcttggtttttatgatacggtccaaagagaaggctggggcggcattacgacaagagacgcagggaatatggtaaaacgcgccatcgaaattgccgaacgaaacttgcaaaatggacagt

SEQ ID NO: 7532 - DNA, 279 bp, Bacillus clausii
atgacaagatctgagccgttatcagcgccgacaataacgatgccgtggttgccctcttcatttttaagttccaccgtcacgtcgccagcgccagcctcatattcttctttatcaaattgccagttcatcgctttaatgacaacggtttcacttgattccgcagtgctgttatcttcttgtccactatcttcttgcgccccgcatgctgtcaaaataaaaaaaagcaaacaggccgtaatcactccagctaattttttcaatatgtttccccccttatga

SEQ ID NO: 7533 - DNA, 569 bp, Bacillus clausii
atggcggattgctgtctgcccacaagaattgaaaaatggattgcgctcctgttatacgtcaaaaaaagaggcggcagtttagtaccgatccacccaagtacgcctcttgctgcagcgaagaaaattgccgcgcaagctcgttgttcttacttattctttcattcgtttgaagctccattgacgctctcaaacccggtcaatccctttcctccagggcttgtccagtttagttcaggcacgaccggggtaccaaaacaattggagcgcagttggtcatcgattgatgaggagctaggcgcttacgccgagcgtatggctcgtgtggacgtcaatacggtcgtggttgcctgtccagtcacccattcctatggactcattagtggggtgttagccggactgtcccaggataaggatgtagttgtgttaacagcgcaaaacccaaaatatatacttaaaaaactaaccgattatccaaaccatttgttgtatggtgccccgccacttctgtacgcattggcaaagctaagcaatgggaaaacgcttcagtccgtcatgacctcgggaacacg

SEQ ID NO: 7534 - DNA, 120 bp, Bacillus clausii
agcaggcattgtcgcagattcagacccagaaaaagaatacgaagaaacattgaacaaagcaaaggcacttattcatgcgattgaacagacagaagcgttgtttgcaaaggcggtgcgttt

SEQ ID NO: 7535 - DNA, 435 bp, Bacillus clausii
  misc_feature (1)...(435): n = A,T,C or G
tccgcctccttcgttatatgtccttgtttataaccgtgttcctatcatcgctgtacatttcatttgnttcgtttcaccatgggcttttgccaacagacgtagccatgacgatcatcgccaccagggaagacattcctttcccgcctattttggaagtgttgattatggaagtgacaattgaattgctgcgtgaagcgggcatccgcttgcccacgccactcgggcaaacgattggcctagtcggtggcgttatcatcggccaagcggcagtagaggccaatatcgtcagttcgctcatggtcattatcgtctcaattactacaattacatcgtttaccgtaccgagctacagctttggcctatcgtttcggctccttcgttttggggcgattatcatttcagcgattttagggctcgttggcgtgatgttcttct

SEQ ID NO: 7536 - DNA, 105 bp, Bacillus clausii
cttcaaaaattgaactggcaggaaagatctttattcttgtgctggcaatccctatcatcaaggctgtcattgaaatgattttgtcgcttttgcccatgtcgggat

SEQ ID NO: 7537 - DNA, 330 bp, Bacillus clausii
aagagctcgtaaacgagcagttaaacatattaaagcttgatgaaatccaagactactgggagtccgtctcagaagagtacgggggctttcttcctgaaagccaaaaagggaacttaaccgattttttaaaaggagacaagcagtttgatttaaaggagtggggcatcggccttataaaatacttgttccatgaattgatccgtcaatgggaactaatgggaatgctgctgttgttgacgattttttcttatatccttcaatcgtttcaaaccgcatttgaacatcagacagtgagcaaaaccgcttatgcggtcacgctgttagtattag

SEQ ID NO: 7538 - DNA, 272 bp, Bacillus clausii
atgagtaaaatcgtttttttctcgataccagcacatggccacacgaaccccactattccggtggtaagcgaattagtaaataaagggcaccaagtttggtattattcttttttagagtttcaacataaaataaaagaagctggcgctatatttattgcttgtgataattttttacctcaagtttcacaaaaagagctggatagtaaagtaggtaaagactttgcagcattgattgaaatgacagcccgagacaacaatggccttggatcaaa

SEQ ID NO: 7539 - DNA, 444 bp, Bacillus clausii
  misc_feature (1)...(444): n = A,T,C or G
acttaaacagggaatcgagaacagcgtcaaaagctttacttgcccaancggtggcaaaatagcnctagaaatgcattcaaacgatccagctataaaaatggagttaaaagacggggcgccttcagtgacatacgacctctcacttaaggccaccatttcagaagtcgattgcgttgatttggacttgtccatcccttcttcctatgaacgggtcgaaaaacaggcgcaaaccgagatggagtcagacattcgcgaagcgatcgtcgcaacccaacaagcaggttcggacatccttggtatcggacaggaattataccgaaaatcccctgattactgggagcaaatccaggacgactggtactcgatctatcaagacctcgatgtgaaaataaacattgacatcaccatttctgatagtggaagcattatcaattctttttcaga

SEQ ID NO: 7540 - DNA, 213 bp, Bacillus clausii
  misc_feature (1)...(213): n = A,T,C or G
ataaggaattaaatatttataacgatgtttttaaagaaaagaaaatcatttttcttggtgaaaatgggcatggcgtttctgaaatacaaaaactaaaaataaagatggttgaatatcttcatgaacaatttggttttaataatatcgtctttgagggcggnatgggggaaatagcgattgccaatcataataaacatcagttgtccctaaagc

SEQ ID NO: 7541 - DNA, 192 bp, Bacillus clausii
  misc_feature (1)...(192): n = A,T,C or G
cagccaccaaagcgtactccctttatgaacaaaacggccaggtagtcattgaccgctggctagacntgctcaaagctggtggtaccaaaaaaccactggatttatttaaaaccgccggagtcgacatggaaaacaaagaaacgattcgcgatgcagttgcctatgtcggacgcctcatcgaaaaacttgagc

SEQ ID NO: 7542 - DNA, 573 bp, Bacillus clausii
  misc_feature (1)...(573): n = A,T,C or G
ttgaattcatgtacgttgactaataatgnnccgagacaagtagtcgttttaggcggggaaacgattatccaaaatagtttgtttgaaacaggacaaattggagtggacattaacgataacggtaccgcccaacttgaagcaacgattctcacgtcgcacgaagacgaccatattcgcgttggcgatggcgccctttacgtgtatcgaagtacaattaaatttgggcaaaaatcaggcgtagtcctgacgaaaaacgcctatgcccatattgaatcaagcgatttgttcggccacatgatgccacaattagcagtaagcgaacaagcacgtgtaagcctaaaacatagcgctatcttctatggcaaacattatgggttttggctgacggaacaagcaagtgcagatgttggccactgccgcttttatgaaaatgaactgaatcaactcgtcattgcagacaaaagtgaagccgacctagaagacatacaagtctttgatggagcgcaaagcggcctttatattcatgaccatagccatgcgaatgttgtaaaattcaactttttaccatcataa

SEQ ID NO: 7543 - DNA, 103 bp, Bacillus clausii
atgatagaggcggcagcatttgcgattgcttttttcttcgcaatgaatattggcgcaagcggaacagcggcagcgatgggccctgcttacggaagtggagccg

SEQ ID NO: 7544 - DNA, 269 bp, Bacillus clausii
gatcatttgttgctgacattgctttcggcgttagggtttggtgctacgtttatgggaattacgacactgacgttgactctggctaaatctttagaaggagctggaaatcatttagtaagtggtttgacggcagcctacgcgatcggccaattattggggccagttgtggcgggtacaatcatttctgtaaacgatttcgctattccatttatgatttcagcagttgtgcttgtagctgctttaatcaccataaatttcataaaagatca

SEQ ID NO: 7545 - DNA, 219 bp, Bacillus clausii
ttgcttttaaaaaatcgataggcatgagtgggcttgtcattctcttggctatatgcgcttttccagcgattaaagtgttgtcgattgcgtttatttttcaagtttcggctgctgttctacagccacttggcgacggggcaatcattgattgtttagggatcatcggaaagccgtcctatatgtgtttgcggcgcttgcactcgtcggcttcatgttttt

SEQ ID NO: 7546 - DNA, 314 bp, Bacillus clausii
tcgaatttattaatgggtgggtcacgtcgatcgtgctgttgattttgctcgcggtcgtccttgaattgcttttgccaaatacagcgttaaaaaactatgtcaaactggttgttagtttaatgctgcttgtcatgatgctccaacctgtgctttccttgtttcaccaagacccagaaaaatggctctacagcctggtagagcaggcatctcaacaagaacaagccattgatattgaggaaaaaataaattcacaaaaaaaagagatagatcagttctttgatgcatatacatctgaacaagtggctgtccaatta

SEQ ID NO: 7547 - DNA, 459 bp, Bacillus clausii
  misc_feature (1)...(459): n = A,T,C or G
gggggtttgtgcggattctggctttctttattgcattgatgttatttattatggttaatcaagataatgtcggcaccccttctcttttgcctgaagttaccaacgctccttatacaattgaagaccaaccacttgaagtgttttatgatgaaacacgttttgaactagttgaccaaccggaaacagtgagtgtgcagctccaaggttcgcaagtgtcgatttcgctattccagttgacaagcaaccggtcgacagaagtgtttgtggacgcnactgatgtaactactgaaggggaacatgtgctanccgtcaacacacgcaattttccgagcgatttgtcagtaacaacgcagcctcaagtagttcgcattactttaaaagaaaaacaaacggcctccatcccggtgcgtgtggagcttgagaacgaaagcgaactatgagacgagtttgctgctggtt

SEQ ID NO: 7548 - DNA, 585 bp, Bacillus clausii
  misc_feature (1)...(585): n = A,T,C or G
agaagcagaagccancaaacaaaaagccagtgtagcccagctagntgattgggaagttngttatgaacggttgtgtgcgctggctgttaaaaacaagcgcntgagccagttggcggaacaatgggcacggctcgaaaaagacagcagcacctgctctttatggctttcaaaaacagcgcaagtggacagtgcttatagccttcaccaggcgatacgaaacgaggcaactcgttatgtgcgtctgaccactcttaagcagcaaagccaggcagtaaaggncaatgagcaaacattgacaaaggcaatggcgcaaacagcttttgtgcaaagcctagacaggaagcaacttgtacgaatggaagaggagaaagccaaaaaagancagctcgaaaaacttgcccgccagtggcagcaaacgcagcaagaatatacatcagtgaaggccgccagtgcagaattgaaagggacagatcaagcagcccggcagttaaacgaggcgattgaaacgacgaagcttttaatgaagttaaacgattataaaagacagttagcagaagtgacaaagcgtgctgctgatggacaagc

SEQ ID NO: 7549 - DNA, 312 bp, Bacillus clausii
  misc_feature (1)...(312): n = A,T,C or G
atgcagccagcgttaatgaacgaanaagacggtgcattgaaaggagcaaatggagaggcgctaattggcaaggacagcgatggccttngctttgatgattttgacgttgaattaatgaaacaagcgttgtctagctttattgctccgccngaagtgttgactgatcgattgatcgacttgatcaaaaaactagcctttgtttaccaagttgagccgttnacaatggcgaatttagttnagcaagcttctcgaggcgacatgttggatgaagacgacttacgtaaaacgatcaaagagtggtaccgagcttga

SEQ ID NO: 7550 - DNA, 180 bp, Bacillus clausii
  misc_feature (1)...(180): n = A,T,C or G
ggatagccaattcattattgngactcactctccgattttattaggctatccacatggaacgatttttagttttgatcaggatgtgatcaaagagattgactatgagcaaacggaacactaccaattgacacggcattttttagaaaatcgtgagctgtttttacgtgagattttaggaga

SEQ ID NO: 7551 - DNA, 447 bp, Bacillus clausii
cattcagcgagatcgcacctgttgttggaaaatccgaactcgccactagaaagcttgcgagccgtgcgcgtcaaaaggttagaggacaagagaccaattcacaagccgacttggatcgacaacgtaaactcgttgacgctttcctggatgcggcttacgctggaaatttcgattcgctggtagcgatgctagatccagatgtggttcttcgagacgatcgtgaaacaggcgtccgaaccgaaactaggggagcaatttccttagccaagaaggtatcgggacacgccaaagctgcgcaagtggcccttgtgaatggatgcatcggggcgattgcggctccaggcgggaagttactttatgtgatccaatttacaataaaagaggggaaaatcaccgaggtagatttgatctccaactctgcacgacttgagcaacttaacttaacga

SEQ ID NO: 7552 - DNA, 469 bp, Bacillus clausii
ttgaagacatttaaactgtatgcattgcaagtgattgacgggcaaggggggaaaatggaacaacaccccattccttttaaagacggcctcattatcaatatggaaaacgaagacaagacatggtttcttgacgcagttgtctccaatgaggatgcccatttttttgaaagagaacaggaagcagagcgccatatactcgttagtgtcgtcattacgagcaaaaacaaccaccccgcggtcatgattacttccattgaagcgattacagaattggatcaaggaaaaagtgtcgtattaaaagggaaaattgtttcaggccgggatgacgtgctggaggatgtgtttgaagacattcttgctgaaggaatcgaacgggctgacgtggtggatgaatttaaacgacgagtcgagaagttagaggcatattcggataaaaccattcaagaagtgtaccaagacttgaaaaaag

SEQ ID NO: 7553 - DNA, 393 bp, Bacillus clausii
taaatgctattcaagaagaagcgcaaaacttagattatggagctggtatatttcaactaaattcaaaatcggttagatttagagtcgcaaaaatcacacctaacaagataggacagtttgttgttttttgggaaaaagatcaagccaataaaaatcaagccttttcatgtgaaaaggctactgatttattggttatcaatacttttactagtgacaatcattttggccaattcgtttttccgaaagaagttcttgtaaaacaaaatatccttaaaacacccactacaaaaggaaaaatggctattagagtttaccctagatgggaacatcccactagcaaacaagcgcttgaaacacaaaaatggcagttagcatactttatagaggtgaaca

SEQ ID NO: 7554 - DNA, 806 bp, Bacillus clausii
  misc_feature (1)...(806): n = A,T,C or G
tattttttattatggcagggattccaattgcgtttagccttggcctgtcttcgttgatttatttgcttatcgcaggcattcctttgacgatcattccccaaacgatgctgtccgggatcaattcatttgtgttgctcgccattccagcctttattcttgctggaaatttaatgaacgcagggggaatcaccacacggatcattgattttgccaatgccgttgttggccacatccgcggcgggctagcgttaacaaatgtcgcttcttcacttgggtttgcgggcatttcaggtacggcattgtccgacacagcaagcattggctcagtaatgattccggcgatgaaaaaacaagggtatggcgccggtttttccgctgcggttacgtccatttcctcaactgttggcccgatgcttccgccatctttgccaatgatcattattggnactcttgccaaggtctcgatcggcgatttggttcctgctggtgctatcctggcattccattggcgatcggcttttagtcgttacgtatatcatttctgtgaagcgcggtatccaaaaggagaacggcagccgtttaaaacagtcgtcacgtcgttttttggcgctttctgggcgttgtttatggtctttatcattttatggggcattcttggcggctattttacgccaacagaagcagcggtcgtttgtgtgttgtacgcattggtcgtcggcggttttgtttatcgggagcttaactttaaanaagtgccagggctgcttgttagcacactgcggtcgacgtcctcgattctgttgctt

SEQ ID NO: 7555 - DNA, 111 bp, Bacillus clausii
ttggcggccaaacgattttaccagcaatcaagacaatgaaagatttcgaggttattatgaacagcagccatgaatatttcgttgtcttggatttgcacttgtctaaactag

SEQ ID NO: 7556 - DNA, 276 bp, Bacillus clausii
ctgtgtggagatagaaagctggttattaccatccttcatgaaaagattctttcaatagttacggaataataacctttgagttttttgttcattcgagacagggtctcaccctgtctcccaggctggagtgcagtggcacgatcatggctcactgcaacctcaaattcctgggctcaagcaatcctcctgcctcagcctcccaagtaactgggactacaggctctttccattgtcttcacagatttctctttcctatccctttgaatcttctacatt

SEQ ID NO: 7557 - DNA, 459 bp, Bacillus clausii
gcttagttgtaagaggaatttatggggaaggcagcgaagctttaggtaacctatttcaaatttctaatcaaataacgcttggaaaaacggaacaggatattgtcgatgatttacaaggcgtagtaaagcaattgatacggcaagagcgtgttgcccgagattcgcttttacagcattcaaagctagaacttatttaccgtgtttttaggtcttacgggattttagcgaacagctatattattgattccaaagaagcgacgagaaggttgtctgatgtgcgcttaggaatcgatctaggttttattgaaaacacggcagggaaaattctagatgaactaatgattttgacacaaccaggtttcctgcaacaatacgcgaaaaccgttctcactccagagcaacgcgatgagagacgggcagctttaattcgtgaacgcttaaaactagaacatgaaacag

SEQ ID NO: 7558 - DNA, 174 bp, Bacillus clausii
aataccaggactatgaaacaattttggcggcctttgacttaaaaattaaaaaaagcctctattcaacagacccggctaaccgcgaagatttagaacaggaaatcaagctcaaaatctttgaaaaaatgcctgtgattgaaaacatgaacgcccctggcttctacgaattcgtcc

SEQ ID NO: 7559 - DNA, 195 bp, Bacillus clausii
tggatttacgttacccgattggaaagtttgaatttgaaggagagcctacaaccgaagtattagagaagtggataacagagattgaaggacttccatttcaattaacaaaagctgtggagggtttaagagatgagcagttagatacagcgtatcgccctgatggatggaccattcgtcaagtagttcatcacgtgg

SEQ ID NO: 7560 - DNA, 251 bp, Bacillus clausii
atgggaatggtgaaacgaggcttgctgtccggcctgtcaacaacatggacgctcgggaaaatcatttttccggttacgcttattgttactttgctaggctatacgcctctactcgactggctcgctaagctgatcgcccctttaatgggcttgattggtttgcctggagaagcggcaattcctttagttattggcaatgtacttaacttatacgcaggcatcggcgcaattttgacatttgactttactgt

SEQ ID NO: 7561 - DNA, 510 bp, Bacillus clausii
  misc_feature (1)...(510): n = A,T,C or G
tggatttacgttacccgattggaaagtttgaatttgaaggagagcctacaaccgaagtattagagaagtggataacagagattgaaggacttccatttcaattaacaaaagctgtggagggtttaagagatgagcagttagatacagcgtatcgccctgatggatggaccattcgtcaagtagttcatcacgtgggccgacagccatttaaatagctactttcgtttaaattagccctacagaaaccatcccacgattaatgtataagaaggaaatggannagctccctgattcaaagttaccaatagatatttcattaaaactaatcgaagctttacacagtagatgggtttgtctgttacgttctatgaaaataagatgatctagcgaagactttccaacacccagaatcaggagtggttacgttagggatgaatattgggatctacgcttggcacgggcgacaccatgtttcgcatattacttctcttcgaaatcgattaggttggt

SEQ ID NO: 7562 - DNA, 200 bp, Bacillus clausii
atgttgcaagcaaaaacaagatggcgcattttagaacagaacgagctgttggcgcaagagctcgcagacgagctgcgtgtatcgatgttaacggcccgtctgcttgtacgccggggaatccaaacagtccaggcggccaagcgctttttacactacgaagagccgacgttttacgatcccttcttgttgaaagggatgga

SEQ ID NO: 7563 - DNA, 296 bp, Bacillus clausii
atgaaggcacagactgcgtttattatcggcattattgccgcgattatcattgctgtgtttgcggtgttaaatgtggagagtgtaccagttaatctgttagtggtaaaagcacagtggccattgattctagtcattttagggtcggtgcttctaggagcgattgtcgcagggatgatgtcgttaatgaaagtactgcaattaaatgctgaaataaagcggctgcgtacagcgaaacaggcaaatgcagaccaaccacatgaaggcagccgtcaaaaaaaagaagtgaaaaaacagag

SEQ ID NO: 7564 - DNA, 379 bp, Bacillus clausii
atggaggcagaaactgacaagctcattttcctgccagaggcaaatgtcgatttcagcccggagggccccggaggccggctgggagcatcacgtgctcggcccagccactcagccctgcccagccagcctggtcacctcttggctccggagccccgccgtgccagtgtcattcgcctcctacccccggagcattcgtgtccagagaaaacccggcgtcccggagacaggacgccccaccctcaggggctgggctgcacggaattctgtgaccggattttccagcatcaatgggaggtggtgggtatacaaaatgccctgcagcctgaagaggatggtagcacggtgcagacagccttgctccgtattccggcttggctga

SEQ ID NO: 7565 - DNA, 750 bp, Bacillus clausii
  misc_feature (1)...(750): n = A,T,C or G
gcttagcagccagctatttttatttgtttattggcaaggaattgcaagcattgcagtttttagtggcgacaaacaacctcgctacttacgatgtagaggaccactttatgcttctggccaaacgggggcgccatcggcaaattcagcattggctaagccagctattcccggatcagaaaagccaccttggttcgcttcagcggtatgcggatgagtctgaaactgccttgcagccagccacttccgttcattacggaacgtgggaccgctggctccaggctccgatgtttacacggtttgaacagcttgtagcagcaatgggacaagagcaagtatcatctgtgcttgcgtacctattgcctaagctggaagaacgcctttataacgaggcaacgcgaatcgtttacgtacagcttttaaaccgttaccgctattttgatcaagcgcgtgattattttttgttgtatgaaaaaaacccactgtcattgcaaccgccaaaaatcaagctccttgaggcgcttgcaacgaaccgtccagaactggctcttcctgtttatcaccaatttatcgtcaggctggtggaaaaacggtctagaaaacattatgtggcagcagctgaatatgtcattcgcttaaaagaattgtaccaggtgcttggccaacatgtgcgttatacggagtatatcgggaaattgaaaaaagtgtacaanacgtacagggcattcantgaggagttgaatcatcttgaaa

SEQ ID NO: 7566 - DNA, 231 bp, Bacillus clausii
caggtggattccttaaggcaggaaacaccacgtttctgatcggcgttgatgacgataaagtagaagatgtcatggcgattatccaaaaaaattgccgtagccgcgagcaggtggtggcaccgatttcgccaatgggcggaaatgccgattcctatgttccttacccagttgaagtacaagtcgggggcgctaccgtctttgttcttcctgtagaccaatttgaacaatttt

SEQ ID NO: 7567 - DNA, 338 bp, Bacillus clausii
atgaaaaaacaaagccatgtccttgtcatctttcctcatccagatgatgaagcattcggtgtttcaggaacgatatctgcttatattgatgcaggaacgccagtgacatacgcctgcctaacgcttgggcaaatgggacgcaacttagggaaccctccttttgcgacgcgtgaatcattggcagacattcgccggaaagaattgcaacaggctgccgcagtgatgggcatcaccgatttgcggatgatgggttatcgcgacaagacgcttgaatttgaacaaccaggacgcttgaagcaaatggtgcttgaccttgttgctgaacttaagccttccct

SEQ ID NO: 7568 - DNA, 344 bp, Bacillus clausii
atggaaccgattgagaaagaacgccttcaatcattgcttgattcttttctgaacgaagacgtttacttgcatttagaaacgacaaatggggcttacgcttcccattttgacgaatcgtttttttcagccagcgcctacatccgcaatgcccttatttcattcgaacatggccttgtcgctggcaacggcccatacagagttggtttaaaaatgaacattggctggatatatggcgaagggttaacccattttgaactagacaaaaaggggcggctattaatggctggccatggccccgacggaaaacttggcgtcgcctttgaaatttcacgcacgccttttga

SEQ ID NO: 7569 - DNA, 69 bp, Bacillus clausii
gctatcaccaaggagtctattatgactcaattcgttacgggctaacacgcgaagaatggaatacgcgcc

SEQ ID NO: 7570 - DNA, 117 bp, Bacillus clausii
cacagcacaccattcgcgcagcgatgagccatgtgcttgaagcgaaaaggcatcttagcgccaacgtttccatccaactagtgatggaacggctgcttttcaccatacaggagggct

SEQ ID NO: 7571 - DNA, 580 bp, Bacillus clausii
ttgcacgaggtcataggtgtccgttttaaaaaagcgggcaaaatttactacttctctccaggcccgtttcagcttacaggcgcagaagctgttattgttgaaacgtcccggggcgttgagtacgggaaaattgttgttcctccaaagtttgttagtgaagaggacatcgtcttgccattaaagccagtgatgcgtgtggcgactagcaaagacgaagaaacagtgagagaaaacaaacgggccgctgaagacgcatttgcaacatgccacgagaaaattgtagagcatcaactagacatgaagcttgttgatgtggaatacacgtttgaccgcaacaaagtgctcttttattttactgctgatgggcgaatcgattttcgtgagctcgttaaagacttagcagcgatttttcggacaaggattgagcttcggcagatcggtgtccgcgacgaagcaaaaatgcttggcggcattggcccttgtggtcggatgctttgctgttcaacgtttttaggcgactttgagccagtctcgattaaaatggcaaaagaccaaaatttatcgttaaacccagccgaaa

SEQ ID NO: 7572 - DNA, 435 bp, Bacillus clausii
atgcgtgtggcgactagcaaagacgaagaaacagtgagagaaaacaaacgggccgctgaagacgcatttgcaacatgccacgagaaaattgtagagcatcaactagacatgaagcttgttgatgtggaatacacgtttgaccgcaacaaagtgctcttttattttactgctgatgggcgaatcgattttcgtgagctcgttaaagacttagcagcgatttttcggacaaggattgagcttcggcagatcggtgtccgcgacgaagcaaaaatgcttggcggcattggcccttgtggtcggatgctttgctgttcaacgtttttaggcgactttgagccagtctcgattaaaatggcaaaagaccaaaatttatcgttaaacccagccgaaaatttccggtctttgcggccggttaatgtgttgtttaaagtatga

SEQ ID NO: 7573 - DNA, 138 bp, Bacillus clausii
agaaaaggggatctgtgtacattgtttgtggaaataacaattaatacagcaattatggaaaacagtatgtttgttcctcaaaaaaaaattaaaaatagaactattgcatgattcagcaatcctacttctgggtatatt

SEQ ID NO: 7574 - DNA, 216 bp, Bacillus clausii
ttttttggtagtttatttacaaggcaaacaaatttttcattttattattttattattattattattattatacttcaagttttagggtttatgtgcacaatgtgccggttagttacatatgtatatatatgccagtctggtgtgctgcacccattaactcgtcatttagcattaggaatatctcctaatgctatccctcccttctccccccacctg

SEQ ID NO: 7575 - DNA, 183 bp, Bacillus clausii
aacaacgatagactggattgagaaattgtggcacatatacaccatggaatactatgcagccataaaaaatgataagttcatgtcatttgtagggatatggatgaaattggaaatcatcattctcagtaaactatcacaaggacaaaaaaccaaacactgcgtgttctcattcatagatgggaa

SEQ ID NO: 7576 - DNA, 179 bp, Bacillus clausii
atgcgttgccctaactgccaccgaaaagacatcggaaagattggcacaaaccaatactattgttggaattgtttcatcgagatgagtttagtgaaagacacgttgctccttcaccaagtagaggaggacggttcgctcagctcacttgacgatttgtttgaaacggaagaacgtcgtct

SEQ ID NO: 7577 - DNA, 467 bp, Bacillus clausii
ttgcgaacagttcaagcgcttatagggcttcctgttatcagcaatacaactggcattgaacatggccgggtcgtggatgctctgtttgatggcaaagaagtcgttggcttaacagtgaaacgaacacatttgtttgcacagcatgcttttttgccgattggtgaaattgctcatgctggtcaggaagcggttatgatcgctggtgaacaggctttaaagccgttcaaccgcgagcaaaaaatgctccaccctattcacacagggcgacgccgttttaaagggaagccgcttctttccgaggaaggggaaacgctcggattggtagaagatgtatattttaacgtcgaattgggcacgatcatagggtatgaagtgacagatggctggctgtctgatataaaggaaggccggaaagtcgttaaaggccaacatttagtgatcagtaaggaacgggccatactgtctct

SEQ ID NO: 7578 - DNA, 300 bp, Bacillus clausii
tctctggcgtttctcttggccaaaacaaatccgttcagttggttaaagtcggggaaacattattggttgtgggcgtcggtgatcaagtgcaattgctaaaagaaattaccgatccagacgaaataacggccattctcgccaaacagcaagctggggatgaggaaccgtttctcggtcatgctttaggaaccatgaaagcggcgttctcgaaaaaagcaggcactgcaccaccgacgttccaacacattttaagggacaagcttgcggcttccaagcaagaactgcaagacacacgccagg

SEQ ID NO: 7579 - DNA, 498 bp, Bacillus clausii
atgcagcaaaaaagagtgacgcagacagaccgattctacaaagtcggcttttttgttgcggctagcctgtttgtattgctaacaacggcaattattgtgtttttcatctatttattcgcaggctctgaggaggcgcgtttgccggcaactgaacaacaggggacaagcggcgacatgttgtccattcagcttaaccgtgaccaaatgaatatgctgctagcagatttgacaaagtctggagaagacgtgccgtttgcttttcacttagcggaagacggtgtttatttgacaggagaagtaaatgttttcattggagacgttgatttatcgatgagatttgcgcctgaagtgcgtgaggatgggtcgcttttattaaaagctgaacatttaaacgcaggtgcgcttcaaatttctccagcctatgcattacggattttttcccaactcgctgatttgcctgagtgggtaacaatttacccttcagaagaaagtgtgctg

SEQ ID NO: 7580 - DNA, 159 bp, Bacillus clausii
  misc_feature (1)...(159): n = A,T,C or G
cagtagaagaattgacagagtgggccatngacatgcataagctttcccntgattcgctcaacggagcgatggttgcagtaaacgaagagtttgcgagccaatcgactgagctgacggcaggggatgtcgtggcttttatcccacctgtaagcggcggtt

SEQ ID NO: 7581 - DNA, 717 bp, Bacillus clausii
tacaagcgtatttgtacttggggaataatgggccaaacactcattttggtggtgaagaggaaaagtatagtgctgaaaaagtgagagcatatttgtcgttgttaacccaatacaaaactgctattttggatttggaagcagaggctaaaaaaggcggtgtcgacattcctttccttgccaaagttgaccatttatcatataaacgaaacgtagatccgcatattcatacctttgaaacagagctgacgttaaacatctcgcaatatgccggcgatatgacgagggaagaatttctcaatatggagttcccagttttagtccgaatcaatgaatcgacagtgaactattatattggtgggaatgcagtaaatagtttggaagcagaagagtatgcagaactgatgaaagagcgtgcaaattatacaaaaaactttattggagaagaaatacagcagctagtactaggggagcttagtaagcgagtcggtggagtagttaatatagctgatgtagttactaggcacgaaacggggaaacaggagctcgataatcagttaacagtgaaagaggcgaaggtaacagcaggcaatttaggaatggagttgcttatttccgagcggaatgtttatggtaagaaccaatatgccgtagaggtacagccaaccgatgtaacttatagtatactggaacgttggaaagaagttaaattaattgatc

SEQ ID NO: 7582 - DNA, 177 bp, Bacillus clausii
aaagaagtattaaaccaaatgagtttgataatgaagtatttgaactatatagtgttccaagttaccctcaaggaaatccagaattagtgaaaggggaagaaataggctctaataaacagattgttagcaatggggatgtgttattgtgcaagattaacccaagaattaaccgagttt

SEQ ID NO: 7583 - DNA, 534 bp, Bacillus clausii
gtgccccgcgatgccgcgtttgtactgacaacgtccaaggagctcaagacacagcataagacattgtatattgaaggcgatttcatcacaaaagaagatattgcccgcattaaggaatgcttaacttacgggattttgcaggcacgcgttaccgaagattgctttttccgtttaaatgggcagacaaaagaagagctgctgcgcttgcttgtgaaaaaggcaggagccgaagtgtacttgccatcgattgaatcgagagagcaattgtctgctacagacattggcaaccgcatggctgtgccccatccgcttatttcaattgatgccccggaaacaaaaatttttgttggcatgaacagccgtgccgtccaatggggggagcggacagtccaaatggcgttcttgctgttggtgagtgaacgggacaccgtgttgtacgaatcaatctttcgcgaaatttatcaacttagtaaaacggcacgtcttcaagacatgaagtcgtaccaaggatttcggaatagtttgtcattataa

SEQ ID NO: 7584 - DNA, 168 bp, Bacillus clausii
  misc_feature (1)...(168): n = A,T,C or G
ttatcacgatgaaagaattgcttaaagtcgcatatgaacaaaaatttgcagtcggctcctacaatgtttctaatagcgaattgctatccgccattattgacacggcagaggangaaaaatcgccagcaattttacaaatccatcctaatgagttggcgcttataggca

SEQ ID NO: 7585 - DNA, 279 bp, Bacillus clausii
ggtgttgcttattgtgtgcatgctgtttggcatgatgctcggagtccagcttatgagcgaacacgccggcttaagcgaaaccaaaccacttgagctgaacaaggaagagcctgataaggaaattccggcccctcctcctacacctgcagtagcagacgcagaatttgctggcacgacgaactttttttctgaattgggattaacgcttgcaagcggagcagagtctgcggcgagaagcggtttagaggggctgatgacagcagtgcgcaatgggatcaa

SEQ ID NO: 7586 - DNA, 177 bp, Bacillus clausii
ccgaggcgtctttaaaaagagtggagcaagtacaaatgggcggtttaaccaagatttgttcgccaattcgattttgctcgaagtaggtggggtcgacaattcgcttgaagaagcgtaccgttcaatcgatgcgtttgctgaagtgttcgctgattactactataacgagaaagaagg

SEQ ID NO: 7587 - DNA, 374 bp, Bacillus clausii
caaattgctagatggcatgaagcagccggccagcaacaagctgcgttttctttatatgaaagcttattggatagcaaagactttccccttttagcgaggcgccaccttggcgacttattgaaaaaacaacggcgctacgcagaagcggcagagcagttccatgcttgtgtgcgggaaggatttgccagctacgattgttggacagagctgtcgcttatttatgaacattatttaaaagaaagggacaaagcggaaatttatgcctaccgggcattagagtcttctaccactaacaaggaaagggaggctgcgttaaagcgggcagcacgcataagcgggaaattaaaacgataagcatttcccggggaagcgca

SEQ ID NO: 7588 - DNA, 399 bp, Bacillus clausii
aagacaacaaggagcaaacagcagggcaatatggctatgatttaatccgtaatgatatcctgcgcacgattctcggagacgagcacgacagattgctttattgggtaggcaaaaaagtcgcgcgcgacaacccacttgaatccgtcgaagaattaatttcgttttttcaacgggcggaatgggggcaactccagcgtctaaaagaaaaacggagcgaatacatttttgaactgacaggggattggatgggacgaaaagataggcgctgttaccagcttgaggctggctttttagcggaaacatttgaagtgtggcatgaggtaacaactgccgttacatatacgcaaaaacgaaacagcacgatttttacggtgcattttgacagaaatgatactgtca

SEQ ID NO: 7589 - DNA, 573 bp, Bacillus clausii
gcgaagcctttgtcaaaacctatttacagacaagcgccgtgcgcggaggcgtctttttagtttgcaaagctgtgcccaaaaagtattacagtgacttatttttattcgtgctcaaatgcgattttcaggaaaacgtcgccacgcttgccgattccaaaacactgattaaaaaagtcgaacgggctattacaacgaaaaatatgaaatcaattcaatacccacatatgattgaggaaggcatggtggaacaagcggaagtcaaaatccaccagtcttcccacgcccgctacttcgaagattttcttccttacgtcgaatatggagattcaatgccgcaaattttgcggacacaggtacaaacgattatggaagaacatgcagaggaagcatttgcccactctgtagaagaacgcaacgctttcaccgaaaaaatcgagctttgggcttcgagcgaaacgagagagctgcaagaacagttttctacccatgaagtgatggaagcgtctgcgcaaatcgccgaacatgcgcctgatgcttcgacacgaatgaagctcggcgatacagacattaaag

SEQ ID NO: 7590 - DNA, 594 bp, Bacillus clausii
atcaatctttaatagacatggagcggattgccccaaatgtgcttcatccccttaaacaggtcgacggcatttccaacaaagcattaaaagaagcattatatagcaccgagatggaacagcttggggacgcaatggaaatagaaaagcggctcttaaaagggagcgtgcttatttcttttaaggaaaatggggcacggcaaaactggttagttgatttggcttatatgaaaggccgggaaatgaatgtcccagaaattgaattcagtgtatttggctcgaaggagtcgtttattgaagcagtggaaacgaatctagcgttgctgcgcaaaagaatcccttcgtctgatttgcacatggttaaattcgtcgttggaagcgaaacgaaaacggacgtatacgtcatctactgtgcctcgattgccaatgaagaaaatgtccaaacggtaaagcaacgaatcaaaggcttgcaaattgatcaagttcctgattcatcgacgattttacaagtgattcaagataataactattcggtattcccacagctcgtcgatacagaacgccctgatcggacggcgggggcattgcttgaaggaa

SEQ ID NO: 7591 - DNA, 336 bp, Bacillus clausii
atgcaaaacaaccagacgccctataaggcaatttattcaatgactgtttttgccacactcgcaagcgccattggctttctgtatttgatgattgtcaatgcggcaaacggaacgtacggctatatttatacggcgccatctgtgtttgtcaatgaaacacacccattctattctctgttacaaagcttggaaatctctacgcttgcgtttgttgcttttatttcgctggggctcattaagacagccaactttaaaaaattcccagcaattgcgattggggcgggcatatttgcattggtgttaattgtcaatttactaggggggcttttgcgttga

SEQ ID NO: 7592 - DNA, 207 bp, Bacillus clausii
tttgcggattttccgcaccgtattttggggcgaaacgattattggcactgacaagatggttccactgagaacaggcatgatcctcccttgcgctcttcttggtgcggcaacactggcattaggcctcggcactgaaagtatttctggcatcgtccaagatgcagtaaatacgttgctaaatccacaaatttatattgatgctgtgtt

SEQ ID NO: 7593 - DNA, 645 bp, Bacillus clausii
atgaaaaagcgtcaggagatcgggcgtggattacgattggctgttgaccaagaaggaaaacgagcagaaaatcatgacatcaatattttaactgtcgttgcaaatgaacaatatgaatcctttgtgtcccgtttacaacaggaatatatagaggacggtacagatgctccaccaacaccgaagaagccagagcaaggagaagtacatcgcaaagaagaagtatacaactccgaagagttcaaggaattctggcaaaagttgaataaaaaaatgagttataaagttgaagttgatacgaacaagttgattgaagagtgtgtgggtcgtctaaataatgcaaagttcccatcacctttgattgaaattacaagaggtcgctttgtaatgtgtgaatacaagctttctcttatagcaactgaaggcgaacgagcaaaacttaagattgagatggaagattcaaaaggaggtcgctttgaaaatgaattttatgtacagaaagatgacgacttaaagaaagtaacaaaggatgatcgtctcagaggattcaaagtgcttcatacaggcgagttgtatggcgaaccatatattaaatttaccaatgaagtaacagtgaaaaagtttgagccatacagatttcatgcagaa

SEQ ID NO: 7594 - DNA, 99 bp, Bacillus clausii
atacattgacggttaatattgctcgtctgcgtaaaaagcttgctgaacttggaaaagaacacttcattatgactaagaaaggacaaggttatattatcc

SEQ ID NO: 7595 - DNA, 558 bp, Bacillus clausii
atgagtttctttcaatatctaaaagataaacggaatttctttatattaaacgtgatcattatgttctttgtttctttgatgacgattgtgagcacagattccagaaacactgtaagtaatatcgtatataccaatgtggttatcttttttattgtagctatatacgtaatcatcgaatactattacaatagagaattttatcgggaattaaatgatttggttgaaagtaatcatgaagaatttctcgcaactctgcctaaaccgcgaaacgatgaacaactgttatatcttgagttattaaaaaaagtaaatagtgtgcatggcgatcaattacaaaagttgtataacgaaaaaatggatcatcaagattttattacatcttggattcatgaagtcaaggttccgattgcggcaggtcgcttgcttatggaaaacagtaatggaagaactgttgaataccttgtggacaagtttgaagatgagttggatagaatcgaaaattacgtggagcaggctctttattattctcgcattgattctttttccaaagattatttt

SEQ ID NO: 7596 - DNA, 357 bp, Bacillus clausii
tcgcttttgcccttggcatgaacattagctttacgtccattcttgaaggaggattgccaggcgtcgtacttggtgtgctcgtcgttctagtaaccggcatctctggctactggatattcaagttgtttaaatggaatccactcgtcggtgcagctgaaggatctaccgccggaaatgcagtagcaacgccagcggccattgccgcagcaagctctgcttttgcatacaatgttgaacttgcgactgtccaagttgcagccagtgtcgtaactacagccattttgctaccgatttttataggctttttggctaaacgtttagagaaaaaaggccagcttcctgaagaagcgaggcaac

SEQ ID NO: 7597 - DNA, 283 bp, Bacillus clausii
atgaaaattgccatcattgccgatgaccttaccggagcaaatgacagcggcgtccagcttgccaaggcaggcttggacacagttgtctggctcaatggcaaaggttcgtcagaaaatcgcgcagaagcagtcgtggtcgatacggatagccgcgccctttctcctaaagaagcgaaagcggctgtccatgcagccatgtctgcattagcgccttacaatccaaatttgattttaaaaaaagtcgattcgacgttgcgtggcaatgtcggggcagaactcgaag

SEQ ID NO: 7598 - DNA, 201 bp, Bacillus clausii
catccaatcaggcaaagaagcggatattggccgttgtggaggaagccgcaaaaacagaagaaccgactgttattgttagtcatggaaacctaatttcgttgctgttgcatgcaatcgatcgacaatttggttttcagcaatggaaacaaatgcagtgccccgaagtttttcatatcgatctagtagggcaaacaatcacaa

SEQ ID NO: 7599 - DNA, 287 bp, Bacillus clausii
atgacagcaaaagacattaaaacggccgcgtttaaatttttttcaaggcatggctatgaaggtgcatcgttggcgcaaatcgcccatgaagcgggcataaaaaaacagagcatttatacgtattttgacgggaaagacgatttgtttatgcaagtcgttcatgatgtggctgagttggaattggatatgaaaaggcagctgctcggggacttcgaagacgaagcatttgaacaacaacttttccgttatgtgtctgaacataaacgacttgtagaggaagatgaacg

SEQ ID NO: 7600 - DNA, 447 bp, Bacillus clausii
ggaacggaaattaaaagaatcacatcaacttccaacaacatacaaagaagcattacttcaactggtaaaacaagtagaacagaatgaaaagcttcaaacagaaaatcttgtactggttcagcaaacgaaagagttaaaaccgaaagcttcgtattatgacatggtgcttcaaaataagtcgctgctagcagtctctaagattgcaaaggattacggtatgagcgcaattgctctaaacaaaaagcttcacgagttgggggtccaatataagcagggagatatttggttgctctatgcaaaataccaggataaaggctatacacaaactaccactcatgtaattgacgctgaaaaatcgagagtcagtacaaagtggactcaaaaaggtcgtctatttatatatgagctgcttaaaaaagaaaatattttgccaatgatcgaaaaaga

SEQ ID NO: 7601 - DNA, 585 bp, Bacillus clausii
tgaagcgattgctagacatgtagaaaacaaccggtcgatttatatttttacaattgttttatttttaattggcgttgttttcggcgcaattgtcgtcaacagccttagtttgtcgcagcggcacgacttgtttacatatttaagtcaattttttgatgaaatgaaaaatgggtctgtggtcacatcgccaagcgagctgtttgtccacagttttacccattatggcaaatatatcggtttaatgtggatccttggcatctcattaattggattgccggcgatctttgtgcttatttttgtcaaaggcctcgttattggctttacggtcgggtttttggtgaatcaaatgggcgcacaaggatttctgcttgcgtttgtgtccgtcttgccacagaatgtggtgttagttcctgcctttataatcgttggcacagcgagtgtgtcattttgcttgcgtttaatcaagcaaacatttgccaaaggtctaaaggagccgatttttcctccttttttccggtacacgacactcgttttaattgttggcgcatttgttacagtcgcttctgtgtttgaagcgtacgtatc

SEQ ID NO: 7602 - DNA, 130 bp, Bacillus clausii
atggaatttaccgttcaatatttatctttttatgccgttcaagtcgaccatgagacggatacaaaacaatataaccattaccaaacgttagacaccgatgcttttgaaaaagcccactttccgccttttt

SEQ ID NO: 7603 - DNA, 585 bp, Bacillus clausii
ttgccaaaaaagcaggcatggatttaaacgagcatatccatatcgggctactggaccatttgtcctttgcccatgcccggattgcccaaggaatgtcgattgaaaacccttttttggcagagacgaaagcgctctatccacgtgaatatgcgattgccaaagaagtagtagcccttgttggccagcagaccggtgtccagctccctgaaggagaaattggctttattgcgcttcatatccatagcgccattcaaaataaaagcatgaatatcgtcaatagccattcgcaattagttagtcaacttgtttcccttgtggaaagccagtttgcgattaaattggagaaagagagcatggattatcttcgtcttgtgaggcatttgcgctttacgattgaacgggtgatgacgggtgaaaaagtcgaagagccgaaagcgattgcaaaactgttgaaacaagaatatcctgtatgttataatctttcatggaagctcattaaagtcatgcaaaggacgcttggtaaaccagtgtatgatgctgaggcggtctacttgacgatgcatttgcagagggtgcagaacaaaa

SEQ ID NO: 7604 - DNA, 141 bp, Bacillus clausii
ttcagattttttttttttttgagacaaggtctcaatctgacatccaggctggagtttagtggcatgatctcagctcacaatctctgcctcctgggcacaagtcatcctttcacctcagcctcccgaatagctggggctata

SEQ ID NO: 7605 - DNA, 108 bp, Bacillus clausii
gtggatcgatgaaaaagcaatggtaatggaaacattaatcagcatgaagcgggcaggagcagacttgattttgacttatcatgccaaagatgtagccaactggctaaa

SEQ ID NO: 7606 - DNA, 126 bp, Bacillus clausii
  misc_feature (1)...(126): n = A,T,C or G
ctgggaaagcaaaagcggaagcgttcgccaagttacgntcaaatgaagtcaatgaggcgttcccagcttctatattaaacaagcatccaaatgtcacagtcattgccgacgaagaagcggcaagcg

SEQ ID NO: 7607 - DNA, 270 bp, Bacillus clausii
aaagagaaattacatctagttatattatccaagcagcctatgagctctttgcagagcatgggatagagagaacgagtttaggtatgatttcaaaaagagtaggaataacgaaatcgtccatatactaccacttcgccacaaaagaagagttgattagccgaacatttgagtatatttttagggatcattattttgctgcttattttgatacggagtccattcataaagacaattttatggagacgatcattagaggcggattaaaaatgc

SEQ ID NO: 7608 - DNA, 135 bp, Bacillus clausii
accctaccgcagccagtattgcgaccgaatcgtttttatcaaagacggcgcctttttctccgagatccgcaaaggcgaccgccaacaaacgttttaccaaaacattttagacacgcttagcgttttaggggcgat

SEQ ID NO: 7609 - DNA, 284 bp, Bacillus clausii
  misc_feature (1)...(284): n = A,T,C or G
gtgagggcacttggtttagttgtagaatacaatccatttcataatggccatctgcaccacttgacacaagcaaagcagcaaacgggcgcagacgtggtcgtggctgtcatgagtggcacttttttgcaacggggagaaccagcgcttttatcacgctggtatcgggcagaaatggcattggctgctggagcagacctcgttgttgaactcccttatgcttattccgtacagacggcncagcgcttcgctgaaggcgcagtgacgatcttagccgcactccgttg

SEQ ID NO: 7610 - DNA, 260 bp, Bacillus clausii
ggtttggcagccttgcaaacggcatcgatcattggtgcttttccatttgctgtgattatcattttaatgattgtgtcgctttttaaagaactccgcaatgaaaaagcagcactggcagtaaaccgtgaacggctccggcaagaacgcctagctttgcgtaatgaacgggagcgcattaaacgggaacagatgttgcttcgcaaagaacagcaaaaacttcggcaactaacaaaagacaagaagaaggacagaaaaaaaga

SEQ ID NO: 7611 - DNA, 189 bp, Bacillus clausii
aattaatgaccgcctagggcaagaagatattgaaacgacacttggtacctatggacatttgtatccaaacagtagctttgaagtagcccataaattagaaggtattatgtcttaccaaatagcaacagaaaatgaagatacttcacctaaaaatcaattcactgctcgttacttacgtaaaggtttaaa

SEQ ID NO: 7612 - DNA, 300 bp, Bacillus clausii
atgtattacaaagttgaaaacgaaacgttttatgtcaaagaaatgatttataacaatgaagaggcccgtcgcgggatttggaatttcattggcgcccatttttccatggtttattacgtaaaaggaaagatctttacaaacgagccgttatccttctttttggaagacagtgaaattgaagaaaaaatctctccttattacatggcgcgcatagtagacgtagaacgtttccttgcttcatttccatttacttcgcaagcgaacggcaaactccttttgccatttctgatccgctgctag

SEQ ID NO: 7613 - DNA, 259 bp, Bacillus clausii
atgagtgaggcaaacgacgacgtacgcgagcgtttgcctacagtctggaagcagggctccatccctgcttctttttttcgcctcttaactcggcactgctgctgcttttcccccatggtgaagccactgcgccatcgcttcaatatctttggcaaatactcggtcagccgtaatcgttggtacaactcggcgcgcctctacaaaaaaggcttttgtggctggagccatcgccgctatgccttgatattcacagcttgca

SEQ ID NO: 7614 - DNA, 153 bp, Bacillus clausii
aaagagattggacatagcaaaggaagttgctcgttcaatcggatgtgcctgtatcggttattgcgcaagaaattggctatgacaacttcagctatttttatcaaatttttaagaagcattttcatacaactccgctcgtttatcgaaaaaaac

SEQ ID NO: 7615 - DNA, 256 bp, Bacillus clausii
atgcggtcaataacgaagttcataaaggatttttcaaaggcgaatttgaagttttcttttgtgttgttttttgctttttggcgaatgtcttcgtcatttaacatatcctctttgacttgctcacgagaaaggaaatctgtttctgtgaattgcgtgccaaaacgctcatttaacttttctaacacgcttgataatcgaaccttctcatcctcagctgcaccaccagtaccatgcttcctgtgggtcaagttcaacg

SEQ ID NO: 7616 - DNA, 228 bp, Bacillus clausii
  misc_feature (1)...(228): n = A,T,C or G
gactgtccgtttcggtgatcgtaatgaaaccgttcgtgaagtccaagaaaaattaggcatccntgntnacggcattttcggaccgcaaacggaaaaagaagttcgcgaattccaagcaaataacggccttgcagctgacggcattgtaggcccagnnantaagaaagctnttgataacggtggacaagttgcctctgcttctgaagaaagcacnacttcaaatgaaac

SEQ ID NO: 7617 - DNA, 335 bp, Bacillus clausii
atgagatggcttctcggtttagtcttgaacgctctcgtgttatggatgctctcacaactgttttctggcttttacttgtctagctttttcgctgcactagtagcagcgtttctcctgaacattttaaattggacagtcaagccgattttaacagtattaacgttgccgatcacgattttgacactagggctgttcttgtttgtcattagtgcagtaacgctcatgctgacatcgatcttgatgggcagcgctttcgaaatcagcggtttcggcacggcattgcttgcagccattatcattgccctgttccaaacatttctcattaacccaatcaa

SEQ ID NO: 7618 - DNA, 417 bp, Bacillus clausii
ggaaatccactctgactggcgcgaagagataaagcgcttggcaagtgaaaaacaattgcctattttttttaaaggcccgatggaaaatcacagcaaaagcgatgcgatcggcgaagacattcttggcaaacagccaaacgctgtattacgcgacgaagctgcctcaagcattaataattttcgtacgcggatctggcttcagcgcgcagacgcggtcattgctcttttcggcgaggattacaggcaatggaatacagccatggatgccgcaactgctattgaagccggaaaaccgttaattttgattcgcccagaaaagcttcaccacgctttaaaagagctgtctaacaaagcacaagtggttgtcgaaacgccggcgcaagcgattgccgccctatcttatgtatttgaagagga

SEQ ID NO: 7619 - DNA, 309 bp, Bacillus clausii
cgatttgggccacaattacattatggaaagtcgtcgatttgtccgtcatcgaacggtttgagtacattggtatttcgacttggctatttgttgtgttgcctaccatttgcttgctgctttgggcagcaagccgcattgcaaaccaagcttttttcatcaagcaacgctccggattgcgtctattaattgctttgctatttgtttgctcctttttcgtcgtagggcgtaaagaagtcaatcaattgaatgatgtgacagccgaaattggcttttggaccattatcacttacatcccgtttttatacattg

SEQ ID NO: 7620 - DNA, 692 bp, Bacillus clausii
atgaaaaaatggctgcttgccctttgctgcgttttagtgctaggaggatgcgcgcctcgtacaaaagtgattgaagacattcagctcattcaagcaattggctatgattatgtgaataaaaacgaattcaggagcgtagcgagttcactcatcgtccttcctagcgaggaaacgctgccgcaaacaaaaatatttactgctaccggaaatacttcccggatcacacaaaaaaaaatacaagcaaagtcatccaaatatatggttgttggccggattgggctcatgttgtttcaagaccgccttgccgaagacggcattttttattttttaaatgtccaccaacgggattcaatgatcggacgcaatcttcgccctgcgattgttgaaggaaaaacattcgatttgctctctaaaaattaccatttggacacgactgtttatcaatatttaagtgaattacttgaacagagtgaacgggaaatttacccacgtgtcacgctgcataccgccttataccaatattacgcagaaggcactgatatgtttttgcccatcatcaaaggcaatgatgatcacgctcgtgtaacaggcctggccttgtttaaaaaggaccgttgtgtcgataagctaaatgtcagtgaagcttccttttttaaattgctttcagaaccgttccgaggtggtttttacca

SEQ ID NO: 7621 - DNA, 459 bp, Bacillus clausii
atggatactgtatatattcctgcatatgaaacagaggtggaagaaagtactttttatgttcgtaaacgaacattagaaagtatgagagatcgtttctataacatagaacttcgctctctaactgtagaagatgttcaacggtatcgaacttggctactttcagacaaaggagctggatattcccaagcatatgctagtttagtatttggtatgtttcgtaaaagtttagatatggcagtggatatgcaatatctagaaatgaatgtatctaaaaaggtgaaagctattccaaagggaaaggcagttgttccttattggactaagaaagaatttgaaaaggttatatcagttatttgtctagatgatttttatgaacatttatgttttgtgatgttatgggtttattttatgacagggcttcgtgtcaatgaaggtcagcattatggtgggaagatgtag

SEQ ID NO: 7622 - DNA, 156 bp, Bacillus clausii
tagagccatgtttgattgcatcattataggaggaggcccagctgggctaaacgcagcacttgtctaggtagagcgaacgaaaggtctgctattggatgaaaaccaaccacggaatgccgtcacccatgcatcacatgggtttctaactagaaacgg

SEQ ID NO: 7623 - DNA, 99 bp, Bacillus clausii
agggtgaacaattggtcctatttcctgatgggcgagtgcttgtacaaggaacggaagacattagccgtgcaagaacgctttttagcaaatatattggcg

SEQ ID NO: 7624 - DNA, 250 bp, Bacillus clausii
atggaaaagaaacctagcttatcaatggttataatctttttgctcttttttatcgctctattaggcggttgcatgttcttccttaaaattgatccccatcttccgattttgttggcgcttattgtgacaaccatttggggtcggctgttgggcttctcttataaatcattagaaggggcgcttattaaaggcatacaagggggagttgcccccattattgatcttgatgcttgtcgggcagtcatcgccg

SEQ ID NO: 7625 - DNA, 480 bp, Bacillus clausii
atggcaaacgtaagtacaggattaatttcgtatcatttttctggcaaaatggatttaatcaatcaaaccttactgtatttacttaacaaaaaattagattttattagtggaaaggttgttcaagaagaaacgtctatttcacaattgaaagcatatattgaagctagtttggcttaccaagtagcacattataaaaataatatcgcattaatcgaaattgtctttaatgctaaaaatgaagaaggtgtgccatattataaagctgatgatgacgaagaagatctgttaaatgcattgctcaaagatattttattagaggggcaaaagagacaagagttttctaatgaatttgatgtagaaatgatgtgcgtcttgattcaaggcgcaatagaggaaagcatgctatctcagaataattcctttagttttgaaaaatataaggatcatttaaccagaatgataacaaaaatagtcttgtaa

SEQ ID NO: 7626 - DNA, 102 bp, Bacillus clausii
gatctgggtaccggcagcaatactaatttttgtgttgatgctgtgcataaataatgtcggtcaagctttaaaacgcgcgactgatgcaaaacaacgaagagg

SEQ ID NO: 7627 - DNA, 476 bp, Bacillus clausii
  misc_feature (1)...(476): n = A,T,C or G
agcaaattgccaaccgtaattggcaagaaccattgcggtgggagggagataaggacttcgaacgcctatcttaccaatttgaacggatgcggcaaaacttaaatagttatgaccgagcgcaaaagacattcatccaacatgcctcccacgagctcaaaacgccaattatggtcattaaaagctactcccagtctgtgaaagacgggattttgcctaaggaaaatttggagcaaacgatggacgtcattactgaagaggcaaaccggatggaacgccgcgtcattgacatgctctattacacaaagctcgaccaaatgaagaaagatcagcttaacgttgggccattcccgttcggaaagcttgcataccagattgaagaacggttccgctaccagcgcgatgangtaaccatttccgtcgaaggggcagaagtcgttgtcgaagctgacattgaacaatgcgaagtgttgttggaa

SEQ ID NO: 7628 - DNA, 1386 bp, Bacillus clausii
gtgaacggagaagcggttaccgatgaagaagatgacgacgaaggccattacgttggtggcgaagcgtttggttccttcggtgacgtaacgaacaccgagtggcaaacgcttgaattccaagtcatcgttggcgaaggtcaagctggcaaggacatcgaaaacgtagcggttgttgatggcgataatttggatgagccagatgggccgcgtgaagaagttaaaatctacccacgtgagccaaagctagagtcaagaaaatcagcaccaaatgcagatgaaagcaaagacggctatgaagtcggcgacacggttgtgtacacgattgaagcacgtaacacagtatctgatagcttgtttgaaaacctcaccatcacggacctccttccagaagggctaacgtttgtggaaggcagcttggaagtcagccatggtggcacaggcagctttgaaaacggcacggtaacggctgagttcggcgaagtcacagacaccgaatggcggacggttacgtttgaagcaacgatcgactctggttatgtaggcgagacgatcgaaaacgtcgcactcgttgaagtaccaaatattgacgagccagatgagccaggaacggaaattgatgttgatccgaaagagccaaagcttgaatcagaaaaatcggcagcactgcttgaaaaagcagacggcaataccgatgaggacaacccagaagtgggcgacacacttcggtatacgattcaaacacgcaatacaatcgaagacagcttgatcgcaaatctcactatctctgacgtccttccagaaggactggaatatgttccaggaacactgaaagtgaacggagaagccgtaacggatgaggaagatgacgatcaaggccactatgtcgatggcaaagtggtgggccacttcggcaatgttgaagatacagaatggcatacactcgtatttgacgtggttgtgttgccaggtcaagcagggaaagatattgagaatacagccgttgtcgatggcgacaatatcgacgacccagatgagccacgtgaagatgtcgaaatctacccacgtgagccaaagcttgagtcaagaaaatcagcaacaaacgcggacgaaagcaaagaccgctatgaagttggcgacacggttgtgtacacgattgaagcgcgcaacacggttgaagacagcttgctcgaaaacctcaccattacggacgttcttccagaaggggtaacgtttgtggaaggcagcttggaagtcagccatagcggtacaggaaactttgaagacggaacggtaacggctgagttcggcgaagtcacagacaccgaatggcgcacacttacgtttgaagcaacaattgatgctggctatgttagccaaaccatccat

SEQ ID NO: 7629 - DNA, 402 bp, Bacillus clausii
gcgatatttccgttacggacaatgcgttttatgtcgcctgcacgaaagaggcaagtgcttatatcgccattgcgcttaagcaagttggcaaggcaaccgtttctttagaagaaaccgatacgcttgagttgcctgacgagaagtgggaagagaagccagtgactgtgtcctctctgcgcttggatgtcctcttaagcgctttgtatggcctatcaagagcgaaagcggccgacttgatcggcaaggggctcgtgaaagtcaactggaaggtagtagaacatcctagcttccgcgtggcgattggcgatgatttgtctgtaagaggggctggccgggctaaagtattaaagcaagaaggcgtgacaaaaaaggacaagtaccggctagtgcttggcaagaaaa

SEQ ID NO: 7630 - DNA, 171 bp, Bacillus clausii
taacgaactcatttcgcttcttatggattagtcaactttttgctaatattggcggggtgttttacatagttgggctaattccgctgattcatgctgtcactggttcagcggcagcaatggctctcgttccttttttgacgatggtctcccgatttgtaagtgctatgatgg

SEQ ID NO: 7631 - DNA, 294 bp, Bacillus clausii
cgctaagtgcatggaaagtcgtgtctctcgtctttattgaacggatcgagtatttgtgcatcgcgatatggttgactgtcatctttccaaacattgcccttgcgatttgggcaagcagcaggctattgaaacaacagctcggtgttcggcatcgcacgacggcaaaagtggttgtttttcttgtgtttatcgccactattcaattcgatacgcgcagagcgatcaatgcgttgaacgatggaatgaattatgtcggtccgctgtttattttcggtcttcttccgcttttatggg

SEQ ID NO: 7632 - DNA, 351 bp, Bacillus clausii
atgtataaggccttgaaagtatctatgctggcgcttctcctttttttgccccttttctccgtagtcacgacaagggtgatcgatgagctccaattaatctcggtcattggttttgataaaggggaagagggcgctataaaagggactgttagcttgacctcgtattcggttgaagaagaaacgaaaaatacggcgctgtcagcggaatctaattcaacgcgagcgctccgactgaaatttaacagcatgtcttcccgtccactccatggggggaaaatatcatcgattttgctagaagaccagttagcggaaggcggcatttttgatgtacttgatacgtattaccgcgat

SEQ ID NO: 7633 - DNA, 564 bp, Bacillus clausii
ccgcagcgtcagcgtgcctcttacaagcagtgtgtatgaagggccagcatctgctttgaccgaaagccttgacgttaacatgaatttgctccgtaattattttcgtagcccagaattagcgatcgaaacattagaagtcggagaaaacgctgcaaaaaaaatggcgattgtctcgcttcacggaaaaacgaatccagaccttgtaaaagaagtgcgcgaaaggctgaaacaagtgcatgtagccgaattcatcatttcgcaaattgcaactgacgcgcttgaagggaaagggtttttgttcccgcggactatggcaaacgaccgcccagatgcgtgcgcattggcattggcaaaagggaaaatcgttttgctcgtagaaggatcgccattggcgattctggcaccaagcctgttttttcatttctttcaaaaccaagacgattacttatccgaatttggtcgctttggcgcacgtcctcttcggtatttgtatttttttattgccaccttttttccggctattacggtggcaatcatccgttttcatcttgatcacataccgac

SEQ ID NO: 7634 - DNA, 274 bp, Bacillus clausii
atgagcttttacagctactcaagcaacttttccgatttttcttcccgtaaacacaaaaagcacgacaggcacgatcgacacgacaagtgcgataagtgtgacaggcacgacagacacgataagtgcgataagtgcgacaagcacgatcgacatgatcgacatgatcgacatgatcgacatgatcgacatgacagggacaaatgcgattgccattctttctttaaacacattgcccgtggccaatttgttactgtttttctaaaaggcggcggct

SEQ ID NO: 7635 - DNA, 510 bp, Bacillus clausii
cgacacttgtcgtctcacgcacagcggtgccgtttccacccattatagaagcgttgtttttagaagtaacgatcgagcttcttcgtgaagcgggagcaagactgccaacaaaaattggccaaacaatcggcattgtcggcgggattgttattgggacggcagcggtagaagccgggttaacgagcaatgtcttattgattattgtggctctcgctgcccttgcttcttttactattcccgtctatcgcatgggcacgacgattcggattgtccgctttccgtttatattggctgcccaaatatgggggttgatcggtattgccattatgttgattttcactctgtgccatctgctttcgctgacctctttagggaggccttatatggagccgatctatccattttccttcaaagacatgaaagactctatcattcgcttaccgatttcgcagcaaacaatgcgtcctcgatttttgcaagcaaagcagcaaaagcgttttttgccgaaac

SEQ ID NO: 7636 - DNA, 266 bp, Bacillus clausii
atgccagcattccgcttgaaaaggacaaagccccggtgcaagctgactgcaccagagctttgttatttgcttcttaatggcgctcctgcgcctgcccattttctaatcgtatttaaaagtggttttcgtttttcgccaattaagcctatacactctgcacatagttggatcagcaaagcgacaacgatcaacacgagcagtgagaaccataagcttgacatggacaaaagaattgcacaagctgcgaacaagaggctaacgccata

SEQ ID NO: 7637 - DNA, 252 bp, Bacillus clausii
atcgaaccagatttgaaaatgagttgataagagcatcaagaatgccctttaccttgatagttgaggacgtaaatggctatcagaaaatattaaacggcacatatcgcagccaatacaagcctcaatcgttgcttggctcgctcaaaacatttgaagcgcgctacgggtttacgactcactttattaatccggcatattcaggcaattacatctatcacacattactttatttagccagggaggtattgaaat

SEQ ID NO: 7638 - DNA, 168 bp, Bacillus clausii
atcttttacattgaacacgaagaagctgctcgtatttgcaaagcgcttaaggaagaaaacggtgatccctgattttcgcagcccgaaaggcattcgcctcgcaccggttgccctttacaatacgtttgaggaagtatggaatagcattcaggtcttaaagctaattat

SEQ ID NO: 7639 - DNA, 417 bp, Bacillus clausii
atgtaaggccatcattgccggggcaggagcatgcgtaacgctgctcctgtccttggcaactccaagctttgccgaagaagaacgagtggaacctggtgtttacaaagagcgggaagtgctgttagagctgcgccaatacaaaccagaagcggagcagagggaaatcagagtgcctgaagaacagaaaatacttacatttactcagccattggaagaaacatacgcagaactacaagacagcctgtttgcgagtagtgcggatgcaaaccgtgaggaaaacctcgccgcaagcgccgggctgtttacagaggaaaaagagttggcccgccaagtggtgcaggcagaagaaaaagtaaacgtgctgccatggatattagcagctgtggccaccgtgctcgtttctgttttattgattta

SEQ ID NO: 7640 - DNA, 434 bp, Bacillus clausii
atgacgattatgaaatgtaaggccatcattgccggggcaggagcatgcgtaacgctgctcctgtccttggcaactccaagctttgccgaagaagaacgagtggaacctggtgtttacaaagagcgggaagtgctgttagagctgcgccaatacaaaccagaagcggagcagagggaaatcagagtgcctgaagaacagaaaatacttacatttactcagccattggaagaaacatacgcagaactacaagacagcctgtttgcgagtagtgcggatgcaaaccgtgaggaaaacctcgccgcaagcgccgggctgtttacagaggaaaaagagttggcccgccaagtggtgcaggcagaagaaaaagtaaacgtgctgccatggatattagcagctgtggccaccgtgctcgtttctgttttattgatttatat

SEQ ID NO: 7641 - DNA, 735 bp, Bacillus clausii
atgcaaaatattaccacagaaagaagtgagtgtttgggaaagtataaaaatatagtttcaataatcggtcgcgataataagttaagtcgatgtacggatgctgaaaatagaatcttcaacgaagaagaacttattaatagttggaaagagtcgtaccacgagagagttgctcgaaatgaagatgagattggtttacgtttgccccaatttggagcattgtctgcaattcgtgcacattgggcgacatcaaattctccagcaacgattgtcttacctactggaacagggaagtctgaaacaatgtatgctacgattatttctgaaagaattacttcaacgcttatcattgtaccgtctaatctattaagggaacaaatttttgaaggagcgaggcattttggtatacttccaaaattagaaatgatatcagataaagctatttatccaacgacttttctttataagtcaaaagtaaaagaagaggatgaaaatattctgattgatgcccttgaggaggctaatataattgtatcaactcccgtgatgattaaaaatatgccttcttcagtttggaataaactgcttgaaacggtagaggttataatatttgacgaagctcatcatcttgcggctcccgattggagaacggtgagagaaagatttataggaaaaaaattctacaatttactgctactccatttagaaatgatggtaaaaagattgacggtaaaataa

SEQ ID NO: 7642 - DNA, 393 bp, Bacillus clausii
ggaagcgaccctttcttaccgccaccacctatggaaacttggattcggtgttgctgaagcaatggatacagcgcaaagaggaatgggcttaacatgggaagcggccaaacagttgattgcctattcggcaaaagacgcaaaagcagtcggtggtgaaattgcctcaggtgtggggaccgatcacttgagtgacaaagaggtatatgggcttgatgcaattatatccgcttatgaagagcaaatggaatttgtcgaagcgcaaggcagtcgtgtgattctcatggcaagccgtgcccttgcgaaaacagcacggtcacgagatgattatcggaatgtgtatagtcgcttgctccgccaagtgaaggaaccggtgattctccattggcttggcga

SEQ ID NO: 7643 - DNA, 234 bp, Bacillus clausii
atgcaatcaatcaaaggaaaagtggcgcttattacaggagctggacgtggaattggccgtgctgcagccgaggcttttgcgaaagaaggagtccatgttggtcttgttggccgtacgctagaaaaccttcagaaggctcaaaaggatttggcacaatacgaggtgaaaacagcgctcgcaaccgcagatgttgccaatttaacttctatttctgcagcagtggcagcgattcgt

SEQ ID NO: 7644 - DNA, 378 bp, Bacillus clausii
ttattccagcattccaagggatttcacaaaagtggattccaaatgctgttcccgcactcgatgcgccgattttgtttccgtttgccccaaatgctgtactaattgggtttattgtatctatgattacctcggtcgcaacaattttcgtgacgggcagcctcggtttgtttagctttgtcattgtgccccttacgattacatgcttttttgaaattggcacggctgctattattggtaacgcaactggcgggctaaaaggagcgattgctggatcagcgacggcaggtgtcgtgatgattttacttgtcggcctttctgtaccggtgttaagtggaacagtgtcagactggattgtcatttttggcggaaacgatttct

SEQ ID NO: 7645 - DNA, 554 bp, Bacillus clausii
  misc_feature (1)...(554): n = A,T,C or G
atgaaacggtataacccagctgaattagagcagctgcttgaaaagcagcaagcattcgaatactacgcccaagctgcctgcttattgccgatcgccgactttcccttgtttgaagatgttcggcagcggctcttaacagcttgtgcttccgatttaaccgcccacaaggatgccattcgcgtcatattcaaccgactggcaaccgaaggtcctctcgcttcaaacgcctttcaaagcgaacgaaaagtgattggtggttgggatncaaacagcgcctccactaaagaaacgtctcatgccttgcaactgctcttcctaacagggcaaatccaagtcgtaaaacgccagggggcgaaacggttttttgcattaacggaagatgcgattccaaaccattacttgaaatcgcctttgtcgacacaagagcggacaagggcgttactccttaaatatgcacgcgcgtaccggttatttagcgctgacgatccccgttatggatggcagaaacaccgagctgcaacgcgaaaaaaatggcacgcacagcttgttgagga

SEQ ID NO: 7646 - DNA, 372 bp, Bacillus clausii
atgagcgaagaagacgtgaaggaacttgagcaagtggtgcttatcatggagagccttcataacaaaggtgattcagatgccttgattgaacaaaattcacggtttcaccaaatgattattaccagtaccgaaaataagatgatgcaaacgatcttagctaacattcgcagcatagacaaagccttccggaagcgtgcccttaaagtggaagtcgagcgcgaagtcggctatcaagagcacagagcaatttttgaggcgattaagcaacgggagcctgagcaggccgaacagcgaatgaaagaccatattttgcggacgaaagacaatattttggctgcagaagcgagagcacaggccgaaagaaatccatga

SEQ ID NO: 7647 - DNA, 300 bp, Bacillus clausii; identical to SEQ ID NO: 7042

SEQ ID NO: 7648 - DNA, 288 bp, Bacillus clausii
ttgaaagcatgccgtggcttatgcaagcgacgtacgagaacccatggattggttttattgcttttgtagcgacaatcgtcctttgtgtgatcgttttcaatctcggttttgcgaggaaactgccattgttgaaaatggtcgttgtttacgttttgttagtcattggcagtttcgggctctggtttttggaattcatttttggcgcgccgattttagctgtattagccatctctgctgtcgtgctaggcatttacccgttttcggctgcacctcaccgcaaagaaaaat

SEQ ID NO: 7649 - DNA, 185 bp, Bacillus clausii
ttgaaagtaaaatgtgtcatgtgcgacaaaattaatgatattgaagattttagcacccttgccaaacggctgcgcaaccgtcctatccatacctatatgtgcgactcttgtaaagcaagaattgaaaaacggacgatcgagcgcaaagcgactggcttatttataccccccatcaaaagaaaaga

SEQ ID NO: 7650 - DNA, 279 bp, Bacillus clausii
atgcaggataaacaaacacaaaccattgctattcttacacgtacggaaagagcaagcaaagccatttgcaggcagctacaaggagcgggtcttaatgcccatttgcttatagcgggaggagaaaggtatgagggcggcatttctgttttgcctgtttatctttcaaaagggtttgaatttgatgctgtcttactagctgatgtgacaaacgaccattacccttgtgatgaactccataaaaaactattgtatgtccggctgcacacgggcccttcatga

SEQ ID NO: 7651 - DNA, 759 bp, Bacillus clausii
ttccaacgtttctttatttcgttgcccttgtgcttgcaattgacttagaagcgaaaaagcatggtttaaaaggaatgagcaaagactcgattccccaagtgtggcaagtaatgaaagagcgcggtgtcttgttattgccgattatcattgtaatctcgacattgttaatgggctatacaccactattcgctggttttgctggaattatatcggtcattattgctagttggcttacaaaagataaagcaacaagagtgacatttgcaaaaatagggactgcgtttattgacggagcgaaaagtacgattcaagtagggattgcctgtgcgtcgatcggaattattattgccgttgtgacgatgtctggacttggttccgcgattgcctacaatgttctttcgatttccagtggcatgctttgggttgcgcttttgcttgtcatggttacttgcatcgtcttaagtatggggcttccatcgactgctctttacatcgttgttgcggtaacagcagctccagcattagttgaagcaggggtaaacccaattgccgcccatttctttgtcttctggtttggggcattgtccaacataactccgcctgtggctttagcgtcctatactgccgccggtattgccagagcagatgcaatgaaaacatcgtggacgtctgtgaggctagcattgcccggctttattattccgtttatgattgcgtacaatccgacgatggtgatgcagcctgaaagcgggtccgtgc

SEQ ID NO: 7652 - DNA, 209 bp, Bacillus clausii
ttggcttcattaacacttgaagaaattgaaacgatgcttgatgacatgaaaaagaaactgaatgttgttaacgccagcgtcattacaagcgacagtgttagccccgctaaacatgacgacttaattgcgttgcacgctcatgtgatgcggcgcccgtccttctcgattagcgagatggacgaaattgtccaggaacttggccagcttcg

SEQ ID NO: 7653 - DNA, 315 bp, Bacillus clausii
  misc_feature (1)...(315): n = A,T,C or G
ccttgatttgttgttaagtcagacaacagaggaacatgtgcaattagaatgtgatgcgtactgggtcgagtttgcgggtgnggatgccaaacgttacatgaaccaatacactggacgtgtgccaatggttcatttgaaagacatgaaagcaaccgataagtcgtttgccgaggttggagagggaacattggatataaaaggcattatccaggcagggaaagaagcaggcgctcgctacttttttgtcgaacaggacatttgtgagcggccccctctagaaagcatttcaattagctttaacaacatacaacgctt

SEQ ID NO: 7654 - DNA, 696 bp, Bacillus clausii
atgcctgccaatccattaaggaccaagccgcatttttacgaagcgttgggctttacgacactgcaaatgtctacacgtcccaatccgtacctttcgatgggatatggcgaactggaaatccatttttatggaagtaaaaaaacggtaccgaccgaaaatgcaacgatgtgttacatcaaagtagatgaggtcgaacggatctatgaggaatttacctcaaacctgaagaaaaacatcggcaaagtcccccgctccggttatcctcgcatttctaaattgaaagatttaacgcacgaccaaagatttatcttaaccgatcttagcggcaatacgctatatatcggaacaccctatggcgaacggccggactcggtgttttggcgatcactcgaaagcgctaaatatgccaagcatttcgaagccctctatgatttgacgtattccaaagaggattatcggacggcgcaaaaaatgctggacaagttctttcccccaataacggacacattcgatgcttgcacactcgattgggcgaaggtgcttctggtcgcattggatcttcataaactaagtagccagacaattcataagtccgttaaagacaagcttcaagaattgtttgaaataagtggtccgctgactccggaatggaacaaaatcaagcaaaagtatgaggatatcctgaaaggcgaataa

SEQ ID NO: 7655 - DNA, 273 bp, Bacillus clausii
tagtagcaaaaaagcccatgtacggttatgagatcactaaaaaactaagaaaggaatctatcgttcaaattgcaaatggttcaatctatcctatattacgacgtatgacaaacaacagatggttaacttcttatcaagaagatcatgagggacgcagtagaaaatattatatagttactgaggaagggaaggaaattttaaacaaaagacttgaacattatcaaaatttatatttatttcttatatctttaaaggaaggtgagactagtggct

SEQ ID NO: 7656 - DNA, 218 bp, Bacillus clausii
cctactttttacgcagtggcgttctcgaataaccacgaaaaagagattggcccagcggatatcgtccatgacgtttcagcgtacgccattcgcaagcttgatacgttacgcgcccacgcttcccagttagcatggacgttgccaagcctggaaaaagcctattatgatggcgtcgaagaagcgaaggaacgtctttgcaacgaacgtttctggacgta

SEQ ID NO: 7657 - DNA, 291 bp, Bacillus clausii
  misc_feature (1)...(291): n = A,T,C or G
tcaatctgactgaattaggtaatgctgaacgaattgcttatanacatggcaaagacattcgctattgtaatgaggtnggttggctcatttgggatggaaagaaatgggctgttgatgaaacaagaaagattgaaacaatcgtttccggtacgctaagaggtctatacgatgaagcatttaaagaatcagatgaagatagacaaaaagcgatgctaaagtgggcgaagatatgcgagaagcggtctacgcgtgtaaatagcattcaagatttaaggccgctagttcccgtcc

SEQ ID NO: 7658 - DNA, 81 bp, Bacillus clausii
gacagaacgtggactgttgccaacggaagaattgttttatgaatttctgcaggagttttttacgaagctgaatcattttaa

SEQ ID NO: 7659 - DNA, 347 bp, Bacillus clausii
  misc_feature (1)...(347): n = A,T,C or G
atgacagtagcagctgttgtcgcgttggctatgcttgtgcaaggaagtgcctttttgtttcagcatttcagtttagacgcactccgctttacgagcgaaagccaacaattggaaaaggaaggtgattttgaaccatttaaagaagcggtcgttgctgtgcaaacagacagaggccacgggacaggnttcatcatttcagaaagtggcgacgtgctcaccaatgaacacgtgattcgtggagcttcgtccatttatgtccatttgccagatggagagcgttacgaggcgactgagacgaaaacagacgaaacgaatgatttagccatgttggcgcntgaaggncagcc

SEQ ID NO: 7660 - DNA, 167 bp, Bacillus clausii
tcctggctatcgctattcccatcacgatcaggcattcggggcagctgaccgcgttgagactcggagatgaacgtgctgccgccatcggggtgaatgtgccccggctgaggtcgcgaatccttattctggcgtcactgctggcagcggttaccgtcgcctttgctggg

SEQ ID NO: 7661 - DNA, 234 bp, Bacillus clausii
  misc_feature (1)...(234): n = A,T,C or G
tgcccttgcagctagagacaatcggcattcaatatgaccaagaaccgatgacaaggccacacgggtacccgtgttaccattggcttcaaacgctggcaggagaaggcgaactgtcgatgaacgggcgcacctggaacatgccagaacgatcaggcattctcctcgcgccaggcaccccccaccactacaagccaagaagcgacagttggcaaaccggttacatcacgttntcac

SEQ ID NO: 7662 - DNA, 171 bp, Bacillus clausii
aaccgaagggttttcttttgcacaaatcaaagaattgtttatagcggcggcaatggaacagcatactgctggcaaagtagatatcaacaaactgatcaaatcgatgaaaaaagaacaaaagaaaagcaagactggcaagtggtgggaaggcggcgacgagctaggttttca

SEQ ID NO: 7663 - DNA, 351 bp, Bacillus clausii
aacaaaggggtggagagactgtgtggaagaaacatgcagccttgttatcgacactaggcacggtcactgttttagcagcttgtggaggcacggaaggtgcagcaacgagtgaagagaaagtcacgattgagtattggcatgtaaacaacgaagactggggtggcaaagcgattaaagagctggtcgaacagtttaatgcttcccaggaccgaattgaagtaaaggaatcttttcagcctggaaattatcaagggctgttgcaaaatgcccaggcggcgctaagtggaggcaatccaccagatgtcgcgcaaattggctacaactacatagcttatgtcgaccaaaacgtgc

SEQ ID NO: 7664 - DNA, 101 bp, Bacillus clausii
atgaacaatcaagaaatcgtacagaagctatggaatctatgcaatgtcttacgagacgatggcattacctatcaacaatacgtaacggagctaacctattt

SEQ ID NO: 7665 - DNA, 663 bp, Bacillus clausii
cgttaaatcggacgaaccgcttactgaagaagattacaatttcaccttacaaccagccataaacggcaagctttcttcaggattttcaggaagcgaagaaatacaacaaattagcgccaatgaacgaaaacacatctatgaatttgaggcgaaagagcttgattctgactcatttaaactcggtctcattttagagaatggaaacggggatacgtattatttttcagaaacggtagactcgcttgatagcaatcaaattgccgtcaacgctagccaacaagccgaaggcatcgaactgaacgtcgaatcgttgtctttaagccaaacttcaacaagcttagccttcaccgcttctcaggcaggagaattaacagacctttccttgcctatttacgatttggagtttgaacttgttgaccaagatggcaatacgatcccttcttattctggcgatattagtggagattttgtagatggggtctggacagtccaaggcacgaaaatgtttgatccgctaagtccatcggtcaaaaaagtggttgtcaccccagtcctcatcacgccagaccgcataggagaaacaggcgaacacatggaagagcacgaagaagtcgccatcgaaccttacaatattacgtttgaaccatttgaaatcgagattcc

SEQ ID NO: 7666 - DNA, 234 bp, Bacillus clausii
atcatgctttctataagagtccgcaatggatcggcataaggaaagcagtgaagcgtagagatcatgggctgtgtgtcaaatgcaaatcacaaaacagattggtgccgatggatgttgtggaccatatcatacctatcaaagaagactggtcactacggctaaacccagagaacctacagtcattgtgtcatgcttgtcataacctgaagactgcaaaagaaaaagcaaaaaggg

SEQ ID NO: 7667 - DNA, 477 bp, Bacillus clausii
atgggtagaaatgcaaagccaatcgatttgcacctggtaggcggcaacaaaagccgaaaaacaaagaaagaaattgaacagagaaaaaaaggggaagaacaagtttcctttaagtcagataatgttgtggttcctgattggttaagtgatcgaggaaaagaaattttcaaacaactgcttgatgaatttaagtatacacaacttttagcgaatgtcgatacccatttactcggcttcttttgcgatgctatggatgattatataaatatcagcaaacttatcaggcaaaaaggttatttagatggagaagggaatgcaaatcaacttcttactaagaaaaaacatgtttttgaccaagctatgaaggtagcaagccaattcggtctgtctccttcggatagggcgaaaatcgcaatgaatatcgttacaaaggaagtcgaacaggatgatggtgggtcattcagtggtcgtatatga

SEQ ID NO: 7668 - DNA, 903 bp, Bacillus clausii
tctatagatggtttcagaaggtaaaatcattggcttgtaaaaaacacaaacaagcagttgaacgctttttaaaggatttagagcggtccatttatgatgaggactgctatttttattttgataacaacgaacttgaagaatttaacgaatgggcttctttgttcagacacacaaaaggcgtgctggctggacaacgaatagagcttactgatttccaactgtttattgcagctaatatcttttgttttaaacgtaaagacaatgattatcgtaagatttccagtgtttacattcaactagcaaggaaaaatgcaaaatctcaattacttgctattataagttcctacgtcgcgttcttatccgatcaggtggaagaagtatatatttcaggttggatgaaagaacagtctgatattgtttatcaggaaattttaaagcagcttgagagagttccttcttttaagggaaaatataagacttcttataatcgcatacaacatattaaatcaggctcaatcataagggctttgagtcgagaagcaagacagtttggagaaggaacaaatccatccctggctattttggatgaatatcatacccatcttactagtgaaattatggagtctttagaagaaggtatgggggcaagaataaatccactgtcagttattataactacagcgggaaggaacctaaactcaccatgtaaggctgaatatgattattgttcaaagattattgacccacacaaccctgtggagaatgaaaattactttgttttaatttgcgaattggatgaaggggacgatccatttgacgagagtctatgggttaaggctaatcctatagcagcaacttaccctgaaggtatagaagctattagaaaacgtgctaaaaaagcta

SEQ ID NO: 7669 - DNA, 102 bp, Bacillus clausii
caaacgttatgcggatttaattatcccagaaggcgggcaaaacaaagtcgcgatcgatttgatggcaacaaaaattcgcacaattattgaacaaaagaagtt

SEQ ID NO: 7670 - DNA, 480 bp, Bacillus clausii
aaagatggcatatagcaagacctttttagaacaagtagaaacagcaatgaagcagtcatttagcggttggaattttgagcagttaagagggcgagtgaaagaggaggagctcgactggtcttatcgggattgggtcaaggagtcacttaagcaaaggacagtgctggatatgggcacaggcggtggcgaatttttgtcttcgtgtgctccattccaaggaaaggtctatgcaacagagggatacgagcccaatgtagaaattgcgcaaaaagcattagccccgtttggcgtctgtgtacgttatatagaagatggggattatctgccattttctgatggggcttttgacagcattattaaccgtcatgagtcatacagcgagcgagaattagcgcgtatattaaaaccaggtggaacgtttattacgcaacaggttggcggtgacgattgcaaagaaatcaatgacgcactttcacttcc

SEQ ID NO: 7671 - DNA, 354 bp, Bacillus clausii
atgattactcttacggattcggctgcaagccaaatcgaagcaatgaaaaaagaggaaggcgatgcgtccctcatgcttcggattggcgtaaaagggggcggctgttcgggcctttcctacgcaatgggtttcgacaatgagcaagacgaagaagatacgaaaatccatgtaaatggcatcgacgtcttgatcgacaaagaaagcgagccaatcgtaaaaggattggtgatcgactataaacaaaacatgatgggcggcggctttacactcgataatccaaatgcgattgccaactgcggctgcggcgcatctttccgtacagctgccaatgcaggaacgccggaagattgttaa

SEQ ID NO: 7672 - DNA, 150 bp, Bacillus clausii
acctgagctcatgtaccaagctcggatcgtcggcggcagggaatttaattattttaccgttctagtcgttgctgccttgatttattggggtatttgttcactgttgtctctgttgcaacgctacttagaaaaacggtttaatcgttatat

SEQ ID NO: 7673 - DNA, 204 bp, Bacillus clausii
acgtaacgccggcaaacacggtagcgcggcctattggcaccgtgacaatcgacaataaccgttacggccgttatcaaggcgaagtacaaattacaaaaacagacttgccagctgatgagaaagtaaatgtgctaggccgggtgattgacgccgatgtacctttaatcaagcacataaaaggtgggcaaaattggaaaattaaat

SEQ ID NO: 7674 - DNA, 112 bp, Bacillus clausii
atgggtgatatcgcgaaaaaagctggtgtgagtacggtaaccgtttcaaaagcgctgaatgataaagaaggcgtaagcgaggatatgaaacgaaaaattaagcagatagctg

SEQ ID NO: 7675 - DNA, 1104 bp, Bacillus clausii
acgaaacgacgaaggaattgccgattattggcgcctatgccgataaaaatttagaagataccattgcagtgccaagcaaacctagtaatcatcaagaagaggcagaagacgacaacgtgcctgaaccggaagcgaacaccacttctgatgatggcaacggagtgaaaaagaaaaagcggaaaaaatggctgtggttgagcgcggttgcactagcagtgctcatcggggcaacggtcctcgcttttacgttttggaacgcgcttttcttcgttcctgagcaagaggtgcctgatgttgtcaatatgaccgaagcagaagcggttgaggaaattgaatcccgtaatttacgggtagaaacggaagaaatcgccgatgaaaactacgatgaaggacgcgtcgcccgacaaaatccacaagcgggccgggtcattaaagaaggccagccggtcaaactatttataagcgcctcgaaagatgaagtcaaaattgatgattaccaagggcttaccctttcatcggcaacgaggctccttgagcagaaaggattttctgtagagacacagccacgggaagacaacagcgagccggaaaatacagtattatcccaaagcccatcgccgaacacaatggctgttcctgccgagacgacggtcgtgctcacatacagcgtgcctgaatcgattcaattggatgacttaacgaaccaaacagaagatgatgtacgtgcttattttaacagcgaaggcttgcgtggctcattttcgagggaatacgacgacgacatcgcggaagggcgggtcattagccagtctccagagccgttgtcaacgctagagagaggggacaatgtgagtgtggtgttatcaagagggccagagccgcttcaagaacagcctggctcacctccagcggaagtccccgagcagcctacagatgaagccgaagaccctgttgaagaaacgcctactcaaggcgaagacgatgagggagagccgacgatggtttatcgcgtaacgcaaacgattgtcgtttcagaagaacagcaagcagaagggcaaagttttgacattcgcatcgttggcaaagatgccgattcacaaggcg

SEQ ID NO: 7676 - DNA, 960 bp, Bacillus clausii
atgaccgaagcagaagcggttgaggaaattgaatcccgtaatttacgggtagaaacggaagaaatcgccgatgaaaactacgatgaaggacgcgtcgcccgacaaaatccacaagcgggccgggtcattaaagaaggccagccggtcaaactatttataagcgcctcgaaagatgaagtcaaaattgatgattaccaagggcttaccctttcatcggcaacgaggctccttgagcagaaaggattttctgtagagacacagccacgggaagacaacagcgagccggaaaatacagtattatcccaaagcccatcgccgaacacaatggctgttcctgccgagacgacggtcgtgctcacatacagcgtgcctgaatcgattcaattggatgacttaacgaaccaaacagaagatgatgtacgtgcttattttaacagcgaaggcttgcgtggctcattttcgagggaatacgacgacgacatcgcggaagggcgggtcattagccagtctccagagccgttgtcaacgctagagagaggggacaatgtgagtgtggtgttatcaagagggccagagccgcttcaagaacagcctggctcacctccagcggaagtccccgagcagcctacagatgaagccgaagaccctgttgaagaaacgcctactcaaggcgaagacgatgagggagagccgacgatggtttatcgcgtaacgcaaacgattgtcgtttcagaagaacagcaagcagaagggcaaagttttgacattcgcatcgttggcaaagatgccgattcacaaggcgatgaacgagtgcttgtggaagaaacgattagtgagacgactgattttgaaatcgatttgcgtgtaagtcctagctacacaggctcttacgatgtatatataaatgatgaattcaatcggcagtcgcaaatctatacgtacactgaggaagaggaatag

SEQ ID NO: 7677 - DNA, 561 bp, Bacillus clausii
gtgccaatcttgctcattgctgctgtcgtgctcgtcatcgttcttatttggaacgtgagcggccgtgatagcggcggcgaagttcagaatgagcaagaagccgggcaaacagatacgtatgatccgcctgagaatgctggcgatgaagaggaaggcgaaggagcagctgataaagacgaagctggcgaagacgaagcagctgacgaggaaagcggatcggaagacgagcaaactgacaaagagcctgaactttcattggaagagacatccggcaacgtctccacttatattcttacaaacgtggaggcaattgaaacgctgaaaattgaaatgggagaaggctcctatgtgcaagtccgtgaccgcgatggacaggcaattgaagaaaacggcggagactacaaagatgattttgagccagacgtgagcggccttgacgcccttgagcttaatattggcaacggttatggggttgaaagggtagaagtgaacggcattgaagtcgaactcttggaaaccgatcaccagtatgtgaccattaccgttgaagaacaagaataa

SEQ ID NO: 7678 - DNA, 522 bp, Bacillus clausii
cggagtttacacagatgcagcaaaaaacattgtagatcaattgaacagctatactgaactttctccaagtggtgatggtttgcacatcattgtaaaaggcaagttgccgctgagagggacaggaacaggtaaacgtaaaggcggcattgaggtttatcgtcatggacgttacttcaccttcacagggaatagcgttgggcttcccacagtggaagagcgtacagatgcgttaaaaagcttttggaaggtccatatggaggataaacctaaacaaaaaacaacgccttcatcaactacacaatctaggtccagctttctaaatgaaaatgatttatgggataagatgtttgccagcaaaaatggtagcaaaattaaagacttgttcgatggcttttttccagatggcgatcattctgaagcggatatggctttatgtaattacttagctttttggactaattgtgatgccgctttaatggattcaatgttcaggcaatccggtttaatgcgagagaagtggga

SEQ ID NO: 7679 - DNA, 174 bp, Bacillus clausii
aagcaatatttgccacaggctctacaggaatcggggtttccggcttgtcccttacaccgttaattgcggaaggcaaatacctctattatttaggtggtattgcgctagcctatttgtttggttttctgttcacctacatgttcggttttaaagaagaaatggcgaaagacattt

SEQ ID NO: 7680 - DNA, 420 bp, Bacillus clausii
  misc_feature (1)...(420): n = A,T,C or G
gtgtgtccgtttatctcagccagccatttatagagcaagaagcttatttaaataaagccgctgccgctggatttaatgtgctgtttacttcattgcacatccctgaagacgatgcttctttgtatgcagaacgactcaagcaagttggaatgtttgccaaagcgaatcatatgcggcttatatgcgatgtgtcgcctgactcaatgaaacatgtaaacttgtcatggcaacaagcgagcaacttaaaagagtggggcgttacaggactgcgcatcgattatggtgtcgcgaacgagacggtggtgcgcctatcacaagagatgcaaattgtcttaaatgcaagcaccctcgatcatagggaagcaatcgcattgcgccaagccngcctcgacccaaacaaagtcgaggcatggcacaatt

SEQ ID NO: 7681 - DNA, 759 bp, Bacillus clausii
acaaaggctagatcgcatctatactgattcggttttagaagacggaaacatcgaagaattaatcgaagaccaagcatatacgccttttccaactgtgtactcaactgagcgccctgatacaacagcagcccatttattagaaggcaaaattgcaatactgagtgatggctcgccaatggctcttattgtcccggccctatttgtgcaatttttccacaacgctgaagaccatacacagcgtgctgacatcggaacccttattcgtctgttacgcttcatgtgtatttttattgcgatgttggccccctctttttatattgcgattacaacgtttcaccaagagctgatccccacagggctgcttggcaacttagctgcgcaacaggaaggcacgccgtttccgacttttgttgaaacattaatgatggaagtcacatttgaaattctccgtgaagcagggattcgcatgccgcagccagtcggccaagccgtatcgattgtcggtgctatcgtcattggccaagccgctgtgcaagcagggattgtctctgcagcagttgtcattgttatctcgattacagcgatcgccagttttgtgtttcctacatacagcattggcgtaccaatccgtattttgcgatttggatttatggctcttgctgcttcgtttggccttttaggcattgtattggctttactgcagtgcttttacattgtctactttaaaatcgttggcatcccttatttaaaagggctttc

SEQ ID NO: 7682 - DNA, 186 bp, Bacillus clausii
taacgttaacaaagccaaccgtggaagatggcgcggcaatgtggcaactggcgaaatcgtcttcgctcgatacaaactcgtcctacaagtacattatgatgtgcgaatattttgacgatacatgtattgtggcaaaagacggcgatgaagtagtaggatttattaccgcttttattcctcctaaac

SEQ ID NO: 7683 - DNA, 150 bp, Bacillus clausii
cgccgccgaatgcgattattttcggcacaggcaaggtgaaaattattgaaatggtgcgagctggtttttggctcaatgtcttctcaacgattctcatcgtgctcgctgtctacatgtacttgccaatcgtctttgacatcgatttaagcg

SEQ ID NO: 7684 - DNA, 195 bp, Bacillus clausii
acacatcccttcaaatacagcggagatcgcagctattcggcttaaatccgtttacacagcattggaaacgtgccagactgaaatgctgcatgtagggggacctgcatacttaaaatggagcaactcttcgcggcggttgcgggaagcttattttatggtcaatttaacgccgacagtaagacatttagaaaaatt

SEQ ID NO: 7685 - DNA, 336 bp, Bacillus clausii
cggctcctgcttcactgtctgtctcttgttcaggaccgttttggttttctggttctccacctgtttgcgtttcatcgagttcaaattcttccacttcgccaaattcgtcatcgacggttgcattcgtaaattcaatgacttgcaatacattttcttctgtatcgaccacaattgcttcaatctcatcgcctggctcaataaacaccgcattggcgctagtagtgacgtcaaattcaagcacacggctctccccttctagcaacacttgcaaaaagcggctattaaatgtatcgcttacccggtataccgtaccagagacagtttcttgctcgtata

SEQ ID NO: 7686 - DNA, 240 bp, Bacillus clausii
acgattcattggctacgttgtttaaactgttgcgccaagaaagcattagcactcaaaacaaaggaatgcgcgaatgcgcagcgttaatgcgagcgctaatggaggaagtcggtgcccggactgaactgtttgaaacagagggccatcctattctatacggtgaacttctcacagacaaacacgcgccaactttgttaatttatggacattacgatgtacagcctcctgacccattaagcc

SEQ ID NO: 7687 - DNA, 314 bp, Bacillus clausii
gtaaaagttggaaataacagcgaaaccgcgatcaagtggaacaaccctttgatgaattgcctcttgaagatattgaaaaagaggaagaagagcgcagagagaaaaaacggacgaaagacgattctgaatcagaggatgcgtacaagccataaacagagctgaacagcggaagaccgttatggttgaaggagccgtaatagaaaaaagggctccttttatttcgagcctaagttgtagcgatattttgaatatggtattatgaataattaacgaacgttttttagtttagaaagagagtggggctggagagaacg

SEQ ID NO: 7688 - DNA, 317 bp, Bacillus clausii
atgctatttagcgagctatccccagagtactttggaaatttgcagcgcacgattttaacgctgttccaaattgttacacttgactcatggtcgagcggcttgatgagaccactaatggaatttaatcagtgggtttgggtttattttgtttcctttgtattggttggtacgtttatcattttcaatttatttatcggcgtcatcgtcaataatgttgaaaaagccaacaaagaggaaaccgaaaatgcacattcacgggagctggaaacgatccaacggcaattggatgagttgaaagaaatgcttaaaaaagaacg

SEQ ID NO: 7689 - DNA, 667 bp, Bacillus clausii
gtgaaagaatggtattttgagtaccagctccacgaaaaccgcccggggattctcggggatatttcttctcttcttggcatgctgtccattaatattgtcactattaacggcattgacgacacgagaagaggcatgcttttgcgcacttctgacgatgacagcgtaaaaaggtttaaagccatcttacatacaattggcaacgtaacagttacaaagttccgcgagccccgcgttagagaccgattagcgattcgccatggtcgctatatcgagcgaaatgccacggagaaaaaaacatttaagtttattcgcagagagctagggctattagttgattttatggctgaattaatgaaaaaagaaggccattatttaatcggcattcgcggcatgccgagagtcggcaaaaccgaatcggtagtagcagcaagcgtctgtgcgaacaagcgctggagctttatttcttcgacgcttcttaggcagactgtacggagccagttggctgaagatgaaatggatggggacaacatttttattattgacggcattgtgtcaacgatgagggccactgaaaagcaccgcatgcttgttgacgacatcatgcggcttcctgcagtaaaagtggttgaacaccctgacatttttatccgtgagtcagagtacgaag

SEQ ID NO: 7690 - DNA, 278 bp, Bacillus clausii
atgataaacgtaacaacaacaaaggagtggatcatgatgaaacgaatgaatttagtgcttgcgggaaccgttttgatcagtgggcttgcgttgggtggatacgctttgagcagtgatgccgtattagcgaatgaaaaggaagagaatcagtcaggcatcacttataaagaagctgaggagattgccattcgtgaaacaggaggcggccatattctgcaattggagcgagatcgtgatgatggggaagatcactatgaagtagaaatccacaaagacgg

SEQ ID NO: 7691 - DNA, 129 bp, Bacillus clausii
accgttccacaggaggaagtgggttaggattgacgatttcccaacgaattataaggcaacacgggggagaactagctgccaagaaccacttagatggcggggcgctcataagtggttggctgcctgtag

SEQ ID NO: 7692 - DNA, 276 bp, Bacillus clausii
ccacattcacgtttttttggcaggctatatgttcacgatttccatgatctacattgaccctgtgtcacatcgcaaaccttttttgtacagggcgattgtgctagtcatcgcgctcgccggacacggcattttatcgaaatggatttacgccaatccgcccgtaggtgttgctcctgaacaagcacagacaggggcgatgctcatgtattatggcggggatgcaattgacttgttgcttctatttattttttgttttcaatggtacaaagcaacgcg

SEQ ID NO: 7693 - DNA, 262 bp, Bacillus clausii
ttgagttcaatggataatacgatgcaattcaatttcaatgatgattcctttgacgcagatgtccaagaagtgctcttgtctgtttatgatgcgcttgaagaaaaagggtacaacccgattaaccaaatcgtcggctatctgttgtctggtgatccagcttacattcctaggcataaagatgcccgtacgctaatccgcaaattagaacgagacgagctaattgaaacgcttgtgaagtcgtatttgcgtgcccatggcaagg

SEQ ID NO: 7694 - DNA, 280 bp, Bacillus clausii
atggcccaagaagaaaaagagcgttttgtcattccagacgagaatggcacagaacatctgtttgatgaattgttccgttttacagttgacgaaacagaaaagtcttatatggtactcgttccagtcggggaagaagaggatgaggaagaagaagtcgaagtgtttgcgttccgctatgaagaacagcaaaacgaagacaatgatatttccttttatcccgtcgagacagacgaagaatgggacatgatcgaagagatgcttaatactttctctgaagagg

SEQ ID NO: 7695 - DNA, 969 bp, Bacillus clausii
  misc_feature (1)...(969): n = A,T,C or G
atgcaacaaccgcacacacaaaaaacattttggttcattgtaataggagcagctttctggggcattaaccctcttttccgcctccttctccttgaaacaatgacgtctttgcaaattgtctttatcgaacatattattttggcttttatcgccgttccacttatttggacatacagaagcgacttggctcatttgtcgttagtcgacattggtgccttgcttttcatatcatggggcggttcagctattgctacgctgttattcacacaagggcttacttacgcagcgacacacggaatgggtcaaatcaattcngtgttgctcttgcaaaagctccacccgattttcgcgattgtgcttgcccgttttgntttaaaagaatcatggtcaaaacattttggttatctcgtgccaattgcacttgttggtacttatttgcttacttttggcttttccttgccaattagcgggtttggtgaaatttttcaacttggcagcctgtttgccattggcgcagcagccttatggggcggctccaccgttatggggcgtttgcttttaccaaaatgccgctatgaaacagtgacagcgctccgctttctcttggctttgcccttgctcaacgtccttgttttgacctcgccagatgcatggaacgagccagcttctgctgcagctctcgtctttattagcataaacttactagcttcagcacttttgccaggcttggtctcgatgctactctattaccggggcttgcaggcaattaaagcttctgtagctacgattgccgagcttagtttcccaatggcaggcttgcttgtctcctgggtgacgatggaagaaaccgttacgtttccccaagcgcttggctttgcgctgatctgggttgtcctttatcagatttccaagcaacaggatgccaaagaagtattgccacctttaaaaaagcgggctgcttccgcataa

SEQ ID NO: 7696 - DNA, 312 bp, Bacillus clausii
atgactacacctttatataaaattgcccatgctcgggcaggcgacaaaggcgaacagacaacgatcagcctgtttctgtacgatgaacgattttacgaaagcgtaaggcaacaaataacggcagcggcggtcaagcaacattttcgccgactagcctctggcggtgttgaccgttatgagcttcctcaattggctgcactccattttgtcatccatggcactcgcccaggtggcgtagcggccgcccttgattttgatgcacatggtaaatcgctctcttggtattttcttgaaatgaacgttcagttgtaa

SEQ ID NO: 7697 - DNA, 324 bp, Bacillus clausii
gtgtcgtgatcgtcgatcaagggcaaatcataacggaaggcaccgtcgatgagcttattaaaaatatccaacatgaggaaaaaatcaaaatcgatgtgacagaaccggcgcttgtaccgatcacgcgcttggaacaattggatggtgtgaaacaggtcgttgttaatggtagcaacatcactgttatttcgaaagtcggcgcaggtaatcttgaccgcgtggtttcgattattaaggaacatggcggcttgctcggcatccaagcagaaaaaccaaacttagaagacgtttttctcacccttactggcaagcagctgcgtgatg

SEQ ID NO: 7698 - DNA, 378 bp, Bacillus clausii
aagagctgccagaagggatcaccatgggcgaatttcgtgaaaaagtggcgccgatgggcccatctgttgtattagaagaacattttggcactgtagtagatatggagccgcgggccaaacagcgacttcaagatattgaaacgtattacgccgattttatttgggaagagagttacccaaatgtctttatgaacgaagaagagctagaccggttgcatttcctagaagcggatttaatggatgtcgttgagcgaaattatgcccgttggcttatggaaggcggcgtcgaagaggaatgggaaacctatgtaaaccagctgtatgaaatgggcttagaagaatggctgcaaatccgccaagatgcgtatgaccgctact

SEQ ID NO: 7699 - DNA, 309 bp, Bacillus clausii
tgaacgtagtgaattgcaaaaaatgatgagcgcctatgcaggcattgaacgcgacgcctatcgattgcaaacagtggctaattggctttcttcgtttcaacaaatgccaaagaaaacggttgtgcacgttgacgatctagaaacgggtactatgtatgagcttgctacgcttgttgtaaaagcagctttgttgcgtacggaaacaagaggcacccataggcgcagcgattatccgtcagcagacgaacaatggcggaagcgctgcgatttgtttttctgtacagaataaagcattcgtgaaaacagagg

SEQ ID NO: 7700 - DNA, 474 bp, Bacillus clausii
gctggtttggaatccaatttgtgcactgcttttgtttaatggattgttttcattttaccacgttccagcaatgtttgatatgctcatgcagtcgccagtgttgcatagtttgtatgaatgggtattgcttttcactgcggccctgatgtggtggtttatcttatcaccgttgccaagctcgtacaagctccccgatttgcggaggattttttacatatttgcaaacggcttattgattactcctgcttgtgcattgatcatttttgctccatccgctatgtatgccacatacacagaccctcttgtgtgggcaaatgtaatggcttattgtttgcctggcggggccgggccagaactgatgttgtcggcatttggaacccctgagtccctttctatttttgaagcgcgaattgatcagcagcttgctggtgtgttaatgaaaattttccaagagatcgtttacggaatcgcaat

SEQ ID NO: 7701 - DNA, 135 bp, Bacillus clausii
tacaaagcaccgcgttgtagaacaaacggaagtcgtcattatcccagaagtgtatccgacccatacgacttatgtcaataaccaagtcgtacgccgcgagtacagttttccgcaaaccgagtcagtcgaagagcg

SEQ ID NO: 7702 - DNA, 237 bp, Bacillus clausii
atggaagaaggtgaaacgatagtcgaagctttaagaagagaggtattagaagaggcgggagcttatataagttcggaaactttaatagggtatgaaaagattacgttattaggtagtagacaagatggttacccttatccttacccatcaagttatcagttatttttcgcagcaatagcggagcagtttgttaagataaatgacccaacaggacaagcgaaagaaagatacttctta

SEQ ID NO: 7703 - DNA, 452 bp, Bacillus clausii
  misc_feature (1)...(452): n = A,T,C or G
atgcancaaggctatcaggntacatcgacgagacaaattgccgatactttagggattactcagcccaacttatactactatttcaagaaaaaagaagaaatttattaccatgtcatgctccgcttggccacagaggtatctgcaaatttagaacgtatgtcttcaaataatgaacagtcttttgaagagaaaatacgaaatatggtttattatttgcagcaacgccatccctttaatttgtttatgatgttgcatgatatccaacatacgttatcgccagacattgcagacaaattatttgtcctttggaccacgtcctataaaaanccgtttattgagctgctaaaaggcagtaaattgcatctaagaagcacaattgatccagaatttgcggtaagtcaattgtttatctcgatttcttcttactttcatgccccgcagaaagaggggca

SEQ ID NO: 7704 - DNA, 537 bp, Bacillus clausii
  misc_feature (1)...(537): n = A,T,C or G
atctgatgatgaaatcagacatgtgttgttgcatgagttgcaccattataaaagcaaacatattaaagtgaactatatatttgtcgtttaccaaattgtttattggttccatcctttagtatggaaagcctttaaagagatgcgccttgatcgggaattagcttgtgatacggaggtcttgcttacattgggccagcgggagtataaaacgtatggccagacaatcatgcgttttctagaaagaaattctcgatttttacatttgacgaaccagctgcatagttcgaaaaaggctttaaaaatacggatcttgaatattgcttcttttactggcgagtcaaagcggcgccaattaaaaagcatggttgtttttgctgttctcaccgtttttgtcattgctcaatttccttttttaacggcaaccgctgtttctacagagcgctaccaatttgatgatagccaggcgattgttgaagattacagcactcattttgcaggaaatganggtagttttgtattatataagcttaaacagcg

SEQ ID NO: 7705 - DNA, 1200 bp, Bacillus clausii
atgatgaaacgatattggtatagcatgacattgattgtgtttagtattgtcgtctttagttggttggctattagttacacacttaagcagcaagatataaaggaaatcgctgatggcattgaacttaaaacggtatctggctcagaggacgtcattgatggttttggcgtacaagggcaaggggacaacacccataatgttcctttatatggcaaggcaaataagccgtcttttcttgaatcccttgatgcgaccccaaatcctgcgatcaatgagttgcaaaaacagttccgctccttttttagaggaaaagatacatggaactctctatatgtagatcaagactttattgtccatattgatgttccctaccagtctcatccgatcgaaaaaccatcgtcattgcaaattagctggctcgatcgttcggaagggcaatctttggactttcagctagaaaccacgccgactaagcaagttgacttgcttgacatccagattcgcgattcgcttttgcatatgacattgctcgaatccgttggcagcagtgaagtggtttccctttacaaaattgatcctcaaagcaaacaaattgaagaacgccaggaactggcccattttagtagctctgaagattacgtaagcaccataagcaaagccgatatttacttagactcatacccttctagcttttattcgccgaacggctatttaacttgggcaattgaacacgtatcgcctgaaggaaatacggaaatcgttcaagtttattcgtacaactatgacagcgaggaacttgatgtcttatctaaaagcaatgataaaagcgaggaagatcaacgagctttggctatagatgacatgattggctatgaacgttttcaagtagggaacgaactaatgattttacagtacgatggaagctacttatcgtatcaacttattaatttagaagaacttgatggaacgcttcctgaagcaaccaccattgagatcgatggagaagtagctggtgttgcctgtaaagacggggtgttgtatgtgtttgccgtagatttacaacaccaagacacacttgcattcattaaagccattctcttaagctccagcgaaaccgtgtacgaagggcaatttgttaataagggcgatacctcggtcttatttaactggctagatgtctattacgaaggtccgctataa

SEQ ID NO: 7706 - DNA, 219 bp, Bacillus clausii
atggttttaattgagcggtcttttcgcttaatcgggattgcctttgcgctttcttatggtggggtcatcctatgtgcggcgaccgtccctctcggaatgctgtcagggcgaatttatgattcagagcttttctttgtggcgattgcgttagtcactctgttaatcgccattaatcttctgctgtccagacggctaattgccaaatatgtgacggtgtag

SEQ ID NO: 7707 - DNA, 429 bp, Bacillus clausii
agttcgtcgtgagtggtatgagtggtgtgaacaacttagcgaaaaagagctgcttgctgagcggacaggaggggtgggcagcattttaagaacgttgctccatattgtcgatgtggaatggagttggattcgcgacttgcaaggaaagcccaacccagaggaagactttgattcctttaaaagtttggcgaaagtgcgcgcgcttgaccaagcataccatgtggaagtaaaggcgtttgtagaccgctgggatgagaaaatggaagagaaccgttatgttgaaaagggaggaaatggcaaggtgtgcgatgacacatggggcatcgtcatgcgccatatcattgcccacgaaatccatcatattggccaattgtctgtttgggcgagagagattggcaaggaaccagtttcagcgaatgtcattggccg

SEQ ID NO: 7708 - DNA, 624 bp, Bacillus clausii
atgagtgatatggcaattgtctttgtccaaaaaaagaagtacaaagagtttctcccttttttagactttattgaaagtaaaattgcttcccttcagaatatcaatgatagcaatcaggaagctacgctaattgaatctttagcacaagagttattaatggaaactaaaaaatcattagaatacaaaacagatcaaggaaaattaattatcaaaaaaaatacaatatcacttactcataatcgtttgtacgtaggaaacaaaggtacgaaagagatagcaataacttctatttcaagcatccacttgtcaaagccaggaattaaagccggccgtatccgtttttttatagaaggaagcttgcaggaaactaaataccaagcttatctcgcttctgagaatgaacttttaatcactaccccaaatgattaccgcacgatgtatgaagcgaaggaagtaattgagagcttacgtttacatcactctgaaaagttatatcaggctctatctaaacatacaatgaccgcctctcccgccgacgaaatccgcaagtacaaatcattgcttgatgacggtattatttctgaagaggaatttgagaaaaagaagaaggaattgctcgattaa

SEQ ID NO: 7709 - DNA, 299 bp, Bacillus clausii
atgactaaagatatcgtcaaaaaagcaaagaacggaacttattattttagggcaaatttaggatatcaccccatcactggcaagcaaattcagaagtaccgcagtggttttaaaactaaaaaagaagcaagggaagaatattcaaggttactacttacaaaaccagatgcactagaagaaaagcaagatgacgttttattccaacattttattgaagatattttcttaccttggtataaaacacaagtaaaaagaagaacgtacgataatcgattaccgactgtaaaaaaacatttcac

SEQ ID NO: 7710 - DNA, 170 bp, Bacillus clausii
atggttaccgtcactaaaaaagacttgatagcgctaggttatggtccctctttttcagctgatattattagagagtgtaaaaaattaatgatatcaaaagggcacacgtattatcaatctaaaaagttagatcgtgttcctaaagaagctgtagaggaagtattagggat

SEQ ID NO: 7711 - DNA, 486 bp, Bacillus clausii
  misc_feature (1)...(486): n = A,T,C or G
tggcgctgctggtgctggtcacattggcaactatagccactgctccttttcggcggagggaatggggcgttttcgtccacaagcaggaaccaacccttatattggcacggtagggaaagaagaagaagtaggcgaagtacgcattgaaacaattgtgcctgccaatatgagcggcaaagtcattgcagcgttggttaaggcgcatccgtatgaggagcctgcctacgacttgtatccacttgatcaaccgcaatggcaacgaggactcggtcgtatcgggaaagttgagggcgaccatacgctagcctcatatgttgaatttgttaaacaggcgctaggtgtaaaaacagttcgtgttgtcggtgagttggatacgaaaatcagaaaagcagctgtgctcggaggcgatggcaataagtatgtgatgcnagccaaacgagctggggcagatgtgcttatcactggagatttgtattaccatgttgc

SEQ ID NO: 7712 - DNA, 168 bp, Bacillus clausii
tcctggctatgaatttatcgcaaagcatacaccgaaacatacaggcggagcaggccatggttctttgcataagcttgactcaaccatgccgttcatcattgctggcaccaccattgaacccgactataggcggcttgtagacttcaaacagtgggtcgaggcattaac

SEQ ID NO: 7713 - DNA, 221 bp, Bacillus clausii
ttgaagggagcagacttcggaccaaaacctttgcttacgaaaagggaacgcgaagtattcgaactactcgtccaagaccaaacaacaaaagaaattgctaatcacctttttattagtgaaaagaccgtacgcaaccatatttcgaacacaatgcagaagctgggagtaaaggggcgctctcaagccgttatcgaactaatacgtctaggtgaattgaccat

SEQ ID NO: 7714 - DNA, 948 bp, Bacillus clausii
agctgttaacaaaacggggatcctttggcgaggccgttagagccttgatgaagcaatggccgatataaaacagacgcttgcatcttatgatgaagcgactgaaaatggcagctatctacaggcgcgaaaacagcttttaatgatgaaggatcgtttgcatgacttaagggcaaaaatggatgagctcccgcagttgctcatccaagttaaatcaaccgttccagctgatgtacgcaacttggagatgggcatcgcccaaatggaggaaagcggcttccatttaaaaacattcgcctttgacgggcgcctcacacaatttaaaaaagacattgaaaaggcgtacgaacagcttctcagccttcacgtcaaagaagcaagcgaattgttgcaaacgatcaacgacgagaaggagcaaatgtacgaaacgcttgaagcagaagtggcaattaaaaataagctaatggagaaaattccaacactaaaggaacaagtgcaggcagcaacagaacaattgcaaacgttactgcgtgaaacgactcatgtacaaaaaagctatttaattgctgaagaagaaacccatttgcaaaatgctttgcaaaaagacctcgccaacttgcggaaccaattgcatgtcattgtcgatgtaaccgaaaaccaaaaacaaacgtactcttccatttacgaaatggctgagaagtggtcaaatgagatggacacattcaaagccaatattgataacagcatagaacggctccgtcgcctccgaaaaggcgagttaaaagcacaagaaaccgtctcacggcttcgtagtgtcatgtacgaaacgaaacggacgttgaaaaaaagcaacttgccaggggtgccagtaaagcagctggaagcattggactttgccgaaacgaaagtaaagcaagcttccgatgcgctaaatgaaatcccccttgaaat

SEQ ID NO: 7715 - DNA, 199 bp, Bacillus clausii
atgaaacctaaaaagacaagccagttcattgctctcggagctgttgccgccttaacgattgtcttcattgtgactcaaacttcgctactatcagtcataacaagcagcccttggtggatgtatggtttgattatcggcattttgtttagcggatatatgtgggtaaaaacaatgaaggaagaaaacgaggctgatcagg

SEQ ID NO: 7716 - DNA, 315 bp, Bacillus clausii
tcttggttattgttattcttggcatacaccatgatttaactggcggcacgtttgcagaagaaaaagggactcctcctgcccctttagccgttcaggtggaagagggtcaaggagaggatgagccatcactaccctatcaagaagtgattattgaaccagggcaaactgtcctctctgtcgttgaacatttgcatggccgccaagttgaccgtccaatcgaatcaatcatcgcagacttccgcgaattaaacgagcaaatggagccaaacgcgcttcaagtcggcgggcgttaccgatttcctttgtatgatgatg

SEQ ID NO: 7717 - DNA, 105 bp, Bacillus clausii
gagcgcgcgtaatacgactcactatagggcgaattgggtaccgggccccccctcgaggtcgacggtatcgataagcttgatatcgaattcctgcagcccggggga

SEQ ID NO: 7718 - DNA, 213 bp, Bacillus clausii
cagacttcggaccaaaacctttgcttacgaaaagggaacgcgaagtattcgaactactcgtccaagaccaaacaacaaaagaaattgctaatcacctttttattagtgaaaagaccgtacgcaaccatatttcgaacacaatgcagaagctgggagtaaaggggcgctctcaagccgttatcgaactaatacgtctaggtgaattgaccattt

SEQ ID NO: 7719 - DNA, 78 bp, Bacillus clausii
ataatgaagcgacgaaagcattatacaactctcttggcttttacgatgttgtatcgaagcggtacagctttcgcttct

SEQ ID NO: 7720 - DNA, 397 bp, Bacillus clausii
atgcgtgattcctttacgccgatcgaatttcaagaactttcaatcaatctgtccaaagcggccctccatcaatttattaaacgcatgatgggccagcactatgcacttttttggcgctatgacgccaaaacgatttatttgacagtagagcttggggaattgacacacgaacttcccttcatccgcaatgacgaattcttaacaatgcaagcaaaagtgttgtatgtgtatgatgatgtgctttcagacgctctggaaaacctgttgcaatcagaaaaaggaaatgggattgtcaaacgaaccagcaaaggaccactctatattacgtcttataatggcggggatgttgaatccatgattgaaattgacgggagtgagaaaatcatgatgaataaaa

SEQ ID NO: 7721 - DNA, 462 bp, Bacillus clausii
actcgattgccgatcaagcactaaaacgggaaattcgtgacgaagtaaatgccgctatcggggaatggatcggggaaatggcaacgatggaggaagctgtcgctgaaattgctttacgtgttcctgagcttgaagcgatcgtagcagagcagctagcagcaaaaggcatcgaccaagactattccgttgcgtttgataaagaggttgcctttccaacgaagctgtacggaaacatggtataccctgctggactgtaccatgccgtccttattacgttagggaaaggccaaggcgaaaattggtggtgtgtgctgtttccgccattatgctttttagacatggataacggcgaagcgaccaatacagcagcagaaggtagcaatagcgaacaagacagcggcaccgaggaaactgccgaagtggaaacatcatttttctttgtagaatggtttgaatcgattt

SEQ ID NO: 7722 - DNA, 282 bp, Bacillus clausii
acaatgcgaaagcagcctttgtcatctccgagtcgattacggagatctcagaagcgattttacgtgaaatgggccgaggcgcaacgacgttacaagggaaaggcacatttactggcgacgaaaaagaaattttatattgcgtcgtcgcccgcaatgaaacggtgaggttgcgcaatattgtgcatcgcattgacccccatgcgttcatgaccatccacgatgtttccgaagccgccggtgaagggtttacactcgatgacaacaagcaaccgattcgaattg

SEQ ID NO: 7723 - DNA, 177 bp, Bacillus clausii
caaacaaagccatcgtgctggcagtgctagcgcgatgctcggcatgttgcccttattccttggagcgatggttgcgccgcttgtaggtattgatgaatcaacagcagtgccgatggccgcgattatgtttgccacaagcgtattggcccttagtacatgccttggtttgacgagaaa

SEQ ID NO: 7724 - DNA, 251 bp, Bacillus clausii
ctttcgttgcgcggacaaatgaacagcgactctatatttttgttaaagatgaaggacaaggcattccaagtggcgtgcaacgccagcttctttgacccgttttttcaagtagaacaggcaagaagccaaacaaacgacaaaggggtaggcttagggctgtctatttgccgggagctgatcaatcaacatggaggcacaattgatgtctattcgtcgccaccacacggaagtacgtttttcttttccattcc

SEQ ID NO: 7725 - DNA, 222 bp, Bacillus clausii
atgtatacggattgcaataaatctctaaccgttctaagaacgctaaagcgaaatggaaaaagagcaaggtttcccctgctcttattgggaagcgtcaagcaaatactctgctacggcttcaatttcattctcttgcaattggcctccgaaggccggcatgccgccgtcaagcccattggtgacaatttcaacaatttcctcatgagacaaacgtccctctaa

SEQ ID NO: 7726 - DNA, 837 bp, Bacillus clausii
ctatctacaggcgcgaaaacagcttttaatgatgaaggatcgtttgcatgacttaagggcaaaaatggatgagctcccgcagttgctcatccaagttaaatcaaccgttccagctgatgtacgcaacttggagatgggcatcgcccaaatggaggaaagcggcttccatttaaaaacattcgcctttgacgggcgcctcacacaatttaaaaaagacattgaaaaggcgtacgaacagcttctcagccttcacgtcaaagaagcaagcgaattgttgcaaacgatcaacgacgagaaggagcaaatgtacgaaacgcttgaagcagaagtggcaattaaaaataagctaatggagaaaattccaacactaaaggaacaagtgcaggcagcaacagaacaattgcaaacgttactgcgtgaaacgactcatgtacaaaaaagctatttaattgctgaagaagaaacccatttgcaaaatgctttgcaaaaagacctcgccaacttgcggaaccaattgcatgtcattgtcgatgtaaccgaaaaccaaaaacaaacgtactcttccatttacgaaatggctgagaagtggtcaaatgagatggacacattcaaagccaatattgataacagcatagaacggctccgtcgcctccgaaaaggcgagttaaaagcacaagaaaccgtctcacggcttcgtagtgtcatgtacgaaacgaaacggacgttgaaaaaaagcaacttgccaggggtgccagtaaagcagctggaagcattggactttgccgaaacgaaagtaaagcaagcttccgatgcgctaaatgaaatcccccttgaaat

SEQ ID NO: 7727 - DNA, 118 bp, Bacillus clausii
atgttggataataaacaagcgatgattgctcgtttaacaggtgttgattcatccaaaaaaacatactacacagaattaaagaaaacagttgaacagctgaaaaaaaaaacattcaatt

SEQ ID NO: 7728 - DNA, 367 bp, Bacillus clausii
atgctttcagcacttatcccgtccatacgtagctacccagcgatgctcctggcggaacaactggtacaccagcggtatgtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtggactcttgggggagataagcctgttatccccagggtagcttttatccgttgagcgacggcccttccatacggcaccgccggatcact

SEQ ID NO: 7729 - DNA, 435 bp, Bacillus clausii
acgggtcgaggttagaatgccagcaccatcagggtagtatcccaccgacgcctccaccgaagctagcgctccggtttccaaggctcctacctatcctgtacagatgataccaacactcactatcaagctacagtaaagctccatggggtctttccgtcctgtcgcgggtaacctgcatcttcacaggtactataatttcaccgggtctctcgttgagacagtatccaagtcgttgcaccattcgtgcgggtcggaacttacccgacaaggaatttcgctaccttaggaccgttatagttacggccgccgtttactggggcttcaattcagagcttctcccgtgagggatgacccttcctcttaaccttccagcaccgggcaggtgtcagcccctatacttcgccttacggcttcgcagagacctgtgtttttgct

SEQ ID NO: 7730 - DNA, 225 bp, Bacillus clausii
gtggtacaggaatatcaacctgttgtccatcgcctacgcctttcggcctcggcttaggtcccgactaaccctgagcggacgagccttcctcaggaaaccttgggctttcgacggataggattctcacctatcttttcgctactcataccggcattctcacttccaagcactccaccagtcctcacgatctggcttcgctgtccttggaacgctcccctacccaat

SEQ ID NO: 7731 - DNA, 123 bp, Bacillus clausii
aggcgccctattcagactcgctttcgctgcggctccgcttcatcagcttaaccttgcacgataccgtaactcgccggttcattctacaaaaggcacgccatcacccgttaacgggctctgact

SEQ ID NO: 7732 - DNA, 456 bp, Bacillus clausii
atggtcctcccggattccgacggggtttcacgtgtcccgccgtactcaggatccactctggaggaaacgaagtttcagctacagggctgttaccttcttcggcctgcctttccagacagttcacctactccgtttcttgatcactccgttgttgagtgtcctacaaccccaagaggcaagcctcttggtttgggctgtttccgtttcgctcgccgctactcaggaaatcgcatttgctttctcttcctccgggtacttagatgtttcagttccccgggtctgcctctcgacatcctatgtgttcagatgccagtaccatcccattacggatggtgggttcccccattcggaaatctccggatcgaagcttacttacagctccccgaagcctatcgcggttcgtcgcgtccttcatcggctcctagtgccaaggcattcaccgtgcgccctttctaa

SEQ ID NO: 7733 - DNA, 179 bp, Bacillus clausii
atggatggtacaaagggcagcgaaaccgcgaggtgaagccaatcccataaagccattctcagttcggattgcaggctgcaactcgcctgcatgaagccggaattgctagtaatcgcggatcagcatgccgcggtgaatacgttcccgggtcttgtacacaccgcccgtcacaccacgag

SEQ ID NO: 7734 - DNA, 327 bp, Bacillus clausii
tttacgacccgaaggccttcctcactcacgcggcgttgctccgtcagactttcgtccattgcggaagattccctactgctgcctcccgtaggagtctgggccgtgtctcagtcccagtgtggccgatcaccctctcaggtcggctacgcatcgttgccttggtaagccgttaccttaccaactagctaatgcgccgcgggcccatcccttagtgatagccgaagccatctttcaccctctctccaggtggagaaagggattatccggtattagctccggtttcccggagttatcccagtctaaggggcaggttgcccacgtgttact

SEQ ID NO: 7735 - DNA, 411 bp, Bacillus clausii
atggtgctgtgctcagcgaatattcgctttgttgccaacgtgggtcaaacagccatacgtggtgtactgctaagtttgctgctatgttgcacacttttgctgctattttttagtgagcaagcgattgtactttgtgtcgttctttcgatttgcggcggatgtacaggggtcgccttgcctcttgcaagcaacgccttgggggggaagacagcaggggctgttcgtgaacatctaattgcatgtctgtcgatggcaaggtttttaagcattgcggcagcgcctcttttttatcaaatgtggataggcaatggcatggttgcaattggcagcctagttgtcgttttggcggctttctttataataggagtatgccgtcacagggaaaaaaaccaacatatcacacaaatttaa

SEQ ID NO: 7736 - DNA, 168 bp, Bacillus clausii
gttaattgaagaaaacaaccgtttgcgccagcgactcacaccagacaacttaaaattgtacgaagatatgatgctttatattcgcacagacttgcggcttgcagagtatgaaagtgaacagattttgatggaaatgttgcatcatattgtagacagccaaaaggatgg

SEQ ID NO: 7737 - DNA, 855 bp, Bacillus clausii
tcgccgagacaggcaatccagcacgcgggctgaaaaatggctaaattataccaggatttttattggctcagccatagtcggtatttcatttaatttgtttttattgccaaaccaaattgcccctggtggcgtcagcggcattagcacaatcgccaactatgtttttgggtttgagcccgcctttacgctatgggccttaaacattccgatctttcttttaggtgtgctgttgttgggaggctttcgttacggggcaaaaacgctcattggcacgctatttgtcccccttgttgtttttttaacaagagattgggttgtcgaagtaagcgaccctcttctcggtgctttgttcggaggcttgggcgtcggtctgggcctgggcctcgtttttttgggcaatgcgagcacgggtgggaccgatctgctggcacagattgtgcaaaaatttacagggctttcagctggcatatgtgttggcatgattgacggcctcgttgtcatcacgtcggcgtttgtctttcatatcgaaatggccttgtatgcattaatttcgctgttcgtaacgacaaaaacaattgatctcgtgcaaatggggataggctattcaaaagttgcctatattatttcttctcaagaggaaacggtacagaaggcactgtttgactcagtcgaccgcggtgtgactaggcttgtcggttatggcggttatacgaacaaagaacgggcggttcttatgtgcgttgtcaaccaaaatgaggtcgcgcgattaaagcaaactgtaaagagagcggatccccacgcttttattgtgctgacaaatgcttcagaagtgctaggggaagggtttaaaaaaag

SEQ ID NO: 7738 - DNA, 696 bp, Bacillus clausii
tggcccgcgaagctataaaagaagggatttctgaaatcattgccaccccccatcaccaacatccgtcttttcaaaatgatggttcttccgtccgcaaagcagtagatgccttaaacaatgatttagaggctgccggcatagagctaatcattcgaccagggcaagaactccgcctttatggcgaaatgactcagggattggctagcgggagtggccttgcactggccgacagcaaatatgtactgattgaattcccgagttcagaagtgccggcttatgcagcaaggctgctttatgaaatcggtagtgaagggtatattcctgttattgcccatccagaacggaataaagtattcaaggaagatccagataagctctatgaactggtgaaaaatggcgctcttacccagcttacgtcttccagtgtgacaggctactttggcaaagatattgctacctttagcagagagcttgtcgaagccaaccttgtccacgtgctagcttcagatgcccacaatttagtgaaccgcacattccggatgcaggaagcgttccacgtattggaggaacactatggccaagaccttgtttacagctatcaagaaaatgcccggcttattgcggaagacaagcatgtgtaccttgagccgccagaacgagtcgtcaaaaaacgaaaaaaatggctaggtttgtttt

SEQ ID NO: 7739 - DNA, 282 bp, Bacillus clausii
atggccacgatgctagcgggcattcaacttataccaaatggcaaagaagaccacacaggaggcattgccaataaagtgattgacgtcattgaacagtctggtttgcggcaccgggttggcccgcttgaaacggtagttgaaggagagttcgattccttaatggcattgttgcgtgatgtccaccaacaagccattcaagcaggagctgaagaagttctaaccaacgtcaaaatgcattaccgtacaagcggcgtctccctcgaggataaacaagaaacttaa

SEQ ID NO: 7740 - DNA, 501 bp, Bacillus clausii
atggccgtaataacttacgatatgccggcgattggattaagtctgttgtatatcgcagaaggggctacatcagttgctttagggatatggatagcgaaccgaaaatttatgtttgcaaaaatccatacgtatggatggatttacatattaatgggagctacatgggcattgtttggttttacacaaactatctatcaagggatatttgtgatcttcctttttgccgctgttggcggatttgtcgttccttttgaacgaatggtgatgcagacacatgtagaggcaaatgcgagagggcgaatttttggattatggaacacatgcagcatgctttccatcaatattggcgctcttataactggaattgtgattgactacgttggcctcgcctatgtaccgttcatcgtcgctatattcgaaatcattttagggattgtcttctttattcaatttagaggaagaagtacagatgaggccaagaaattaggggaggtagggtag

SEQ ID NO: 7741 - DNA, 461 bp, Bacillus clausii
gggaaaatgcaagccgctctgacgtggcttattatatgaatgccaataacttcaaacaaggaacctcttcctatctgcaatttctaaatttgtcttccagtgctggactaagcgccgaagcaattaacagccaactcctttcagataagggaatcttacaaggtcaaggccaggcatttattaatgcaagcaagctttacggcgtgaatgaaatctacttaatttcccacgcactgctagaaacgggtaatggcaaatcccaactagctactggcgtgcaagtcaatggcaaaacggtctacaacatgtacggcattggcgcttatgatggaaacgcggtcagcgcaggcgcccaatatgcatacaaccaaggctggtttacaccagaagacgccatcattggcggtgctcggtttgtttctaacaactactttgcccgcggccaaaatacgctttacaaa

SEQ ID NO: 7742 - DNA, 327 bp, Bacillus clausii
gctttacgacccgaaggccttcctcactcacgcggcgttgctccgtcagactttcgtccattgcggaagattccctactgctgcctcccgtaggagtctgggccgtgtctcagtcccagtgtggccgatcaccctctcaggtcggctacgcatcgttgccttggtaagccgttaccttaccaactagctaatgcgccgcgggcccatcccctagtgatagccgaagccatctttcaccctctctccaggtggagaaagggattatccggtattagctccggtttcccggagttatcccagtctaaggggcaggttgcccacgtgtta

SEQ ID NO: 7743 - DNA, 181 bp, Bacillus clausii
atggatggtacaaagggcagcgaaaccgcgaggtgaagccaatcccataaagccattctcagttcggattgcaggctgcaactcgcctgcatgaagccggaattgctagtaatcgcggatcagcatgccgcggtgaatacgttcccgggtcttgtacacaccgcccgtcacaccacgagag

SEQ ID NO: 7744 - DNA, 456 bp, Bacillus clausii
atggtcctcccggattccgacggggtttcacgtgtcccgccgtactcaggatccactctggaggaaacgaagtttcagctacagggctgttaccttcttcggcctgcctttccagacagttcacctactccgtttcttgatcactccgtagttgagtgtcctacaaccccaagaggcaagcctcttggtttgggctgtttccgtttcgctcgccgctactcaggaaatcgcatttgctttctcttcctccgggtacttagatgtttcagttccccgggtctgcctctcgacatcctatgtgttcagatgccagtaccatcccattacggatggtgggttcccccattcggaaatctccggatcgaagcttacttacagctccccgaagcctatcgcggttcgtcgcgtccttcatcggctcctagtgccaaggcattcaccgtgcgccctttctaa

SEQ ID NO: 7745 - DNA, 123 bp, Bacillus clausii; identical to SEQ ID NO: 6990

SEQ ID NO: 7746 - DNA, 223 bp, Bacillus clausii; identical to SEQ ID NO: 6991

SEQ ID NO: 7747 - DNA, 435 bp, Bacillus clausii; identical to SEQ ID NO: 6992

SEQ ID NO: 7748 - DNA, 365 bp, Bacillus clausii
atgctttcagcacttatcccgtccatacgtagctacccagcgatgctcctggcggaacaactggtacaccagcggtatgtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagcagacatcgaggtgccaaacctccccgtcgatgtggactcttgggggagataagcctgttatccccagggtagcttttatccgttgagcgacggcccttccatacggcaccgccggatca

SEQ ID NO: 7749 - DNA, 327 bp, Bacillus clausii
gctttacgaccggaaggccttcctcactcacgcggcgttgctccgtcagactttcgtccattgcggaagattccctactgctgcctcccgtaggagtctgggccgtgtctcagtcccagtgtggccgatcaccctctcaggtcggctacgcatcgttgccttggtaagccgttaccttaccaactagctaatgcgccgcgggcccatcccttagtgatagccgaagccatctttcaccctctctccaggtggagaaagggtttatccggtattagctccggtttcccggagttatcccagtctaaggggcaggttgcccacgtgtta

SEQ ID NO: 7750 - DNA, 276 bp, Bacillus clausii
aatcgtcgcccttgccaaaccgaagccttttatttttattgacgaattgctcgctaatctcgatacggcaaagaaagaggcgatggttgctgtgttaacggattttcttgtggaagaagagcggatgatcatcatggcgacccatgcgtatgaagatgtggaaatgcttgcagatggggttatttttttacgcgaggaaggtgcggatatcattaccgatttagaggaatggcgcttaacgaaagggcagtcccttaaggatttgtttgcagaggt

SEQ ID NO: 7751 - DNA, 204 bp, Bacillus clausii
tgcttgtgcatttcaaagaccgcacgacggtaagagcgacactggaaagacaggatgtttactacggagaaaaagataaacttgttttcattcctgtgattttacaaggtgagagccatgtcattaaactgtcttctgaagagcggcttaccgaattcgatgcactcttgtttgcctcacttgtggccatttatgatcttttgt

SEQ ID NO: 7752 - DNA, 321 bp, Bacillus clausii
ggacgtcggcgaagtcagcgtccttgatatcattattacgatcatggtcgcagagctagctgtcattttaattgaagatacaaaaatgcccctcattcgcggccttacaccgattgcgctgctcatattgttatcccgtgttttctcctatgtacaagtcaaaaatcagcgtttccgcgacgtcgttgatggcaaaccggtactgttaatacgagatggcgtttttattgaggaaaatttgttgaaacaaaactacaatatcgatgacattatgatgcagttgcgtgataaagacattgccgacattcaagaagtggattg

SEQ ID NO: 7753 - DNA, 119 bp, Bacillus clausii
cgaaaagcctattggcgaatcgcgaaaagtccgatcttacacaaaaccctcgactctgcatattggaagagtcaagggctcaagagcttaatggaacgttatgatacgcttcgtcaaac

SEQ ID NO: 7754 - DNA, 462 bp, Bacillus clausii
atgagcgaaatagtaaggaactcaattaaaacattaatcaaggaaacatttgaagggccggaagcaaatggaagttggttcacagaggctgaaccgaattcgggaattttcggtgtactggaagggatatcgagcgaccaagcttcccaatccgtttatggaacaacattggctgcacacacagatcacattcgctattatatatggggaaccaacgaaatctttaaaaaaggaaaacaaccagaaatggattggggcaagagttggaccattcattcagtagatgaacagcagtggagccacattcaagcaggtttgcaaaatgaatacgtgacacttttgcaattggtggacgatgccgaatggaatgaacgaaaggccaatgaactggtagcttccctcgctcattccgcctatcatctaggagcaattcggcaaatgttaaaagtagttaatgggtag

SEQ ID NO: 7755 - DNA, 672 bp, Bacillus clausii
atggttatgagattgaaaagggatttatgggaaacaaggagaagtcatatgtctggtataaataaaaatgtatacgagcatgaattgcttggcggacgtttgtgtttggattttgccaatacagtaagttggcacgatagcagtgagaaatcgcaggagttgctgacgagttatgacagattagtgaactggagtttgcatgctaatattcttaacgaacggcaagcgctttcgttgctgaaaaaagcagaaaatcaaccttctaaggcgaaagaagttctccaacaagcgattgagctgcgagaatcgatttaccacatttttagtcttgtatcgaacaatgaaatgccaggtgctcacgatctttctattttgaatgaggctttaggcaatgcttacggaagaatgcaaatagtacctagtgggactacattttcattggaatttttaaacggcgaagacacattagattgtatgcttccgccgattgttaagtctgctatagacgttctgatttctgaaaaagaacggagcagggtgaaaaagtgtgaaggcgatccatgtggttggctgtttttagatacaagccgcaatcgcagcagacgttggtgttccatggcagactgcgggaatcgtgccaaagcaaagcgattttatcataatagaaaatga

SEQ ID NO: 7756 - DNA, 294 bp, Bacillus clausii
atagcgaaatcggcaaaaaagtcgcccagttgtaccgttgtattgtgaaacgccatgtccaacaagcggccatcttaatagaagagcttgatgtgtgcttcaaagaactgctccacgacgacaaaatggttgcttattacaatctcgtttgttttcgctatcaaatgatgcttgaacagttgcaagaaccctataagctagaggcacttgtcgatcatttgcagtcggattttttgttgaattattactattatttcttcagtggccaatatgccttctacaaagtacgaaaca

SEQ ID NO: 7757 - DNA, 359 bp, Bacillus clausii
  misc_feature (1)...(359): n = A,T,C or G
acttggtacanacgacaatttcagcggccacatttggagcagcaaacagtttgcttatcccgattggcatacctttcgtaatggggctgcctgaacttgtgtttccgatgcttgtcggtgcaggttttgctttaatcattgatgcccttattttatacaaagtgtttgattccaaactgtttggcgccaatgaagcatggccgtctggcgttgcgacggcagaagcactccgtgcaggagacgaaggcggaaagaaggcaaaattccttggcatcggcattgntggcgggctggccggttnggngttaggcattcctatgtcagcgttagggtgtttgcttttattggcaacatttggg

SEQ ID NO: 7758 - DNA, 561 bp, Bacillus clausii
agatgccaaaaatcggctgtgaatatggcgccgattattcgactttttctggttttaagttgcttgggccagaagggattggcgttattgttggaaaagcagcagcaattgaacgcctccatgcccgcaattattcaggggggggccaagtacaaggccatgaagctcatgagcttttacggagcttgacgctagcgccagtcatgttggcgacgcaaaatgaacaagtcgaagaactttatcaacgtattaaaaatggtgctttgcctggagttgaagatgtttacatggtcaatgcccagtctaaaaacgtaatgattgagcttgctgaaccgattgcaagccaagtcattgccaacgcggctcgtcttggtgcagccacctatccagtcggcgcggagtcccgttatgagttggcgccaatggtgtaccgtccatctggcagctttagggaagcagatccaaagttagaaaagcatggcctgcgtgttaacccgatgaaatcaagtgcaagcactgttctgcgcatcttacacttggctgtgaaagaagcacagaaag

SEQ ID NO: 7759 - DNA, 111 bp, Bacillus clausii
aaacattgttgagcgtgtgccactgcaaatggaagctgtagctgaaaatgaacgttacttgcatacgaaaagagaaaaacttgggcatatgctcaatttataggaggactt

SEQ ID NO: 7760 - DNA, 186 bp, Bacillus clausii
atttcattttgattacacatattgtgcttgccgcagcaatagttccgttggcactgacaagtgttgcgagagcttggaacatggaaaatgagcgccataagcggattgcccgctggacgatgccgctatggttgtatgtcagttttactggtgtgcttgtttacatcttgatttcaccttattatt

SEQ ID NO: 7761 - DNA, 390 bp, Bacillus clausii
  misc_feature (1)...(390): n = A,T,C or G
ggaaaaggcaagtngccgtcgcgctattggcagcagctttactcggnggatgcagtgaaccgaagccgggagcgctccatgccgttccagacgagactgctgagcgtgtttcagcgtttgtgacaagctacaaacaagatatggtggcagcggtaaatgaccacgaattggntcaattggaagcagactatttgcttcctaatacatcctttttccatgcgttacaacgctacggagaagagctgcaaaaaaatggctcaacgaaagagcttgtttcatttgaagtagaaaacgtatacgaagatgataaggaaggcgactattttgcagatgtcattgagcaagtccacattatgacagacgaccaagtcgatgncattaccagaaacg

SEQ ID NO: 7762 - DNA, 204 bp, Bacillus clausii
  misc_feature (1)...(204): n = A,T,C or G
aaaacatttttttcattttgctcggcacggcgcttatgtcgtttggccttgtttactttaatatggaacaccaattggcagatggcggcgtaacaggcattactttgctttttttctttttatttacgatcaacccggcaatcaccaacatcgttattaacattccgttgttttttataggctggcgnatgttaggccggattc

SEQ ID NO: 7763 - DNA, 384 bp, Bacillus clausii
  misc_feature (1)...(384): n = A,T,C or G
atggtcgctgaagcaaaaaaacagggcatccccgttataaagcnccagcaactttcagaagagctagcgaatcttcgtgaaaggcaattcatccccgagtctctctatgaagtagccgccgaactatttgtttttctccattccctcgattctgttcatgattttccaggatcagcccatactaaagcagagaaagggggaaaagagatggatgaaaaacgcaaaatcggcgaagaggaattttccgatgaatttggccaaaatcgccccgcgcttgaaaaggacgtgatcgcaaaggggctgaaagcactgttttcaaaaaaaaacaaaccacgccaaaaaagcgctgagccccaagaggaaaaacagaaagataaaaaatga

SEQ ID NO: 7764 - DNA, 504 bp, Bacillus clausii
atacgaatgtaaacaagattttattgattcggaacagtcgcttttatatggccattggctccatccaacaccgaaaagtaggcaaggtatggcttactggcaacattcactatatgcgcctgagctaaaaggacggtttcagctccattattttcttgtccaccatgaccttgttgaacacggctcgttgtttgagagcagcgcctgtgaattggtggcacaagacgttggcactccgacatttcaaaataaaggcaatcaaaattgggttgtctttccgatgcatccgctccaagcccaatacttgctaaagcaaacttctgttctaaaggcaatggagcaagggttgataaaagacataggacaagcgggaaagctttttagcgcaacctcttcgatacgaacggttacaagtggatcaggaaaatggatgtataagttttcgattcccgtaaaagtcaccaactcactcagattgaaccggcgtcatgagcttcaggcagg

SEQ ID NO: 7765 - DNA, 480 bp, Bacillus clausii
aaaggaccatttgctgtctttgaagcaagactttgcccatgccaagtccgagtatgaccaggttgcagacgctcttcgcatggtgaaacaaacagggtatggcattgccgctccgtctttgaatgacatgagtttggatgaaccagaaattattcgccatggctcaagattcggtgtccgtttaaaagcagtggcgccatgcatccatatgattaaagtcgatgtcgagtcggaatttgcgccaatcattggcaccgaaaaacaaagcgaagaacttgttcgctatttaatgcaagattttgaagaaaatccgctttcgatttggaactccgatattttcggtcggtccttaaattcgatcgtccgtgaagggatttccgctaaattgtcgttaatgcctgagaatgcccgctacaaactgcaagaaacattagagcgtattattaacgaaggctctggtggattgatcggcattatttt

SEQ ID NO: 7766 - DNA, 252 bp, Bacillus clausii
agcggctgctcattattgggatgattgaagatgcggaggccgtcttgaatattgaggacattgtcactgcaaaaggcttagatttactatttattggtccatccgatttatcggcatcgtttgggtatccgggacaagttacacatccagttgtccgtaaagcgattcaaaaggtgattgataaagcgaataaagcgggcgtaaaggtggggattccggctttttaacccaatcaagtaaaagaagtcatcg

SEQ ID NO: 7767 - DNA, 222 bp, Bacillus clausii
  misc_feature (1)...(222): n = A,T,C or G
taaaaggaaagcgcgttttagctgcagttgatgcagaatttgaggatttggaactttggtatccagtcatccggttgcaagaagaaggggcggatgtcgtttttgcaggggctgaagcgaacaaaacgtatataggcaaatacggagtaccggcaacgagtacgattgcctttaacgaagcatcagttgacgaatttgacggtgttttagttcctggcggtn

SEQ ID NO: 7768 - DNA, 750 bp, Bacillus clausii
taataacgaagaagagccaacacaagctgtttcacctgacaaagaactagacacagacgaaaacgctgaagagccagcaatcgatgagagcgacactgatcttcactcaggcgaggcaaatgacgacgcagttaaagaagacgaccttgtagttgatgaaaatgagcaagctagcgaaacgactggcacggaaaacaacgctgaaaacgaagaaagcgacttaccaacatcggaagacgctccttctgaagagaacgactcctctgatgaaagcagcctagaagagccacaaaatcctgaaactgacgctaccaaggaagaacaagatctagaaacggacgctagcacagaagagcaagattcagaaactgacgctagcacagaagagcaagatccagaaacggacactagcacagaagaacaagatccagaaacggacactggcgcagaagaacaagatctagaaacggacactagcacagaagaacaagatctagcggaacaggtagcggaggaagaacatggcgatactgatcgtacctccgaagaccaagacagtccagttagcggtacaactgaaaacaatgaagctgacgaaaacagtgaatttgttcaagaacaagaagaagaagaatcagatgtagcaggcgacgaagatgaggcatcaccagaagaggctgaagcgtcttcagaacaagacgaggaaccttcagaagcaacggaagagcagcaaacagcagtggcaaaaaa

SEQ ID NO: 7769 - DNA, 903 bp, Bacillus clausii
actctatagatggtttcagaaggtaaaatcattggcttgtaaaaaacacaaacaagcagttgaacgctttttaaaggatttagagcggtccatttatgatgaggactgctatttttattttgataacaacgaacttgaagaatttaacgaatgggcttctttgttcagacacacaaaaggcgtgctggctggacaacgaatagagcttactgatttccaactgtttattgcagctaatatcttttgttttaaacgtaaagacaatgattatcgtaagatttccagtgtttacattcaactagcaaggaaaaatgcaaaatctcaattacttgctattataagttcctacgtcgcgttcttatccgatcaggtggaagaagtatatatttcaggttggatgaaagaacagtctgatattgtttatcaggaaattttaaagcagcttgagagagttccttcttttaagggaaaatataagacttcttataatcgcatacaacatattaaatcaggctcaatcataagggttttgagtcgagaagcaagacagtttggagaaggaacaaatccatccctggctattttggatgaatatcatacccatcttactagtgaaattatggagtctttagaagaaggtatgggggcaagaataaatccactgtcagttattataactacagcgggaaggaacctaaactcaccatgtaaggctgaatatgattattgttcaaagattattgacccacacaaccctgtggagaatgaaaattactttgttttaatttgcgaattggatgaaggggacgatccatttgacgagagtctatgggttaaggctaatcctatagcagcaacttaccctgaaggtatagaagctattagaaaacgtgctaaaaaagc

SEQ ID NO: 7770 - DNA, 330 bp, Bacillus clausii
gcaacggatttacgattatatgcgagaacatacatatgcgccaatcggagaggcgctagactacaatttgtttacgcttgactttcaagcactcggttattcagaagagccgtatgtagcaagtccttataaccaaacatcgctaccgttgttatttacaaacgatggcgaagtggtaatcgattatttactcgatttaaagatggcagagcaggaaaaagagtttgaggaaggtgtcgacctccgccgttatttatatgaagactctccttttttgccattgtactcagtgccgtactcccttgatgaggaaggcaatattcaatacga

SEQ ID NO: 7771 - DNA, 208 bp, Bacillus clausii
ttggacatccatattgaacggaaacggaccgctgacaaagcaggtgacttcatttgtacatcttcggacaagttatttgtgcttatcgttgacccaccagagcgctacccttacttattgctatgcctcgacacgttctcaattgtacaaaattatagcagcattccatcgagagaagaattggaagaagatatcggggaagacatta

SEQ ID NO: 7772 - DNA, 402 bp, Bacillus clausii
cttcgacagcgccgggctctacacccagggtggcaacaccaccgtcaatgccaccaacatcgatctcgccaacaccagtggcgcgaccggcacgggcatcaccggcgccggcggcatcctcacgctcaatgcttcgcaggtcatcaccgaggacgtcggcaccaagcacctcggcggcttcagccaaatctatttcaacgccggcaagccggttgcgttcagcggcaatggcacgctcgatacaggatcggtcgcggctgcggcgctgatgttcgatatcggcggcgtaacgatcgcgaaccccggcaccggctataccagcatcccggacgtgaccatctcgggcggcggtggatccggcgcccaagccaccgcgttgcttggcgtggtcagctttgccgt

SEQ ID NO: 7773 - DNA, 488 bp, Bacillus clausii
atgatgaagagtgaccaacttgccagccggcacgttggtcaaaaaggaggtatcagaagcatgagagggcaaccgcaattgcgactgccgagaaaggcgatcaacgtgtggcgcctgcaacatgcaatcgatacgctgctgctagctctggtcccgatcggctattattttgcacaaagatacatatttctgtccttttatgaatggctaacatggtggttagcaggagctgttgtgatatatggcatcgtgcgcatcgggatttggccgctcgtgcagtggcgtcgtttccgctatgaaatttttgatgatgaaattgatattcagcaaggcgtattagtggtgagacggacgcttgtgccaatggtgcgggtccaacatgtcgacacggagcaggggccgattcttaggcgttacaaaatggccacagtttcgattacgactgctgcgaccacacatcgcattccaactttatttttaaacgatgc

SEQ ID NO: 7774 - DNA, 421 bp, Bacillus clausii
atgagagggcaaccgcaattgcgactgccgagaaaggcgatcaacgtgtggcgcctgcaacatgcaatcgatacgctgctgctagctctggtcccgatcggctattattttgcacaaagatacatatttctgtccttttatgaatggctaacatggtggttagcaggagctgttgtgatatatggcatcgtgcgcatcgggatttggccgctcgtgcagtggcgtcgtttccgctatgaaatttttgatgatgaaattgatattcagcaaggcgtattagtggtgagacggacgcttgtgccaatggtgcgggtccaacatgtcgacacggagcaggggccgattcttaggcgttacaaaatggccacagtttcgattacgactgctgcgaccacacatcgcattccaactttatttttaa

SEQ ID NO: 7775 - DNA, 237 bp, Bacillus clausii
ctgagcaactacgcgaataaacaagctttgattgatgaaataatgaaaagagcaacgttattcatgaatgaatttgatgctattgatgatcttgataaagatgtgttcgtaaaagaagttgaccgaacgccagcccagatgattgcctaccaattaggctggatcaatttaattctctcatgggaacaagataatcaggatggaaagtttgtcatgacgccaacagaagattatgaa

SEQ ID NO: 7776 - DNA, 195 bp, Bacillus clausii
gctagccagccatgaatacgtgcaggcattaaaggagacagacgaaggctaccgcatcgtttcagcaaaaaacaatttgtttccaatgcttttgcatatggttgaagacagcgggactactgtaaaaggcatccatatcaagcagccgacgctagaagatgtatttttgcacttaactggccggtcgttgcggga

SEQ ID NO: 7777 - DNA, 411 bp, Bacillus clausii
tagcccttgggattaacttattggttgtttcctaccatttgctagacggcggcattattggcgtcggattgatcgcccattacatctgggattttccagtcggtatgaccataatcgtcgtcagcattcccatttacattcttgcttggatatactataggccgtttttctacaactcactagtaggcgtcatcgtttcttccttaatgatcgattactttgccgcttacataccggctaccccccttttgcctccacttcctagcgccatcattggtggcctgatgctcggaataggcgctggtattatgtttctcctagatattagcactgggggctttgacttgctggcacagatgattgctgctaaaacaaaatggaatgtcggtgtcttaattgtcggttttgatt

SEQ ID NO: 7778 - DNA, 180 bp, Bacillus clausii
taaaagatccgcaaatgggcgagcaagcgctggaactgatgaagtcaaaagagtaccgtgaacaaattatgggcatcatgaacgaagcgctggaaagtccttatttcgcctcaaaaatgactgatttaatgagcaaggcaatggaaaagcaaacaaaaggacaagatcagaataaagaag

SEQ ID NO: 7779 - DNA, 1109 bp, Bacillus clausii
atggaagaagcgctgctggagtttgaaattatccagtttttaatgaatgaggatcggtataccacatacgacgaaattgctgacaagttttattattctccacagacaattcgcagcagaatgcaacggcttacaatgaatattgacgctttaggaatcgatgtttctatagatacaaaagtgtttaaaggcatgaaattgattggaacggaaatgcaaaaacgaattttgttagaaagctttttcacctccatttctgtaaagaaagagatgttcaaggattttgtcgtcaatggattccggtcgtgggtgaagccagaaacgattgaaagtgtctttaaagtggtggatgaaattaataaaaatcaccagcttaacatggagttctctatttacaaaaaactgactactcaattgattattattatccatcaaatcaatgctggtcaccttgtcgccattcaagatacagagctggtaaatttgacagacttcaaggaatttgaagtagcagaagcgtttcggtctcagttgcatgaattcgtccatttcacagatgatgaagcggtttttcttgtcaattatttaatatcgttacagttagacttagacgatgccaatataaaaaacaagaatccagaagtgataggcaaaattgaagagattttacgtcatgtggaacaggtttaccaagttcctacttattcacagacaaggtttagaaataacatttctaatcacatttatcgaattattaatcctgcttcacataatttgcttatctataacccatttgtgaaagaaacgaaagcagaatattttttctctttcagtattgcttctaatattgctctacaaattgaaaaagaatttgctgtcgaaattcaggacagtgaaattgcttatttagcgtatcatattcaagtcattctcgattcacaggataaaaagaggaagaaattaaaaaccatcattctttacagtagaagctatgagcggacaaagcttattgcttctaaaattgcaacatattttgatgaactagacatttgcaaaatcgaaaaatgctcgacttattatgtatttgaccattcctatttatacattgg

SEQ ID NO: 7780 - DNA, 438 bp, Bacillus clausii
gctttccacaagcgaacgcctcgccaagtacggcgccaacgatggtaagctcgttgagctgctctttcaaatgggccgttatctcctcatcgccagctcaagggaggggacagaggcagccaatctccaaggaatatggaatgaacacattcaaccgccttggagcagcaattatacgttaaacattaatgcacaaatgaactattggccggcagaaaccgccgctttgccagaatgccatcagccttttttaacgtttatcgaggagctggccgagcaaggaaaagccgttgctaaaaattactaccaatgtaggggctggacagcgcaccataatagtgacatttggcggcaagcagagccagtcggcggttttggcgacggcgatcctgtctgggcgttttggccaatggccgctccttggctcacgcgccattt

SEQ ID NO: 7781 - DNA, 258 bp, Bacillus clausii
agcaggaatcttcggtttattaacgtctgctgttgtattggctgcatgtggcggcggaaacacaatccaggtaggggtggcaaatgaagagccctacggctacattgacacagacgcgggagaagtaacgggagctagcccagaaattgcccgggctgtgctgcaaaaaatgggctatgaggatattgaagggactgttgttgatttggaggcattgatccaaggcgtcaacagcggacagtttgacattgttacagc

SEQ ID NO: 7782 - DNA, 312 bp, Bacillus clausii
  misc_feature (1)...(312): n = A,T,C or G
atggtagatgtaattttgctcattgcgatcggtgcgctaagcgcagtgatggccaatttaggaatcgccgtttttaatgatgggttgcgcccgattgtaccagagaacttggaagggcgaatgtcgcggaaagaactaggagtaaccgcatttgcaatgagcttcgggcttgtcattggtttcggcattcctatatccattgctggcagcattattttgattcatagcatcttgctaggaacggatatcattggtctatcgattgcaanaggcaaattttccacaatggcagcaggtgtgttagggggactt

SEQ ID NO: 7783 - DNA, 255 bp, Bacillus clausii
atgaccccgatggccggtcgcgcttaaatgtaaacttatttagcggcgatatcattgtcactgattttggcgacgttcctaagcttgggaacattcaagacagccgttttgatgaagcttacgcccggtggcgcgattcagcgattaaccgttctctctcttgccattgtccttctgtgcaatgcttaggtccgaatttgcttgtcaaaaacacctattaccgtgaaaccgatttttcaaaacgatctgctcgtt

SEQ ID NO: 7784 - DNA, 213 bp, Bacillus clausii
ggattttgattgcaggtgttgtcatcggggctgtacttgtaaaaaaagattggcgaaaccgtctttgccaagaagcgaaggaactgaagcagcaggcaggggacacgtatgcctttttgcgggacaatcgggaaaacatggttgggcaagcaaaagaagtcatggaggatgtccgctcgatttggaaagacatttccgaagatgtgcgcaccg

SEQ ID NO: 7785 - DNA, 410 bp, Bacillus clausii
atggcttttaccgttcgaaaaatggaagaaacagacctgctggctgttcaggcattatttgcccggatgcaaacaaaacaaccagtaacgttagaagacccattgattgtcgtagaaaatgacgcaggcgaattgattgcaacagtaggcctggaaaaagccaacatctacggtttgctccggacaatggtcatggacagcgcaaaaatgagttcaagtgcgttggttgaatttatccaaatggcgctagcctatgcgcaaacagaaggagtagaaaccgtgtttgctgccagtcaaggcaacgccacattatttgaactgctcggctttaaacgtcaagaaaccgatgctatcccaaatgaaataaaagaaatcgagcactatcaaacggtagtggaacaggatggcgt

SEQ ID NO: 7786 - DNA, 477 bp, Bacillus clausii
cgactcgattgccgatcaagcactaaaacgggaaattcgtgacgaagtaaatgccgctatcggggaatggatcggggaaatggcaacgatggaggaagctgtcgctgaaattgctttacgtgttcctgagcttgaagcgatcgtagcagagcagctagcagcaaaaggcatcgaccaagactattccgttgcgtttgataaagaggttgcctttccaacgaagctgtacggaaacatggtataccctgctggactgtaccatgccgtccttattacgttagggaaaggccaaggcgaaaattggtggtgtgtgctgtttccgccattatgctttttagacatggataacggcgaagcgaccaatacagcagcagaaggtagcaatagcgaacaagacagcggcaccgaggaaactgtcgaagtggaaacatcatttttctttgtagaatggtttgaatcgatttgggatcggttatt

SEQ ID NO: 7787 - DNA, 255 bp, Bacillus clausii
atgtcaatgagccaaattaaaaaaacagccaaagcgctgcctggctggacggttgaaggagaagcgctttggcgcacctttacatttgatcatttcttaaaaggaattgattttgtgcagaacgtcgccgcttatgcagaaggcgcacaacaccatcctgtcatcacgattgaccatacggcggtatcgataaagtggacaacggtcgatgaagggaagctaacacaaaaagacattgacgccgcgcaagcgtgc

SEQ ID NO: 7788 - DNA, 423 bp, Bacillus clausii
caagaatcaggaaatacgccagctaacaacgaaaattgaagttagatcattagaaggtgaagaagaaaaaggcgaatatgtagaaggctatgctctgaaattcgaaaagtggtcagagcgcctttggtatttcaaagaaattttgtcaagaggttctcttgatgaaacggacatgtctaatgttatcgcttgttttaatcataatgagagctatccactggcaagaaatacggcatctggtgatactggaaagcttgaattagaggttgataacattggacttaaattcagatttaaaccaacatccacttcttactcaaaagatttagttgaaaatattcgcgctggaattattaatcagtgttccttttcttttgagttggatttctctgacgagaatgtagacgaatgggcgttatacga

SEQ ID NO: 7789 - DNA, 729 bp, Bacillus clausii
tttacattttaagggtttaagtgaggatggcataattgggaaatctccaatcgctgtagtcagggaacatgtaggggcacaagcggcagctacaaagtacaattcaagactttataaaaatgatgctactccacgcggtattttaaaagtaccgcagttattagaagaggacgctaaaacagccgcacggaaagaatggaagcgggtaaacaagggtgaaaatattgcaattatagacgctgggcttgaataccagtcgatttcaatgccgcttcaagacgctcaatttgttgaaagtatgaaatacaacaaggcccaaattgcagctctatataaaataccgcttcataaagtaaacgagcttgaccgtgctacttttaataatattgagcatcaagctattgaatatgtgaaaaacacactacaaccttggatagtcgcttttgaacaagaattggcagcaaaactttttactgaccacgaatttgatgatctgaattactatctaaagttcaacgttaattcagaacttcgtggagatgccaaaagtcgggctgagtattatgaaatcatgcatcgcatttcaggactaaataccgatggaatccgagcatttgaagagatgaacgcgatacctaacggggataggcatgtaatttctctgaattacactttcctggatattttagaagaataccaacttgccaaagctggagcattgaaaggagg

SEQ ID NO: 7790 - DNA, 578 bp, Bacillus clausii
ttaacgagtgaggaaagcaataaaggactacttgatccttttgtcattatgaaaaagaaaaaggattcggaaagtcttgcgattgatattcttacctttctcacgggtatatcgagtcgagatggagataaattccctgtattacgacgagcgatacgcgctgttggtcaacaagaggaacgtggtttactccttgtgattcatgaattaagaagtgatcccaatccattagctggccccatcgctgaccatatcgaaagttttaccgattatgactttgcccatcttctcttttcggatggaacggtgaaaaattcgattagtttagaaaaacagttgaatatgattcaagtggcggatttagtgttaccagacgcagaaacaagttttgaggaatatacaacgatggaattattaagtgtcgccatgttgattgtcatttctacttttgcgttagattttattcattcggatcgcagtatttttaaaatcgtcgatttggatgaagcctggtccttcctgcaagttgcacaagggaaaacactttctaataaattggttcgtgcaggacgtgccat

SEQ ID NO: 7791 - DNA, 1107 bp, Bacillus clausii
atggatgaagcgaaagggattaagaatcaaattgatctattgattgaggcgcgggaacttgatgcccctgacaccgaggaacgtgattttgttcctgaaaaagagcgtaaaccacaagaagataaagaggagcagcgtgaattcatcgctacaaaagaatatcgacaagcttggttcaaggtcttaactggtaaggaagatgatttatcccaggaagaacgtggtatgttgcaaaaagtcatcaaggaaaatcgccagttgtctgctggttctgataaagatggtggatatacagttccagaagatatttcacgtgagattttaaaatctatccatgaaatgaacactgtgcgaaatcttgtaacggtcgttcctaagaatacttcttacggtaactatactgttcgcaaaggtgttgctcaaaagctttataacacggctgaaaaagagcaaatcaaagaactaaagaacatggaatttgaccaaatcacatggaatattaaaaagtttgctggcttcttgccaatttcaagcgaacttcttgatgattcttttttaaacttcacgcgagaaatcattgattggttgtctgaatcagctttgacaactgaaaacgatgaaatcttttacgggaaaggcgacgaaaatgttgagggcttgctgacaaatgatgtgtttaagcggattactgctcctgatgaaattactattaaattcttgcgtcgtgtaaaaaactctattgttcaaggctaccgccgcaacgctgtatgggttatgaacacagaggcgtttgagacgttagcaaacattgaggacaagaacggtcgtggtattcttgcggctgatccacgtaacgaagatgcctttaaccttttcggtcgccctgtccatgtttacgatgaaattgtaacggatgatgaaacaaaaacaacgcaaattctgtttggtgacattaagcgctgctatcgtatgtttgaccggaaacgctttgagattaaatccacagacgttggagcagacgctttcttgactgatcaaacatacttccgcggaatcgaacgttttgacggccgcattgttgatccagaaggtgttgttattgtagaa

SEQ ID NO: 7792 - DNA, 593 bp, Bacillus clausii
gacttgtgaaagtaagcattgatactgccggcgaaggaatggaagcagaagctgagtttgttgcggtaacgagggcagaggcggtccgtattcgggctgagctgttaaaggagttaaaagaagaagaacatagcggccaaaacgacggggaacttaacgaagcacaaggcgaaatggaaactgaaacagaaaccaaaccgttaacagtttggcatttgggtacaaaacggctcatttatgctgccttaacatcaagtggaatcggcctcgtcatttctgcagtggcagcagtattgtcgcaagttggccagtttataccagatgacatatacgaaaatacgtttgattatgtgatcggtttaagtcttattctcctgctcattctggctgtcgccgtgctgctcctatcgtggatcatttcaagtgtgctaacgattttaacatatggaaattttaaagtgagcacctataaaaaggaaatggtgattgagcgagggctaattgaaaagcgtcaactcacgttagcttatcgtcgtattacggccgttcggatcatcaaaagcatcattcgccaaccgtttggctttgtttct

SEQ ID NO: 7793 - DNA, 281 bp, Bacillus clausii
  misc_feature (1)...(281): n = A,T,C or G
atggttaaagaaatcgagtatgaagcaaaatcaatgcttagtgaagctgcctatcgccagttaaccgaaaaattcagcacaaacgcagaaaaacagcaaaatgattactatgatacggctgactttgcattaaagagcgcaggggcagccctacnagtccgcanaaaaaaagacgcgtccgtctttacnttnaaagcgccagcaaatggtggactgttggagacacaccagcctctcaccaaangcgatgaacagttgctcctaagtggaacgcttcctga

SEQ ID NO: 7794 - DNA, 345 bp, Bacillus clausii
gaagggacgaagaagcgagcactgtagaactagaagaggaaatagacgcacaattggcggcacgattaaaaccagggaagcgcgtgctcgtcgattctgaccaatatgcttttatttacattcttgaagatgaggaagccttttacgcgatccgttttgaaaagaacgtttggccagcactaaatgaagcgcacacattaaaaacgagttattatgtcaagcttaatgaacatactcgtcttgcgcttgtcgatatggaggaagagctggtatttcttctagagaacattcgtggtaatgggaattatggagaggcctttgaacaagcagtgaacgacgcatttt

SEQ ID NO: 7795 - DNA, 617 bp, Bacillus clausii
ctgggatgcttttttaacaccgtataaacaggctgttgaagagttgaaagtgaaatttaaaggggcgagggaacagtaccaaaaaacgtcgctgcatacaccaattgaatttgtaacgggacgtgtgaagcccgtatcgagcatattaaacaaagcggcgcgcaagcaaattcccctcgaacagctggctgataagatgcaagatttggctggcgttcgcattgtcactcaatttgtcgaggatatagacaaagtcattgagctcatgcgtgcccgctccgattttgaaatcatttccgaacgagactacatacaaaagaagaaaccgagtgggtatcggtcataccacttaatacttcgctatcctgttcagatgattgaaggggaaaagaaagtccttgttgaattgcaaatccgcacactgtcgatgaatttttgggctacgattgaacattcactgcgctataaatatagcggtgaaataccggaagacatcaacatgcgtttgcagcgggctgcagaagctgccttttggctcgatgaggaaatgtcgatcatccgtgatgaagtacaagaagctcagcgaattataaccgcaaaacaacagcaaagccgct

SEQ ID NO: 7796 - DNA, 177 bp, Bacillus clausii
gtgaaataattttgaagtttacggttgcctcgcgaggggatacactctcagatgaattatgcgatacgataaaaacacggcttcttgctgccgatttggcacatgacagcgataaaccggatatcgtcattacggtgggaggagatggaacgtttttagaggcattccattcttatc

SEQ ID NO: 7797 - DNA, 215 bp, Bacillus clausii
atgaaaccaatgaaactgacggagacgaccgcatttcctcagtcaacaggctgggtcggagagcctaaatacgatggctatcgttgcctagtttccatcacagacgcgagcgttgagctaatcagccgcaacgggcgattgcttaaccatgctttccctgaagttgtaagtgcttttgaagaaaggcaaacaaagctttcaggccagttgccgat

SEQ ID NO: 7798 - DNA, 534 bp, Bacillus clausii
atgcatacagtttggaaaggcagcatccagttcgggcttgttcatattcccgttaaactgcacacggcaaccgaaaacaaagacatcaaaatgcgtcaactccataaaaagtgccatacgccaatctcttatgagaaaaggtgtcgccactgcgaggaagcagtagaagcagatgatattgtcaaagcatacgaatacgtgaaaaacaaatttgttgttgtcgaagcggaagagcttgagcagtttcgaaaagacaacgaagacaaagcggtgcaaattcttgattttgtccagttggaggaagtcgatccgatttattttgaccgttcttatttcttagcgccaggtgatggtggctccaaagcctacgcactgttgcaaagggcgcttgctgattctaaaaaaattggcattggcaaaattatcattcgcgcgaaagaacatttggcaattgtccgcacgtacggcaacgctttaatgatggagacgatttattttcctgatgaggtgcggaagcttgctgatgtccctaat

SEQ ID NO: 7799 - DNA, 216 bp, Bacillus clausii
tgcttatactatctttgttgagcattagcagttttttcgcttccttgaatcaaaatatttatacaccggtcattccccttattcgagattcttttaacgtgtcgatacattgggtaaacttcacagtgagcagcttcattctgactatagcgcttgtacaaatctgtttaggatcagcggtcgatcgaaaaaaccaaaaaaaagttattaatacta

SEQ ID NO: 7800 - DNA, 2085 bp, Bacillus clausii
aacaggcatttgtgtttaacggttcgactcatgtcaaccacttttttaaagtcgctcctatcaaaaacggcgatgaaggaaggcgttcttccgctgtaaaatcccctgtggaaaagcagttcgatgtgcaattggaagcgcttgaccgtggcttagtagcggttgatacaggagaaggcgtttttttaagttggcggctgttgaaggaagaagcggtcggctattctgaccatggattggtcggcacggtttttaacgtttaccgcgatggacaatttcttaaaacggtaaccgacagcaccaactatttggatgagcatggaacgccaacgtctagttattatgtaagcgctatcaatggtgggggggaagaggcgagtgacgttgttcatccgtgggaaaacggctattatgagttgccgttgcgaaagcccgaggatggtgtaacccctgcaggagaagcgtacacgtaccatgccaatgacatgagtgtcggcgatgtcaatggcgatggccagtatgagttttttgtgaaatgggaaccgacaaattctaaagacgtgtcacaaaaaggttacaccggaaacacctatattgatgcctatacattgactggcgatttgctataccggatagaccttggtaaaaacatccgttccggggctcattacacgcagctgcttgtttacgattttgatggcgacggcaaggcggaactgatgtttaaaactgcaccagggacaaaggtgatcacattcactggggatggcaaagtcgaatcggaaacgtatattacgatgccgcaggaagacgtggaagcaggttacagccatgaagacgattaccggatgagtgccgatgattattatgcccatgtggtcgagatgtttatcggttggcatgagcatgaagaagtaaaaaacggcaattggccagagacgcttgaagaggctttcgggatcgaaccgctgtatgactatcctttaagccgcggagatgcggaggcgttagccgattattttatcgatgaatacgccccttcgagaagtgcgaacaaccaattgcgggattttgaaggttttatcgttgaaggccctgagtatttaacggtgtttgcaggcgagacaggacaggaattacaaacaattcattataaaccagggcgagaagacgatggccttatgtggggcgactatgcgatgaaccggattgagccaggcaatcgtgtcgatcgctttttagcaggggttgcatacttggatggtgaaaagccttctgccatttttgcgagaggctattacacaagaaccacacttgttgcctatgattgggacggcgaacaactgcacgagaattggtttgttgacagcggctggacaccgatggaaaacccatttcacgattcaccacatggcgtagacggaaccaatgacgaatacgccaccctcaccacacaaggggcacattcattgagtgttgccgatgtcgacggggatggcaaacatgagattatttatggtgctgcaacgattgacgatgacgggacgctcctgtatagctcgtttgctgaattgcctcccgaaagtgcagctccaggtgaaatggcacgattaggccatggcgatgcccttcatgttgccgatattgatccagacaggccagggttggaatcatttatggtttttgaaggggcccagtatgcgccgtatggtttcgctttacgcgatgcgcgtacaggcgatgtcctttacggagagtatagcggccgagacactggccgaggcatggttggcgatgtcatccctggcgagcgcggcctcgaaacgtgggccgtcggcttatacagtgcgtcaggcaagcgtttaggcaccgagcagccaggcacaaacatgaatattaaatggtcccctgacatgaccacacaaattgtcaatggcgcgcttgacgagacaccgacgattgatgattggcaacgagggcgtttgttgacagcggaagggacaaggacaaacaacggaacgaaaggcaatccgtcccttgttgcagacatatttggcgattggcgggaagagcttctcgtccgca

SEQ ID NO: 7801 - DNA, 165 bp, Bacillus clausii
ttacgttaacgaccaaagtgaactcgacactgaataagttgtctgatatgacgttgatcggatacaaaagtgaacactcgttaattccagattatgaagttcgctcacgcctttccttaaatgtgattgcgagagtgctccttgacgcctatgtcatccgtacaa

SEQ ID NO: 7802 - DNA, 157 bp, Bacillus clausii
atgatttatacatgcacgatgaacacagcaatcgacttatatgtacagttggaaaagcttatgcccgacaaagtcaaccgcacgattgatgaagactaccagccaaatggcaaaggcgtcaatgtgtcgatcatgctaaaacgctatggaattgaag

SEQ ID NO: 7803 - DNA, 782 bp, Bacillus clausii
atgattaagccgtaccatttaaaaatccgccataagaaagatacacttattttaataggcgaagaaagagaaaagcgccgtctgatgagctttattatttcacaagaaacgtccggagaatttttaagtttaaaagcggttcagaatgcttttccgaattacgacgttttcacattaaaagatgaaatcgtttccattcttgaggagtttaatttgtatgtcaacgattatattatgaataatcttctcctccaccttgtgattacagtcgatcggattaaaaacaacaactccgtgattcactcatctgatctgaacaaattaaaaagaaatcctgaaacggaagcagcaaataaaatggcggacttgttggaagatcaatatggtatttcctttaatgaatcggaacgctacaattttattttgcttttatcaagtaaaacgacattgcttaattatcagtcattaacatctagctctttaaatcattatgtcgatgaacattatgtaaacctttcgcagaaactgttaaagaaagtgcatgaacgctactttattgaaatcatcgatgatgaatttttcgtcaagtttacgctccatattcgtaatttaattttccgggcaaagaatgaacaaatggttaaaaattctttgacttataaattaaaggattcataccctcttatttatgaactagctgggtttatctcgaatcaaattcagttgatggaaaacattcatattaaggaagatgaaatttcctatatcgcctttcatatcgg

SEQ ID NO: 7804 - DNA, 466 bp, Bacillus clausii
atgaaagggagacggctgcgcagccgcgcaagataccaaattttcaaccggattttggccatgtattcgattattattttgcttgttattagcttgctcgtcgtgctgatcgcaaaatatgtagcggatgacttcataactagatcccttgaagccaatgaaaaacaagtcgaagctctggcggtttatatggctgaacgggaacgctcgcttgcaactcacttacgggaattgtatttttatccagagcttgtcgagtcgatagctgttgccttaaaaaatgaccctgaaacgtatttggaatacagactggatcaatactcactgcagcgctcatttgtgccaagcaacgtcgaatcgtttatgcgcggattttattatggagacggcgccattgatgccatcaccttgaccagttatgaaacggatcaagtatatgcctatgtgtttcaatatggcgaaattg

SEQ ID NO: 7805 - DNA, 547 bp, Bacillus clausii; identical to SEQ ID NO: 6883

SEQ ID NO: 7806 - DNA, 474 bp, Bacillus clausii
  misc_feature (1)...(474): n = A,T,C or G
cattaaagttgagcgcttgctcgtcaactacaagacattagaagagtttcgccatttcagagaatatggcgctgccgagctttccatgaaagacgatttaaagaacagtatgattgaaaacgacagcgaatcccctttttatggcatttattacggaaaaaaactggttgcgcgaatgagtttatacaaaattgacggcaacttcgaccgctattttgaccctccgcaagactacttggaactatggaaactggaagtgctagagccttaccgtggtcgaggttacggaagggcactcgttgactttgccaaaagtttcggcctgccagttaaaacgaatgcgcgccaaagcacaggggaattttggaacaaactttggtttcgaacctatcacttacaatgaagcacgggatcggggcgagagcccataacgtatgggtttcctcaaagggtgtgcaagaacaaancaagcaa

SEQ ID NO: 7807 - DNA, 324 bp, Bacillus clausii
atggcgaatgagcttatatgcacacaatctctaacgacagaggaaatcgctgaattgaaaaaaggttatggctttcggtcactcttcacggctcaagattggatagcagctttgacagagaatggattcagccatgtaaaggtagtaaaagaagcagtggcggaagcactccagcaagatgaaagcgataaaggcaacgaccttatgccgtcaccgcttctttcccctgattgttttgcgcaaatgcaacagcaccaattgaggatggaaaagttcaggacaaaacttggccatgcttggatcatcgcaagtcggtcaacttaa

SEQ ID NO: 7808 - DNA, 234 bp, Bacillus clausii
atagccccgaaggaagtaacgtggattgtcccaaaggaggagtcaatatttggatatcgctgcccccttgggtcgataccaatgaaatgctgtttgaagcaaagaaatttggcatctcctttctccctggatctgcttgctaccctaaagaacctgccatgaatcatctgcggttgtgttttgctgctgtagaggatcaattattagaaactggcatcaagacactttgtaaaa

SEQ ID NO: 7809 - DNA, 498 bp, Bacillus clausii
agttcagccaggttgagaccatatatatactaagcgaacggtatggcgtcccagaagcagcgattatgaaagtcaacgatctttccgattctgccattgaagctggcgagacgctaacgatccctgcagctgtttccgctgcggagagagagcttttagctaaactagtcagcgccgaggcaaaaggcgaaccgtatgcagggaaagtcgcggtagcgactgtcgtgctaaaccgagttgacaatgaaaattatccagatactgtgcgcgatgtaatttatgaagtgacaccatcaggccattatgcgttttcccctgtcttggatggcgccattaacaatgagcctgatgacgagtcaagacgagccgtgactgaagccctagcgttccggggccaaggtcaacaatcgctttatttctataacccgaaaacagccacaagcggttgggtagcgacacgggagcaaacactcgttatcggtgaccatatttttgcca

SEQ ID NO: 7810 - DNA, 439 bp, Bacillus clausii
atgagaattgaggcgttggacacagggcgtttaacggggttcttagctgaatatgtcaaccaaccagatcaatgcagcgatctgttctcgtatagatggaaaacgaatggctgggagcaagagcggagcgaagatttggcgaagcgttctttttcccatcggcaagcgctttgtcgcttgcttgaagcacgccatgcgccattgagaaagcgagaggcttgtatggacaacatacataaactcaagcaggaaaatgcattagtcgttgtggcggggcaacaagctgggcttatgactggccccctttatacagcttataaagcaatgagcgtcattttactggcgaaacagtatgaggaaacgttaaaccaacctgttgtaccgcttttttggattgccggagaagatcatgacttagacgaagttcgttatgtccatt

SEQ ID NO: 7811 - DNA, 393 bp, Bacillus clausii
atgaaagtaatgtcgtttaatttgcgcaatagcgggggaaacgatccttctcctcatagttggagtgagaggcgtcctacagttcagtcctttttagaaacggaagagccagatattttaggcacgcaagaagctctttatgatcaggttactcaccttgatgaagacttacctgattacgaatggattggaattgggcgagaaggtggaaccgatggggaattcatggcaatttattataaaagtgaccgtttcaaaccaactgatacaggccattactggctttccgatacgccagatgtagtcggtcgcttcttggggaaatacaattcctcgaatggtccatgggcaaagtttgaagaagaagcaactggcgaacagtttatttcgtga

SEQ ID NO: 7812 - DNA, 405 bp, Bacillus clausii
atggagtttgaagttttgaattgggatgctcttttgaaacaagtagaagaattagggcggaacgttaatcgcgctgaaaatgcagctattaaagcaggtgcggaagttgctttgccagtcatgaaacaggaagtcccacgttcgaatatcagtgctgcagattacaagcacatggttgatgatattcaagtaagcagggtaaaaaatgtagatggtgtaaagatggttgaagttggcccatctgctggaaaaggcggtacgaggtggcgtgctcatttcctaattaatggaacaaagtttatgccgccgaatgattttgttttgagaacagcccaacgtacgaaaggtcaaattcaaattgctatgttgcaagaattgcaaaagaaagtgatgggctggctatga

SEQ ID NO: 7813 - DNA, 294 bp, Bacillus clausii
atgccgttcgtttgcttcttcttggtctgtttcactcggcaacgcgtcggtttccaccattatctctgcatcatcaatctccgcttcctcgtacccatgccgatcgtttgcttccacttggcttgtttcgcccggcatagcttcggtctcaacgattgcttctccatcatccatatctgctttctcgtgttcatatgtacgctctttttcgtcaccacttgcctcttcttgggaacgaatttccttgctttgttgttgctgtgcttgatcgtcggcaagtggcagcgactgtag

SEQ ID NO: 7814 - DNA, 321 bp, Bacillus clausii
aacgttcgtcaacgaggacgcacctctcattttagaactcgatgaagacgacaaggtcattggctacacacaacgccatttcacctttgaagaaaacccagatgaacggaaaatgattacgtacatggaagcagtcgaaacgctgctaaacaaccattttattaaaagaaacaatagcattgttgaaattgattttggctattatagcctagctgaacaaacgcctcgtttcttttcgcctatgtgggaagtgacggtgaagggcaacaccgatgaggaggacgatgtacgcatttatttagtgaatgcgattttaggcga

SEQ ID NO: 7815 - DNA, 159 bp, Bacillus clausii
tgcagggattaattaacgtaggaaacgacttaaatgaagaagggattagttttcactctctacaagagaacattacgatgaataaagccaattcaacggggcaacggatgtttcatctatttgccgcgtttgctgaatttgaacgaaacctcattcggc

SEQ ID NO: 7816 - DNA, 303 bp, Bacillus clausii
ttcaccgagatgatccaacagtgccagttggcgccattttagaatggcttaatgaacataaagaagcagggcggataggcgcgtttggtggttcaaattggtcgttagcaaggctggccgaagcaaacgaatatgctgaaaaacatgggcttgttggtttttctttttccagccccaatttaagtcttgccaaagcccaacagccttactggcctggctgcattagccttgaccaaacagcgatggaatggcacggggaaaccaaactggctggggtctcgtggtccttccaagcacgtggat

SEQ ID NO: 7817 - DNA, 285 bp, Bacillus clausii
atgcaagcgtttgtctacagtctaggacttccacaatgttggaagtcctttacgtatctatccccttacactctcccgacagttgaagaaaaatgtttccaccaaaaaagcgaccttccgattgaagaatcgcttcttagccaaacgtatattcttctttccgcgcttccacaaattcagcttttgttaatccaaatagtattaaatctagatattgtccgtttatgtatacaacttgtcgacggaccccctcttgaacgcagccaagcttttccatcattttaa

SEQ ID NO: 7818 - DNA, 771 bp, Bacillus clausii
accatttccattatggatattttgtgaaagcagctgctgaaattgcccgcgtccatccagaatgggcaaacgatgacgagtggggcgcgatgatcgatttgttgatccgtgactttgctgctgggcgcgatgatgacatgtttccatacttgcgcatgtttgacccttattccgggcactcatgggcagacggtcttgccacatttgattcaggcaataaccaagaatcatcttctgaagccatgcatgcttggaccaatttaattttatgggctgaggcaacaaacgattcggaattgcttgaccgtgctatttacttgtatacaactgaaatgagcgccattaatgaatacttctttgatgtctatgacgaaatccatcctgaagcatacaaacctgaaattgtgacgatcaactggggtggcaagatggaccatgcgacgtggtggcattctggcatggtcgaaaaatacgcgatcaattggcttcccctgcatggcggcgccttatatttaggccatcatcctgattatgtcgagcgtgcctatcaagaattgtatacgcgcaatggctcaacggattggaacttgtgggcgaatatggtgtgggcgtatcgcgctttaaccaatccaagcgatgccgtctcgcaaatgaacgccaaaatcgatgattatggcgagtttaatccaggggatgaacgaattatggaacggggcagcacgaaagcacagacgtaccaatgggttactagcttgcatgccttggccaggt

SEQ ID NO: 7819 - DNA, 380 bp, Bacillus clausii
atgagactaggagctcgtatcttgaaaacggggcttgcagtcgtacttgccctttatctggccaattggctccaatttaatccaccgacatttgcagcgattgctgccgctttcgcgattcagccttcgctgtttcggacattgcggactttcagccaccaagtgcaagccaatttgattggcgctattattggtgtcctctttgtgatgacatttgggcatgcgcctttcgtagttggtgttgtagtaatgctttccattgcgatctttattaaattaaaattggagccagctattattccaacagcgattgtgactgtgatcatcatcatggaaagcccgtccgataatttcctagaatttgcagcacaaaggtttat

SEQ ID NO: 7820 - DNA, 339 bp, Bacillus clausii
atggcattgtttgcttcgcaaagccagagtctatttcagcacgctacgcacttattgagcttgctgctgccgatttttcttttctttgtaattaacttctgcatagccctagcaactggaaaatggttttcattctcttataaggacacagctagcctacagctcactgttctggcccgcaattcgccacttgctctagctgtagtagttgccgcttttcctggtgaacctttcattgctcttgcccttgtcattggccctttgcttgagttaccaatcctcgcgctcgtagcctatgcgttgttgtatataaagaagcggacccatgttttcgtctaa

SEQ ID NO: 7821 - DNA, 424 bp, Bacillus clausii
atgaacgtaaaacgatttgtagccccgacgctagaagaagcggcaaaagacattcgcaagcagttgggcaaggatgctgttatattgcacgtaaaagaagtgatgaccggaggactatttgggttttttggcaaaaagcaagtccaagtgaccgctggcattgacggaccgagtcatcgtaacagcaacgttagccgcgaaggtgatgataagcaatcaccgcttttaaaagaagcaaaccgccatttgcaacagctgggcgtgtcgaaccgtgttcttaaaaatttgcagttgacagcacaaatggcagagaagcaaggcgacgcccggacgaaagaagagttgcttatgcatacatttcgcgccagtttgcagctgcaaccattcgcgcaaaaacggcaacaaacactcattgtcgctgggc

SEQ ID NO: 7822 - DNA, 366 bp, Bacillus clausii
caaaacagaaaaacgctatgtcgaaaaaaagcttgaaacgtacaatctttatcgactgacactaacttatgaagaacttccaaaaacgacacagagctttcaattcgttcctgctcacacaggagctcgaccgttcttttctacaaccgaacagacagcgctaaaaaatatcgaagccgctcaaaaaagaaagaactatatgagcatgatcgaacaatgtgtcaatcgcttgccgcctgctgaacgtgagttgattgtccgccgctatttgcaagaggcagaccggttcgattatcaagtatacatggatatgctcattagcgagcgtcaatattaccgcataaaaaacagggcgtttacaaagct

SEQ ID NO: 7823 - DNA, 630 bp, Bacillus clausii
atctgggcgtgtgctcgggctcattgatgccgattggcaagtcgacgatgcggaaagggcattgcgagaagcaggcaaacatgaacggatgtacggcatgtatcctgtaacgttaacggaagaatacaagcaccctaatttccaagatacagggtatcttggcggctggggcatcggcatttccgtcgataatgaagacccagtcaaagcgattcaatttcttgattatctcgcttcagaagaagggcaaatcctgcaaaactggggattggaaggagaacactatgaaatcgtcgatggcaaacgcgtcatccctccagaagaaatggaggaacggaataacaatgccaactacgtgaaggaaacgggcgttggcgttttaaagggcttcgctccagcttacggcgatggtgtggaagactcgacagggcaaacattcacaatcgccaatacagagcaaatcatcgattcctatacagaagtggaaaaagaagttttaagcaactatggcgttgaaatgtggaaagacttatacccacaagaagacgaatttccagttaagccatggggagctgcttacaatattccagttgattcttcctccgatttgaatgtgatcatgcagcgttg

SEQ ID NO: 7824 - DNA, 423 bp, Bacillus clausii
acaaacctttgatcgattttgcctttacgagtttacaaaggaagcgcctcctttggcgggaaaactttttgttgttggcgcatcgacaagtgaagtgggaggcggacggatcggaaaacaaggttcagacaagattgcggctgaactatatgacgctttcgttcactttagcaaagaaacaggcgctcatctccttttccaatgctgtgaacatttaaaccgtgctttagtggttgagcgtgccattgcccatgcccaccggttcacagaagtagcggctgtacctgtacctcgggctggcggtgctatggctgcgtacgcctataagcatatgcaagaccctgttctagttgaacaagctgactgcgacgctgggattgacattggcgatacattcatcggcatgcatttaaagccggtcgc

SEQ ID NO: 7825 - DNA, 654 bp, Bacillus clausii
attaagcgccagccaaatcggcaataaagccttgtcttcgtcgaaaattacaattgcccctgctggcaccggcatacaagtgacttctgatcgaattagctgggtatcaaatgaaatgtatgccaatgctttagtaacagctggcgtacaagacgctgaagtatatgtcacagctccgtttgaagtttcaggtaccgctgctctcactgggttgattaaagcatatgagacagctgctgacttggatattccagaggagcaaaagaccgttgccaatgaggaaatgatccgaacagcagagctggctgaatcgattggcagtgaagaggcaaatgagttaattacccgagtgaaagaagaaattgctagcaccagcattgaaacagaagaggaaatgcggacgattattattaagcttgctgatgaaattaatgtgacgctatcggatcaggaaacggatgaacttacagcgttatttatgaaaatgaaagatcttgatattgattgggatcacttaaaggatcagctatctaaagtaagggagaactttggtaattttgtcgaaagcgaagaggcaaaatcattcctcgatagttttattgatgcgatgaaacgctttttgattccattgctgacctatttcgttcataataa

SEQ ID NO: 7826 - DNA, 568 bp, Bacillus clausii
  misc_feature (1)...(568): n = A,T,C or G
atggctgactcaaaaaatgaaacgagttatcgcgagattattacgaaagctgtctgcggcaaagggcgcaaattttcagaagcgacacattatatccgtccaccagagccaccgtcaagcatactcggctgctggattattaaccacacgtatagtgcgaaaaagcgtggggatacagtcgaagtcaatggcagctatgacattaatgtatggttttcgtataccaataacacgaaaaccgacgttgcaactcaaacggtttcttataccgacctcgtgccattaacaatgaaagatgacaatgtgatttccgaagaattggaagtttatgcgaagtctgtgcaacagccgaatacgctggaagcagtcatttctgaggacggccgcagcgttgatgtccaagtcgaacgggaatttattgttgaatgcattggtgaaacgaaagtggcagtagcggncaatccacaagggcttattgaagaatatccgattgactcacttactggcgaaattcgcgacgaagagtttgaacaaatcgatccaaacttcttacaagaagaaatcgacc

SEQ ID NO: 7827 - DNA, 139 bp, Bacillus clausii
ttgtgaaaaaaatcgttttagtgggcggagcaggaacgattggcgctattcttgccgaagggctaaagcataagtatgaaatcgtcgtcatggacgtgcaaaagccagacgacaatgtggcttttattgaaggggatgc

SEQ ID NO: 7828 - DNA, 537 bp, Bacillus clausii
atgcatacaatgacaaaaaagggaggagtgtacatgaatacgtccgtgttgcagtcaccttcattgaatttagcaggcgactccacaagaacactcaattaccaacgagatccacaaaactatattacccagttgtttgctgcccagcttcccgctatccccacgggattttttaatgtccatatgagcgcaggcattgtcatcacgccgcattggcatacgaacgcctcagagcttgtatttgtcatttgcggcaaagtacaggcatccgtttttaatccattctcccaaaagctgcttacatacgagcttgttcctgggcaagcggtcgtcttgccaagagggtggtttcattggattgtcgctttaaccgatggaactcatttactaacgatttttgataaaccgacacctgatatcgtctacggttctgacttccttcgctttacgccgggcagcattatggagcttgcttattgcgtcaatggcaacgcctatgaaaacgtagtcgcgccgattcaggaatcggcattctag

SEQ ID NO: 7829 - DNA, 201 bp, Bacillus clausii
aaaggaggcgttatcgatggcaaacggaacaaccgacaaaatgaaaagcgcagcaaacaaagcaaaaggagcaaccaaagaagctgccggaaaagcggcagacaataaaaaaatgcaagcagacggcaagaaagacaaactaaaaggcaaagcccaagaggtggagggcgatgttaaggagagggtgaaggattaaaaaaa

SEQ ID NO: 7830 - DNA, 198 bp, Bacillus clausii
aaatcgttttttcaataaagaacttgccggcggggcgattttagacattggcacctatgcgttatcgtttgcgcgcttttttttagaaagccagccacatgaagtgttgacgacggtcaagccgtttgaaacaggcgttgatgaacagtcgggaattgtccttaaaaacaaacaagaacagttggcaacaattgcact

SEQ ID NO: 7831 - DNA, 207 bp, Bacillus clausii
aagtggaaacccttaaaactgcatttcctatgggggtttgtatgattacggaagggtgttatccgattattttcaatgatttatggcgctgtgttgtttcaacagctgttgggggagctattggaggtgcgatgagtatgtatttagctgcagcatctccagttccgcatggtggcttatttgcaatggtcacaatgaccaatccat

SEQ ID NO: 7832 - DNA, 384 bp, Bacillus clausii
ccgcaatgtcgggttttttaaatccattcgcttcaaactgattattatttatgtgctgttgattgtattggcgatgcaaattgtcagtgtctacttttcccgggaactggaaagaaatttgcttgaaaactatgaaacactgttgaatgaccgcttaaatgtgctgtctttaagtgtcggccaagaattgcaagaagacccagaagaacgggaccttgatacgcttgtacgcaacgctttcccgcaaaacgatgagaatacacgcaaagggaaagcgcaagtgattggctataatagcgtggtgctggcaagctcttccgacgaagacgccaacattattgaccaacagactgaccaaacgattgttaagcgcgccttaaccgg

SEQ ID NO: 7833 - DNA, 192 bp, Bacillus clausii
gccagtcaggtaaaagggaagttagccatgctgctgccccaaaacaacttcaggcgtttttagctgaaaaagaaaaggaacatttgcgacaaacgcttgctgaagtagatggtgtaaagacagaagcggcgaaattacttgggatctccattcgctcgctctattacaagcttgaaaaatacaacctcgcat

SEQ ID NO: 7834 - DNA, 331 bp, Bacillus clausii
atgttatctggcttctataataaaaaaaaatggaagaggagtcgtcagatgtcattatatattgttactaaaaggtatcaaacgtgttatcctgatccactcattttagaaaaaggcgagagcgtccaatatggcgaggaagataccgattacccaaagtggattttttgtgaagcggacaaatcgcataagaaggggtgggtaccgaaacaatttttaacagttccaaatgaaaagggagaggcctatttgttggaatcctatactgcacacgagttgacagttgcagtaggacaacggcttattgtcaataaagaattaaacggctggc

SEQ ID NO: 7835 - DNA, 685 bp, Bacillus clausii
  misc_feature (1)...(685): n = A,T,C or G
gtgaagctgattgtaaatgcagatgattttggactatcccgtggtgtcaattacgggattgtggacgcccatgaactaggaatcgtcacatcaacgactatgcttacaaacatgcctgcaacagaccatgccttccaactaatggagcattatcccgatttgcaagtgggtgttcatttaactttgacttgcggcgttcccttaacgtcggactgccctacattaatcaaccaacaaggcgagtttcgtcttactagtcaatttcggcgagcaacacatgagatcaacgtggaggaagtggagaaagagtggaacgcacaaattcaacaattctatacaaaagggatcacgccttcgcaccttgacagccaccaccacatccatacgtgggagcctgtcatcccagtgatcaagcaccttgcacaaacgtatgacctgcctgtaaggactggctttaaacaagcacctgctggcattcgcttctggtctgatctactcgatcaaacttttataaagaaggcgtaaacaaggcctattttgctgaacttatcccaacaatacaaagggtatgatgggaccattgaagtnatgtgccacccagcatacatagatgaaacgttaaggaaatattcttcctatgttgacgaccgtgcccgggagcttaggattttgacacaagtgaaac

SEQ ID NO: 7836 - DNA, 303 bp, Bacillus clausii
atttgccagaagcgcctaaagtagaagaaaaagaactaaagacggcgttgcttttgattgaccagcttaccagtgaattcgacccagagtcatacacggatgaataccgggagcagctttttgatctaattgaacaaaaaaagcaaggaaacaaaatggttgtttcggaaccaaaagaagcggaacgggacacgaatgtgaccgatttaatgtcagcgctagaggcgtcactagagcggacaaagccgaagcggaaaaaagcggctgcatcaaaacgaaaaacagcaacaaagaaaaacgcat

SEQ ID NO: 7837 - DNA, 414 bp, Bacillus clausii
atgataccgattttcacatccactcttcccttctgttggacaattccttttccagtatacacacctttaagcaagatttcacgacttaaaactgaaaaaaccagctggcaatgccggctggttcaacctatcgctttcaatatcttcattgacaaagcgttttcgatccgtctggttatgcgtttttctttgttgctgtttttcgttttgatgcagccgcttttttccgcttcggctttgtccgctctagtgacgcctctagcgctgacattaaatcggtcacattcgtgtcccgttccgcttcttttggttccgaaacaaccattttgtttccttgctttttttgttcaattagatcaaaaagctgctcccggtattcatccgtgtatgactctgggtcgaattcactggtaa

SEQ ID NO: 7838 - DNA, 159 bp, Bacillus clausii
aatgacacagggagaactatccgaggcagtgggggtgacaaggcaaacgattgttgccttggaaaaagggcggtattcgccctcattattgcttgcccttcaaatagcgaagcaatttgaattacctgtagaagatgtgttttttttaactgaagagga

SEQ ID NO: 7839 - DNA, 357 bp, Bacillus clausii
agagaattccgttatgttaattgaccaaaaacaattcgacccttattacattttgcgcaaggaactcgatcctgtcgccttgcaagggtttgaatacaatttacagcttcacgatgtttcacaccgcgatttgattcattgctataattccttgttggaacaactgttgaatggagaaaatgaaacctccttccaaggagtcaacttcctcacatttcaaacagatgaacattttgttcttgtgcagcatcattttaaacgaaatttgacattggaaagcggacagcctgtgtacgaccgctttgagtttacaaccgataaaggcaaacgcaccatctccctatatacgaacgcatt

SEQ ID NO: 7840 - DNA, 255 bp, Bacillus clausii
ttttacagcctgctagactgcaaaaaggggataaagtcgcaactgtgagccttagttggggaggagctggagacaaggagattcgttggcgttatgaacaagggaagcggcggattgaagaagtgttcggtcttgaggtggtagagatgccccatacgttaagccctcctgacgaagtatatcgccatccagaaaagcgagcggcagatttcatggccgcttttgctgagccatccattaaagcgattatttcct

SEQ ID NO: 7841 - DNA, 315 bp, Bacillus clausii
atgaaaaaagctaaaggacgcatggatgaaagcattctcgtatgtgtttattacgggccaaacggcgaacgtttaattaaacgcggtgcgaaaatcgctaacatgcttgactgccctttatatatattaacggttgaccctctcccttatgatgaattagatgccgaaaaatcggcctatattgataggtggaaagagttggcggaagagtatgatgttgaagagtttattattcgtgataatgaaaagaaaccggcggtgaaagtaatcgctgaagtcgcaagagagcaccatattaccgccaaattattatcg

SEQ ID NO: 7842 - DNA, 543 bp, Bacillus clausii
  misc_feature (1)...(543): n = A,T,C or G
atgcatgagtttgtgacgatatgtataatggcggcagctttagggatggatgccttttctgtggcgctcggtatgggcatgttgaagttgtcaggcaaacaaatttttcgaatcggcctaacaattggtttgtttcatgtggccatgcccctcgccggaatggctgtaggaaaatggctttcaggccactttgatgtcattgcgacttatattggcgggggcttactattggtaattggcgtacaaatggtactaaacgccttttctgaccatgaagctgaaggcatgaaacccgctggttggggtttgctattatttgcggtcggtgtcagccttgacagcttttctgccggactgtcattcggcattcttggtacggaaatgtatttgacagtcgggatgatcggggcgatgagcatggtgatgtcatggcttggtttgatcattggctctcattttcaaaagtttttangtgcatatggcgagctgctaggcggccttgtgttgattggctttggcttaaagattatgcttcccctctaa

SEQ ID NO: 7843 - DNA, 462 bp, Bacillus clausii
tcgtcacaagcgtttcggccttgcgattgacgcgtttgccgaaaacagcgaacccctttggaaaagcacggaaacgcaagtgatggcgtcactagacgacctagaggaagcggctgtgtcaaaagatgcccaagctctgaaacgccaaataaatgcatttcattccctatacggcatgattcgtccggctatccacataagcacaactgaacaaaccgttgttcgttttgactcgtattttgctttattagaaaaccaatccgtatcgcctgagcaactggaagatcatattgaaacgatgcgcggcgcttttaaagaactttatgaaggtggtggcgaggacggaatagacccatcgctcttatgggcgattctgtctatcggtgggccgcttgttgtgtctttatcttatgttggttatcgaaaataccgggctgagaaacggcgagtaaaggcaaaaga

SEQ ID NO: 7844 - DNA, 330 bp, Bacillus clausii
gttagatttgttgattgtattaatggtaatcgacattatcactggtgttatgaaagcagttaagctaaaagacttgcgcagtcgggcagccctttttggttatgcgcggaagatcgccatatttggcattataattgtcgcgaatatcgtggacagaatactagacctaaacggcatggttgcaacgacaactgtgcttttttacatggcaaatgaagcgctgtctattgtagaaaacgcaagcagaattgggctgaaagttccgccagttatcatggaaaaactacgcggctttgacgaacacggccctgagaataaaaaggagagtga

SEQ ID NO: 7845 - DNA, 436 bp, Bacillus clausii
atgatcatgttaggttttaataagaaaaccgagtttattatattaaacaaaatagaagggtttgtcgctatggagaaaaaatattgggttcccgcgattgggagggcagataacattttaaatcttattgcctatcggcccaatcaatatcggttaattgatctctccaatgaattaaatattaataaaagctcactttattcattactaaacacactcgaaacgctcggctgggtgaagaaagggaaggatgatacgtattcccttggaatgagatttggtgtatttagtgctttgtactcgagtcaatttgatttaattggcacgttttcggaggaggctgcgaatactgtcaataatttagatgaaacggttcagctttcgattttggatggtgtccgatattttatatttggcaaagaaagaggggagttcc

SEQ ID NO: 7846 - DNA, 548 bp, Bacillus clausii
cacttctggacgggcctcagtacttgctgcccctatatcgcgatttgtcgaaacaagcggataacgagcgttttacaaaagcgcttgcgctattaattccgactgttattcttttggcaacaaatgcaaccttgatcggtgctagctcccatttgattgccaatgactatttaccgacactcggacacgagcgtatatcgtttgtccagtggctaatatgggggatgccttttgcctttttggccagtataggtgcctgcttgatgattgggtggttgtttttagacaaacgggcgcggcaactgaatttccataatgaaaatcagatgtcagagcctatgacttctgctgaaaaacggactgttttagtcatagtcgccatggtgggtttgtggctaactgaagcgacccatgggattcacatagcgaccgtgacgatcattggcgctttcactttgcttatgcctaagataggggtaattaagtggaaagaaggggtagaggctgtttcatggaatttgcttctttacgtaggggcagcaattgca

SEQ ID NO: 7847 - DNA, 530 bp, Bacillus clausii
ggaaaagtcggcagcatggtatccatgtttttttctgttgataagttgacggaatatgtgttgcctgaaattaaaaaattccttcaggacgaacagacaaaagaaacggtgcaaagcctgcttcaaagtgagtggcaccgtatgctcaaccgaccgctcgcttcttttcaggcagagaactatgtcgatcagttggtcgataaagctgcagaagagcttgaaggcaagatacctgttctaaattggtataacgcacctttgcgtacatggacaactccttatgcagaaccgctcgttgaacggggtgtccctgtcattgtcggcatggtgacggcttacatggaacaacatattgctgatatccttagcaagctccgcctggaggaagtgattgaagcgcaagtagcctcgttctcaatggcgcatttagaaaaattaattatgaacattacgagacgggagttgcacatgattacccttctcggcggcttgattggcggaatcgttggcctcgttcaagccgttatcgt

SEQ ID NO: 7848 - DNA, 276 bp, Bacillus clausii
ttattgaccattgtgatgtgataggctggttctcaggcgatcaactcgtttcacaaatggtcgtctacccattttcggttaacatccatggccaaccttttcaaatgggcggcgttacaggagtgggcacttaccctgaatatgcaggccttggcttaatgaatgacttaatgaagaaaagcttaacaaacatgaaaaaccgtggccaaacgatttcttaccttttcccttactcgattccctattaccgcaaaaaaggctgggagatcatttctg

SEQ ID NO: 7849 - DNA, 111 bp, Bacillus clausii
aaaaagggcggtgccagaagacattccggtcttttcctgggaaggcgacaaagaagtgccgttaattgatttgcttgttacgttgaacatgcagtcttcaaaaggtgaagc

SEQ ID NO: 7850 - DNA, 317 bp, Bacillus clausii
aatatggatgcttcaataggattatttattcctgttgttgtatcgatcacatatgttctaataggttatgtcggtagtggtacagaatttgctaatgtagctactagcgctgatttccaaagtgaaagaagaaagatagtaggcagttcaatcactttcggttttatattttctctactttccattttggtaactggtcttccaaaaacaattggagatttcttaactatggcaggcctaggcgtaatagcgtttatcttgatgttcttattaaatatgttttctttacatcgatcttataaaaaaaacaaagactt

SEQ ID NO: 7851 - DNA, 246 bp, Bacillus clausii
atggctaaaataggggtacaatcgaatttgtcagatgtacagcaagagcttcagtccaaaggctatgaagttgtacaaattgaaaatgaacaagatgggcaagactgtgaatgctgcattgtttctggaagaaatgccgatgttgccggcatcagtgttcctggacaaatgagcattatccacgcagaaggcttaagtgcagaagaaatcggccaacgtgtcgacgaaattgtgactcaacattaa

SEQ ID NO: 7852 - DNA, 119 bp, Bacillus clausii
tatttgcgattaatgcccaagcggctgctgattttgttcctgtagggcttggcttagccgaggcagaacctgaaacggtcgaagtcggggttcccgccgttttatacgggaggttctta

SEQ ID NO: 7853 - DNA, 702 bp, Bacillus clausii
atggtctttgccttgttgggcgtagcgcaagaccggttccatcgagaacggtggcagtggcaacaggtcggcgatggaagcgcgaatcgattcaatcgctgtcgcgtctgcgatcgcatagcgctcgactcggtccaggccgtttttgacatcggcgagaaattcttcccggatcagggcggagctgctttcaaagttgagcaaattcgagcggatttgcttcaattgttcgatgtattggccgatgaaaagctggaacgctgccaatacagggagatggagcgtcgcaaaatggtctttgattgcttcgccgccttcgccttgcaaggaatcaaggtgaatgatcttctgaatgctggcctgcaagcgttcaagctgtgcttgatcgtgaagctttcgttccacaatttcgtcaagtgcatcgagtacttcttgtacgtcaagtgtgttcatccgtctattcctttctctattatcggcggcttgccagcatctcgtccacgactccgtacgtttgaaccagttctttcgtttctgcttgtacgtttttcaccacgtctaagtagcgatttaattgttcagcatacccgctttctacttccagcaatgaatggagaaaggccatcgacgacgtatggatcgcaggctcgtgatccgacacagaatagctggcctgttcccccgtttcgcttaaagcgctga

SEQ ID NO: 7854 - DNA, 291 bp, Bacillus clausii
ggagcgattgcgggcggcaaaacaagcgcttgtttccgaacaagcgactcttcacgaccataataaatgagggagcgaaccagagctagaccatgatgcgtggcgcggccaagccgaatcgacacacgatgacattcgccaccatatgcgacaggcttacacgaacgtacaagacgaaacggaacaactgatgcgcgtgattgaaatggaaacgagtcgtctccaaacaatggtgtcttcttgtcaagtcgtcatcgacacaaagcaacaatcgctccaaacattaaaagc

SEQ ID NO: 7855 - DNA, 111 bp, Bacillus clausii
atgggatgattgaacaagggtctaggcttccgagtttgtatgtggcccttgccatttccgatttgtttaaggctgagccgtctgcgttgtttggtgcccctaagcgcaaac

SEQ ID NO: 7856 - DNA, 335 bp, Bacillus clausii
atgaaaaaatcgctgctctacacggcggcagcaagtgttttacttgttccgctagccgcttgcaacagcgcagaaacaggaaatgacgggaacggaggcaattcaaccgacacagtcacagtctggacatacccagtacatgaagagtatgaaagcgaattgaaagagtcaatagccgagtttgaagatgccaatcctgatataaaaattgagtatgaaatcctttcctgggcagaaggagagcaaaagtttgatattgctttaaatacggggagcccgcctgacttgtatttcggcaaagcgctcggaaaatacaaagaaacacagctcttagt

SEQ ID NO: 7857 - DNA, 350 bp, Bacillus clausii
atgacgatcgaggcgacgagagtgaggacaaaacgcaggaaatgttttgtaagttccgatagtaatcgcaagcgcgggaagtggaaggtgctttttgcagctgttgttctgtcattagccgtgactccatcagagcttacggctgaaggcagaatgtctctcattatgttaatattggctatttattgttggctgtttacggctcttccgccagcgatggtcgctttaggcgcactgttattgcttgttctcacgagagctgtcccgcaggaattgctctttgaatctctttcctctgacgtaatttggttaatgttagggacatttatgattggcgcctgtatgcagaa

SEQ ID NO: 7858 - DNA, 506 bp, Bacillus clausii
atggcggtaattggcggtcttggaggagctttgttcagcccagcactgaaatctttattgatttacaaacaaccgaaagcgcatcataaaaagttgttctcttacgtgaatattacgggcaatgctggtacaattcttggccctttatttggcgtgttgttttcagcgcaacaatttccgctccttagcttgctttccgggcttttgtttattctaattggttgtacattattaggattgccgatccaacaagaaacagcaaatagcgacatttcgttcttatctggattaaaacgaattgtcgccaatcagccgcttttaatgatgattgggctgatgatcccttatcattttattcaccagcaattatttttaacctatcccgtcgttgcgacaaaaatcagcggcagctcaggctggatctttacacttgtcaccgtgattgtcatcacaacacaaatgaaagtaacagcttggacgtaccgtttcaccgctcgccaatcgct

SEQ ID NO: 7859 - DNA, 621 bp, Bacillus clausii
atgagtgtagacacatttatgggcacgttgtttggcccttattatggcttgtttgcgatctatccgtttttagtttacaacaaagggtatgtttacacgcttgcacttggagggacaagaaagcagtttttgtttagtatgctagctgcctctggcttgtttattgtcatttgcatgactgtgttaaatggtatttaccaactaaatgcgtttttgcttaaccaaggaataatcaatatacccctctttcatatgggcgaattagttggttctgccaatccgttgctttatttctgggttgatctcctttggtgtgtgtttctgtttggcgttagcttcggtattaactctgtctggttttattttggaacggtccgtttcttgttaggcttaaccggagttgcactagttgtcattgcctatttggcgtttgctgaccttcgcacattgtttacttggattgttgaaaaccatcttgtctttttacatgtcattggcgcagtcggcttcgcagctgccggtctttcatatgtgattatgaaaaatggcccacttgaacgaggcgggagagaggcctcttctttaaaaacaaaaccgttcaagactaacgagctggtataa

SEQ ID NO: 7860 - DNA, 94 bp, Bacillus clausii
atgaacgagaaaaaaacaacaattatcgaaacggcgattcacttatttgccaaaaaaggctacttttcaacgtctattcaagaaatcgcatctg

SEQ ID NO: 7861 - DNA, 369 bp, Bacillus clausii
taaagtgttcggccatgtagaagcatcaaaagatttgaaattgctccttgtcattggcggcctttatgcactaagtgtggcgctttccaatacatttgtaaatatattcttgtggaaacagtctgggaaatttatggacctcgctttatacaatttaatgtctgtcatgttgcagccactcgcctttatccttgcagggaagctaacgaaaagaatcgaccgcgtgtttattttgcgcctaggcgtaagcattatgtcgcttttctacatcacggtgcttctagccgggtcacatgccgcggattatttgcttttgcttggtgcgttgcttggtgctggcgctggttgttattggcctgcatttaatgt

SEQ ID NO: 7862 - DNA, 346 bp, Bacillus clausii
atggaaaacaacaaaaaaacgatgtcttttcgctttgatcacaacgaaccactgccgcccaaaaagacacccgctaaaacgagtgaacaagaagaaagcccgccactggaagtattgacatgggatgggacgccttttcaaaaaccggaagaaacgataaaagaaagcagcagtgaggatgaatttttgccgaagccggacaaagtcattgatttaaacagaaaacgggaagagcgtggacaagaggaacgtttttgggatgatggcaaccgttcaaagtcgccaaagctgcctccgaaaaaacggaagcgtcctacaaactggacggcaaaagagtttccatgga

SEQ ID NO: 7863 - DNA, 542 bp, Bacillus clausii
atggtgtttttagtcgtcggtgcagctgtgatggttagtttctgtttatggctgtttctccgttttgatgactatgagccgctgctaacaaaagaagccgttgccggtgctgatggggatgagaggccattaaaggctcgttatccaaaaacgtcgctgccattggttttatttggctcaatctttttcttttgttatgttggcgtcgaaatgacgttcccgaattatttgccttcgattttagcaatgacatctgacctttccccgtctgtgcttgcccttagcattaccgtcttttggggggcgatgacgattggccggatgatcatggtctttgtcgtcggcaaaataaacgtcgcgaccttgtttttgcttgctgtttttggccagttagcgacgctcggactgtttgcaatttctccccattacatcatcagttttatcgtcatctttttcgcagggttgctaatgggaggcatcttttcgttaggattgcttgtcgtcaatgaagggctaccagggcttgaagaccggccaacgag

SEQ ID NO: 7864 - DNA, 441 bp, Bacillus clausii
  misc_feature (1)...(441): n = A,T,C or G
aatcgtagaccagaagcggctaggcggcggctctcattccacaatgggcacaattactgatatctcaccgattctccgtcttcttttctccagagcaggccagccctacgttggagaatcaaacatgttctcctttaacgatccccaaggtatgtgtcccgaatgtaacggtattggccgcaaactgaacgtcgacatggacaaagcagttgatctgtcaaaatcgttgaacgaaggggccattaaactacctgattataaagtcgacggttgggactggtcattggttgtacaggcaggaccctttgaccctgataaaaaactgagccactattcggacgaagagctagaaaaactgctttacagcaaagcgaaaaaagtaaagatggactttgcaggaaaagcancaaatgtcacagtagaaggcgtgattgagaagtt

SEQ ID NO: 7865 - DNA, 282 bp, Bacillus clausii
cacagtcgagtggcaaaacattggcgacgacggccattctttggatggatctttttcgtttcaagtaaatgcagaggaagaaacaactcctgaagatgaaagtacagcggaagaaaatgccgcaaacgaaaacgaagtgaagcaagatcgtgaccacgaagcaagtggaccagaagaagaagaaacgaacacagctggcacgtctgtgctttggctttctatcattattgctggcctttttattgtagcgctcgtcatttttaccgtttcacgcaaacgcaa

SEQ ID NO: 7866 - DNA, 645 bp, Bacillus clausii
atgatgcctatttatgatgccattaaaaggaggtggtttatgccaggaacatgcgctataatacacaaaatggaggcgaatgaagtgactgaacaaatcctcaagatactgacaaagttagacaaccagcaagaaaagtggcttgacgaatttgataattttaagcaaaatcaattcgcttttaatgacgaaatgcgcgattttggaaaggaacaacttgctttcaatgacgaaatgcgccatttccaaaaggagcaacttgctttcaatgatgaaatgcgccatttccaaaaggagcagcttgctttcaatgatgaaatgcgccatttccaaaaggagcagcttgctttcaatgatgaaatgcgccatttccaaaaggagcaacttgctttcaacgagaatcagcgcaagtttaacaaccaacaaaccaaattcaaccaaacatttgaggcttttcaacagaacacagagaaccggcttgaacgaatggagaaaagattgaatggggtcggctatctaattgaacatagcactgccgaacggttagaagacaaaaagcgggcagataccgttcatgattttcttatgtcaaaaatggtctcactagagcaagaagtgttctccttaaagaaaaatcatctttaa

SEQ ID NO: 7867 - DNA, 354 bp, Bacillus clausii; identical to SEQ ID NO: 7671

SEQ ID NO: 7868 - DNA, 150 bp, Bacillus clausii; identical to SEQ ID NO: 7672

SEQ ID NO: 7869 - DNA, 696 bp, Bacillus clausii
atgggcgttggcttttatgcgaggcatggggcagtgttattcgaaggaagaacgaaattaaagtcagtaatggcagacattaaagactcaaaacatataaaaaagttttctgttgcattcaatggagcaacaacaattgttcaaaaaggatatgaaactgctatctcccacatttctcagcaccccgtagcccaaaatgtcagcaataagataaacgatgcttttaagcctggtgggaaacttcatgcaataacaaataaccgctttacaaaggcactaggacctgtgggttatgctcttactgggatgagtcatcttacagaatttacggatccggataatagagacaaatcgattctagttaaaggtgccagagcacttgctggagcatctacagaaattgggggagctgctgcaggtgcatttattgggggcgcacttttatcgccaatcccagggggtgcctttgtcggtgcggctatcggtggttatatcggtgggaaagcaggtagtgaaatcgtggacgatgtgaaagacgcggctgaatatgtattttctggccagattatagatgacgcaaaagaactaggcacaaaagtaattaatcaagtggcagatgtaacagaaaatgtaacaaaatcagtaggcagcatatttaaaggggctgcggatagtgtgcttgggtggtttagttaa

SEQ ID NO: 7870 - DNA, 1053 bp, Bacillus clausii
gtatggaagatgaggctgttgagtttctttcccttttttacgaggagcatcgcttagacggcaaagaagcgcggatacacgacgtttgcgaagcgatccgtacagacggcacatacgagcataccgctgaggagcttgcatttggggcgaggctcgcttggcgtaacagcaatcgttgcattggccgcctgttttgggaacggcttaccgttattgatgaacggaaagcacatacagaagaagcggtcgcacaagccctttttaggcatatggaatatgcaacaaacggtggaaaagtcattccaaccattacggtattcaaacaaggggcctcgatccgtatttggaatgcgcaacttgtccgttacgcaggctatcgcagtgatggccgcattattggcgatcctgcttcccttgaattaacggatatttgcaagcagcttggctgggttggcgcagggagcgattttgatgtgcttcccctagtcatatcggtagggacacgtccccctcaactattccctatcccagagcatcttattaaagaagtggcgcttgtccaccctgataacaaagcatttgctagactgaaccttaaatggtacgcagtcccgtttgtatcaaatatgcgccttgaaattggcggcatttcttattacgcagcgccgtttaacggttggtatatgggcacggaaatcggcgcccgcaatttagccgatgattttcgctataaccgcttgccagaagtggccgccgtgctcggaatcagcatggagcgggaagcatcgctatggcgcgacaaagcgcttgtcgaattaaaccgtgctgttctctattcgtatcaagagcaaggcataagcattgtcgatcatcatacagcagcaaaacagtttcaacgttttattggcaatgaaacagaagcagggcgcgacgtgacaggagactggacgtggctaatcccgccgatgtccccagcgcagacggacatttttcaccaatcgtttgataatcgcatcgtttcgccgaattacttccacgaaaagccaccctatt

SEQ ID NO: 7871 - DNA, 168 bp, Bacillus clausii
tctctgaaagcgtccgctctctttatcgtttagaaaaagcggaacaggttgtcgtcgacagtgatgtcctagaatcaatgggggtgacgcctattaaaggccgttttgtccttgaggcgaatcaaaaattgcgtcatgatgcgatgaaagtgtcaaaagcactaatga

SEQ ID NO: 7872 - DNA, 934 bp, Bacillus clausii
gtgtcttttgccgcgaatgccaaaaaagaactgacacagcttgaacttgtttcttgctgtgctcgggcagagctttctgccctcatccggatgaacgggtcgctgtcgcttggcaataagcaagtcggattagatgtaacaaccgaaaatgcagccattgccagacggatttacacacttatcaagcatctataccctaatatccacattgagttgctcgttcaaaagaaaatgcgacttaaaaagaataatgtttatatggtgcgcatttccaaagaagcgcgccaattacttgaggatttgcggattttgaacgggtcttttcaatttattcgtgacatttctccggaaattgtaaaagagtcttgttgcaaacgtgcctatttgcggggggcttttttagcaggcggctccattaaccatccagaaacgtcttcttaccatttagaaattttttcgctttacgaagagcataaccaagcgatatgtgaactgatgaacggattttccctttcagctaaaacgcttgaacggaaaaaaggatttattacgtacttaaaagaaagcgaaaagataacggaattcctaaatatcattggcgcccaccaagctcttctttattttgaagacgtccgcattatgaaagatatgcgcaactctgttaaccggcttgtaaattgtgaaacggctaatttaaacaaaaccgttggggctgccctttgccaagtagagaacattctttttattgataaaacgattggcttggaaaacttgccgccaaaactacaggaagtcgttaagctccgagtgaagcatcaagatgtgacgttgaaagaattaggggaaatgatgcagggcggaaaagtgagcaagtcaggtataaaccaccggctccgtaagattgacgaatttgcggacaagctccgtaacggca

SEQ ID NO: 7873 - DNA, 201 bp, Bacillus clausii
aggaggcgttatcgatggcaaacggaacaaccgacaaaatgaaaagcgcagcaaacaaagcaaaaggagcaaccaaagaagctgccggaaaagcggcagacaataaaaaaatgcaagcagacggcaagaaagacaaactaaaaggcaaagcccaagaggtggagggcgatgttaaggagagggtgaaggattaaaaaaacg

SEQ ID NO: 7874 - DNA, 396 bp, Bacillus clausii
atggattattcagcaaacattacccggttgagaaatgaagttggttcgcttcgtggggaaattgcgtccatccagcaagatatcaggcgtcttcaagaggcgaaaagcactcttatggaacaacaggtctctttccatcacgaaaaggcacagttacaagaaccagggttaaccgctggggtatggcatggaaacgaagcaaatgaccatgacaccaagcgttctagtttagaaacgtcttatcgagcctctgaagaccagttggaagagatcatttcctcaattgaaaggaaaatcaaccttttgcgaagtgatattcaacacgcacacacacttattgacgttaaacaatcgcaagtagcgatgttcaagcgtctgcaaaatgaatcagggtga

SEQ ID NO: 7875 - DNA, 945 bp, Bacillus clausii
atgaaaaagtatgttgcctctgaatttttctctgccctcgataagatcgactcggacatgaatcagtacacagagacattgagcaacgttcattctgctattcaaggcgtcgtgaacttgggagacaatctcacagggcaaggcggagaagcactcaaaaacttttatgcaaacaaccatgtaccgctgctttcctactggacgatggcctgccaacaagtcaaaatagctacggcaaaaatgcggatgaacgcgctaagctttgagagcagcgatgcagtgattgatgaaagctttattgaaggagaagtcattcctcaattagaaacaaaccagcgaagaatcgaagaacatgagcacaaaattaatcatatcattgctagcgtctctgacattgtatctttgccaagacttgacacaagcgccatacagacagggatacacgaggcgaagcagcatgcaatgaatacggttgaaaagctctatgctttcgaccatacacaatcagcagcggtcgatcaactgatttcgttgatggcgccaattagctcgtttgttgccggcttaaatggagcgattgaatcaggtgttagcattacggcacttgccggctacattgcttcccaagatgtgccgccagaaataaaagcgatgcatccgatgctaaatggcacgtataatgtattgactccgtatcagaactttcaagaccaagccgtacatacacagaatttcttactttcgccaaacccgtttggatttatttattttagcaatccgtttatcttaaatgcggctaagcgactttatttggctggtggccatatcgatgtggtccatcattattcgccagatcatcagattgcaggaacaactattgatgcgaacggaaacgagattgcatcttccgcttacaccgtcgacgctgaaattattaatgattgg

SEQ ID NO: 7876 - DNA, 300 bp, Bacillus clausii
gtatgagacgtttgaacaggagacggagtggtctttatttggctatcgtttgccgattcagttccgtacgatcgaacagcgtgaaaccttagaatttactcgcacgtatacaaaagaggaagctgttgcagtcgcgaaagaggaagcgcggcgggagttaagagagaaaattccagaagatgcggaaatcatgtctgaacatgttttgcaagaagcggtcgaaaatgataaagtttctttaatgattcattaccaagttctagaagaaattgcacgcgaaaaaccaattatccaaggaga

SEQ ID NO: 7877 - DNA, 108 bp, Bacillus clausii
gccaatcaatgaacagatgttgcgtgttatgatgcagcaaatgggtcaaaatccgtcgcagaaaaaaatcacgcaaatgatgaaagcgatgcaaaagcaacagtctaa

SEQ ID NO: 7878 - DNA, 363 bp, Bacillus clausii
aaatcggcactaagccagttcagaaagacgaaatggaatatgaattcatgttgaattttaatgtcgatatgaatcacatggcaaaagcatctaaggacaacacccatctttttggtgaagaagaatttcgaattaccattaatgacggtcgccgtctgtttcgctggctcgaacttggtgtagacgtgaaagcagaagaagccgagcggagggcaaagcaagcggaagcagacgagaaggagcggcagcgtctattggctgaaatactgaacgctgtggaaagagatgaaaagaaacagaaagagcttgtcggaatggaatttaagatgaacgaacagaaggtacacgattttaatttaaaag

SEQ ID NO: 7879 - DNA, 274 bp, Bacillus clausii
atgtttaaagtagattacaaccaagtgagcgaatttgaagagtttaaaaaaggggaatacgaagtaactgttgttggctatgaaacgaaacaggctaaaacaggtagcaacatggtcgttttgacttacgaggtgcgtagcgatgtcgaacaaccatgcaaagggcaaaaaataaattacgataactttgttgtctcagataaaagcatgtggagattccacgccttgtcaaaagcggtaggagtgccggagggaacgccgttcgaatcatata

SEQ ID NO: 7880 - DNA, 700 bp, Bacillus clausii
atgacgcttcatttagcagaggcgtttttacaaaaaggcaagcaagtcgatttgcttgttatccatcctgatggcgaatacaaacaagccgttccaaaaggcgtcaatcttttcgcgtttggcaaaagaacggcaaaggaggcattgccagggatgatttcttatttgcgccgggagcagccagacgtggtttgttccgcaaaagactacttaaatgtactcgttattgccgctaagaagctaagcttttcgaaagcgcagttaatcgtctcatgccgcgtccatttgagcgagcaagcacggaaacagccaggccagtttggccgcataaaaacagcagtccgttacagttatcgttttgccgatgatgtcgttggcgtctccaaaggcgtagctgaagacataaaggcgattgcccaattgcctgatgaaaaggttcatatcatctataacccggttgtgacgaaaacgttagaggaaaagatggaacagcctgttagccaccgtttctttgaagaaaggaatgccaaagtcattgtcacagttggccgcttgcatgtgcaaaaagactaccctacattattgcggtcatttgcgaatctacaacaaaacgagttgcccgaagcaaggctgctgtttataggcgatggggaagaaaaagaatcgttgcaaaagcttgctgcagaattagaagttggcc

SEQ ID NO: 7881 - DNA, 801 bp, Bacillus clausii
atgattacatttgtcgtgccaacgcttggtgaacgatgcaacgaatttaaacgattgcttgtcagtttggataagcaaacggataaacggtttgagttgattgtcgtgtctcaaggcaattacgaccaagtagagcaatggctgagcgctttccagttgcgctcgacccatattcaactaggggaaaagggcttatctagagcgagaaatgcagcttggccagcgctgaaaggcgacattgtctctttttccgatgacgattgctggtacccgcctgatgcagtcgaacgggtacacagcgcgtttgcgcaagagggcgctgatgcctactgctttcaaatttatgacccgatccaacaaagcccgtataaacactataatacatcgcctggtactgtccgaggacgacgcgtttggaaaaagtcctccattgagctgtttttccgccagtcagcgattgaatcgctgcgctttaatgaagcattcgggcttggtggaacgtatccaagcggagaagaaaacttgtttttgcggcagtttttagtggcaggccatacactgatgtacatacctgaaacaattgtattccatgagaaaccgtctcaagcatcacggctccaggaagcgcaattggtcagcaaaggtccgctatttaaaacaatgtacaacgggccgtttggcttcgtcttgcttacagcattgtttgctaaaaaatacaaacacttaaagcatccaactgcgagctatgcgaaagcggtacgggcattgctgaactataagccgaaggaggcaaggccgtga

SEQ ID NO: 7882 - DNA, 618 bp, Bacillus clausii
tgattgcccctgagcaagtcgtgctgcacagctctgaagggacgtattcgctcataaaaaatggctcttcgtatttttctcacgttgtgaatcaattgtttgccgaagggcaactgcaatcaatcaaccgcgactatgaagacatctccgccgtaagcggaattgaattgatttttcccgatgcagtaccgaaagaatttgtgctgaaacaattcgggatcgatcatgaagattttcgcttcaatttaagtgccatcgatcggatgtttgtctatgttagcccttatgacggcggggtcaacatccaatttgcctcattttaaaatgaaagcttatttacggttggctctgcgatggatcctgaattgcttactgatttgctcgaatctggggaggaagcagacatcgaagaggctgtgattgtgaagcaaaagggtgatgacaacaaattgttgcaaaaccggctgtacgtcagcagtgagccacaaaaagtgagagaaaagcagtatgagcttgcccgtctagacatcgggcaaatcaaccagcgtttgtttaacggcgcttctgatgtcccccggcaaaaccagcttgatgggcaaaatgtctacaccgatggca

SEQ ID NO: 7883 - DNA, 494 bp, Bacillus clausii
atggtagcgaaaagcgaaaaagaagctctattattggatagcgacaaatgttttaaagcgctgcttgaaataattgaatcagtgcctagcagaaaacggactattacgattgaaactcacgaaagagacaagaatttccgtgatatcatcatgcatctgtatgaatggcatacaatgcttgagagatggtatagagagggtatggatggagatgttccatttatgcctgcaccgggttataaatggagaacgatcgagttacttaatatgcaaatttgggaaaattatcaagatgtaacattaaatcaagcaataaaaaagttgaagttaagtcatgaaagagtaatggatctaattcgattacatacaaatgaagaaatcatgacaaaaaaatattataaatggactaaaacaagtaacttatatagctattttgcagcaaacacttttaatcattacaattgggctataaaaaaatgtgaagttattgcgaa

SEQ ID NO: 7884 - DNA, 1005 bp, Bacillus clausii
cagccattccggcatcggcattaaagatgtttcaaggtattaacatctttactttattggcgattcctttctttgttctggcaggcaatattatgagtaaaggcgggatagccgtccgcttgattcattttgcaactgccttgaccggcaggataccaggctcccttgcccatacgaatgttgtggccaacatgctctttgggtccgtctccggttccggcacagctgctgcatcagcaatgggaacgatcattggtccgatccaaaaaaaagaaggctacaatgaggatttttcagctgcactaaatgttgctacagcgcctacaggcctgttgattccaccgagtacggctttgattacgtatgctttggcaagcgggagcacttctgttgcggcccttttccttggcggagtgatcccagggattttatggggattaagctgtatgcttgtcgtctacttttatgcgaaaaagaatgggtatgttgctaaaagagctataagcgccaaggaattttttagggtgacctttgacgccctaccgagtttgctgttgattgtgattgtaatcggcgggattgtaagcggtattttcacagctacggaagcatcggcaatggcagttgcctatagtttacttttatcgatgttcctttataaaacaatcacaataaaagagttatacactattctgattgacagtgccaagttgtcggctattatcatgtttttaattggtgcatccaacattttggcatgggtgatgtcatttactgaaattccaaccttgattgcggataccatattgggcatttcagataatccgattattattctattggtgatcaatttactgttgttgtttgtgggcacatttatggatttgactcctgccattttaattttcacaccgattttgcttcctgtatgccaagcgttggggatgactccgttgcattttggcattatgctgacatttaatttgagtatcgggaccattactc

SEQ ID NO: 7885 - DNA, 207 bp, Bacillus clausii; identical to SEQ ID NO: 7498

SEQ ID NO: 7886 - DNA, 667 bp, Bacillus clausii; identical to SEQ ID NO: 7689

SEQ ID NO: 7887 - DNA, 426 bp, Bacillus clausii
atggggcgtttgcttttacgaaaatgccgctatgaaacagtgacagcgctccgctttctcttggctttgcccttgctcagcgtccttgttttgacctcgccagatgcatggaacgagccagcttctgctgcagctctcgtctttattagcataaacttactagcttcagcacttttgccaggcttggtctcgatgctactctattaccggggcttgcaggcaattaaagcttctgtagctacgattgccgagcttagtttcccaatggcaggcttgcttgtctcctgggtgacgatggaagaaaccgttacgtttccccaagcgcttggctttgcgctgatctgggttgtcctttatcagatttccaagcaacaggatgccaaagaagtattgccacctttaaaaaagcgggctgcttccgcataa

SEQ ID NO: 7888 - DNA, 353 bp, Bacillus clausii
gtgttatatattaagattcaggaattacataagagaaagtttaaagtagcgcaaatcgctaaggagcttaaaatctcaagaccgactgtctataagtacttagaaatgacattcgatgaggcaaaggcgtatactgaacagcccttgggaaagaagaaaaaactagatcactataaggactggatactggcctggctcgaagagtatccccacctaagtagtgctcagatccatgattggcttttagaaagataccccgacctagtggtcggcggaagtactgtaagaacatatgtgaggggggtgcgagaagtttatcagattgagaaaaaggggattgtccggcaatacga

SEQ ID NO: 7889 - DNA, 588 bp, Bacillus clausii
atggcgattataaatatggtactaaatcaactatttgattatacctatttctatatttggaataatttttttagttctttatttgttgttgcggtagtggtacttttactagacaactttaaagcaaaaaacttgtttttcttcatcatttggcaactatcaacccttattttatgtctcgttttagcagaaaaatatgaggtattaagactaagtgatgcagcaggtacatattactttttaggttcagtatttggtaatatcctctttgtggagggcacttttttaggggttgtacttgaagctatattttatcttactttatcgaaccgaattaatttaattattctatatagctccttctccttgtgtttttatatgcttcatttaaaggtaagcaattacggaaacccagtcattcacacatatttgtttccgtttgcagactatcaatggatgatggttttcgcccttccatttttattgctctataatggcaacagagggattggcttaaagtatatcttctatattttttatccattacacttaattattctgtatttattggctgtgtctcgattgtag

SEQ ID NO: 7890 - DNA, 168 bp, Bacillus clausii
tgtctgaaatggtacaagttagcgattcgacattagacaaccacgccttaacagtggaaggcttaaaatatgcggttgtcgtcgtagccagtttgccaatgttggtgttgtatccattcttgcaacgttttttcgtaaaaggtgtcatgattggttcaattaaagggt

SEQ ID NO: 7891 - DNA, 2421 bp, Bacillus clausii
atggcttaccataatgagcaaacggagatgatggtgcaagcgaacgctcaaaatggggagcttgtcaaccaagcagtggctgactatcaacagacattgcaggcagggagcggcaacgtccaggaaggccagcatgcgtttgcgccacagctttccaatgaaggcgacaaagtggtttctttgtttgacgattgggcaatcggcgcctataagtttaatggcgaaatgaatgggtttaatagcgaaataaaccaagtatatgctgcccaagatttagccgtcgatcggctgccaaatgcacaggctgaactgattggaaaatatgcaaatgcgacgcaaggagaacgggcagaagctcagtttcggcaaacgttaagtgtgcgccggcatttgtcaaaggacgagcggcctccacagaacatccctcgccctgaacaaccagaggaagcactagagccgattgacgaagacctactgaaagacgcagaagaaacgattgccgagattgaaaagctagtcggcaagttaaaccctgaagaaattgaatttccagagccgccgccaccagaacctgagccaggcgatggggacggagatggcggtgacggcgacgataatgaacagcctacaccaccagaaccaggagacggcgatgacgatggaaacggtggagaggaacccccgccagagccaacagagcctcctgaagatgaagatagcgatggagacggcaatggcggtggagatggcgacggagacggggatcctgagcaagagccgccagcaggagatggcgaacaagatggagacagagaggaagcgctctcctttacgccattccatgcccaacttgtcacttttactccggaagaactgcaaatcgtttgggaagaagcaatggagctccttgatagtatggagccaacgttagaagtggcacaatggaaaatcgatgaccatcgagaagtgaccgaggcgttcctcgaatatgtcgaaaaactggaacgttatgcaacgcgtttggaaaagtatgtggagaaactggaagcgcaagtgattgatccagtcatcgaggaagttcacaagcaagaacaagccgttttcaaccgtataggcgcatctccgtccgttattaacagtccgattcagtcgacaaatgtacgggaactgcttacctattacggcgagctggccaaattggattgggcatacagccagcaaggctacttgaatcaagaccggattaagcaaattgtcgatgaagacaaccgtgtccgcgaggttcaggaaaaaattgacgaggcgcggcaatcagtcgattcgtttatgggcaagcgaacgcaattggaagaagcccaacaatcggttgaggaagcagaagcagaatttaatcaatttatcaccgatgcaaacaacgtgctgaacgagttagaacaagcaattgctgaagaacaacaagcgattcgcgaagaagtggcggcgattgcagaaacgggcaacgctattggagcgaacttatctgaaagctatggagcgattgaaacagaaccagcgcctgtcgaagggttaaatgggcaaatggtcgtgaccaatcaacaaatgtcattaggcgaagtccaacaattaggagcagcagttgagtctcttagcaaccgccaagacgatattattgcccaaacagaagacctacacaacaatgtgacggcagtccaagccaaatccgatgatttaaactcgagatggtcggacaatgtccaaacaactgaacttgtttacgaggacattcacacgattcttggcaacgcgctgtcagacgggcaccataatgactatgtctataaccatctttctagccctgttgatataagcggcgagcaagtaacaggacctgcagaaagaatgacgccgccaatcattgttcttgtgatcgtactattgtcgagcttgctgatcggctttttgacacaccactatagctctgtgccaattgccgttaatatcgcgttgtttagcattttatcgatcattgttggtttaatcatcagcatttatggactgacgatttacacaatgagcgagagccaatcgattcaatggacgatcattaccgtcctcttgattttggcgacagctggccttatccgcgttgcctttatggcgggcccgtgggtcgaatggctgctaagtgtcgcgttcattctattctttacaagcccgcttcttgatatggccatgccaaacttccgtacaaataacccaattgcggagctgtacatttccattcaagcaagcccgcaaaatgcgtttctcgcaggcatgatcccattggctctcattgcagcagcaacgattgctttgccaatcattcgccatttggtcgttaacagccgaaaagaagaggatgacgattatgaaatgtaa

SEQ ID NO: 7892 - DNA, 414 bp, Bacillus clausii
aggccatcattgccggggcaggagcatgcgtaacgctgctcctgtccttggcaactccaagctttgccgaagaagaacgagtggaacctggtgtttacaaagagcgggaagtgctgttagagctgcgccaatacaaaccagaagcggagcagagggaaatcagagtgcctgaagaacagaaaatacttacatttactcagccattggaagaaacatacgcagaactacaagacagcctgtttgcgagtagtgcggatgcaaaccgtgaggaaaacctcgccgcaagcgccgggctgtttacagaggaaaaagagttggcccgccaagtggtgcaggcagaagaaaaagtaaacgtgctgccatggatattagcagctgtggccaccgtgctcgtttctgttttattgatttata

SEQ ID NO: 7893 - DNA, 219 bp, Bacillus clausii
gatcatgattcgtggcgtccgaggtgcaacaacagttacaaaaaatgaggcacaagaaattgaacaggccacagaggcactcgtgcgggaaatggtcagtcaaaatgcgttgcagccagagcaaattgcccaagtgattgtgaccgctacaaacgatattgatgctacatttccggcgaaggcggtccggcatttacaaggatggcaatacgttcctgt

SEQ ID NO: 7894 - DNA, 525 bp, Bacillus clausii
atgagtgctaaagttattgctattagtggggtaactgctggaggaaagactactttagttaatcagttagtaaaggaatttccgagcgcttgtgctatttactttgatcattatgaattggaaaatgctccagatgtgaaagaaattctaaacaaaccagctgattattttaatgcttatagattagttatgatgatgaacgacttgaaggaaatacaagataaatatgattatatttttctagattatccaatcggttatgaaaataaacaaatgggtatgttcatagataaagtcatttatataaaaacccccttggatatcacctttgcaaggtatctacttagagattttcctaattcttctggcaatgacattttaaaatgggccaaatgttatttagaagaagcaagaccgatatttatttcacatgaagagatcgtcagcaaacatgcggattatataatggatggcacacttgaagtagtaaaacaagttgcacaaataaaacagttattaacctaa

SEQ ID NO: 7895 - DNA, 486 bp, Bacillus clausii
atgcgtgcaactggcgcgcaaatgggcggctttggaagatcaacagaaggcttgcgtaaaaaacaagaaggattaaataagatttatgagctgcaagggcagaaggttaaagacttagaaggcaactatcaacgtttggtagctgagaagggcgctgaatctaaggctgctattgatgcttccaggcactataataatgccttagctgaatacgccaaaatggaaagccaactacaagacttaacaaaagaaattgctttccaagaatccgcttggggcagaatggaaagcggtctaacgggcttttcgcaatccacaggcaggctggctgacggttttggcaatgcaggcagaaagatgacaatggggctgactctgcctggttctctttcctctacacggatatctttctctttgtaccatacggctgctctcatcaagaacatctccttattatgctatggtgttttgtttacacctttataa

SEQ ID NO: 7896 - DNA, 609 bp, Bacillus clausii
atgatgaaaatctcgcaactcgatccggctacccttactgacgagcagttaacgaagcttctttacggttacaaaaaagatgatggcaaaagcggtgactgcattttcgtccctggcagcagcagagcggtcgagtaccgtgtgcctaaagccgttgacctttataaacagggccgggcaaggaaactattgttttctggcggtgtctcttgggacgagaccaaaacgccagaagccgtactgatgaaagcaaaagcattgtcacttggcattgcagccaaagatattcttgtggaagaccgctcgctccacacgaaagaaaacgtgctcgcctccttgcttgtgctcgaccgggctattgacttgcaccgaatcaagcggctgctccttgttaccgcttcttaccatatgccacgtgtctatttgatgatgcggacatacatgccaagctggatcgaatattctctttgtccagtcgacgattacaccacaactgctgaaaactggcacctctctccttttgggagaaaacgggtggaaacagaagcgcggaaactgatttcgtatgtgcaacagggcattattaaagaatatccccttatatggtga

SEQ ID NO: 7897 - DNA, 333 bp, Bacillus clausii
cttggcgaaaggcggccggatcggcaaaggaaaagcattgctaggttcgttgctcaaaataaagccaattgccgctctgaaagaaggcacgtacacacctgttgcgaccaaacggacttacaagcaagtagtcgagttttttacagaaaaattccatctagagacggctggcaaaaaaattggcgctgtcggcattgcccatattgaagccgagcagcttggcaaaaaaatcgttgatagcctgaaaaaggtccgcgccgacctgtctgtgtcgattctcgaaacctctccgattattagcacgcatacgggtccaggggcgatcgcgttaat

SEQ ID NO: 7898 - DNA, 831 bp, Bacillus clausii
gaagcaaaaacatcgtgatgacatggtttaccttgaaggcggcaacttcttaatgggaaccgaagatccagatgctaatccatttgatcaggaaggacccgttcgggatgttacggttcgcccgttttacgttgataaatttgctgtcacaaatcggcaatttcaagaatttattagcgatacgaactatcagacagatgccgatacatttggctggtcttttgttttccatctcttgctgtctgacaaaacagctgagaaagtgaaacaggtacctgtccaaaccccatggtggcgtgtggtggagggagcaacttggaatcaccctgaaggtcctgattcttctattgaagatcgaatggatcatccagttgtccatgtttcgtggaatgatgcgaaagcttattgtgaatgggctgggaaaaggctccttttggaagaggaatgggaatatgctgcgagaggggggcttgttcagcaaaggtatccatggggaaatacgctccatcctaatggagaacaccgttgcaatatttggcaaggagagtttccgactaaaaatacaaaagaagacggctatctagggacagcccctgtacattcttttcccgcaaacggttatggtttatataatatgtcagggaatgtgtgggaatggtgtgaaaactggtttgataaaaacaaggtaagtggaaagcctacaaataggccaaaagcgatgcgaggcgggtcctatttatgtcatgattcatactgtaacaggtatagggtcgctgctcgaagttgtaatacgccagacagttcatcaggcaatgtcgggtttcgttgcgc

SEQ ID NO: 7899 - DNA, 129 bp, Bacillus clausii
cttttggtttaaaaaagggcgatttgctttttacaggcacgccagaacgtgtcggggcaatcgctgatggcgatcaatttaaccttgcatgtcaaggagaaccaaaggggactttttttgtaagaatgg

SEQ ID NO: 7900 - DNA, 265 bp, Bacillus clausii
atgaaagaaattgatgtgtctaagttcgaaaaaaaaatcattcttcgccatatcgaagaaaaggattttaacgatattataaatttgtcaaaactatgctttccaaatatggagccgtggcgccgtgaagaattaaagagccacatttccatatttccagagggccaattttgcgtcgaatacgatgggcaaatcattggctcttgttctagtttaattatcaattttgatgaatacgacgaccagcacacttgggatgaattac

SEQ ID NO: 7901 - DNA, 363 bp, Bacillus clausii
  misc_feature (1)...(363): n = A,T,C or G
atggttggtaatatagccttggtcggtaattcatcccaagtgtgctggtcgtcgtattcatcaaaattgataattaaactagaacaagagccaatgatttgcccatcgtattcgacgcaaaattggccctctggaaatatggaaatgtggctctttaattcttcacggcgccacggctccatatttggaaagcatagttttgacaaatttataatatcgttaaaatccttttcttcgatatggcgaagaatgatttttttttcgaacttagacacatcaatttctttcatgctgctcacaccttcctcacttgaaaatgtcaattcattccgtagttnacctntttttcagctgttngaatag

SEQ ID NO: 7902 - DNA, 72 bp, Bacillus clausii
gtggcccgttggtcaagcggttaagacaccgccctttcacggcggtaacacgggttcgaatcccgtacgggt

SEQ ID NO: 7903 - DNA, 102 bp, Bacillus clausii
ttgcaggccttgaaatgggcaaacatatccgctattccttttttatcatgtggggatttagcatcgtcatgcttgtgatcgcttacatcctcggcattatta

SEQ ID NO: 7904 - DNA, 375 bp, Bacillus clausii
caaactggacacaagggcaaattgaagacgatcagcttaaatcgttaatggcagcaattgaaacaggaacaggccttgccggtttgcatggcggaatgggggactcgttccgcatggcaacggactatcagtttatggtaggagggcagtgggtcgctcatcctggcaatgacggcgttcgctataaagtccagataaaggaccgtacgcatcctttaacaaacggaatggccgatttcgaagtagaatcggagcagtattatatgcatgttgatcccgctgtctccgttcatgcgactaccacctttccgattgccgatggcccccatgctgtaaacggcagcgtggaaatgccagttgtatggacaaagcaac

SEQ ID NO: 7905 - DNA, 312 bp, Bacillus clausii
gtatattttattggtcattatagccacagcacttgttacctttatcccacgagtccttccattagttgtccttactagaatggagttaccagcgtggttattaaaatggcttgattacgtgcctatagcgattattgctgcattactaggtcaagaaatcttcattaatcaagaggggaatatatccttttcgttgtataatttaaacatttacgccattataccgacttttttagtagcgatcatttcccgtagcttattagccactgttttatcgggggtgttcaccatgatggtcttgcaatatctttt

SEQ ID NO: 7906 - DNA, 483 bp, Bacillus clausii
atgccagatgaaaatattggaatcgccattctgacgaatgcaaatagcaatttgtttggaacggcgttatctatggaagtatatgacggacatttacgctgccaaggccaaaacaactggttttctttataccaagatggaatgaacgctttggtaactacgatgaaggggcagctgcacgccatctatgatacaaaaatcgacaacaagccgtgcagccatgctttagaggagtatagagggacgtatactcactctggctatggagatatctacattaccgtccaaggcgacgcactgcacatggactatcacggccattcaatggatgtgaaacatctccactatgacatttttacgtttgaattattgagcggtccacttcccctttcctttgctacgggctttgatggccgaattaactcgttaagcataccgtttgaaggtacagtcgaaccaatccagttcataaagaaacaatag

SEQ ID NO: 7907 - DNA, 1019 bp, Bacillus clausii
ttgacgcttaatggtcgaagccagcaaatactcaatgaaatcgcaagcaatcgccgggtcacgagcgcaacgatcgccaagaaatacggccttacccgcaggcagatcagctacgcgattgaaaaaatcaatgagtggctgcaaagggagcatatccctgaaatcgagcggacaaggcaaggccattttattgttgatcaatccgttttttcaaagattacggggaaacaagattaccagcttccagatggacaagggtttttaaccgaggagcagcgcgtccactttattttattaatgctgttggcaaaaaaggaagagctgtcactgctccattttcattcccagttaggttacagcaagaacaccattttaaatgacttgaaaaaagtgcaagagtttgtatcgccattccaattggtggttcgctattcacggaaacatggttacttgttggaaggcaaagaactgcaaatccgaaaattgctgattcacttaacggaagtggttgtacaaacgcagacgggcagacggcaacttgaaatcggtacagacattggaaaacatgaaatcagcgaagtccatgcccgcattgagaaagtcgaacagaagctaggcatccaatttacagacgaaaaactgatggcaatgccttatattttaacgctcgttttaaagcgaattggcatcggacatgtgttgccgccatttccgatcgaatacgatggactctcagatacgaaagagtaccaagcaacagaggaaattttccgccatctaaaagacgtgcctaagcaggagcggctattcgtaacgctttacttgctgacgacaagccgttattggactgaatgggtaaatgcggaggaggcgctgcctgatttagtgccagcattggccgatgttttaaggctatttgaaaaaagcgcctgtatttatttgcaggaacgggatttgctgttgaaaaagttgattcagcatattaagcccgcgtactaccgcatgaaatatgagttgac

SEQ ID NO: 7908 - DNA, 441 bp, Bacillus clausii
atgattgctacaattgatgcgatggacatgcttcaagcgtcagatgagctggcagcaatggtgctgcaatcaagcgtgtttgctaactatcgcttatcccgtgcccgttttgaagaaaaccatgctgcacaagcaaaggtagaacgatttaaaaaagtaaagcaagcccatgaggaagtgcagcggtttggcaaatatcatcccgattataagtcggtatccgcggaaattcggatcgcaaagcgcgagttggataaagatgaggtcatttccgcttttaagcaagctgaaacagaacttgagtcgcttttaaacgaactcagcgccatcatcgcccatagcgtttcttcttctataaaagtacctacaggtaacccgttttttgactcaatgccttgcagcggcggctgtggctcgggagggagctgcagctgcggctag

SEQ ID NO: 7909 - DNA, 435 bp, Bacillus clausii
aaaatccttttcaagatggcggcgccggcgtcacttctattgctgctcttactcaagatccattacctggctaccattcaaagcttgcgagcttaataaaaaagatcgcggtacgcgaatgcctaccagtttccacagttagccttcattggtttaaacattatattgatgtggctgttcagccacttatccatttgtatgatgaacttggtttggcacttgaagcacaccaacaaaatagcctactcaacatttataacggctacccgagcgctttttattatcgcgacaatcaaggctattacttggcaaattcttataaagacgttctgttggcaaaagagcctaaattaaaggaagccgaaggactgttttacaacgatgccctcattgacgaccgatttgcttattatttgaccttgacccaagtgtttc

SEQ ID NO: 7910 - DNA, 662 bp, Bacillus clausii
atgaagtgccgggttggcagacaacggatgatagccaaggcgtcaaaattattgaaatttggaattatgaacggcagtacccacaagggagtaataaacttccctgctccacctgatggtgtccgctatgccgaattaaatgcgtttgaccatgggttgctgtatcaagatgtagagacgactcctggacaaacgatcaaatggcgcttgtcgcatatgggacgccacggtgttgatacgatgcaacttcgcatcggccaagcaaccgacgacccttatgatacggaaatcatcgaacaaatgtcggatggaaacactgcgtgggggacgtacactggaacgtataccgttccagccggacaacccgtaactcgtttcgggtttgaagccgtttctactgcaagcggcagcttaggagcaggtaacttcctagatgatattttccttggaacggagccatgtgtagaagctgaaaaaacagtttctcctgaaggagaagtgtctgttggcgatgagcttacctatgaagttacagtgaaaaacacgggtggggacattgcggctaacgctgtctttgaagatgcgattccagaaggaaccgaatatgtaccaggttcaatcaaaatccttactggaccaaatgcaggcgatttaaccgatgc

SEQ ID NO: 7911 - DNA, 639 bp, Bacillus clausii
  misc_feature (1)...(639): n = A,T,C or G
ttggcacgtggcacataacaggnggatttcaacggactttaccattggccattntattaccgatcgtttcngatgccaaagtngtgatnatagcgattgnaacgtgatgggttgttgcaagacggcgatgccatgttcgccttacttatgggtcgnttccccatatatatttgccgagtatgaaggggggcatgcggagattgatttcccaattgagccgcagatttgggccaatcaaggcaatgtcattggtttttccacccatgacaataagcattatgctgcttatgcgccagatggatttgactggcaactgcaaggaaataagtgggaaaatgccgcatcgtttatctctgtggcgaaactgccagaagcaaccgatgagctcctccacacatttgaagaatatgccttttccgttgtacgtgactcaagggcagaatatagcgttgaccatgatactggggaagtccgcactgtatattcagtagaaaccgaagcaaaggtcgcaggagcaaaagaaggcaccatttttgctttatacccccatcaatcccgccatttaacagccgcttcagaagcacaattgttggagcaaacgatttttacaattcgcggcgatatgaaactgcttgcagg

SEQ ID NO: 7912 - DNA, 426 bp, Bacillus clausii
gtagaacgacaaatccgccgaatgatacgtggcttgctgttgcgggcaataaacggggctacaaaaaacacccccattttcaagtcgggttgtttgatgaccatctctttatttggctagcgtttatttacgagctgccggaaaaaggcaacatcgccaaaacctttttggaaaacaaaccgcttatagaagaggtcgtcccttctgattatgtcgtttccgttgaccacacaaaaaaagaagcaaacccattgtcagagcttaatttaacccaatctcttgaacggttccgcgacgttaaaaaagcagaatggctcgttggacgccattttgcaaaagggagcgaaacagtcgagaatggcgagcagcttatggacgctattcgcgaaacagtcaaaacgctgttgcctctttaccagctctcgc

SEQ ID NO: 7913 - DNA, 195 bp, Bacillus clausii
gttttttgaccgtatcgcgcttgctgtagagcaaggcgtgaacgccggggaaatcaaggctcactataaccggttcaaaggggtggtacctgctaagtctgaagaaaaacagctattccgggaagtagatgagcaactgggtatttcctgttataaaatcgtgaagcgagcactggaagcagcggaacatgagct

SEQ ID NO: 7914 - DNA, 276 bp, Bacillus clausii
  misc_feature (1)...(276): n = A,T,C or G
taaaagagcaagttagaagaacacttgcccaaggaaacggctgngcttattgcaaggcgaaaggagagccagatcaggnccacgttgacgagaagacggtgttggcgactggttttgccgacgttttccttaagaacagagatgcgattgatgataagctgttccaactgttgagagagcagttttctacaaaagaaataagtgagctttgtgcgtttattgcctttactaccgcccagcaatattatggcgcgatgatggggttggaggcagagt

SEQ ID NO: 7915 - DNA, 90 bp, Bacillus clausii
  misc_feature (1)...(90): n = A,T,C or G
attatggtatgataatgtcaggcacgctttgggcaacagctccgctcattgcgatctttttgctattcaaccgtttctttattaatagcn

SEQ ID NO: 7916 - DNA, 108 bp, Bacillus clausii; identical to SEQ ID NO: 7411

SEQ ID NO: 7917 - DNA, 343 bp, Bacillus clausii; identical to SEQ ID NO: 7412

SEQ ID NO: 7918 - DNA, 807 bp, Bacillus clausii
atggcacactcttttaattccaagcatataactatgtttactaggaggtgtagagggatgactgattttttctttcaaaaggaagtagcagaaaaatacgaagcctataatgacattttagagcaactattaggatatcaatttgtctttacccattttgacaaagacgagcgccagaccattcttgactttggctgtggaccaggcaaaatcgcaacgcgctttgctgagttgttttccgcgaccgtgattgccgtcgaccaatcggcggaaatgattcagcttgcttccaagaaacacgaccataaaaacgtgcattatcgtttagtgaaagacccaaaactcgcttttttagatgacaactccattgacggtgctttttcctgtttcgttttcattacgattggggatgaagcagtactaaaccatattttgcgagaagtataccgtgtattaaaaccaggcgctccatttgtgctgctagataccaatcctaattccacaggtcatgttttttccacatgccgtatcggcgaaaaaggcaaaacctacaaacgaggcgatatcattcaaaaagaattgcgttggggaggaaaccaattgctaattgaagattaccattggccagaaaaaacgtatgaaacattgctcgttaacaacggctttgttgaaatcgaaacacaacaaccgacgctacaaagcgttcccgctaagacgattcaacgtgttgaagacgagtacggcctaaaatggaaagatgaaaaaaccattcctccctttattctttttaaagggattaaaggatag

SEQ ID NO: 7919 - DNA, 381 bp, Bacillus clausii
taaagggacattttgtttatcgaaaataaaggcactggcgccactgtccactcctatcatttgccttgcctttaataaaccggaattggctaatttgactgggaaaatcaaccgcccccgtgcgcctaaagaccatgttgcccaaatgaatgaaagcgatggctggtcttttttagaagaaagcggcgatgcccaagcaaaagaaacgggccagtattggctgaagccaaaagcagcggaaattcctgccttatcaacggttatgttttctaattttgaaattcaattgcctatggcagcaacaagctctgtggcgatgcaagtgaacgggtttgtatacggcgacgaacatccacaaggaatccctgctttgaatgcgat

SEQ ID NO: 7920 - DNA, 669 bp, Bacillus clausii
gcataatgtatgcattagtgtccctaaagtgttcgactgggtcacacgccaagtcgatttgccaacggcatgctaccatgaaggaaataaatccggcagtgatttgtccgaactgtttaaatgcagggacagcgaggcagaatcgtttacagagtttattaaacaattcccgaaatgtgaagccgtctgccgggtgatcgagtccgatatttatacgaaggaagtgactgatccgcatcacagaacgcaagtagaagtttgcatgccaaatggcgaagaggttacgcttgagaaagtgaagattctcattaaagtctccgtcgatgtagacctatacgacgaagctggcaaccatatttgtacgtcatgtgagccatttgaatttacaaaagtcgaaacgttctacttatgcgcgccagaaggcactgaagtgtgcgctttcgtcacagcaggtcaatgtgatgctgaacttatctttgacggctcttatatgcagctggacctttctttctccttctgcctagatgtccatgtattagctgacgttttgctggaaattgaagcggcatattgcaaacctcggttggaatttcctatcagcgatgttctttgcaaagaaacgaaattcccaccacaatgcccgactctatttcctggcaaaaaaagcaa

SEQ ID NO: 7921 - DNA, 1117 bp, Bacillus clausii
atgcgtaaattagctggagttagcgcgccttttgttgttgtacttgcacttactacgggctgttcacttggagccaatgatgctgtggacacactcgatgaaccgccagtcacatacacggatgcggaagaggaattggaaaacgaagaaaatgaacctgaagaggatgtaacggaagaacaagcagatgaaagcgaagcaggggaagaaacaggggaggaaacaggaccaacagatgaaacaactccagatgaagctgctgaatcattaaatcagcgagagctctatttaattgacagcaatggcctagtcgtcccgcaaacgttgacgcttccaaaaacagacagtgtgatgaagcaggcacttgagtatttagtagaagggggaccaatcaacgatattcttcctaacggcttccgggctgtcttgccagcaggaacagaagtcgatatcgaccacttaaaagaagaaaagttggcaattgttaatttttcaagtgagtttaatgactacaacctcgcagatgaaaagcggatttttgaagctgttacctggacattgacgcaatttcctgacgttgaagaagtgaaagtcgaagtaaacggttatgagctcgataaaatgccacaaagcgagaaaccgcttgtcggaaaccttagtcgcgcagatggcataaatgtcgacacaagcgaagtcgtcgactttaccaatagcacggacattaccctatatttccttggggcaaatgacgaggaaacgtactacgtaccggtaacaaaaagggttgaaaatgtcgacaatgagctagaggcggcaatcaatgaattgattgaagggccatcgctcatgacaaatttgctaacagaaatgtcaggcgatgtggaactccttaatgaacctaaactgcaaaatggcgaagtcgtcttagactttaacgaagccattcaatcagccaacgaaggcagcgccattccgaccagtgtattggaaagcttagcgctcacattaacagagcaaggcggcatcgaaaaagtgtcaatccaagtgaacggagaggcaggcgtaaatgaggcgggcattgaagtggaagaagtcactcgccctgagctcgtgaatg

SEQ ID NO: 7922 - DNA, 249 bp, Bacillus clausii
  misc_feature (1)...(249): n = A,T,C or G
tccaatcatctcggctgnaatcgatcaaaaaaacattaggaaaatctgcgggaaaagtactccgcgatcgacagctccttgaggcaaagcgtctactacggtactcaaatgcccatatagcggagattgcgagctaccttggtttccgagactcttcatacttcggacgatattttaagaaaaatatcggtgtcacgcctacttcttttcgaaaaggttgactaaacccatactcttcaacgccctcat

SEQ ID NO: 7923 - DNA, 267 bp, Bacillus clausii
tattaaatgaagcagcgcttaagaacgacacgaaggtgtctgtagtagtgcctgtatataatgcgatcgcctacttagagaagacggttgattcgattattaagcaaacgattgggtttgaaaacataacttgcatccttgtcgacgatggttcaaatgacggatcaagggaattgttgaagagttactcagaaacctacaaaaatatcgttagcattttcctggaaacgaacaccggtaccccagcgtttccgagggaacttggga

SEQ ID NO: 7924 - DNA, 156 bp, Bacillus clausii
aatacattgttcaagaaatccagcctgtcttaacaacgtacgtcacaaaccgtgtctaccgccatgtgcacactttcccgcactcagcatccgttgccaatgtcgtccacaatcagcaagcttttccccctacgcactatgttccaggccgacctc

SEQ ID NO: 7925 - DNA, 426 bp, Bacillus clausii
  misc_feature (1)...(426): n = A,T,C or G
agtggagtgggcgaatgagagaatcccgcgctcaatttttactgacagatgatccaatggaattggcgagcggcgccccttttgcatccgatgaagatgcacagctgatcacatttgaggaacggcaaagtttgctggacggcgagacagttgtgattcgtcgcgaacatcctcgttttcaacaagagttgcttgggattgcccttccgttnatcagtgaaaataaattngnaggcgcgatttttatttcgatcccattagctgttgtttatgaggcgtttgttgatatccagtgggcgctttatgcagcagttttgttcgntgctttctttgtcgtcgtttcaggcaagcgcntgacgaaacatattgtagagccgctaagggaaatgaaagcaagcgccaaagaaatggaaaatggtcantttt

SEQ ID NO: 7926 - DNA, 664 bp, Bacillus clausii; identical to SEQ ID NO: 7388

SEQ ID NO: 7927 - DNA, 186 bp, Bacillus clausii; identical to SEQ ID NO: 7389
  misc_feature (1)...(186): n = A,T,C or G

SEQ ID NO: 7928 - DNA, 165 bp, Bacillus clausii; identical to SEQ ID NO: 7454

SEQ ID NO: 7929 - DNA, 183 bp, Bacillus clausii
gcacagcaacaagagtgaattttactgtatgtaaattgaaaactaattttttttttgagatggagtctcgctctattgcccaggctggggtgcagtggtgcaatctcggctcactgcaacctccgcctcctgggttcaagcgattctcatgcctcaacctccctagcagctgggattacaggt

SEQ ID NO: 7930 - DNA, 108 bp, Bacillus clausii
ctggatacggttttgaaacacatgctggctatggcacagcgtcacacttgcaagctttgcggacttacggaatgacacctgagcaccgcaagtccttccggccggtgc

SEQ ID NO: 7931 - DNA, 171 bp, Bacillus clausii
atgtctaatattcaaactggcgccgagcgtatgccgcatgacctttcccatcttggcttccttgctggtcagattggtcgtcttattaccatttcaactactccggttatcgctggcgactccttcgagatggacgccgttggcgctctccgtctttctccattgcgtcgt

SEQ ID NO: 7932 - DNA, 270 bp, Bacillus clausii
aaaacgccgtttttctagcgcttacgttcgccaagctctccattctaacggctttttattgctgcatgaggaaacgttatgggagacacgggcgatccatccaagcaagcaggaacttctcgttgatctatcgaaacggaaagggcgctcgattttacatcagctttctgaccaggaattggctaaacttgtacgtgtcattgagaccacactcgaacaggacggcccgatcattgagaaggatcgttggacgttatggattgccgagaa

SEQ ID NO: 7933 - DNA, 288 bp, Bacillus clausii
atgttttatattatggctgctttaacgaagccgcggcatggttacgctattatgaatttaattgaagaaacaacaactggcgcgatcacgataggcccggcttcgatgtatacgattataaagaagttattaaaacaagagtggatttacttatatgacggatcggattcaagacgtaaaacatatttacttaccaaaagaggcatagaagtgctagaggaagctgtgaaaattcgaaaaacggtcattcaattggcagaaaaaggattacaggaggctggagaatga

SEQ ID NO: 7934 - DNA, 417 bp, Bacillus clausii
atgctagtaagcacagcaataattggcatcgttaaaatacgccgcaggggattaacctcaattgctggattgattgcaacattattcgtagctatcgcatttagccaaattcctaatttgtatattttgacggcattagcgttcctaattggatttaccatgacatttgtttcaatcccattctttacttcagcacaagaagatactgatccccgtattatggggagggtcatgagcattgtcttcttagccatgaacggcttcgatccccttgcctatgcaagtgtaacattacttgtagctagagggattgatgtccaacacgtaattttgtccttttcgattgttggtttaataattgctcttatcactttatggaaagggagaacatacagaaagtatacttctaactattaa

SEQ ID NO: 7935 - DNA, 469 bp, Bacillus clausii
atgaagaatcactttgtgcctgctgtggcaagcctcctattgctgtgcgcttgcacaggcaacaatgctggtctcgatgataatggacaacgcatgcaaacattggacaatgatacacttatggcggaaacaggcagagattttggttatgggttttcccgctataccgaaaacgaagtaggacgggcaaaccacaccgttggcgccttaacagttgatagagggatgcttgccgatgtggtcacccggttagtgcttagcctcgagcaaattgaagaagccgcaacgcttgtcactgacaaatatgcgctcgttgtgtatgaagatcgagcacagcaaatgacagaagaggaagtagccgaacaagttaaacgggcgggatcggcttcactgccgcgcttttatgaggtatacgtggcaaacgaccgtactcgcataagagatattgagcgttttgcttcactgccgt

SEQ ID NO: 7936 - DNA, 285 bp, Bacillus clausii
  misc_feature (1)...(285): n = A,T,C or G
atggtgacgatttcaggcattgaatatgaagtcctcgaaaacgagcgcantggttggaatgaggaggcattcaaagcgcggtacagcgatgtactgaacaaatatgattacatcgtcggcgattggggctacaaccaactgcggttgcgcggcttttttgatgacaaaaacaaaaaatcaacattcgataaaaaaattagcacgttacccgactatctttacgaatactgcaattttggttgcgcttattttgtcttgcgaaaagtaaggaaacaagctatgtaa

SEQ ID NO: 7937 - DNA, 240 bp, Bacillus clausii
gaaagcccgacaagcgtatgacgaattcacgaatgtcgaagcaatgcacctttatattattccggaagaattgcctgaagggccttacggggcaccagtcggaaaagaagaaccggtcgtgaataaaacaaccgaatggaaagaaggccagcgcacttatagtgcttttaattatgtaaacaaagaccttcatgcaggcttaccccggaagtatccaaatcaccatccaccacacgacaa

SEQ ID NO: 7938 - DNA, 445 bp, Bacillus clausii
atgtattttgttgacaggcagcggatcgaacaaacgcttgattatatggaacatttattaaaaatgatgaaggaagaagcgtttggtacgagtgataaggaccgcctcgcattagaacgaaccgcctctgtgctgattgaagcagttattgacgtcggcaaccagatgattgacgcctttattatgcgtgatccaggggggtacgaagattttatcgacatcttgcttgatgaaaaagtcattatagacgaaacggcagcaggattaaaacagttgattcgccgccgtaaagcgcttgtctatcaatatgcaagccttaaggcgaacgacgtacggagctggctccaggaaagccaaccaagtttggaggctttcccgcctgctgtccgccaatatttaaaaaatgaacttggcgtcattaccgcatttcttccagataaagaca

SEQ ID NO: 7939 - DNA, 809 bp, Bacillus clausii
atgtatgtatttcacaatcgtcacttttattcattaagggggaacaagaaaatgaaaacttttgacgcatttccagaaccaatcggcagctatactgtcggtcgaacccagatcgattttgagtacacggcatcagatcactcaaaaagaaaactgacggcgtttgtgtactatccgtccgacagtagcgaagggaaggctacatcgacgtacatgtttcccgaagtctacgacatgcttgatgagcagccacttctcactgcgttgaaggatgcttactctatcgatatcaagacccagtgttacgacgaccttgctctctcggggaaggaaaagcgctatccggtgttattctatgtttgcggcgggggcggttctccagaatggggtactgtgatcagtacagacttggcaagcttgggatatgttgtggtaagcatcggccatcagaatagcacgatgtataagcgtaaagacgggcgcctgtttaatgtatcaaaggatttttcggatgtcattatggcgttttctgaagatccggagatggtggcgttggctagtaagatggagatgcggcctgacgatgaaacggccattgagatgtgccaaaacgtgcttacactgccgatccttgccaagttaacagagtatagcgaattacaggcagaagatgtaaggtatgtagccgattatctttacaaactagaccctggagagctgaattccatctttaagggcagattgttgcttgaggttggcatgggtatagtcggacattcttatggagggcctacgacggcgattgtttg

SEQ ID NO: 7940 - DNA, 1188 bp, Bacillus clausii
atgtatgtatttcacaatcgtcacttttattcattaagggggaacaagaaaatgaaaacttttgacgcatttccagaaccaatcggcagctatactgtcggtcgaacccagatcgattttgagtacacggcatcagatcactcaaaaagaaaactgacggcgtttgtgtactatccgtccgacagtagcgaagggaaggctacatcgacgtacatgtttcccgaagtctacgacatgcttgatgagcagccacttctcactgcgttgaaggatgcttactctatcgatatcaagacccagtgttacgacgaccttgctctctcggggaaggaaaagcgctatccggtgttattctatgtttgcggcgggggcggttctccagaatggggtactgtgatcagtacagacttggcaagcttgggatatgttgtggtaagcatcggccatcagaatagcacgatgtataagcgtaaagacgggcgcctgtttaatgtatcaaaggatttttcggatgtcattatggcgttttctgaagatccggagatggtggcgttggctagtaagatggagatgcggcctgacgatgaaacggccattgagatgtgccaaaacgtgcttacactgccgatccttgccaagttaacagagtatagcgaattacaggcagaagatgtaaggtatgtagccgattatctttacaaactagactcgggagagctgaattccatctttaagggcagattgttgcttgaggttggcatgggtatagtcggacattcttatggagggcctacgacggcgattgtttgccgggacgacgaccgtttcgcttgcgggattggcttggatagcggtgctttcgcccttctcgacagcgacctaaacaaacccttcttgctgttgtttagtgaacctaactataacatgaatgcgatcattggcgctaacaatagcaaggaaacctattatttctctgttgatcgtgctggccatctagattactgcgacctcgtatttactagtgttaatgaggaactcagaggcgaacgggatgctatggaaatgcgaaatcttgttacagactatacgaagaacttttttgatcattacatcctgcagaaggctgcaagtgtggagagtctggcatatgatggcgtggacttgatcaagaagaccagcaataagtga

SEQ ID NO: 7941 - DNA, 381 bp, Bacillus clausii
cgttattctatttgatggcgtgtgcaatgtatgcaaccattcagtccagtttattgtcaaccatgacaagaacggttattttttgtttgcctctttgcagtcgccggtagcggaatcttatttctccacactaggcatttccgacaaaaacctacgttcaatcgtgttgattgaaggagagcagtatgtaaccgaatcaaccgcagtcctacgaatttgcaaaaaactaaccggactatggaaaattctctatgtacttattcttgtccctcccttcattcgcgaccccgcttaccgctggtttgcgcgaaaccgttaccgcttcttcggcaaacgagagcaatgcatgatcccctcccctgaaataaaaacgcgcttttt

SEQ ID NO: 7942 - DNA, 285 bp, Bacillus clausii
  misc_feature (1)...(285): n = A,T,C or G
tgaggaccgatttgcttattatttgatcntgaaccaagtgttttcgntaatctgccgttttgggtgttggacggtcttccaggaagaagccgttttacttgaagtgttgcgttcagcgcttgctgaaatggaggttactttagtaggagcaggcaagcgctttgtggaagggttacttcgaaacgaacagcttgcttgcaaagcaaatttactgacgcgcttccacgatgtcgatgaattagccgaagagttagaacaagcagtctatacctcaattaaaaaccc

SEQ ID NO: 7943 - DNA, 692 bp, Bacillus clausii
  misc_feature (1)...(692): n = A,T,C or G
gtggcgaanaatttgaacaaacaaaaatggaaaaagattgtcttaacggtggtacttattggtactgccgtttttctatgtcttcttttacttggaacatttgcccaagctgctggattagttgatgatacggtatcggaagacaatctgtattccaaatacccacttgaccattaccaactcgatttttatgtggacacaggttgggattggctgccatggaactggaacgatggaataggaaaacaagtcatgtatgggctctatacgattacaaattttatctggattattagcttgtatttgtctaatgcaacaggctatttaatccaacaagcttattctctcgatttcatttcccaaactgctgatgccatagggaaaaacatgcaaacattagctgggattactgcaagtggttttggcagttcgggcttttatgtaggttttttgcttcttttcattttagtgattgggatttacgtggcatatacaggattaatgaaacgggaaacgacgaaagccattcgggcgatcctaaactttttagtcgtttttaatttgtcggcctcctttattgcctatgccccaacgtatattgctaaaattaatgacttttcggcagatattagtcaggcaagtttagatttaggtactaaaatcttgatgcctagctctactagtcagggaaa

SEQ ID NO: 7944 - DNA, 117 bp, Bacillus clausii
atttagagcattaccgcattttttatacaacggctaaagagcaaaactttagcaaagccgcttcctccctatttattacacagcctagtgtcagccacgccattaaacaattggaaa

SEQ ID NO: 7945 - DNA, 478 bp, Bacillus clausii
atgatggatgaacccgttttgcacacaagccacctgccgccacatttggcaacggacctatggcaaaggtccacgccaatgtcgtttactcctcctacgtcattgaaagcaggcatggaggaagctgaacggcagcttattacaaacgtacttgccaattgtgcaaatcatttagaaggcaaaaagcaggcagcaaaacgattaaatatttccttggcaacgctatacaataaaatgaagaaacaccgtttgttattgttgggagactggaaaaaaaccggacggaaattgtccggttttttctgtataacttgcgcagaagccgtgccttttttaatgagcttccacacagaacgctctgctaccatcttttataaacgcttgatgcaagcgggcgtcatccgtcaattcaggatggaacgaacatgccaaggaaaggggcttggcttgaacgggaaacgaattctccgttgtattc

SEQ ID NO: 7946 - DNA, 526 bp, Bacillus clausii
  misc_feature (1)...(526): n = A,T,C or G
atgaaagaaacgaacgtgtccgttcatctaccttcttcttatagcaggatgttgaagcgccttttagaaaacagaatagcgaagccgaaaacactagcggtaaaaaaataccgtgcttctgctctcaacactctttttaagcgggatttcattcttgagcatggcatttattttgaggagaatgtccttggctttagtgatattttgtttacttcacaagcgtacaccaaaacgacgaaggccgtcgtgtacgacaaggatgccatttatttaaaattgatccgcaatgatccaattaatgacccgtctattgcgcaagcgttaaacggcattgaatggtatccgcaatcaatggcacaagcaatcgcttcattagaagacggtcaaccgttcaaaaacgttttgcttaaacgatttttaaaggcttaccattataagtatttaaacgggatttataatgatgatccagatgaagtatataagggcatttgggctgacgcattcaaacgaatcnggctagaccaat

SEQ ID NO: 7947 - DNA, 734 bp, Bacillus clausii
gtgttatatattaagattcaggaattacataagagaaagtttaaagtagcgcaaatcgctaaggagcttaaaatctcaagaccgactgtctataagtacttagaaatgacattcgatgaggcaaaggcgtatactgaacagcccttgggaaagaagaaaaaactagatcactataaggactggatactggcctggctcgaagagtatccccacctaagtagtgctcagatccatgattggcttttagaaagataccccgacctagtggtcggcggaagtactgtaagaacatatgtgaggggggtgcgagaagtttatcagattgagaaaaaggggattgtccggcaatacgaagcagttcctgaacaaccaatgggtaaacaactccaggtagactggggagaaacaaaacagaaaacagtgaacaacaaggaaatcaaactgtactttattgcctttgtactcgttcactcgcgacaaaaatatatggaatggcaagtacgtccattcaccacaagagatgcgattcgttgtcacgaacatgccttccagttctatggaggacgaaccgaagaaattgtctatgatcaggatcacttaatctcagtaagtgaaaatgcaggtcaactacttttaacagctgagtttcaaagctatgtaaacgagcgtaaattcaacgttcacctttgccgaagaggggatccagaagctaaagggatgattgaaaatgtagt

SEQ ID NO: 7948 - DNA, 312 bp, Bacillus clausii
  misc_feature (1)...(312): n = A,T,C or G
ggccttcctcactcacgcggngttgctccgtcagactttcgtccattgcgnaagattccctactgctgcctcccgtaggagtctgggccgtgtctcagtcccagtgtggccgatcaccctctcaggtcggctacgcatcgttgccttggtaagccgttaccttaccaactagctaatgcgccgcgggcccatcccntagtgatagccgaagccatctttcaccctctctccaggtggagaaagggattatccggtattagctccggtttcccggagttatcccagtctaaggggcaggttgcccacgtgtta

SEQ ID NO: 7949 - DNA, 134 bp, Bacillus clausii
  misc_feature (1)...(134): n = A,T,C or G
gtggnnacaaaaatgangatgcnccaattaggngnaagcgtaacggaagggacaatcagcaggtggctagttgcaccaggagacacngtccaaaagtatgagcngattgctgaagtgttaacggataaagtgag

SEQ ID NO: 7950 - DNA, 522 bp, Bacillus clausii
  misc_feature (1)...(522): n = A,T,C or G
gaatgaatttaggcatgancaaaaagatgaagctgtgcgcagcgtttatccagacgggattcaccaagtcattgctgattttttaggcaaagaacatcaagtttcaacggcaacactagacgagcctgaacatggtttgacagaagaggtgttaaaccaaaccgatgtccttgtttggtgggggcatattgctcaccacgaagtagatgatgaagtagtcgagcgcgttcataaaagggtgcttgagggaatgggcttgattgtccttcattcaggccatttttcgaaaatattcaagaaattgatggggacgggatgcgatttaaaatggcgtgaggcggatgaaaaagagcgcctttgggttgtgagtccaagccatccaattgcagaaggcattgatgaatactntgnactagagaaggaagaaatgtatggtnagcactttgatattccgaatccagatgagatcgtttttcttagctggtttcagggtgccgaagtgttccgtagcggctgtacgta

SEQ ID NO: 7951 - DNA, 696 bp, Bacillus clausii; identical to SEQ ID NO: 7869

SEQ ID NO: 7952 - DNA, 384 bp, Bacillus clausii
atggccgatcagaccgaaatagccaagctccaccatgaaattagccagatgcgggcgcaacttttccagacagaagcgcaattggagcggttgcgggcggccaaacaagcgctcgcttccgaacaagcttctcttcatcatcataaaaaatggggaagcgaaccagagctagaacatgatgcgtggcgcggccaaaccgaatcggcgcacgatgatattcgccgccatatgcaactggcttacacgaacgtacaagacgaaacagaacaactgatgcgcgcaattgaaatggaaacgagtcgtcaccaaacaatggtgtcttcttgtcaagtcgcgatcgaaacaaagcaacaatcgctccaaacattaaaagcgacgaaataa

SEQ ID NO: 7953 - DNA, 621 bp, Bacillus clausii; identical to SEQ ID NO: 7859

SEQ ID NO: 7954 - DNA, 285 bp, Bacillus clausii
tcgaattgaccggatgctaaaccagcttacgctcgttggaaggcatgaagaagttggaggggtggataggggtagaaaaaacggctgtgagccgaaaaagcgccaacattcatttacgctgcaagaagtattggacgattatttttctggatctggcaagccgtgcataagcggctttcaaattggccattgctcgcctgcattttctgttccatatggagccagggccgttttagatacagaacgcaaacgtttcgtaagggaagagggagtggggggggaggg

SEQ ID NO: 7955 - DNA, 226 bp, Bacillus clausii
atggcgattgccgccatgtgttcagagcgtagacaaaacgcctttgagaaaatgattctcaaaggcgttttgttgatgataaaaaggtgggtggactttggagactttgaagttggaggggtgttcctcctccaactccaggtggctaattttttcaagttcatcgcagcaaaaacaagcatcgcctgcattgcatttttttccaaccctttcaggttggtccaac

SEQ ID NO: 7956 - DNA, 233 bp, Bacillus clausii
atgattagtgcgtcagtcgtccaatccatttcatttgcacttgcagcaaatttgatgtcaatgacttcggtatctgggttcatttccaaccacttatttattgcttttccgatgtcaccgccggaaatatatttaacggcaatgctccctgctacgcctagttccatctactcttcctcccaactaattagtaaccttggttcggttgtatcactgtacaattctgtaacaac

SEQ ID NO: 7957 - DNA, 216 bp, Bacillus clausii
atgacgggatcgaaccgccgaccctctgcttgtaaggcagatgctctcccagctgagctaatcctccatttaccaataaaatattgcccggcaacgtcctactctcgcgggaggaagcctccaactaccatcggcgcaaaagagcttaacggccgtgttcggcatgggaacgggtgtgacctctttgccattgtcaccggactctacttcagataa

SEQ ID NO: 7958 - DNA, 396 bp, Bacillus clausii
  misc_feature (1)...(396): n = A,T,C or G
atgacgaaatgcgcgatttttggaaaggaacaacttgctttcaatgacgaaatgcgccatttccaaaaggagcaacttgctttcaatgatgaaatgcgccatttccaaaaggagcagcttgctttcaatgatgaaatgcgccatttccaaaaggagcagcttgctttcaatgatgaaatgcgccatttccaaaaggagcaacttgctttcaacgagaatcagcgcaagtttaacaaccaacaaaccaaattcaaccaaacatttgaggcttttcaacagaacacagagaaccggcttgaacgaatggagaaaagattgaatggggtcggctatctaattgaacatagcactgccgaacggttagaangacaaaaagcgggcagataccgttcatga

SEQ ID NO: 7959 - DNA, 441 bp, Bacillus clausii
atgaatcaagatcattattctggcggtgaagcgttagaaggcccacacggtgataagttatacagccatgtcaaaccacctcttgtccatgtcggcgcattcgcgattacggacaaaaatgagcaccctgaagcgaccgtgcggtggatggattacttctttggcgaggaaggcgctacgttttatttcatgggcaaagaaggagaaacgtacacgaaacaggaagacggctcccttgaatatacggaagacattactgacaaccctgatggtttgacgcaagaccaagcattggcatcgtacattacttggcttggcggcagctatcctggctatgtgcaagaacactattttaaaggctcagagtcgctgccaaattcaattgaaaatggtgaaaaagccgccgcaaatgcccctgaagcaaatttggaatgcttttaa

SEQ ID NO: 7960 - DNA, 298 bp, Bacillus clausii
atgtttcaagggcgtgaatgggagcaactaaaacattatgcagctatctttacgcctgctcttgtagcggtttctgccgaaggaacgtatgcaaaagcaacgcaggcgctagaacttggctgtgtcgacttgcttataaaaccacttgattctgagaaactattgcggcatttgcacaagttgctgcgagaaaagcgccctgttgtcaagagcgaaaaagaagagcctaagtggccatgtccatcgtaccgtgacctttttttgcctggccgtgctgattcgtttccaggagatgtgg

SEQ ID NO: 7961 - DNA, 273 bp, Bacillus clausii
  misc_feature (1)...(273): n = A,T,C or G
atgtgctgtcgattgtttataaaaaagcggctagtaaaaaaccaacttgagcataaaagaggattggaccaaataaatatatctattaanaatgccaaanacatagtaaataaacgatcaaaaatctggttaggggatagccctattgagagaagtagagaagacggccaaaagatttatcaaactggatnccttaagcatcgaggcgttaattttactatcaggtctactgaaagatcgaaaatgcaggatgccggattcattattatttga

SEQ ID NO: 7962 - DNA, 339 bp, Bacillus clausii
atgaaagagatttatcattttgttaaagaatttgattcctcattaccgttcattaaaccggtccattcaacgtattttggtcttgagaatggggaaaaagcattacgcagctcttttaatcgtgttcagttattgaagtacgaatctaacttacgagttacgaatgttcacgatttggctgattatatcttttcgatagatacaggacttgaagatgctttaaacaagcaaggcagatatgatcaatttattagtttcttagaaagtaagaaaaacacacaaggatatatccatattagtaaagactcaggaatgtatgttgtaagtgaaccttattaa

SEQ ID NO: 7963 - DNA, 213 bp, Bacillus clausii
atggacaaacgctttgataacatgaaaaacgatatggacaaacgttttgatgaaatgaaagaagagcatgtcgtaatgaatcgccgcattggcaacttagagactgctcaattggaaacaaatgcccgcctttctaaagtcgaagacagccaaatgaaaacagctgcagcattaactgctattgctgacgctattaaagagcggacaaagtaa

SEQ ID NO: 7964 - DNA, 271 bp, Bacillus clausii
atggataagctaaagttgggctttgctccaacacggagattcgtgtttagtaaagaagacgcatataaatacaaagagttgataataaagaaaataaagagttttggattggaaatagaaattgtcgatttagaaggaatcaatgacgaaggtctactatataatcgttcagatgaagctgcgattgtaaatcgatttcaatctaagggtgtagatgcattattttttccgcattgtaattttggtacggaagatcttgtggccaaaattg

SEQ ID NO: 7965 - DNA, 384 bp, Bacillus clausii
atgagaaggccaatcgatgtcatgctttctggaacggtcataagtgctgaaatttatttatgggtgaaattatcgatttttattcatatttggcttgacaagctttccaaaaacaaaaaagacggctggcataatcaatacaacgccgagaaaggccagacacggagcaaactgttcgaatggtggtttattcttctcattttatttgccttaatcgtttttgcggcgttctatttcagagattttttcactagctccaaagtggttgctttgtcagcaccttacttaaaagtcggctggacgattttgagctatttaactggatgggctacattgttaatgctttatcagttgtggacattgcgcaggaaatacaaggcctaa

SEQ ID NO: 7966 - DNA, 267 bp, Bacillus clausii
atgacacatgaatttataagctctttgcacccattcctacacttaagccccttcacatactttcttggtggagacgttgctgctggttttttagctgagcgatttaacaatggccgcattgactttataagtggagtaatcgtattggttgtttttgcaagcataatcacatttatcttatgtatacatgcctatatggtagagaagcgtcaattaattacgtcaaaaaaggttggtcaagtgggggaaataaacacaaacaactaa

SEQ ID NO: 7967 - DNA, 240 bp, Bacillus clausii
  misc_feature (1)...(240): n = A,T,C or G
atgggaggtgctgttgcacctccctcaaactgtagccaaacgctcgcatccttcgttgttcgtctcgttcatatgctcatgaacccccgttctattcgcatcttcactcgacttcacgcctcggctgacaagcgttttctatcagttcgagtgattttgtcgacgttgtcgacaaccgctgggaggtgctgntgcacctcccgaaggccaattaaattaattgagttccatgncttctaa

SEQ ID NO: 7968 - DNA, 249 bp, Bacillus clausii
atgcccactttcccattctttaacgcagaatgctacgctggtttttgccagcagcgtcgtggggtaggtttcaaacgcagaagggatggtcggttttttcagccggtgaaaccaactctctttacatattctgccttttactggtcccagtcatcactgcaccgtacatatcgaattgaagtgattatatcgagccttgcggagaaagtcaattccttttttctgtctgcggtgtccggtgggagatag

SEQ ID NO: 7969 - DNA, 231 bp, Bacillus clausii
atgccgttcttaaattcctgcttgttatttttcaaatgcctaagcggattctctcatgtgtcgccaattaagcagtcgctcttttgcttcctgcccataacaaaaaaagacacctattcaggtgtctttagtatttgcccggcaacgtcctggctccgggatcttttcctacggggatgttgggcacggagcttcttcgatgatgtttttcatgtagtcttacgaaaatga

SEQ ID NO: 7970 - DNA, 270 bp, Bacillus clausii
atggcatttcaacaattagctcaaaaatccattcctttaacgaataccgacacgattcttacaattggttcactcgtcattttagaaacagatgattttgagacggtgtctggttgttatattggtggaacgataaacagattatataacttggtcgcctttttcgcaggcttgccagaggtagataaaacgaattttgaaaattatatcattgatgattacttatcttctttagccgatgtgaaaacaattggtttttttgaactttag

SEQ ID NO: 7971 - DNA, 437 bp, Bacillus clausii
atgattgaagcaatcttaaatatgctgctctatacgcttttggcgtttgcgacaggggtttttactgtcgctcttgctccgggcgaacgggggctccgtgccgaaccaaaacaacaaacggctgcgctgctgttaggtgggattgttgttgttttattcggctatgtggctaaattggcagttacttatgccgattttttcgatatttcctaccttgatgcgcttatgaccgtcattgctgaccatgccgttggcgctagttttctatatgggagcttgattgtcgtactcatggctgttgtatggctagcaatggcaaagatacgagcactgcggcctgttgccgcaggtatcaatcttgtgttcattgttttgctgatatttgcaatcagcctgtcaagccatagtgcttgctctaaacggtttgcacgggatca

SEQ ID NO: 7972 - DNA, 474 bp, Bacillus clausii
atggtggggttgcttgaaaaaatgttgccgcttacagaggaagaaaaagacattcttgaatatcggcgtgtaatgaaagcacgttatacgtcaaagcaacaatttattattgaagccaataagtttcttgccccagggacagaaatcatgatccgcaagcatacgcgttttattgattttcctccacacacacatgactacattgaaatgaattatgtctataacggcagtttaaagcaaacgattggcgatcgtgcagtcgaattgcaaaaaggggagctggttgtgttgaaccagcatattgaacaccagatagaggcatgcggtacagaagatattatcattaattttattattcagccgtctttttttaattatataggactcttttttaaatgtggaagggcccttggattcattccttatcgacagcattcatggtggcgaaccgtatggccagttcctctattttaa

SEQ ID NO: 7973 - DNA, 309 bp, Bacillus clausii
atgaaagtaggattgagttcatacagcctgttgcaagcgttaaaagacggacgcaccacgatagtagacgcccttcagtgggtagccgacaatggcggcgcccatatggagctcgtcccttatggcttttcggttgtagatgactacgaactggcgacgaagttaagagacaaagcagcggaaacagggattgagctgtcagcctactgtatgccggccaatttcatccagccgacggaacgagcttttcaggaagaagttgaacgcatccataaacatgtcgaatgtcgtccaacatatgggcattaa

SEQ ID NO: 7974 - DNA, 273 bp, Bacillus clausii
atgacaaacgaccaatttaagcaagtcatgactgcatttcgggaagttaacagccaattgcgggaaatcaaaggggatgttgccacgttaaaagacgatgtcgctatcttaaaaagtgatgtttctatcttaaaaaaggatatggctgaacaaaaagtcataactgcccaattacaaaaacatgcagaacatgcctctactacgtttgactttattaaagaaaaactcattaaccacgaacgtgatatttatgcgttaaaacgccgtccataa

SEQ ID NO: 7975 - DNA, 246 bp, Bacillus clausii
atgatccaacaggctattgtaagtgtagcatatgaggcaaaaacatttcgaaaagacgccagctttagtgaaagtctcctgctgataaggattacagaatctttacgattgcttaatgctggctacatgcatagcccttatgctgaaagcagcaagataaaaggaggcgtcgaggttggaggaggatattcaatacgaagttggcgagaatatggttgtaggcgcaggctgggctcttgctcttag

SEQ ID NO: 7976 - DNA, 543 bp, Bacillus clausii
  misc_feature (1)...(543): n = A,T,C or G
atgatttttgattatattggaacagttgattttgaaattggtcatntttggtttatcgcattattattctttctttctgtctgctacgccctagtacgagttataatgaagataccaaatcctacaaaaagcagatcattaggacataaacaattatttttattttcaatatcattaataattgctaatacgtttattcggatttggtttcctgtaggagaatgggtgaatatntcaccttttatgccggtagaagttggacgnncgccacagnatattannttctttgcctttggcatncttgcttatcgttctaatgggttagaaaacattccaattaaaacaggcgtgatctggttcataataggaattatagcagcatccatgcactatctaaatgctttaacaggtttacggnctgtctatatatggctagtnttagaagggtttattggcgttggcttgataataggaatgctagtgtttggcagggaattngcgaataaacgcagaaaattacttgcttttatggcagaaaacgct

SEQ ID NO: 7977 - DNA, 318 bp, Bacillus clausii
  misc_feature (1)...(318): n = A,T,C or G
atggagattatattcgttttacacaacgctgatgttctagaagatagaatggctcattttgaagaaatgcanatanacgtttggaatananacatgtctcaagnaanaagaatgctaggtagnttttttgctaaaaatccattanatncnanatatctagttctancagggtggactgataaaaaggctcatactcattatttgcgattgattnaagaaagtgacgtaaatgtagatgnatcgacagtttatggtgatcaatttgtagtagaatcaatcttggttgcttattcnataaccataggaggggctgtatga

SEQ ID NO: 7978 - DNA, 249 bp, Bacillus clausii
  misc_feature (1)...(249): n = A,T,C or G
atgttatgctggtgggcaagtgcatgtgtaaattggtcgcgtgnttgctttaatgccgcatttgcattttcangttggtcagggtccatgcgnatgggtagcttggccaaccgcacgttgtgcagcttggatggcaagttcaatttgcttgaggtcgttgtagccatatacatctttagggtaattgttcatgttgctgcctcctttatggctagcatgaacggatttatacccatttattcaagttag

SEQ ID NO: 7979 - DNA, 213 bp, Bacillus clausii
atgaaagacgaataccgtaatgatcaattgattaaatgggaaaaaatgctgaaggatctcttcaaaggtgatattccattaaaaagggagtggcatgaacctatagagattataagagtattgaattttataggtaaaaatgtcgctgacaaccacacattcatgcctcggagtgggggtgtccatatagaaaggttgttctttatcaaatga

SEQ ID NO: 7980 - DNA, 260 bp, Bacillus clausii
atgttgggatgggataacggaatttgtctaaatatgattataactaaaaaaggtaatcttaaaaggaaagcattgtccccgcgaggaggaattctaaaagaattatcttaccagcgaaaagtaacaccaacaaacgtagatggaaaagaaatcgtcttccaagcagctgagacgtggttaaaagaccaacctacgtttgagcagcagtatgaccaagaggacgcattaggggtcatcctattacgttatttatattggtt

SEQ ID NO: 7981 - DNA, 203 bp, Bacillus clausii
atggctaagaaaaaggtcgtttttattggcgtggctagtgcacttatcattcttttttcagaaaaagcgtatgcagaggaaacaacgatccgcattcttcatacaaatgacgcccatggccgtgcatttgaaggagaattagatggcatcggttatgcaaaattgaaaacgctgatcgatgaaaaccggggagagcactcgct

SEQ ID NO: 7982 - DNA, 243 bp, Bacillus clausii
atgatatggatgttctcgatccggcatacgcaccaaggagtcggcgccaacgaaccaggcgggctgacgcctgttcaaagtttcgcgattttagatgcattgtaccccatcgttgatgcgtttgatattgcagaggtcaatcccctgtatgaccatcaggacatcactactgctatggcggcgcgcattatgtttgattgttttgtcgctaggatggaatgtggggaaaacgctcaaacataa

SEQ ID NO: 7983 - DNA, 218 bp, Bacillus clausii
  misc_feature (1)...(218): n = A,T,C or G
atgancgggagcgcattanacgggaccagatgttgcttcgcaaagaacngcannnnctncggcancnnnctnaagccaagaagaaggncannaatnaagnctgnctggtgtgctcctagatgcaatcgatctaggagctttttttgcgagatttacaatcgattcacagtcattttacatttttatgacgctagaaaaagaccnttttccttgtgcta

SEQ ID NO: 7984 - DNA, 219 bp, Bacillus clausii
atgagcgttgccatgaatcaaggagactttgtaaaagtcgtatttgttttccaaaaaaacgaacaagtagaggaagtaacgcttaactccgctcagttaacagcgttgctacacgccaaaccagtgtggattgaagcgtttgccgatcattttaaaatcgagaacagcgtatggtcttacgggaacgaaaatgtctctttgcagatttatttgaagtaa

SEQ ID NO: 7985 - DNA, 219 bp, Bacillus clausii
atggatgctaaatttggaaatggaggaggtattcatatgtctacagaggttgttacgatcatagcgatcttttctattgtaatatggatagcggtgtcccaagaggctgtaaaaccctcaaaaaagagaaattggctaaaaatgataacgttactatcggctggctccttatctacactcattctagtcatttctctttttcaacagcttccattgtaa

SEQ ID NO: 7986 - DNA, 573 bp, Bacillus clausii
atgcctctggaattagttgaggattatataaagtatattgatggtagattttctaaatatgatcctatttatttggtaagtggagatactgattttccaacagatcggaccattgaatattactcgttagctttaaacacaatcaagcgattaagccctcattgtctaacgactttgcatatcagagggagattgcaggaaatacccgatgcgtttttatatagtgacaaattagacttttatatgtttcaatccgggcacaacgctcaattccaaaatatgacgtacaaacttgcagaagggtttagcaacaagccggtcagaagaccttcccttaattcagagccttgttatgaaaaaatgggttatagcaggaatttatatggacgatttaatcagtttgatgtcagaaaagctgcatggcaaagtttattatctggtgctagtgcaggtattacctatggggctcacggcatatggagttggcataagaaggggaaagggttcggactaattggcgaagcttttgatagaccttatgattggaaggatgcattaaagtttgaaggtgcc

SEQ ID NO: 7987 - DNA, 648 bp, Bacillus clausii
atgatcgtcggtgtcgctgcgatgcactctggctggtttcctgcttttgccgttacgctgatcgtgctgttaatcgggatcatgctcggctttccaccaatcgcgttagcgttgcttaccggttacacggcggctactggaccagcttttgccgattttggatttgatttaaagacaggatttttaatcagaggccgctccaattgggaacaagagctctacggccggcgcttgcagctgattgcgggcatgatcgggctcgtggtagcgattgtgatggtgctgcttttccatcagatgtattttgcccaggacttggttcctcctgttgaccgtgtatttacagcaacgatacaggaaggcattgctggcgaaacaggaaagtacttgctgatttgggcgattcctggagcgatcattcaattgattggcggcgctaaacgccagcttggcattatgctagcaactgggttgctagttatgaacccttgggctggttgggccgttctagtgggcatactagcacggatcgtaattttgaaatggaaaggcgaagccggtgagtcggcgatgtttacaaccgcagctggattcattgctggagatgcgctttatagtttctttagctctgtctttaaagcccggtaa

SEQ ID NO: 7988 - DNA, 204 bp, Bacillus clausii
atgttggatactatatgttttttctgcaaaaataaatttacgattaatcattctgattcacaatattataaaatcaaaaaaggagaaaataaatactatatatgtaaaagttgcaataattcatttcaacaagaagcgattaataaaactggaataagtccggatcaaattgatgattatgataagtttttccggtataaataa

SEQ ID NO: 7989 - DNA, 351 bp, Bacillus clausii
atgactaatataatattaagcgagccttcctggagcgtttcttttggaaaagcatacgatttattgcgcgaaatgatgatacacaatattcaaaagacttttgattggaaaacattcgaaactgtttcctccaattcagcgatggaaagattgggagaaattacaacgaagacactttttatcataggcgagaaggactcaggagatctctttaaaatcgcacaattatataaggaagttcccaatattaactttgtttgtatacctggtgctaatcacatcatcactttgacccaccctgaggaagtttccgaccacatcagtcattttttgaacttactagattggtaa

SEQ ID NO: 7990 - DNA, 387 bp, Bacillus clausii
atgatccctacgtctcacaggaggacacgatgcttttccagtgaagcctattcacgtagtttttttataggagcttatctccatatactcctaattaagcatttaactctgcttcttcgaagcagcactcttttgcttcctgcccataacaaaaaagacacctattcaggtgtctttactgttgcccggcaacgtcctactctcgcgggaggaagcctccaactaccatcggcgcaaaagagcttaacggccgtgttcggcatgggaacgggtgtgacctctttgccattgtcaccggactctacttcagataagctttggatttcttcgagcactccggccctcgaattcctgcttgtcttcgtagtttttttatcttcagagtga

SEQ ID NO: 7991 - DNA, 267 bp, Bacillus clausii
atggccattttgaggcactcatttaacgctgtagccggcatcttagtttttctcgcgtccctttatttaagctcccataatgaaaacgtggaaggcgcccgtcaattcgctcctgcctacttgttgttatttgttgtatgggtgtgcggcttcaccctccaatttcgtccatctacacgtcttaccggcattgcgattacgctcgtaccactgtttttttggttgttttcctttttctttcatattgaacgaggcgggcttttttga

SEQ ID NO: 7992 - DNA, 285 bp, Bacillus clausii
atggatcctgaattgcttactgatttgctcgaatctggggaggaagcagacatcgaagaggctgtgattgtgaagcaaaagggtgatgacaacaaattgttgcaaaaccggctgtacgtcagcagtgagccacaaaaagtgagagaaaagcagtatgagcttgcccgtctagacatcgggcaaatcaaccagcgtttgtttagcggcgcttctgatgtcccccggcaaaaccagcttgatgggcaaaatgtctacaccgatggcaagccgaattgtcacgattga

SEQ ID NO: 7993 - DNA, 337 bp, Bacillus clausii
atgaagcgattgagtacacttgtggcagcctgttcgttggtgatgctcaccagttgtgcgccgcaaacggaaacagaaaacgccccgagtgaaaacgcagacttgaccgtcgcgatgattggcgattttaagatgcaagatacaacagacccgattacaggccaaaaagcgaccggtttccatgctgcaaaagcagaatttgaacggcttcatccaggcgttacgattgaattcatcatgatgccatggagcaactatgtcgccaatacacaagcaatgattgccgggagccaggccgacgtctaccaaatgccaggcgtcaacgattttgccgccc

SEQ ID NO: 7994 - DNA, 441 bp, Bacillus clausii
atgttctgtacctttgtactacaaacggtgatgagcctcgtactccggcgacaaccatctatctacgaattgcttcgttttttcagttccgttcattttcagactgaaaaatgcccctaccattgtttgggtttctcgctcgaggggtttaccgcgttccactctgcccgtttccaagcagactacgtcactgtggcactttcaaggagtgcatgccttatccatttggacgtaggcatctctcctgccgtcagctgcaaggcagctgccctagcttatggattagctaggcacgaacactaccggcctctcagccggtgcgagcatggactttcctctacgcataaaatgcgcagcggttgtctgaagacatgtatctgtcataagcgacttgttcagtttaacacatttgcgccaacttggcaatcattatcgaaataa

SEQ ID NO: 7995 - DNA, 325 bp, Bacillus clausii
  misc_feature (1)...(325): n = A,T,C or G
atgccacaagcgaaaaccatatttgattacattaagccgaccgactatcgntttgtacatatatgcaggcgctgtgaccagccgcaattttcaaatgaacgagagccagcagaagcatgcgtccgctgnggaagtgactcgttccacgtngnnccttattacaacccagcgcaagattatggntnagatgtngactattatgcgatcacaatgatgtatgcgctgnggaaggaaggattgcacaaaacgcaagtngnntacgatgatnnnnatcgaaaagcgccgnntgnaaaaggagtnggcgattttagcggcgagcttggcg

SEQ ID NO: 7996 - DNA, 226 bp, Bacillus clausii
  misc_feature (1)...(226): n = A,T,C or G
atgcaatcatcgcctccatggctaacacagttatttttccagttccttacttatatcccctatatgctaatgggacttgctattgttggggtttatagcgagtatgctcatatggaagcagtacaaaaaacgctcttccacacgaccaaaatagcgctctttctaaaaataaagccaatnaaagcaactgcccaacaagcgatttccctattatttctcttttgca

SEQ ID NO: 7997 - DNA, 437 bp, Bacillus clausii
atggaccaacaaaaaatcgacgccctttttacggtagcaagcaagttaaaagcgaatcagattgctttttcattaggggggagcggcctgctgtatgcattaggattgacggaaacggtaaacgactgggacattatgacaaacgctaacaagaacgctgtggagcaagcccttttcccaataaaaacgttcgaaacaggacaaacgggtgacagcttatttgtgagtggctataagctatttatcgagaaaaacggccaagaagttgaaatcatcggcgattttgcgcttcgttcagaagtaggcatttgccgcattcctgcagatgctgcttttcattggcaaggcataccagtaggaagccctgaagcttggcttgttgcctacgtcttaatgggacgagataaaaaggcagcgatgctcgagtcggacttgca

SEQ ID NO: 7998 - DNA, 288 bp, Bacillus clausii
atgaataagttcgggaaatggtcattctttctcgccatgatttcacttgtgttgtttattgcctttgcgctcttgctaattacaggctatgcgttgcaactttcgccaagcacaacgagcgcggtcggcaccattgccgttgttgttctagtggcaagcgtgattgttagtttggtgtctcttgcaaaaggggaaactggcaagtggaagctcgcaccgtggctcttaattggcgcaagtgtgctcgtgctcgttatcttgcttaatgtagtgtggatgagtggttga

SEQ ID NO: 7999 - DNA, 306 bp, Bacillus clausii
atgtacggaaatggcgaatgggttatttacaaagcaggccgcgcacgcattcttggttggattagcgaagcaaaagtggtggcgtccaattcagcgaacacccccatcaaaacaatttaccaattccataccaagcagcgtgtcttaaatggtaagcagccgcttttggcaaatgaagaagatttgcaaacatgttctcccaaactgaaagccgatgatattcgcgcgcttcaagagcttgcccttctgactaaggacaagcaatggtttctcgaattaagcaacgctcaccattctcatgcttaa

SEQ ID NO: 8000 - DNA, 549 bp, Bacillus clausii
atgaggagcagttatatggaagagcattttcacacactttacaagcaaagggatgaaatgtcgattgcgatggagccttttaaaggggaagaatggaaaagaccttgtaaagataaatggtcgtttggagaaacgtattaccatttgtttttaatggtgaaacgttttaaacagctaaataagctgtatttgccattgtcaaagccaattgccgcaatcatgaaaaacaagccttatgaaacgcacagtaaagacgtatacaagcaatatcataaaaagcatcacaacccaatgaaagcaccaagtgtgttaataccgccaaaagagatccaaaagaacacctcattccctcaattagtgacaagcatagacgccgaaacaaaacaattagagaacatgcttgatcgaataaaagacgaaattgctggccatattcgctatccagacccaatcgccgattatcctaatttaatacaaagtatacatttgctttgtatacatgaaaatcaccattttcaactttgcaaaaagtattacaagttcgattga

SEQ ID NO: 8001 - DNA, 375 bp, Bacillus clausii
atggctgctttctttattccacacgctgctgcatctttaggagttgcttttttcaatgtttcaaagcgcaatgaaattcggttgattgtgctctctctcattgtcgcttgcttcacttttttttgtatgccgtttgctacgacactggcaacgatcagtctgttgcacggcgttattggcttaacagtcggcgtagtattgccgcttttgctctcacaaattgcttcactcccgcagcctaccttaaaaacgtctgttatgggtttctaccaatctgtctatgcaatcggcatttttattggcccgtacggcgcaggctttgttgctgaacatattggcatcgctcatattttcacattagcaggaatcgtctag

SEQ ID NO: 8002 - DNA, 326 bp, Bacillus clausii
  misc_feature (1)...(326): n = A,T,C or G
atggattatgagcgctaccttcaattacgggcggatgcacaagcttatttacgtaatgatcaattagaagccgccaaagtagtaattgaccgagcctttaaactgtttgcccgtgaccctgacttatggcatttaaagggggtctattatttacgaaacaacgattaccaggctgctttgcacatgttccaggaaaagctggccttatctccagcagaccccgacggattgctttatagcgctcagctgcattttcacttcaaagactttcaaaaagtcattgcccactgngatcaacttcttgcctaccacgatcattaccttga

SEQ ID NO: 8003 - DNA, 339 bp, Bacillus clausii
atgtttggggttgaggaaaaaatcggtatcattggtggccaggttactgccggtgaagatcaaaaatggatgtggcatttttggggggaagaggttcaatacaaagaatttagtgccgttgctataaatatagaaaccaatgaagaaattgatcctattaaaatagattatgaaatgctaattcctatagaagatggcttaattagtcattccccctcacaagtaatgtttccgtcggagggtatttggaaagttacagcttacgtagatgatgagttttttgaagaatttgtgttgaagtgtttccaaaagccactgcatattagtctaaaaagataa

SEQ ID NO: 8004 - DNA, 453 bp, Bacillus clausii
  misc_feature (1)...(453): n = A,T,C or G
atggcgattcttnntatgcatgtatataacaccatgaatnggccagagttttctacgtatatgggaataggaaagtctgatatgagaatagaccttcgaatgacagacacgatcacagcggattttacaagattgcacgaagagctagtgaacgattcggatatcgaaaagcatgcagcttacatcaccagtgcataccaggtcaaaaatacagagggttcatgggactatatttatatcgagatcggcgatttttccctattcccattaaactatttagaagggagggccccgcaaggagaaggagaaatctcgctgtcttatgccaatgcttccgctaacggattaaataagaaagtgggcgatgaagtcgtcgtaaaggctggcgggaaggaaaagacgttaacagtaacgggcatttatcaggatattaccaatggcggaaagaccgca

SEQ ID NO: 8005 - DNA, 312 bp, Bacillus clausii
atggagccctttaagcaacagccacgattagaggctaagcaaggaaacggttcttcccctcgagcgctgatccgtttcttgctttatagcagcattggcgcgtttatgtttttcgtgcccgtgccaatcaacggtacgtcttccattatgcttgaccatatcgtgaccgcagtaaggcaggctttccctgcaattgtgccgtattatgcgttgcttgtgatttttcttggtgcgctttatccgttttacaaggggacatggcggcagacaaagaccgatttgcttttgtctgtttttcaactgctggtttag

SEQ ID NO: 8006 - DNA, 354 bp, Bacillus clausii
atgaaaatgggagatttgccatgcagaggatgcaatgggttgtgctgtgggcccgtgcctatttcggaaaaagagctgcgacatataaaaaaacatatcaagaaaatgcctgcgaaaaggtgccactccctaaaaaaccaacagcgttttttagggacgtgcatcttttttgacgaagccaatgattgctgtggcatccattccgttcgtccatcgatttgccgcgcatttgggcatcaccaaaatctcgtttgttttcgcaaaccagaagctgctttagctaaaacgtatcacccaaatgaagaggttgtcggtacgttaagcattgattttacatggaaagattttggttga

SEQ ID NO: 8007 - DNA, 225 bp, Bacillus clausii
atgtatggactttctagggatccagagagacatgggagggtgagcgaccgtgagctgtgtggagagttcgacgaagcacggtcatactctaatttccaaacacatccagtttgggcgttaggatggtccacgccctgtaaaaaattaaaatttgtgctaactatatccaaggcatgttatctagtggggggggggcagctggttagcttgtatatgaaattctaa

SEQ ID NO: 8008 - DNA, 370 bp, Bacillus clausii
atgatgaaacgatattggtatagcatgacattgattgtgtttagtattgtcgtctttagttggttggctattagttacacacttaagcagcaagatataaaggaaatcgctgatggcattgaacttaaaacggtatctggctcagaggacgtcattgatggttttggcgtacaagggcaaggggacaacacccataatgttcctttatatggcaaggcaaataagccgtcttttcttgaatcccttgatgcgaccccaaatcctgcgatcaatgagttgcaaaaacagttccgctccttttttagaggaaaagatacatggaactctctatatgtaagatcaagactttattgtccatattggatggttc

SEQ ID NO: 8009 - DNA, 273 bp, Bacillus clausii
atgtccttcccctccatgtctccgcctcatttacgcctatcccctttggtcactaggacttcgacttgtcgtgcagcctcatccaagaataagcgcctgatgagattcgtgttcctcggagcggaggtttgcctcggacttccttcagattctgagtcgccccagacacccttgtcgtcggctaacagttacagtgaccttcactgttcgggacttcaaccctatagcccatgcgcatgccgggcacacacgcaaaaagctggccatcaataa

SEQ ID NO: 8010 - DNA, 281 bp, Bacillus clausii
atgaaaaggttgttttgttgggcgattatgggggccatgccaataattgcaggtaacaacgcgtcgctaaattttttatacttgatgtatagaggaggacgcttcgtgattatttttacactattagcgattttggttattttgcttttttatagaggttacaaaaacacgcaacatttggtggtcaacacggtttctgtatctgtatctgagtcggatcggcaggctaaccaatctttatgtgtcctgcatatttccgatatgcatcttggagcggattt

SEQ ID NO: 8011 - DNA, 240 bp, Bacillus clausii
atgaagaagatcgtgattatccatatcaacaaattcaacgatcatcgtgcttccccctatattccaatttatctattttatgttcttttgtttaacggcatgccgtttattaaaggaagccgaaaaatcacaaacaaaaaaacacggttttcattagggaatctgctattaggaaagcaacgacctaccaaattccttatggccagcgtatgcccatcgataacgtttcagtgtcagtga

SEQ ID NO: 8012 - DNA, 258 bp, Bacillus clausii
atgaaaattggcttaacgacgcagaagggatcgaagcactcgaactcaatcaatttacgctcacatgccgccaaacgctcgatgtcgacagcgacggcgaaatcaatgaacagacacccgtctcctatacacttcatcaacaggcccttgcttttattacaggacaacaagaaaaagactaagggagcgatgaggacagggaaaccggtttgtttgatcattggcgttaaaagaaagatgttaagcggtggttggtag

SEQ ID NO: 8013 - DNA, 347 bp, Bacillus clausii
atgcagatgaaacagtttgacagccgccatgatgtacgattagtcattccaaacgaatatcggctgtgggaagaggcagaagtccattttttgatggaggatgcctctaaaaatttgctagtgaatgacaaagccgattatgtgaataaagaaacgggcgaagtggtctatcgtttgagggaagtagacacgatgaagcccggctgccacaaagccgttttccgcattgattacggcgatggcacaacgatgagcttcccacagcggggctacatcgcggtaaaggtagagcgcaccatccataacggacgcgacacacagattgtcgaagaaatcgcgcttaaagt

SEQ ID NO: 8014 - DNA, 204 bp, Bacillus clausii
atgactgtctcttcctctgctagcttattcggggatgcttggttgcgtcgagacaactcacttcgttcgttgctccaccccgcgtcgttaaggataaatcaaataaatggcggaggaagagggattcgaacccccgcgcggtgtgacccgcctgtcggttttcaagaccgatcccttcagccggacttgggtattcctccgtaa

SEQ ID NO: 8015 - DNA, 485 bp, Bacillus clausii
ttgcatcaggcactcgcctatagcgatgcaaaagaaatactcgcacaatcgttgcatgacggagggctggaacatgtccttacccggttggaacagcttgtgcacacgccttgcacgattgaagcgagtgtgaaggaagacgaagcgattccgatcatacgcaagcgaaaacgcctcggttaccttcgcccccggcggccattggcgactttatcagtggtcgaccggaacatccttgagtttgctgcgttaatgcttgctagcgagcttgaaaaacagtatgacgattatgaacaagcgcttcacaggcgcaattgcgcgttccaagacctattgaatggagactatcgttctgtagaatccttgccacgcgcccctatttattgtttcgtgcttgcaggcggtgttagcgacaacattgcgcttactcgccaaattgaaacaacagtccaagcttacttcccaaatgggcatttttctgttta

SEQ ID NO: 8016 - DNA, 448 bp, Bacillus clausii
atggagagatgggcagccaatgttttgtcaaacagttctttaacatttgcacaaattagaagctgggaaaggtcggctttgtttcgaatcatttcagatacacagaactactattttaaagcagtaccggatgtatttaatcatgaacctttattgagcgattacttatttcaacattatcctttgtacgtacctgaaattgtacaagtcgaaccgaacaaaaactggtatatcatgcgagaaatacaaggttctttacttggccagaccggaaaaatcgcttactggagacaagcaattgaacagttagcagttatgcaaaagcaatctactcgacatattgacgaattgaaaaaacgaaattgtccagttaggcctgtagcaaaggtaattaaatcgtatgtaaagtgttcattcgatgatttatatgagagccatcctatttcga

SEQ ID NO: 8017 - DNA, 249 bp, Bacillus clausii
atgcaaaactggggaaagatgcggttaggattgaaatacggatatggtctcatgaagctgcaatttcttccgttcacaggaaaatatacagtatgggggcatctcggcgctagcggttcttttatgctctatttaccagcgatggatgtctatcttatagggagttttaatcagacgaggtatcaatcgaaaagcatgaattatttgtttataaacgtcctgcgtaaattagcgaagatcactgattga

SEQ ID NO: 8018 - DNA, 366 bp, Bacillus clausii
atgtcatacggtattagcgataattatacttataattcaagttacaaaaccaaatatatgctcgttaaatgcaagcactcttactgggcagttgcatatactgtaaaaaagcctaaggagagatttcctgtgaattattaccataattcattttacaacagtccccaaaacctgcctgaatggagaggtattccatactaccaaacacataacatgtacagaacagtgccataccaacaacccaaaacggattttggtaaagagccctttacattaaacatctcacaagcttccaaaaataataatacctaccgcactgtcatttgggactggagaacatctacaagtaaccctaatgagcattaa

SEQ ID NO: 8019 - DNA, 302 bp, Bacillus clausii
atgaataacatgacacggcaaaaaggtttggcatggttgcttattttcgtttcttctttagtaggcgggtttttagcaatttacttcctgaatgacggacatgaatatacgatgctatttgccatcgcaggcggcgttttactggcgttatcatttacttcattagtgtccgttcacgaaaagacaaaaaagtgccaacatccgatgaacgctctgaatttctacagaacgttttttagcaatcgcattcatagcggtcttgtttatcagtgccctattattgattgggctcatgataatgg

SEQ ID NO: 8020 - DNA, 408 bp, Bacillus clausii
  misc_feature (1)...(408): n = A,T,C or G
gtgttncctgatcgtgacccttggcgggaaaaattgtgccataagctgcttaatagttgggatgatgaaaacaacggcttagctgtctttgttttggaccaaaaggaaaaccgtactttgcaggaagcctatcagcgagcgctactccatttgcaacgagcatttttcatcggttttgatcaagtgatcgtaactggggaagcgttttcgtggaaacggattgatccacttttgacgccagaggaacaacggatttggatcgaaatgttgagagacaacaaactcacttcccttaagcaatggctatacggggaattttattatgccggcggcgctttgcccgatcctggactgctgcggattaaattgacaagcattcttgcccaagtgcgccgctatatggcgtaa

SEQ ID NO: 8021 - DNA, 240 bp, Bacillus clausii
atgcaaaagcagtcaataagctgttttgcctgccatcgttgtgaaaacgcgtatactttaacatgttcaagtgatgaattcatgggcaaaactaagaggaatatggtacttctttcttttcctctttcgcaatcatttcttggagcaacatgctttcttgtgcggtcaattcccggcataagcgtttttcaaaatcttgttttaaggcgagaaaacgtgctgctaaatcttcagacataa

SEQ ID NO: 8022 - DNA, 273 bp, Bacillus clausii; identical to SEQ ID NO: 8009

SEQ ID NO: 8023 - DNA, 249 bp, Bacillus clausii
atggcgggcacgttgatggtattggttttaggaatcctatttggtgctttagcgtcaaattatataggggagttcctagtaagtttggcgatgtcttttatgggagctgcgaaaattgaactggttcaagtggcttggcagacttggttgctatggccattattgctgattgtcaccgttgcaataacgctatacgtgtcgtgtaagccagctgtaaaaggagatctatctgccaggctgaaagtttaa

SEQ ID NO: 8024 - DNA, 468 bp, Bacillus clausii
atgatggttatacaccggattaatgtagaattcggtccttgggatatatccaaaggaaccacccaatatattggagaactggggattttaagaaatcctttaattgaaatagggttagggaaacatacggggaatattctctccattacactaactttaagtgagaatgtagacaatactgaattgaactttgattttaggaatataactttgattaaaggaatgcctgtttttcaggttgaaaaatataataataagacatacattgatgaaaatggaaaactaagtgtctatataggacctgatagtatattaatatcattctcggaaaatgctattgtgtcaattgtacaaaatgataatattggatttgctctagacaataacaaaacggtttgtggaattttagtaagtggtatgttggaatatgaaaggaatttactaaaggatgcattaggaataatgtaa

SEQ ID NO: 8025 - DNA, 339 bp, Bacillus clausii
atggggtatgactctttaatcggaactttaataaattttgaagatagtgatataatactagaatgggaaaatggattaagaattattggcgaactagatacagttttcgaaacagacaatggattagatgaggatgatatagattatacagaatatgatgctgctgtatttatagtaagtaaaatcttatctcatcctagtagtaacaaaggtagtgtatataactggttaatacaagagaaaggttcattggttgaaatttctctctatgatgatcccccaagtgcagtatttttaccagacggaaagaaggtttgggaaagagaacgatccaaataa

SEQ ID NO: 8026 - DNA, 209 bp, Bacillus clausii
atgaataggattgcttttttgaatgttaacgtttatcaaatatcgatggatgtaaaaattgagaataaatggtacaataaaggcaaatggaaaaattggaatagaggtgctgctaatgccatatggaaccgaggcgttcggcaatgtaaatggcgaagaaatctccctccagtttatcggcgcaacggaagacaagcactggctgttcc

SEQ ID NO: 8027 - DNA, 293 bp, Bacillus clausii
atgattacgttgttgctgcttcctatccatattcaagggaatttgcttgctgaagaaaaagaacaacgtacttggcgtgtattaaaacaaatgggaattcatttttaccacttaacgattgcgaaagcggtcatcaccatatccgtcacattgctgacaatcgttgtcaccactttgcttcaagggcaaaccatcttctatactgcaatggcaagcctttttacagttccctgtatcgtcattatgatttgtgctgggacattgcttggtacttatgcgaacaacaccgtcga

SEQ ID NO: 8028 - DNA, 207 bp, Bacillus clausii
atggcgtggcttcttggctacattgccttcatttatcttgtaggcatgttgattgccacttctctgtttctcgtcgctttcttgatgtttgaatcgaaaatgccatttatcaagactgccctttctgtcgccatcgtactgatcggaatttcagccgctagctccctgctcggtgtttactggccgacaaacttgcttgggctgtaa

SEQ ID NO: 8029 - DNA, 246 bp, Bacillus clausii
atgcgtctgaactatccgagcagcaattccaatcgttgctcgcccaacaagccgccatcgaggaagacgcttatacaaagctacagacactactggctgaacatgaacacacacgctatatgctggccgaaaaccggatttaccgttacgatacggaaggcgagttgctttacgttgctgattgggcagaagcagaagatagtggcgtctttaaaatcgccgcactcacgtttccataaaagataa

SEQ ID NO: 8030 - DNA, 258 bp, Bacillus clausii; identical to SEQ ID NO: 8012

SEQ ID NO: 8031 - DNA, 228 bp, Bacillus clausii
atggattcatctgattacaaacgtctcgatggtgtagcgttggccgagctcattcaagcaggaaacgtttcaccagaagaagtgctcgatgcccattttcaagttagctacgaatgggaaaagctgaacgcgattgtctcaaagcgggaaaaggaagtgtaccaagaggcgaaggaaacagccaaaaacggtgtgttttcaggcgtgccgtttttgcttaaagatagc

SEQ ID NO: 8032 - DNA, 213 bp, Bacillus clausii
atgatatccaacttccccgttaagtttagtcgtccccacacgcatattttcctgatatacctagcgctctctaattacacatttccaccaagaataaatttctcaattgcttttccaactccatcattattatttgtatcggtaatagcgtcggctacttgctgcactgctttttgggcatttcccatcgctatgccgataccggcagattga

SEQ ID NO: 8033 - DNA, 204 bp, Bacillus clausii
atggttagccaaatcatccaagaaagtatagacgaagcactttttgggctcctggccgttttagatggcgtaagtgccattgacgaaaaatccgggagtgagttgaagcttatttataaaaataaagatcaagaaaaattgttaaatgacattgaaactgaacacttacatgacttatacaacgatttaacactagaagattaa

SEQ ID NO: 8034 - DNA, 345 bp, Bacillus clausii
atgagctatgcttctgtgaaagaacggacagaggagttgcttcatttacttgcccgcccctttcctcaagaagatgacgagcgtaacgatttcctggaggctgtcaactgtttgctcggactaaggcaatcaatgatcgaagcaagcgcgggcagctttactacggaagaagcttcttttttaatcgagcaagatcgtcttttaacagcaagcttaaacgctgtttccgccgtaattaaacaggacttgaaagaaattgctgaccaaaagcgctttcacaagggctacgagcgagggaccattctggcaacaaaaggagcgtttattgacgagaagacccgctga

SEQ ID NO: 8035 - DNA, 561 bp, Bacillus clausii
  misc_feature (1)...(561): n = A,T,C or G
atggggcggcttttggaagattcaaccagaaggctttgcgtaaaaaaacaagaagggattaaattaagattttatgagctgcaagggncagaagggttaaagaacttagaaggcaactatcaacgtttggtagctgagaagggcgctgaatctaaggctgctattgatgcttccaggcactataataatgccttagctgaatacgccaaaatggaaagccaactacaagacttaacaaaagaaattgctttccaagaatccgcttggggcagaatggaaagcggtctaacgggcttttcgcaatccacaggcaggctggctgacggttttggcaatgcaggcagaaagatgacaatggggctgactctgcctggttctctttcctctacacggatatctttctctttgtaccatacggnctgctctcatcaagaacatctccttattatgctatggtgttttgtttacaccttggtcaatagctactgtaaaaggaaaaatggtcattataacgggaaatgtccactaaatctccttatgtatttaaaaacctttcattga

SEQ ID NO: 8036 - DNA, 201 bp, Bacillus clausii
atggggaattgtgttgtccagctaaaaggagagaaacaggtgctgaaccataaacggctaaagctagcgattccggcaactgagctgtatccgcctgattatgattttgacattctgtttaaaagcaaagaataccgggtaacgaaaaaacaattaacaaaaaaacatgtagatggtttgacgctggaagaggaagactaa

SEQ ID NO: 8037 - DNA, 417 bp, Bacillus clausii
atgctaaatacctggcgaatttcttggcgtaatatcacccataacaagaaaaggttttgcttgacgttgctcgctattatactaggaacgtcttttgtaacggctatgctagtagctgataaaacaacaaatgacgtctttgactactacgagcaaatgtatgtcggcaatgccgattactgggtattaagcgatgaacatacgtattctgaagaaatgattgcgcccatccaaaatgacccaattgtcacccatacattggaagctctcgacaagcacgctttttttgagcttgagggcgaccgctctttaaatcaacgggctgtaagaattaccggagtcagtgaccaaaatagccctttgctgaaattgcctgtcatagatggggaactagacaatcaaggattggtcgtacca

SEQ ID NO: 8038 - DNA, 376 bp, Bacillus clausii
atgaaaaatcggattgtagtaaaatggtttctgctcatatcgtcattatgcctatttattttatttggcatttttgttggtcaaacactattctttgaacaatactatgctaaaaacaaagaagaacgcctttcagaagcgattgaagcgttcacaaaaacttattggcataacgaagaaaatgaaacaaagcttcaagaattggaacaaacattttatcgagaaaacaatgcttggataaccgttttagaccacaatggctatataaaaggaacaaaagattatacgatcgaattaaatgggatatttgaattagaagatgaattagtcacttacagcgatgacaactttgttattcctatcgtctatttagaaa

SEQ ID NO: 8039 - DNA, 294 bp, Bacillus clausii
atgctagatggttcgtgggtaacaataaaacgaggcaatcacacgattttagggtggattgaaaaaaacaaatcctttcattgcaaagatcctttataccaaacgtactatttccatacgcttcatcccgaacggtcaaaagcgccgattttaatttactataaagacatacataaagccgaattgacgttagaagacgaggattaccatgcgatgcaattacttgcactggaattgaaagatgccaattggttttctgaaataggggagcggcgaaaagaaattcctttttga

SEQ ID NO: 8040 - DNA, 408 bp, Bacillus clausii
gtgtttcctgatcgtgacccttggcgggaaaaattgtgccataagctgcttaatagttgggatgatgaaaacaacggcttagctgtctttgttttggaccaaaaggaaaaccgtactttgcaggaagcctatcagcgagcgctactccatttgcaacgagcatttttcatcggttttgatcaagtgatcgtaactggggaagcgttttcgtggaaacggattgatccacttttgacgccagaggaacaacggatttggatcgaaatgttgagagacaacaaactcacttcccttaagcaatggctatacggggaattttattatgccggcggcgctttgcccgatcctggactgctgcggattaaattgacaagcattcttgcccaagtgcgccgctatatggcgtaa

SEQ ID NO: 8041 - DNA, 279 bp, Bacillus clausii; identical to SEQ ID NO: 7519

SEQ ID NO: 8042 - DNA, 427 bp, Bacillus clausii
atgcatcaatggaatgtggaggttaaggttactggcaaagcagagagcgagcgagaccgcccttcttttgatcacacaacagctttttctttacgttctatcatacaatttaaaaatttaaatcacaacgtttttttaaatcgatttgcgtatgacagctgtcataaaaaaacaatgacacctatgaatagcactctagccggttatcgcttaatctataaaggcgctataataaaagggattgcctataaaggagccctccctatgatccgactttatccccgggaacaaatgaaacgttatcttttcgttgatattttcgtgtttacttttttgctttttaatttgttaacgttagaaagcgaactgcctttgttgctacgcttgctttgttttgcggctattttagctgcttattatgtagcac

SEQ ID NO: 8043 - DNA, 318 bp, Bacillus clausii
atggcgttgttttttacagaatattcaattttattaggaggggtttgtgtggatgtatcgatttgggtaattgtcgcaaatatgactgtgctcttaggtgccatcgtcttttccttttatattagcaaacgtactaggaacaacgaaggctgggctgttggtggacgggctttggcctgtctatgtcgcattttaccaccagttcgcgacggcttctggcggcggaatgcttgttgctcaagttgggatcggctatcctttcggttggagtgtgatcacttacggcttgtttacaggaacgggaagtccttgcccttc

SEQ ID NO: 8044 - DNA, 477 bp, Bacillus clausii
atggttatgacaatggcggatctccctttaatcaattatcaacaggagattgacgacatccggaagagatggaagtttgactttgtatccctagctctcgtccagccggccgaagatcggtttgtattaacgtggcagtatgtgtccgggaacatgaatgaccggtacaagcggattgtgctccattcaggcaaaggcgttgccgggatcgtttttaaaacaggaaaagcgatactgctccaaaatgtgaacagcgatatcggcacaagggacttgttcaattatcctattattgtgtcagaacagttgaaaagcctcggggcgttgccgctatgggaaggtgcacgtgtcgtaggcgtgctgctagtcggctttcgcaaggagaatgttttaaatcaaccatcgtttgcgagcttccaagaaagcttaggatcgacgtttggagcttttcagatcagggaggtgtcacagccttga

SEQ ID NO: 8045 - DNA, 297 bp, Bacillus clausii
atggtagggtttcttggaatcaaaccgaaaaaggatgtggccgagatcgggctcggaatgaaaccggactacataggcaaaggatttggccgttcatttttgcaaaattgtttgtcctttattaaaaacaatttcgaagagataacggctgtcaaattatttgttgctgccgataataaacgggccattcatgtgtctgaagagtgcggctttgaaaaaagaagcccccataagcgggaaattaaaggcgatgtttacgatttcgttgagatggagtatcgttttaatcatgaataa

SEQ ID NO: 8046 - DNA, 222 bp, Bacillus clausii
atgctgtcattcggccaagccgtcgccctcatctccaagcgcctaatcgagaacgaagaccatctcgctttcacggaactagatgacaaccgattaaagcggcaaatttatttcgtatatcaccagcacctgtgggaaaacgatgcgattctgttttttaaagagtcggtcgctgctttgaaagaagtgattacaatagagtcggctccacaaataacataa

SEQ ID NO: 8047 - DNA, 225 bp, Bacillus clausii
atgccagagagaagtcaagcggtgatttccatatttttcgtcatctgtcgcagcaaccatagcaaaccagcaatgaacgctgtacttaaaagaacggagaaaaagggagaagacgaaaggccattgctccaaataagcacgggatctggcacgtctaaaccccaaaagcggttgtggacaatgacgactccaacacaaagcatgacgatgccaaaaccagcataa

SEQ ID NO: 8048 - DNA, 270 bp, Bacillus clausii
atggaattggcttatatccggcgtttgaaagctgtcctgaaccatccaatacctccttcatttttgaacagctctaggcaaaagaaagcaaccttttcagttaactggaaagattgcccaaacgttctaaaaaacaacggctttttcattataacgggttcatcatcgaacttcaatgtctatattgagcctgtcatcattgacgctgtgagagtgcaatgcttaatgggtcgtgataattggcgcttaataggccacctacacggatga

SEQ ID NO: 8049 - DNA, 435 bp, Bacillus clausii
atgaagaagcctaagcgcctttactttttactaatctgtgtaagtacttctcttgcttcatgtggagtagctgagaataaagacaacagtagcccaaataatgaaaatgaggaattaatcatacaagttattatcgaaagtaacgcttcgtacgcctctgatttggaggtggaaattaatagtagaaatagccctcaaacagttaacgaactatcaattgaggttccttattcaaaaacatttgtaatacccaccgatgcagcatttccaataagttcaactaaagttaaagctacagctggagaagatggagataggatatcctgtaaaattttatatgatgaaatagaagtagctactcacgacagcgaaggagaattagccacagctgtttgtgagaataagtttatagataacatattgtcctatcagtaa

SEQ ID NO: 8050 - DNA, 474 bp, Bacillus clausii
atggactcaaaaacaatagatagacgaacagagaaacaagagaaaacaaacccatctgtttggagagatcagcttttaagtgactccaatactgctaaacaatcttcaattatgctcataagtcttgcatttaccgcatgtctattagaggtggctaccatgctaccatatctattagcaataggaatgatctctgccaatgattattcacttcaacaatctggattgatactgtttggttactgcatagttatgattctgccagcactaattttattaatgggaagagtgtttgcccataacttgctgaaaaaaccccttattcatttagaagtatggttatcaaagaatgccagaaacacaacagcatggataattggcattgttggatttatcctagcagctaatgccatttatgagttagaactttatcatatcatggcttgcattctaaacgtctcttttgtaacctag

SEQ ID NO: 8051 - DNA, 525 bp, Bacillus clausii
atgaaaaataggcaaaaaagaaaaatgaacactctttcaaaagtggtcgcttctacggcgattacaactctaacaatagtgccttttagcaatcttaatgctgaaggcgtatctggaaatgtattgacgaacccaagtgcctacgcttcggcagctagtctaacagagtttcaattattgacggatgttgcagtcaatgctcaacttggtgatgctgatgaaaatgggctttatgatcttgggctttctttaactgggcgaagccttgctgatgctgagctcttcggtccagagcgtacggttatcttttattctcctgaccttgctgataaatggaccgtagaagggccagcgcaagtcagggtaaaaatccctccagttacaatggatgctttgccaactgtaggcaatttaataggggatatcacgcagcaattgaacactacagttaatgacttggttgctgcagttgaccggattgtaaataatccaattacggcgcctttaattcgtgtaagggattaa

SEQ ID NO: 8052 - DNA, 510 bp, Bacillus clausii
gtgattagtcttaaacaagcagaatcattattagacaaggcgtttgggcgttgccaggaatcgttgttgtattgggtaggtgtaaacgtaagtagaatccgcaaagggtttaccattgccagggatcgtttttttgacgtgtttgtgaaaacacatcctttgtttgaacaattccggaaagacatctataccctttataaggaacttacaaaaataaatgatcgtgatttagaggatgaaattgcttttttattcttagcctttatttctttttcttatttagaaaaaggcgaccaacgttccatttcttttatccaaaatgctttttccaacgcttctgctgattttgtcaaatataccatacaatggttggatcgttttattgatttttttggagtcgcgattagtggcgaagaatatacaacactatatgctaacttaattaacattcatttggcagacagttattttaagggtaattccttttttttcagcaacgacccattctga

SEQ ID NO: 8053 - DNA, 207 bp, Bacillus clausii
atggagtccattgttaaatcgcgtgcgccaccgtttttgtattctgctattcccatcgcttcacataacactgctttcccatcaacagctacaagaacgacgccattgaaactgccgtgctgtttgacttcttcgaataatgccgtaaattgctgcttcatcgctttattttccactattccccacctcggtttaattatgacttaa

SEQ ID NO: 8054 - DNA, 222 bp, Bacillus clausii
atgatggtaaagggagagactgggcatttacgcccagcgccgaaggagcaagcattttgcgaatctctcaggcaaagaagacttttacttgacgcatctctggagagcgctttttataagccacctacgaagacaattcggcttttggccgagggaaactttttggttcaaggacagggcatacacagcttgtgtttgccgtgtccttttttcgtctattga

SEQ ID NO: 8055 - DNA, 474 bp, Bacillus clausii; identical to SEQ ID NO: 8050

SEQ ID NO: 8056 - DNA, 435 bp, Bacillus clausii; identical to SEQ ID NO: 8049

SEQ ID NO: 8057 - DNA, 261 bp, Bacillus clausii
atgaaacataaaagcggacaaaaaaatattcccgtcatcccagcagctacgctagacacgaaagggttcagattgctgccacttatacctgaacaggttgactcttacgagatgcaccgacatgactgctttcaactggttttgggatcaatgaagggcacggtaccggctcaaatcgactttcaagggcttacaggcttttatccccaatacgctttgcctcattattcaaccaggggccgaagtttcaccgggatttga

SEQ ID NO: 8058 - DNA, 287 bp, Bacillus clausii
atgttaaacaaagcgaacaaaaatcgcctatccattgaggaaaagaaccgtctctatttgatttacacacgcctctttgctgacattatcaaaaaactcgacgaacaaatgacgacaaaaaacgagtctgtcactaaacgagtcatccatttttacagaattcagcttaaccgccttgatcatgtgcacttgaacaacgatgaaaagctctataaggaaatgctcggattgcattacgagattatggaagagatgcgccgctctttgcaaacccttttccaaaacat

SEQ ID NO: 8059 - DNA, 288 bp, Bacillus clausii
atgaggctgttggatagtaaaaagaacaaatttttctttagtttattggcggtatttattataactgttatccctaaagtcggtgtatacattaacactaataattacaatactattaggtatgatctagggtttcctgctacatggatatcagtaacacaacagtttaattttgcagatattaatctgatagggctcgtcatcaatgttgcctttttttacttgttttttgtgttcgttgaaataggtgttaaaaaaatagttaataaacttagaagagccgactga

SEQ ID NO: 8060 - DNA, 212 bp, Bacillus clausii
  misc_feature (1)...(212): n = A,T,C or G
atgagtaaaatttcactcataaaaaatgaggangcaactacagctatgccccgtagcaaaaaacaattcgaagaaatgcgtagcgcaactcgtgataaaattcaatctgccgccatgcacctgtttgttcatcaaagttatggctcaaccaatgttcagcaaaattgcccgaatgttanccgggttatcagcattggcttgttataccgact

SEQ ID NO: 8061 - DNA, 282 bp, Bacillus clausii
atggccgcggaaagaatcgaccgtccatccgagcgcatagccaacccttactcgttccgggaaatcaaatggcaggatctgataggaaataattggcttgaacagtttcttgaaaaatggccgaatcgatccaacggatggtcttctgctttaccaccacttagattaaagacgatccacttggctaactcgttaatggtcgtattaatggaaccggcgggccccattgcatcaatcaccaatggcacattttcttcattgaccccatcctcgttcggtgta

SEQ ID NO: 8062 - DNA, 241 bp, Bacillus clausii
atgaaagaaaagggggaaatcgtgttgaacaaaaaaccattttacacgtttttgctggcaactgctgttgcaagtacgctagctgcttgcaacagcgatactggcggttccggggaaggcactgacggaggagaggaaggcacaggaggagaggccgttgaaggcggcaatgtcaatcttggaatgatgtcaccgccagacaatttattcaatccgtgttttacacatctatgtacgatct

SEQ ID NO: 8063 - DNA, 243 bp, Bacillus clausii
atgagactcactgtcaatcgagggatttcaattgtgttgatcggtattgcagttgtttatttagtgatggcattccaattgccggaatatgcatttgtccccgttgattcggacttagtgccgaaattgctcggagctagtttgctcgttctaggggttttctttttctttgccaaagaccctgacacggaagagcaaaagaaaaagcggacgattccgaagaaggaagtttggatgcttctt

SEQ ID NO: 8064 - DNA, 210 bp, Bacillus clausii
atgctattgttgtttcttggcgccacttatttcacaagcataattgaagagcgtgaattttttcgattcgtaagcattcctcaatcgattttaactggttttttcctgcctttgtttctcgttgctgtcggcctgattaaacgacggaaaaagaaacaacctctttggccgaagcacgctaaagaaagcacaggaccgcctacttcctaa

SEQ ID NO: 8065 - DNA, 342 bp, Bacillus clausii
atgaatgagaaaacagctaaattaacaccaaagaataaacttattgcatttgtactactccccttataccaaatcgtattatttttaataaccaacataattgtcatgtatttaaaaggaacttggtactttgatatatggggatttttaggatttttgataatagtacttgctgtttgttatattctcaatccagttttcgatgcatttgattttaataatatctatattagaaatggagaggcgtcattaattgagaaaattaaaaggttcaaggtggtttttataatatttacggttgctccaatattagtggggctacttgcgttgaatacaaactaa

SEQ ID NO: 8066 - DNA, 250 bp, Bacillus clausii
atggataaacatgtgcggttcgcaggcagaactcaagggcgattcagggcaagccatgcaccgggcttccaccattcccggttcgctttggcatgtacgcgattgcccactgtccctatccttgtttttaacgttcattcattttatggttttcattataaggacggaacccagaaaatgcaactggttatacgttttcctgctcttcctgttcttttagcagttcctcttcgtcaaaatcctcgttccc

SEQ ID NO: 8067 - DNA, 233 bp, Bacillus clausii
atgagcaacaaactcacggtgagtaagatggatagaaaaccggtcgttgggatcagtttaaaaatttatatgaatacggtagcaaagacacgagcgtatgtacagcaagtgaaagtgctttgccaagagatatcgaagttagaggtttttatctttccaagtttaggcacgaataccttggcgtttgccagaattattaaagaataccaatatcgggtttatggagcaccaga

SEQ ID NO: 8068 - DNA, 272 bp, Bacillus clausii
atgtatcaaacaattgtaaaagaaattggacagatggccccatcttttgcagacgacaaaatcgtgattctttttgggatggaagcgccagcagaacttagggaaatttcattcctccatcaagtagatggggaatttgaagacaatcccattaaagaaggcggtacacttggtattgatgaacaggaatttgtaatcgaaaaagtcggtttcggctgcaaatggaaatttaccggacatttgggtcacaatcttgaattactttactggac

SEQ ID NO: 8069 - DNA, 558 bp, Bacillus clausii; identical to SEQ ID NO: 7515
  misc_feature (1)...(558): n = A,T,C or G

SEQ ID NO: 8070 - DNA, 290 bp, Bacillus clausii
  misc_feature (1)...(290): n = A,T,C or G
atggtcaacgcctctttttttaagaacttcacatatgcaactgacaaaacagtggactttaatcataaagcggctcttcctgtttgtcggcaacaaacgcagccaatgcgccgactgtgtaaaatgcttttatatcaatgtgctcatctggggatggcaacgccatatttcatctctaattcaagcaanaagcttgcaaaatcatnaattgggagtcaagcgccaggatcttcgttcatttcggccgccgtctttgatngaaaacntgtttccagccgtttgggccactt

SEQ ID NO: 8071 - DNA, 413 bp, Bacillus clausii
  misc_feature (1)...(413): n = A,T,C or G
atgaagtgccgggttggcagacaacggatgatagccaaggcgtcaaaattattgaaatttggaattatgaacggcagtacccacaagggagtaataaacttccctgctccacctgatggtgtccgctatgccgaattaaatgcgtttgaccatgggttgctgtatcaagatgtagagacgactcctggacaaacgatcaaatggcgcttgtcgcatatgggacgccacggtgttgatacgatgcaacttcgcatcggccaagcaaccgacgacccttatgatacggaaatcatcgaacaaatgtcggatggaaacactgcgtgggggacgtacactggnaacgtataccgttccagtccggacaacccgttaactccgtttcngggtttgaaagccgttttctacttgccaag

SEQ ID NO: 8072 - DNA, 213 bp, Bacillus clausii
  misc_feature (1)...(213): n = A,T,C or G
atgaacaagctacccaaaaatttgtttttggaaattcatttattattaatggaaatgccccaagatgttgtaacatatagaacaagcatggacaaattattaggtgaaggcagttattcgattngccaaaaantaaccattgcccaggcggcccntgcccggccacttaatgggaggaagtcgtttcgaaaatggcgtgatgatttcatctaa

SEQ ID NO: 8073 - DNA, 304 bp, Bacillus clausii
atgactttaaacaagcttctatctggattacttgttgttatttctatatttacagggggtgtggaggaccctttaaccccggatccaaacaaacctttaggcgacgttctcccaattgaaaaagccgtacaagaatttaattacctgtacgggattgaagtggttttacctcaatacttaccgattcattacacaactcaaggtgggtcgattgatcaaggttcactaagagtcgactatatggaccaatcgaataatgaattactaagtataaacgtttttgtcggggaaaaacatgtagaaa

SEQ ID NO: 8074 - DNA, 702 bp, Bacillus clausii
atgaaaaaggtaaaatcattgaaattagccatgatcgctacagcttttgtaggagcgttagttattgttctcggctcaggagggtcgttttcatggtttacaggggaaacgtctgctactggggaaattaaaaatggaacgctggaaattaaccatggcgaggacattgacggcaacatcgtccaagcggaaagttttgctccttcacagctaatttttggcgattggctctcaattgaaaatacaggcaccctcgacactcatttgcaagcaacctatgaccactctgtcgacttgaatgtacccatcgatgcgtataaagttggctacattgcgattaagtatacaacaacgccaggcagggatgtgtatgaagatgcacaatataagttagaccaattgtttaatggcattactaatgaagttcagtctttttcacatacggccgaggcaaatggcgttgaagttgtagctgtcttaattgatgaacaagcttatgacgaaaatgctgatcagtttgtgcttggcgatggcagcttgcaaggacctgacaacgaattttggcaattggatgaaggccaatacattgatcttaattttggcgtgaaattagacgagaatgcaggcaatgaataccaaggagctgtttatactgcttcacttgaagtattagccaagcaaacagaccaaggcgcgaaataa

SEQ ID NO: 8075 - DNA, 351 bp, Bacillus clausii
atgtcttgggattatcacaaatacctgcatatatatgctcagcatacccatcatcaagagtcattcattgtaggcaataaagaagcgctactagaattaaggaatttaatcgatcaagcccttaaagaaggggaagccaaaggcgtttttttcccatcagatgaggaggggtatccattatatgtttcgttagtggataatgaggacagctttttggctcttgaaatgccgtatacagagcaattcggcgatgataatcaacatttccattttataaatacacaaaatgatccgaatgccccgtactcaccggcaactttgttcaaagaagaggaaaaaggagaggaataa

SEQ ID NO: 8076 - DNA, 654 bp, Bacillus clausii
atggtgtttgcgttttcgatttttcgtaaaggaattcttaaaaaagtctacagtaaaagcaatgtttccttttcaggcacgtatttaattatcattatcctgccacttatggcccgctacggggcagatgtagccccgcaaatccgggaaattctcagtattggatggattttcattgttcaagaatttggcaatttaggcacagttttattaggcttgcctgctgcactattgctaggtttgcggcgtgaggcgattggcgccacgcttggaattggtcgcgaaggcgagctcgcctatatttctgaaaaatatacgttaaactctgatgaagggagaggggtcttgtcgctgtacattatcggtacgctatttggtgcgatctttttcagcattttgccgccagttttgttgcatttcggatttagcgttgagtcgctggccatttctgcgggcgttggttcaggcagtatgatgacagccgcctcttcatcactcgtagcaagccatccagacaaagagagcatcattcttgcttatgcttcggcaagccaactactcacaagctttattggcacgtttacgatggtgtttttggcggctcctttgcaacggttcatgtatcgcacgctgacacggaaggaggctaaatga

SEQ ID NO: 8077 - DNA, 264 bp, Bacillus clausii
atgaatgcgatcattggcgctaacaatagcaaggaaacctattatttctctgttgatcgtgctggccatctagattactgcgacttcgtatttactagtgttaatgaggaactcagaggcgaacgggatgctatggaaatgcgaaatcttgttacagactatacgaagaacttttttgatcattacatcctgcagaaggctgcaagtgtggagagtctggcatatgatggcgtggacttgatcaagaagaccagcaataagtga

SEQ ID NO: 8078 - DNA, 264 bp, Bacillus clausii
  misc_feature (1)...(264): n = A,T,C or G
atgctgaaaccaccttttttcatcgctngccatggttatcctcnttatgaaggcccctttcgcaagaaattctcctctcttccattgtatngtaatcgcttacattatttcaaatgtttttttctttttttgtacatttantacaggtcatcatttgttgcaaatggcaaaagcgcctcccccagcgagagggaaacgcttcttcttgctatgngtataaaattaagaacacgattccagcaatggcaaataacccacaactaa

SEQ ID NO: 8079 - DNA, 591 bp, Bacillus clausii
atgcattgctttctttattcagaaatggaaggagagccacttttagttcatgcgaatgaaacaagctttgagttagtaacgtcatttggcgatttagagcgccttaccaacagcttcaaacaatgtgctttatccgcctatttaaaaggcaaacaccccaaaattgcgtttcaattaggctgggggacgggaaaaacacttcatgaagcacggacaaacgcaaaaacggccaacaagcaacaaaagaaaatcggctgcccttatatcttgactgaaagcacgttgctcggccctctaggcgacgggaaacgcctagaactacaactggatccgcttcaattgcaaaaatggagcaaacaaactggcgtatctgtgttgcaactgcaaaaaattttggcaatacctgcaaaaacaaagcgccatgatgtctgtgcaaatgatctcgcgctccatttaggcatcacgactcgaagcgccaatcgcattttaaagaaattagaacaaggacaagccgcagaagaaacaacagtaaggcaggaaaaacttcgtggccggccacgtaaaagtaccggctcctgttccattagatga

SEQ ID NO: 8080 - DNA, 318 bp, Bacillus clausii
atgatgagaaaggaggcgtttatgcatatacacgcagaagatgtgctgttgcaaatggaacggcaaatggggagaatcgcgaaagccgttaaagacaatgacggggacgaattaaaagaagcggctgctgtgttggagagctattgccagttgttaaaagggcatcctcttgagtctaggttacagcaagagaaaacaaagccgatttcgtatccattgcctgttcaaaagcgagttccggaaacgaaggaatttggttctcctttggccgaaacggaaggtgaacaagaggaaaagcgaaatttacttgatttttga

SEQ ID NO: 8081 - DNA, 268 bp, Bacillus clausii
  misc_feature (1)...(268): n = A,T,C or G
atgctgttacgatcttcctcaatctccgaacagcctaatcaacatcatgctgaaatagtggagcatcattttcccaaaacctttacctatttcgatcgaatgcttcccgataaagttcccttaactcaactgnaattatctttccattcaactggttgtccgttgacgatctgtttaaacacacccagacatctatgcccatcctggcggcagttatacatcgcccatttccttaatcggtncaaaaaaatngtgggaatgaaacacc

SEQ ID NO: 8082 - DNA, 525 bp, Bacillus clausii; identical to SEQ ID NO: 8051

SEQ ID NO: 8083 - DNA, 270 bp, Bacillus clausii
atgctgtttcatccggagcaagtgcatgacggaaagtcacaggaccgaagcggcattgattatgtcatgatttacatcgatcctggtcagtttctcgattggatcggcaaaaaagaggttgttaaattctccgcacctatcgtgtacaaccagaagctgaagcagagtatattgaacttggttcaggcgatctacagcgatcaggacgaaacgatctgtagcgagttactagtggctcttgcggatcatttcgcggatgttgaaatgagc

SEQ ID NO: 8084 - DNA, 609 bp, Bacillus clausii
atggggttcgcactcaacggttcagacgatattgccttaacagatgattttacaagtagctttcttgacccagatgttgaaacagacgaagggttccattatttcaggtcagaaaaaaacaacttttccatgtggtttcctgcggggtattacattgaagatgatcctaccctgtacgagagcaaagaccattttgaatttctcgatttttatgaagatcaaagacgtttaaatgaaaatggattctcgggatttattcagttaaaataccgtgacaatatgacggagtatgacggcgaattagaattagcaattttactaaaggattttggattcaaggaccagcatgaaaaacttcaaactgaagaaacaatcatttattacggctcatcctatctaacattggaagataaaaaaggggttatttatgacccggaaacacaccctgctaatcggtattttgccttggttcaaagtgtggattacaaacaatttattgttgttaagtatggtatattttgcaaagatgaaaaagactgtgccatcaacaatgagcaagaaagcagttttttcgatactattatccaaagcattcgtttccaaaagtag

SEQ ID NO: 8085 - DNA, 267 bp, Bacillus clausii
  misc_feature (1)...(267): n = A,T,C or G
atgaaaatgtttcataacgggaatagaaaaaggatacggattgaaaagaagaattttttccccgctgcaattcaatcccgttttaagaacatgtatgcccacntaccattcaatattcgtaactttcccaccatggatcacccattttttagccagcgcttgttagaatgcagagcacccttgcttctttttacattgtacaaaaaaagcttgtcgcctgtcctaacaaaaccgaaatgcaaacggcaaagtcgtgcctggacgtaa

SEQ ID NO: 8086 - DNA, 444 bp, Bacillus clausii
atggcctttcaattttcgttacaaacagcgatggatgtatgcaagcaagaaaaagaagcagcccataagcaatacgaagtggctgttgacgcatttgaatctgaggcaatggcgctgttccgtttgctaaagcaaaaagaagatgtacaagcggcgaccgagaagatgctggttgaaaaagcgtcggtttccgatttgcttattagccaggcgtgtttagacggactgcagcagcaaattggaaaacaacagctgcgaactgaccaagctagggttgatatgcttcaaaagaaagcgacgttccagcaacatgccgtctcgtataaacaatatgaacggttgaaagaaaagaaacgccttgaacaaaaacaagcagaaaaccgccgggagcaacaactgatggatgagttgtgcgtgacccggttcaaaaggaaatttgcctaa

SEQ ID NO: 8087 - DNA, 285 bp, Bacillus clausii
  misc_feature (1)...(285): n = A,T,C or G
atggcagtggatacttcagaaaaaggtttcgaaacgaatatcgaattagcattaattgcgaatggctataaaaagcgtgtgcttgttggagagacaagtgttacttttaaacagcatgccattgatgttgaggagctatttgcatttttagaagatacacangaaaaacgtatgcgcacgttagagaaattgtatggtccttcttataaagaagaagtgttaaagcgtattaaagaccagctgcatcgtcaaggcttggtcgaatgtttacgttctagggattaa

SEQ ID NO: 8088 - DNA, 307 bp, Bacillus clausii
atgcaaatgttatcaaagaaatatcccattttggagcattctttatattcaacaccaaaaccagttgtgatgtcaaaactaatgtcgcatgcagggatacatggtatttttgtcccttttacttttgaatctaatatcaatgttaatgtgccagttttcttggcgcctgctactatggcacatgaattggcacatcagagtggtttcatgcatgaggatgaggcaaattttatagcttatctggcatgtaagcagcaggacgatccaatgatgctttatagtggtttttttctagcatttgattatt

SEQ ID NO: 8089 - DNA, 306 bp, Bacillus clausii
  misc_feature (1)...(306): n = A,T,C or G
atgggctttcgnaatagtattgaccttggaaaggcttttcaagcagttgtgaagctgtantcagcaagagctnggcgctttgatcgaaaaatgcgntggcaacgtccntcaangtttccccatttcccagccaattcccgtctgctcccaatttgccagaaaccggtctgcttgttcttgaatgcgagcaattgcttgttgtttgccgcggagttggtcggttttcgcggaggtgtggccattgtttcgggatcagttcagcttctacccactctgttgcttgaccacgctgcttcagcaggttga

SEQ ID NO: 8090 - DNA, 397 bp, Bacillus clausii
  misc_feature (1)...(397): n = A,T,C or G
atgattatgatttctttgtgttgttnctttgataaggataatggaatagttcatataaatgaaactgatgctggaaaaggaaatcggcttgtggatagtatgtttccggaagcatcagcaattaagggagattcaatttatcgaagcttagacggaattaatcgattgatgattggaacgctgggattaaagcaaaaacctagtgggaggattagctttagaatgtttgctggtgctgatattaaggctggaattagtgaggcagttgcatcgggttcgactaagtctaatctattcggttacggctatcaagacggagaacgaattagtattggttgttcatataaaggaaaagtttggatgcgctgggtagagcggataaacttttggacagact

SEQ ID NO: 8091 - DNA, 220 bp, Bacillus clausii
  misc_feature (1)...(220): n = A,T,C or G
atgcctattgcatggttcttattttctaaattattgttatcaccgtctagcatgtcttgtaatgtgtttttaactccattagctaaatcaatcatctctgttgcaatcggaaggtctgccttatacttttcttctatttcggaaatgatcgcctcgcaccttttaatccctgcttgcnnttcactcttttgctcaaaacttccatcttcgtattctaccg

SEQ ID NO: 8092 - DNA, 249 bp, Bacillus clausii
  misc_feature (1)...(249): n = A,T,C or G
atgatcctctggcaccagcttttcaatccagaccatctccatctgcatccgtttatcttccagctgtttggnacaacatgtttcctctcaccccgtaccctttttctcttttttattgtacaaaaaagcctgtcgactgtctcgggaaaaccgagactttgtcgacaggctggaaaatggattctgcaagcaaaaaaagcctttgccacaatggcaaaggcttcaaaggaaaattttgaaaagggataa

SEQ ID NO: 8093 - DNA, 423 bp, Bacillus clausii
gtgttggtcgaaacgcatccccatacgttatgtgatacagtcccgtccacgctgcaactggtggcggaagtcgatcacccagggttagcaatcaattttgatgtccttcatgtatgggaaagcggagcggatgtaaacggtgcgttcaaacaattacagcctcatattcgccatctgcatgtaaaaaacattcgctcgccagaagacttagatgtatttgcaccggaaaacgtctatgccgctgccgggtctagagagggaatggcccggctgtttaatgggtgcgttgattatgaatcttttctgtcggccaatcaattggacggcgtcaatgtatcgcttgaatggttcgggaacgatccgtttcacgtattagaacaagacttgcagcaattaatgaaatggaaaacagtccccatgtag

SEQ ID NO: 8094 - DNA, 455 bp, Bacillus clausii
atgagattgaatagcggcaactcatacggggcaaacgtttcagaaaaaaatctctcagggaatagacccatgaaattggtagcgacattatccttttctcgtacattaagctccaaagaagagcgatcgacaagaaaaaggacaatggctacgacaatggctggaagaatggcccaaaacgtgcttttcaatagcgagtcggcttttttgtctgttgacatcgtatccacctctcctaattcaagaaaaaataacaccatactagtctctacaaacaaaatattcaaatatataggtgttaaactttattttccgatattttcacctattatttattctgccataatccctttacccactctaacaagaaataaacctctttttgcaaaaatttattcggttttctccttccactatgtatgtggcaaaaaacagcctttaattttgcgtaataa

SEQ ID NO: 8095 - DNA, 227 bp, Bacillus clausii
  misc_feature (1)...(227): n = A,T,C or G
atggccaagtattcaacacttggtcaggcaacaacatcgcttttcttgcatgggcatagccatattcaacatttgcaagcgtaccgattccatgtgcgtctgaatttaatagcaatcggcacacctgttttctgctggctaaactttaaaccatgtttacttcntaaatcccagaacgcctccgnacttggcattncaattncgaagttgcgccaacccaagctttc

SEQ ID NO: 8096 - DNA, 210 bp, Bacillus clausii
  misc_feature (1)...(210): n = A,T,C or G
atgaatacgtacattcgaatcattgatggtattaatgatggggttaagtcgattgtatctgtgatgttggcgatcgtgcggtgcttgtcgttgtcacaaatgacgacacggtctgtgattaatgtgccccttgcgtggacagacgaaattggctcgttatttaatgatttacnttgtatggctagggtccgggctagcgatgcgccataa

SEQ ID NO: 8097 - DNA, 363 bp, Bacillus clausii
atgatgaaaagatatgcagtaggtgtcgcaatacatgacggtgagattgtagttaaaatcgtgtgggctacagatgaaattaaggcaatgatgagggcagttcaagaagaacaaatttccttcgttgaagaggaacttggggaagatgaagcaaaaattgcgcgttctgagattgaacatgatgactctacaatggagttttcctctattgagcaagtaatcgagtatttttacaaaggagatactcacgtttccagaccagtggaaatccgagaacatgacctccccacgatagaagagggggtagagggagtgaaggagttgttggatagatacgagcacaagtggtctaaatataagtag

SEQ ID NO: 8098 - DNA, 366 bp, Bacillus clausii
  misc_feature (1)...(366): n = A,T,C or G
atggctccatcaacgaaacatattgccgaaagtgcgtcatttcaagcgtttgtaaacagctttattcgtgagacggggacagggtgcatgaaggcattaacaagcgtagatgaagtcgaattacaacaaaagatgcacggccctttcatcatggaactacatttgccaaagcagaaaacaacgttatggatcgatgtgctttacagatcccttgtcggtcgccacacgtttggggatgtttttcaagttaagcaaagangaaagtggcaccaagaagacctttttcagctatgctttttgcttatacaagagttgcatgcacaaagcaaaagccaactccgggaaatgccaaactcttgtttttga

SEQ ID NO: 8099 - DNA, 273 bp, Bacillus clausii
atgggagggatttttttgaaagtaatcgcaggtaggttcacttttgtaatgttggccattttatttgtaattggcacaacagtatcttcggtcgcaggtgcgcagagcataaccgatgaacagctacgaaaacaagttagtgaaaagataacgaaagaactaggcattgagtactatgaggtagaaacaaaagaagctgaaacatatgtaaatgatttgaagagtaattctttatttgtaaatgaggctaattctgatatatcagaatattag

SEQ ID NO: 8100 - DNA, 306 bp, Bacillus clausii
  misc_feature (1)...(306): n = A,T,C or G
atgacatctaacaaaaaatcggggcaatannctgattatggcgcatcgctagcccggaccctagccatacaangtaaatcattaaataacgagccaatttcgtctgtccacgcaaggggcacattaatcacagaccgtgtcgtcatttgtgacaacgacaagcaccgcacgatcgccaacatcacagatacaatcgacttaaccccatcattaataccatcaatgattcgaatgtacgtattcatagcgttactccctcataccttggatcgtgtcgtaaagttctctcccgtatttatcagctaa

SEQ ID NO: 8101 - DNA, 402 bp, Bacillus clausii
ttgatgcttgtttttggattcgctgtttttggcgctttgcaattttcacggttggcacagttttttccactgtatgtttcgattgctggaaccgtttgtacagcgatttacttagttgttttaattatccgttatcgaaaagaaaacgcatcaagttcaagagtggtcgtttctatcgcccggccactacgctatatggcgtggcttcttggctacattgccttcatttatcttgtaggcatgttgattgccacttctctgtttctcgtcgctttcttgatgtttgaatcgaaaatgccatttatcaagactgccctttctgtcgccatcgtactgatcggaatttcagccgctagctccctgctcggtgtttactggccgacaaacttgcttgggctgtaa

SEQ ID NO: 8102 - DNA, 252 bp, Bacillus clausii
atggttaaagtaacggcgttagggggagtcggcgaatacggtcgcaactgttttttgcttaaagaggaagcgaccaatcaaacgattttgcttgactgcggcgtcaaaaatggaaaaccagaacaatttcctgcaattactgagcaactagcttctaccattgatgttgtgtttatttcccatgttcataacgaccatgtcggcgctttgccattgctcgcagcaaaggatttacgaaagagatatggctga

SEQ ID NO: 8103 - DNA, 231 bp, Bacillus clausii
atgttgttcgcttttgggattccagatacttctccgcctagcgcacgaatcgaaatcggtaatgccatggtcaaacgaaacgaccacttctgggttaaccggtactttgacaacctcgcccgttcattgattccacttcgatcgtttcttcagtcgcctccgtgctccgttccttccgccaagcatttgtttgctccattttccatcctgaaacttgttaccgccaagcgg

SEQ ID NO: 8104 - DNA, 327 bp, Bacillus clausii
atgaggcaatggggcattttcaaaaaggccaaacgcccttatgaaattagagagacgattattaagccaataaacgttatttattttgatttggcaatggcaaaggattatggcacgctagaagcattggcaaaatggtcgaaaaaaggtggagaaacaaaacagattatagagaacgggcttccttacaatgttgccgtattggaaaatgggaaagaaatgaagattcccgttcggttaaaagcagaattggatacagaaatgcaagaccaagaaaaaatccaactgaaaattaaactgactggccattcccctgtctccgattga

SEQ ID NO: 8105 - DNA, 287 bp, Bacillus clausii
atgttttccgtttcgacagggaaaagcaaacatgcctgctacaagaccactgcctcctgcaccaaggccttttgtacaagaatacattgttcaagaaatccagcctgtcttaacaacgtacgtcacaaaccgtgtctaccgccatgtgcacactttgcccgcactcagcatccgttgccaatgtcgtccacaatcagcaagcttttccccctacgcactatgttccaggccgacctcgtcgctaagcgaggaggtgaggttgttggaaaggccggcagcatgaatgc

SEQ ID NO: 8106 - DNA, 204 bp, Bacillus clausii
  misc_feature (1)...(204): n = A,T,C or G
atggattggcttacgtatggaacanggcangggcgtcaaataaatgaggaatcnttcgttaaacanagtntncccttgttaatgaacggagccnaagaactgctggaanaagtnctgtcnctattgctgtggcaagaaacaagatgcatacaaaaaagacccactcccacgcgaagtgatacgctcccaccatctaatttataa

SEQ ID NO: 8107 - DNA, 1423 bp, Bacillus clausii
  misc_feature (1)...(1423): n = A,T,C or G
atggatcgacataaccgtatcgttgattttgtcccttacttgcaagatattacctaccggggaaaacagtatcgtggcgtaacggcgcgtgcggatggcaatggccaatcgattcaccgtatttcccagtctagcgatttgcgtacggctttccgcgctgggccgatccagcggccgccaaaacggattcctgtctccccaagcaagttgctgttaattactgaatttatgtacacgccctattttgatgaaggcacaaatgaatatgtcgaaatcgccaatataactggcgaaacaatcgatcttagcggtttttatttcggcaataaagtggaggaaaacggcgttgcgaataaagcgatgtacaatttcccggaaggagcgatgcttgccccttattctgctgctttaattgcccgcaatgcccaagcggtaaaaaaattatacggcgttactgctgattttgaaatggaggaaacgattgactctgtccctaagctccttccaaactgcgattggggctgtggaaacttccaaatggccaacggcggcgatgccgtcgtattgcttaaccgggacaaagagcttgtcgatgccgttgtttttaaaaatgccctttgtatgggcctctcttctcatcctggtgtttttgccaaagggcactcccttgaacgggtcagcgccattgacacgaaaaaccctgctgttgattttgtggaacagccacatccaactccaggaaaactacttttcggccctaatggcgatccgtcacttgttccgagaccttctattaaagaagaggtgctagaagtcaatgagccgaaaaccgctcttgtcgcaagccctacaatcattgatagctctaccggtatgcctgacgcgctgccagccaatgtcccttctattctgatcaaagctgaatggcgaaacggcagtcttgtcgccagcaatcgtggcgtactgcttgatgaggcactagatacggttaaacaaaaaatgctgccgatgatcgagatcaatgagcacttccttgttccttatgtccatcaattgcttaagacgaaagggatagacgatgtctttatcctttctcgccaagcatccattattgaagcaatgagaacatggaacaatgaataccggggggccttgcgtctttctgggcagacgttgcctaagaaaaaaagagacgatgccattcgtgccatccgccaatgccaatgttttacaatactagtacaagcggaagcactttctgctgaaattatccattactttcgcagccgggcgattacgatatgggcatatggggctaacagtgaattagcgatacaccgtttagctgccattggcgtccaaggcatcgaaacgccaatacctgaaaaagcaagttgctggctttacnagcgtaccagttgga

SEQ ID NO: 8108 - DNA, 309 bp, Bacillus clausii
atggaggacatcttctattccacaagggagaagcaagaaccaaatgatcgtctttgtctaacttcacgcctaaagcagttgcagtttctggaaactttgaaatcgcatcttctgaagacgtgtaaggcggaaaatgatcatgtcatgcattctagcttgatttttaacagaccaaggggatatcaggcatcaaatgcttccagattgttctctaaatccttttttcgacattcctcgtcgatgttggtgtttatcaaaaataaaataaacatctacatcctgggtgttctttcgttcctaatccattaa

SEQ ID NO: 8109 - DNA, 309 bp, Bacillus clausii
  misc_feature (1)...(309): n = A,T,C or G
atgagtgcnatagctatattccgaaaacaaaccgccatccatcctcctcctttcgttagaataaaancttatttanccattnnaataacgaactcctatctatcggtcttattaaatacggttccttgctctcagtttccgaacttagcttttttggccgccaaaaaagacagtggttattatgagccaccgtctgattgtgatacactatgctatattaaagaagtttacagaaaaatctatattcaaaacagacacagaccctatnaaaaagtanacagagccagaggagctaaaaatnanaaatag

SEQ ID NO: 8110 - DNA, 525 bp, Bacillus clausii
atgttcaaaatgggaaaaaaaccgtttgtcgttttcttatttgcaatacttgctttatccgcttgcgtcgatggaacttctcctggcaaagcatctgatgaaatcaaagggctctccagtcaattggatgtcaatcatgcacaaaaagaacattcaaaagcagctgaaacctatgcccgtgcctttgaacagtatgttgatgaagctgcccctgtcctggtacaattgcaagaggcggtcatgacaggaaataacagcgaagcagccgcgctcacagaacttctagccgacaaagcaaaagaacacgagcaaacaaacacgtttccgccgccatttgccggagggtttgaggatatccaccattcctatacggtaagcttaggcgagcttgaacaggcactaaatacccgttcctatgaggccgagcaacaacattacagcaatgcttccttatcatttcgattaatgaggcgtgaatatgagtcacttattacggaatatggcattaaagctagcccctcatag

SEQ ID NO: 8111 - DNA, 225 bp, Bacillus clausii
atgaatagccgagataaaggagacattactttcattgacagcagtgatcaaggcgatattacttctattgacgaccgtgataaaggcgatattacttctattggcgaccatgataaaggcgatattacttctattggcgatcatgataaaggcgatattacttctattggcgatcatgataaaggcgatattactttcattcacacggcaaagccaaaagcttaa

SEQ ID NO: 8112 - DNA, 360 bp, Bacillus clausii
atgattcagaaaacagatgtattagcagttgagacaagtttaggagaagtaaacgatgaattgcattatgcttgggatgtagaagcagaagattggaaagaatacattggcgcacgccctgaaggcgagacaggggctgcccttcatcgcgagtcgtacgcaaatcggtttgatgccaaccagcaacgctggtttaaaaaaattgccaataaaatcgagaaacaagcaagaaagagaaattggcaaacgattcatgtcgttggctcaccagaccaaacgacggcgtttgtcaaacaatgttcgacggctgatgttgccgttttaaaaaagaatttggctaagttaaaagcacacgaaatc

SEQ ID NO: 8113 - DNA, 272 bp, Bacillus clausii
  misc_feature (1)...(272): n = A,T,C or G
atgggcaaccaccgcgccgaccgcgaggaactaaaccggttaattcaggaatacaaacagattatggcggagtacatggatagcgtattccgtgcaaactctgtccgaataggcgcgcaagaactattggcaaatagaggtttttcccctccgcacattgcagtcgtagaagaaggcgacatttacggagacctccaagccatccaccgcttttgggacggcatggtngcagccgactcaaccgcaaaagccgattttccngccgcgcaaac

SEQ ID NO: 8114 - DNA, 201 bp, Bacillus clausii
  misc_feature (1)...(201): n = A,T,C or G
atgacccaacaaaggacaggacangacatccaagaaatgatcgaacaactagagcatcaagcccggcaaatccaacacgagattaaacaacaacaggcagcgacccttcaactagagcgcctaatcgccagcaacgaagcgtcgatccactctgtcaaagccaacatcgctagtacacaaagcaagctccgtgctctataa

SEQ ID NO: 8115 - DNA, 339 bp, Bacillus clausii
atgataaagaaacaagcggttttattgctatctgccctgttggtaacggcttgcagccaagcagaagcgaatcagttggagcctaaacaactttctgaaatcgaacaacgttatttgcaagttggtaacagccattcatttgtgtatgaagtttctcgtttcgacccagaggcgacgacactatcattcaagctccaagcctatgaaaatggcgaacgctcagaagagtggacacgagagatttattcgatgcacgcagaggaaggcgaggggttgttttcaggatgggaagaaatgattgtaacgattgacagccctaggctttacgaagaggaaggc

SEQ ID NO: 8116 - DNA, 483 bp, Bacillus clausii
  misc_feature (1)...(483): n = A,T,C or G
atgaatgctgtggacagccaatccactcaaataaaaatggaatatcagttcantagtgacagaaacgggattactgataaacagagaaaagacgtttctgcgattttagatgtcagtgcccgatttaaaatttttatcaacgacgacctttactttgatcaagaagagttccccatcctcgagttttataaatacttgtataattggaagaaggcaatcgatcagtctaaaagagcgcaggaatttcattattatacgttggagtttgatgaatacgaagacggggcgattctctcgatcattccttttggcgatagcgctagactgaaatcgatttgggcagaacaagagctctatcatgtatttgacctagactacttgattcaagcgtttttaacattagagaaagacttaaagcgagatattgaagcgtatttccctatcaaactagataaattcataaaacntattcccgccgctgta

SEQ ID NO: 8117 - DNA, 384 bp, Bacillus clausii
atgatcgttgttttcggtcaagaaggaaacgtggttcaatttaatgatgcggttcatgagtttcttcagaaccacgaattaacccatatttctgctttggttgcccactgtgagccacttgttaaggaaacgttctactccgaaaaagcaggccataaggaaatccatctccgcaatcaaaccatttgtgagctttctacgtacccccttctcaataacgaacaggtgatgtatggggtgattgcttatatcaaagatgtgacggaaaagcgaaaaatggaagtacagctcatccattctggcaagctagcggctatcggtggaaatggccagcagggagtgggcacatgtaattggaacagcccgtttaacggccatttttag

SEQ ID NO: 8118 - DNA, 225 bp, Bacillus clausii
atgaacatgtttaaactgctgctcgaattaaaaaaagtcggctatgatggatgcctcaatcctgatcatgtccccgttttagaaggagacagcccagatttagatgctaattgggcccactctaatattgggtggagttatggaagcattggctttgcctattcaattggctacataaaagcattgcttaatgccttgaatgaagtgacaggaacaaaatggtaa

SEQ ID NO: 8119 - DNA, 213 bp, Bacillus clausii
  misc_feature (1)...(213): n = A,T,C or G
atgagctgctttcaattcgagtcgctccatgtcgacnaaaagattcttttaaccgaaggaaatgcctttgagcaggaaggattgctttccgttatccgcgcctggacagctaaccaagaccaagaaatacagcagttgcttgcaaaaggggtaggcacgatcatgacagactatcctagccgtgccattgccttacgtgatggaatgatatga

SEQ ID NO: 8120 - DNA, 234 bp, Bacillus clausii
atggtgaaacaaccacagcgtgagttaatagaggcgggtgtcgctggcctatacgacaaagtccaggtagattcagacgtagagcgtgattttatccagaacccttgttcgaccctgatgttgagaaggataatacaattctttattttaaatttcccgccgaagtttaaaatattactgccgaaaattattggaaactataatcccgacctgggcaatcgtcaggaaagatga

SEQ ID NO: 8121 - DNA, 397 bp, Bacillus clausii
  misc_feature (1)...(397): n = A,T,C or G
atgattaacgagtttatttcacaaactactgaatttttaaatcagtcaaacattaggattcatgaaagtgacgtaagacttgtaaaaataaacgacgattgttctaccataaggaatttctcatatgttaacttaaatcccaatgatattgccgaaaatgttttgttacaccctttgttgttttttacgttactcgacgcaaatttggatcttaaatacccagagctaagcggaaaatcgttttctcatagatatagaaacttaccttcttctaatgatcaagaaatcattttaaaagaatgttacagaatactanagctattgaggaatgcttcggcccataataaaaattctataagttatnatgacgaatttgtatgtgtttcttatcaatttg

SEQ ID NO: 8122 - DNA, 348 bp, Bacillus clausii
atgaaaattgcggttgataatcaactatcttacgaggaggagaggatcatgaaaatgctggcacaaataaacgatgtggctgggaatggtgctcgtcctgatcgtgttaaccgtatttggagtagcgatgatgggatcggtgcttggatcgaagccaaaggagctcccgatggctctcgttatcctcgacaatctggcggaactttcgaccaaaggaactttgctgtaggggaaatgatccgagcaaagttggtatcaaacccggcaatgccgtttgtctggcatgtggtcgattgcgaggaaaaggcccgggaagcttacaaacaatatagtggaaacaaaacatga

SEQ ID NO: 8123 - DNA, 258 bp, Bacillus clausii
  misc_feature (1)...(258): n = A,T,C or G
atgatgcaaatggctgtatgtttcttcgggcaaaggaagagtattcattgcaccctgatcacagggnacattattgattatgccgacaaacacaaaagacagttaatggcatttatggtcgagcaaggacttacaaagcaagaagcaatacgccttgtcttactgtttgagggagcaaccgcattcgcagaggtactaaatatggaggacgttgcccaagagcttcattattctgccgagcgtttgtttgaaaagtaa

SEQ ID NO: 8124 - DNA, 471 bp, Bacillus clausii
  misc_feature (1)...(471): n = A,T,C or G
atgtttatcgcgttttggctcataacgatgaaacgtttgggcttggcgcttcgaacagtggcccgaacagttgtctatttagggtactctcctaaaaggctaaatcggcaattggtcgttactancggggtgctagcgatcattttagctgtcttctctacgcttttggcgctgacggcattccatctgtttggctttgctttagcagaagacttggcgacacggttatcactttatataggtgttgcccaattggcttatatcccggtttcccttcgctttactttgctggcaatggccattcttctacttttggccgtagtgcttggaagaagcatgcttatcgctcgtgcgctagccgattctaaaccataccggnaatctaccgtacccagcaaaagggggattggtactagtcgcttcatcagcggcaattgcttttcttgccatttcaccttatcagccaactga

SEQ ID NO: 8125 - DNA, 213 bp, Bacillus clausii
  misc_feature (1)...(213): n = A,T,C or G
atgaattgtgttttaggggngccgtggctgacaaaccaattctcgatcaagtttggcattcctgccaattcagcgagtgaattgattgatttattgaaagtagaaaagctgcttggcactgaaaacaaagaattgaagaatggggatattaaaccaagtctagcgttaacagaacaagggcgcagttggcttgcacccttgtcgaaagcgtag

SEQ ID NO: 8126 - DNA, 285 bp, Bacillus clausii
atgcgggaactttctccagcgcttgagcttggccttattcaaacgaagccaacgaaagcattgtttccatatatgaagacaattaacgcttcctctctggctattcacatccgccatttcagtagaaaattcgcggagcagtgcagtcgtgaaggcgtgcaattgatcgtttataacgtcgacagtgtccgtttgattaaaaaaatgagcaacttccctaatgtccgttgcaccgtaaatgaactggaacggttcaagaagtggtataagccagcagacggttga

SEQ ID NO: 8127 - DNA, 272 bp, Bacillus clausii; identical to SEQ ID NO: 8068

SEQ ID NO: 8128 - DNA, 357 bp, Bacillus clausii
atgaatccgaaccaagactattatatttatacgaaaaatcattgtgatctcagaagtaagcataaaaaggtattgattactacttttagccgaagcagtttgggacatatgatgagggctattgcaataggattagaattacaaaaaagaagccacgatgttttattagcgtgtgctgaggaaaccttgtacttgccaaagtcatacggtttaaattgtgttaaggtacatgaattagagccaatgcctttgtggtcaaaaatgaacagagaagtggatctttcggaaattaccaagaagaggttggccagcaaaaattatattgaaaagtgtatgatagatgatacaacacttata

SEQ ID NO: 8129 - DNA, 435 bp, Bacillus clausii
  misc_feature (1)...(435): n = A,T,C or G
gtgttggaaggggcgctcgtagggatattagatattggcggatccntgcaaaccggtcttggcataggngtgccggcantcntgctagngtcgggtattacacccccgattgaaaattttatcctttccttgctaacaggcgctttgttaggggcactcgttggctatgccatcttggcaattcgcaaattaacagttgggcaatccaattccacgtttggtgctgatattatgatgggcgctggaaatacatcgggccgctttctcggaccgttaatcgttctttctgcagcaagtgcctctcatcccaatcggaattggttcaaccattggtgcggcgattttctatatatggaaaaagccagtatcaggcggagcgattttaggcgccatgatttttggcgcaatatttccaatctctttagaataggatga

SEQ ID NO: 8130 - DNA, 729 bp, Bacillus clausii
  misc_feature (1)...(729): n = A,T,C or G
atggctgcgatccaagcgcatcacccagccatcggggccatgcatattttagccgggctttcacctcacggaatgactgcactgcaatttgctgaaaaaacagcgcgtcacttnacaaaattagggatgtttagcatgccaggcgacggcacgatgactcaagctttgctctcctatgcaaagcaccgcggcatccctcttgtcggcggtacgagcaacagcaaagcgagcattcaagcaaagaaaaaacggggcgttacgatgatctacagcgactacccgcaatggtccgaccagatgccaatttgtgtcaatccgattccgttatacaaggtcgtaaaagaaggagatgtgctgaatttagctgaaatgggcgctactgtccatgaacggtctggcgtagcaagcacgctgcgcggaggcattcgcataattggcgaaaacgacggcgttgcctatacagacggcagtagcttaacggcattgaaagcaggggaaacgcttttccacctctatcatgaatatgagccatttaactacgaaacagaaggcgatccagcaaagttgcctgacaaatggcgtatgtattcgaaccctgtgcggctcgttgtcctgaacaaagcagacctatcagccaaacgcttagtggaagtggtccaacgctatcgccaagacatgactgtgatagcttatgcttcactactctctttatgccaagtgacgttccta

SEQ ID NO: 8131 - DNA, 909 bp, Bacillus clausii
atggaaatcggaagtttgttcgttggtcgagtaaatggatcaggccaaacattggcctttcatgaagggcaagtcttgcgtggcgttgtgctgaaccgttttgccgattctgggcttgtgcaaattcaattgaaggatacacgtgtcgtggccgagttaaaagcggatttgatggttggcaagacctattggtttaccgtgcaaaaaggacaacctttgccaatcttgcaaaaagcggcagaaggccattcatatgaacagcttctcacgtcatggaatagaatgccttcacaccgcaatgtccgtgtgcttgcactgttggattcaaccggattgcctttgacaaaaaagggatttgcaggcgtggcccacgcgtatgcatcattgaaactgtctgaacagcagacaaaagaagcattgctttacatcaagcagcagaacgtaaacgtgacagccgccacgctccaagcagcccatgtggaagtaaacgcatctgagtcgttaagtgtcgcgctacggcagtttgctgcagcctggaaacatacagtgcctgcccaactccttttccaattggaggagcttgggcgccagctggaagcaggcgaatttcgacgaggtgagctgttaaaagcgtatataagcacgctaggacgggtgacggagctacttgatcccattcgaaatggagcaggagacaggaaagcaaaaaaagcagctgaagagctggctttgcgcttttctctttaccaagaaggcacactgatccctttgataaaacagcagtttattcctttgtttggccgcgattggttgctgcaatgggaaaccgccgagaacagcgaggagaacaagccgcttcgtttttatattagcgctgagcttgaacaagcttggttatgtattagttag

SEQ ID NO: 8132 - DNA, 276 bp, Bacillus clausii
atgttcggcgttggcacaactttattaaaggtttccatctccggggcacttgtaacaattcaagcgaagcataaacgggcagcccgttctaccgcgcttgaaggagaagtgccttctttaaaaatggaagtcgattttcatctttcccttctctataaacggaaacttgcagaacaattagcgacgtacttccacgacccgatcgaggttgtgctgcgtgattatgatgcaaaaacgcaatgggcttttacaaacattcttttttccacttcgtaa

SEQ ID NO: 8133 - DNA, 270 bp, Bacillus clausii
atgttacgaacttgcgttttctataaatattccactaagcaggtgaaaaatgtgttttttaaaaattctgtcagtaacaaaaatgttaataacgcttattggataacctttttattttggggaggagtgttattagtaaactccataacagaattattttatagccagaggttaatttcaagctcttttattactttagttttgggtttattgctattttttatagttgtgtttatatcaaatgtaaaaaaacaaaaacactccgattag

SEQ ID NO: 8134 - DNA, 330 bp, Bacillus clausii
atggaagggaaagtgcaagaattataccgcaagaatgaaaactacgaactgtgcgtggaagtgatgcaatttacagaaaacctattaaggcaagagcatattcagacgacagacgcgcagaagctatcgttattgtcccatctttcagcgatggtctaccgttccacgcataaggaacggatcgagcctatcgataaacatctatttcaggaagtatccaagcaatcaatcgaaatggcagaaaaagtgtgcaacagattgacggatttgcatgaggatgagaaatacttgctttctatccattttgaaacagctaaaatgaaggattaa

SEQ ID NO: 8135 - DNA, 310 bp, Bacillus clausii
  misc_feature (1)...(310): n = A,T,C or G
atgagtcaagttgttgtggttatcggggatcgcttaggtaaaggacataatgtagcaaaaggcgttgaagctgctggtgggaaggcgattgtcatttccggtgttggcgcggacatgcgtcttggtgatgttatggatacagagaatgctgatatcggtatttcattctgtggaagcggtggagcangtgccatcactgcacaaacaaaatacggctacccagcacattatggcatgcgttctgttgatgaaggcatcacagccattaatgaangaaaaaaagtactcggttttggttttatgggatacc

SEQ ID NO: 8136 - DNA, 300 bp, Bacillus clausii
  misc_feature (1)...(300): n = A,T,C or G
atgccancggctgatgcgtatgtggataatggggtggatggtgccctcggtgtgttggaagaaatgacgggcctcaagcggacggtgtttgatgattttaacgagttgcaggctgattttcaacaattgatggaatcggaaacgattgatttgtcagagtatcctgcctttatgcggggagaaatggcncgttcccatgcgctagggcaagtaggggcgaanattccncaggcctttgatttgttaagcaaggcattgacagagtttgaccatattaaacaattccagcggaacgtatga

SEQ ID NO: 8137 - DNA, 615 bp, Bacillus clausii
atgcacaagccgacaatcgataatcgccatggggacagcgcgatcagtgaaccggtggacactgcctttgaaaaattattcaagagcggaaagctgtttcttgttaaagaaaacgggcttgccgttagtggtggtttgtgcgcaataaacaaagcacatcgccgtttagacgcaaggttgataggggtagctggcggcgaggcccggcatcgccaaagtggcgcacaagctgctgtttatgattttttgctggagtgggcatgtggagagtcagacatcgatgaggtcgatttccaagggggtgaaccatttttgtcgaaaggaacggtccagtataaaaagcggtttgctacagcggtgaaatggccgcctgcaaattttgcggacaagcgagtgttgttaagtgcaaatgtcgaatcccctgctataaaacattttttgctaaataatccagtatttctagctaaaggagacgccattggctgtgggttttttacagatgaaacaaagaagccaaggtatgacttagccgttcgtactcccggggttgagtttgaaacagagttgaaccttgaagtgacttctcctagcaggcaacatcagcctgcattctaa

SEQ ID NO: 8138 - DNA, 381 bp, Bacillus clausii
atgactgggttgttggcacttttgttcgttttaccgtttatgagtaccattatagcagcgggcaagtacgaccgcgcacttgggcaaatgattagcaagcctcctaaattaaacatggttcggctatatcgacgcacatcggtgatgtcgtatatgctgacgctgtttttaaatgtggccactgtcccagttgttgtggcgacggtaaaaagcaagcttagccaactcagttctgctgtcatccaacgcttttttgcccacagtatattgcgggcatatgcccttgttttgttatggagccctacggaaattctcgtcgcttccacgattgacttaacaggtacaagttatgttggcgtttgttgccgacgctacttgtga

SEQ ID NO: 8139 - DNA, 291 bp, Bacillus clausii
atgttacacttgcataggcaaggggatcgaagccgtttcatggctaagaagacaatgctcatgaccctccccataatacggggatcagtatcttcttgtgctgaagtaaagaatgggattgaaacgaatgtcatggtaaatccaattaggaacgctaatgccgtcaaaatatacaaattaggaatttggctaaatgcgatagctacgaataatgttgcaatcaatccagcaattgaggttaatccccctgcggcgtattttaacgatgccaattattgctgtgcttactag

SEQ ID NO: 8140 - DNA, 207 bp, Bacillus clausii
  misc_feature (1)...(207): n = A,T,C or G
atgcaaagcaatccctcccctacttgtcagcgtaccgagtatagtcacaaaaatctactttcctgcttgaggcaaggancnatcgcctttttgctattttgtggtaaaatggacgtacagacgttcaccgcagcaaacaccgcctatttaaaaaatgcgtttttgacaaggcagccattacgggcgtgcaccgagatggacaagtag

SEQ ID NO: 8141 - DNA, 201 bp, Bacillus clausii
atgttaaagaaaggactctttgctgccgctcttatagtagccattgttgtgcttgcttatgaggggggagtgcttgccgctgcggcggaatcaactgaacaagttgaagagaatgacggttttttacgcgtcatccttaacattttgtctgtcgctacacttgcctttctcgcttttttaaccatcactgataaaggctaa

SEQ ID NO: 8142 - DNA, 801 bp, Bacillus clausii
atgacaatgaaaaaaacgatggctgttgccgctcttgcattggttgccgtgtttgctgctgaaagcagcgcacaagccaatagtccgattgttccaggctatgaagtaaagtttaacctcgacgttgatcaatttgacaatgaagacgagatcgtatcggctttccatgctgtccacgatgaagacgtgaacgtttattattttgatacgcccgagcaacagtttcgcgaaaacggctacattcaccggttgcgtgtgtatgggagcgataagaaaaccgatctaacttataaaaaagtgtttccgaataggacggttgacgaggcgataaacgaagcaacgttgcgggggtttcacggcgatatgtcaaattacaagtttgaaaatgatcgtaaacaagggaaagacacgttctccattagcagaaaagaaaaatttaaaaagaccgacgatattcattttgaagggattgacgaacaaagcgtgattgcccttttcagaaaagaagcaccgaaaaaatatgcaggttgggatgacacgagttggtatgacgctacattaagccgttccatttcgtacgggccagcattggtgaagacctatgaaggcgaatatctcggaatcgatgccgatctggaaatctggtcgtatcaaggcgagttgctggcacaactatccacgaagacgccagatccagcagaagcggacgcgattgaagctgcctggctctatggcttaacagaatctggctggttaagcgccgaccaaacgtcaaaaacgagttttgtgatggatcggtaa

SEQ ID NO: 8143 - DNA, 501 bp, Bacillus clausii
  misc_feature (1)...(501): n = A,T,C or G
atgaatgctgtggacagccaatccactcaaataaaaatggaatatcagttcantagtgacagaaacgggattactgataaacagagaaaagacgtttctgcgattttagatgtcagtgcccgatttaaaatttttatcaacgacgacctttactttgatcaagaagagttccccatcctcgagttttataaatacttgtataattggaagaaggcaatcgatcagtctaaaagagcgcaggaatttcattattatacgttggagtttgatgaatacgaagacggggcgattctctcgatcattccttttggcgatagcgctagactgaaatcgatttgggcagaacaagagctctatcatgtatttgacctagactacttgattcaagcgtttttaacattagagaaagacttaaagcgagatattgaagcgtatttccctatcaaactagataaattcataaaacatattcccgccgctgtattcgaatgggacagttga

SEQ ID NO: 8144 - DNA, 474 bp, Bacillus clausii
  misc_feature (1)...(474): n = A,T,C or G
atgtcaaaattcgattgttggattggaatgggaacgctccttgtcggcgcctatatgattttggaaacgcttacgatggattatatgaggctcatggatgatcctgggccggttttgttgccaagggttgtcggaatggcgcttgttgtttgtggtgttgctttaacagtaggtggattaaaagcaaagaaaaaaacggagccgaaagacgactcgcctgaggcgaaaatccggcnaaagaaaatgtatatgatgttaggaagtttgtttttatacgccgtcgctttttcgacgttaggatacgtattaagcacgttcctttttttagctgccacgactttatacttgtcgagtaagcgaacgaaaaagcatgttgttcaagtaacagtggcatcactgcttattactttttcaatctattggatatttaccgaatatctagatgttttattaccagacggattttttcgatga

SEQ ID NO: 8145 - DNA, 255 bp, Bacillus clausii
atgcatatatcgtgtgatattgatttcctgattgtaaaagaagagccgtcgctgctagattctcatataaaacattgccaagacataggcctgccttacagcaatcaaattcgccctcagtcgaggcggttgacagggctgcatttttttaaagtcaaagagtattttgagaaaatggagccagtgatcaatgagtatatagacgctcctgaaaaaatcgaagccgcttttcgcacgggaattcgaaatgaatag

SEQ ID NO: 8146 - DNA, 300 bp, Bacillus clausii
  misc_feature (1)...(300): n = A,T,C or G
atgccagggtttctttccttcaaacacatcanggatttcacgctctcttttcagttcccgccgggccatttccccagacaagcatccgcagcgtnacatcgccaccaccgcntcgtgcactttcctcacctccacaagcagaaagggccagtagcgaagctaacacgattggtgcatacatcgattttttctccatctcntctccttaaatatgagttcgtcacctnacggccgcaaaatgtggaacatngatgtcaagatgaatgggcngccaataaggtaggagccacgttcccgtaa

SEQ ID NO: 8147 - DNA, 558 bp, Bacillus clausii
ttgactgagaacctgtatcccgttttgacgaagacggtaaatggcacgaaatgggggtatataaacgacagagggcgcatccgcatttcccttgtttatgatggggcagagcctttccaaaagaatggttttgcaattgttacgttaaatgaaaagcaagggcttattaatcaatttggccgttttgccgttaagccggtctataaaagtattcaacctttctcagaagaacgagcaattatccaaacaaaagacgggtttaaaatgattgatgaggaaggccatgtgcgtacgaaaaaaacgtatgcctacatggctccaatgaaacatggccgtgcgctgtttcaaacaaatggccggtacgggtttcttaattctgatggcgaggaagtgatagcagcccgttatctttttgcctttgattttgacgaaggaaaagcggtcgtgcaaacgaaaacggcagagtttcagctaattgatgagaacggtccatgtgctccatacatatccatatgccgatgttggatcactaagcgaaggacgatcgcttttaaggaa

SEQ ID NO: 8148 - DNA, 204 bp, Bacillus clausii
  misc_feature (1)...(204): n = A,T,C or G
atggccaactttgatacaaatgctaccaatcacttcttgcttgctatttttcagagagatagaagaaaaacggacaactttcctgtcccgngccagttcccttcatggaagtttcctcgtaaccttctaatcctaaacaactcccgcaatcgcctaaccttttggcaaacatcagtgtttttcaatgagaacaattgtagctaa

SEQ ID NO: 8149 - DNA, 222 bp, Bacillus clausii
atgaattgtatctgtctgaacgatgaagttatgaaacactgtttacaagattccacaactcttcctctgttatgtttccggctattcctggtttatcgcgcaaataggttacaatttccccttgctttaagcctacatagacatacagcccttttacgatcattcttaagtattcaaaggacggggcatggaacggtacttcttttttccactttgctgtaa

SEQ ID NO: 8150 - DNA, 276 bp, Bacillus clausii
  misc_feature (1)...(276): n = A,T,C or G
atggaaggaggaggatttagggttatnaaaaaggggggggatnggatggataacgctaagtatttttgtatgccaagttacggatcgaatatgaacagggagcgttttttttgtaatataagagncgcccagccagagggggcggagatcgaagaagttggtttgttcagatcctgcccacccaataaaggaagcgcgcatcgattgctttcccgttttattttgctcaaaactcaacccgttggcaaaagaagggcgttgcttttattggcttga

SEQ ID NO: 8151 - DNA, 559 bp, Bacillus clausii
atggagctgtctttaggtggagcagtaccccatttttttcaggcagattatgaattgaacgcggcaaatcgtcagctcactcgtagctggaatcataacgctaaatgcatttacattaaactcgattttagttgtcctgacgaattttttctgggcaatttaccgccgcggatgttgccgacgtttatttctgataagcgcacccaacatgtgatggggatttttaatttggtgtttgtgtttattcttttttcgttttttctgcttgatcaacaagtgaccaattattattttgcgattccgacgatgacggttctgtttatgttgactgctgttgctgcctttatttatttcattaaccactctgttaattggatgcaagtcccgaatattatgttcaatatgaaatgcgaatcgaaaaaccaaatactagaaacgcttggaaaggatttggagcctttcaggacacgggaaccgaacgggtctccgaatgatctttgcaacaaggaggccattactgtttgtgcagccaagtcaggctacattcaatcgtcattac

SEQ ID NO: 8152 - DNA, 220 bp, Bacillus clausii
  misc_feature (1)...(220): n = A,T,C or G
atgaacacaaagaaagaagcctcctcaaggcttcgtttacataaatctgtattattgtatgtgcatatgcggtttaacccaaattcccctggcccatctggaaccaggggtttcctattttccaaacgggcaacattgccatcacgattcatttcttttttcatattaatcaaatgtttaattaactgccgatcnttccctttttcatgctacaattatt

SEQ ID NO: 8153 - DNA, 213 bp, Bacillus clausii
atgctagtagcgaaacactacagagcgacgcgaggtggagcaacgaacgaagtgagttgtctcgacgcaacaacatccctgaataagcaagcagaggaagagacagttcattctctttcaaacaatagtaccaaaaaaccaatattttttagagcgacgcggggtggagcaacgagcgaaagcgagttgtctcgacgcaacaaacatccctga

SEQ ID NO: 8154 - DNA, 375 bp, Bacillus clausii
  misc_feature (1)...(375): n = A,T,C or G
atgtatgtagacgccgatgattggctttcgttagatggcattcaaattttgtatgacttgttagaagagacaaatggaaagtatgccgttggaaagtcgattcaagttgactcaaaaggacaaaaggttattggaagatacgaatcgagtaaagtcaggcacaatgtctcacctttttcgatcaagcatttgttttaccatttagggccnagagcgcggatgatgagtttagatttaatcnaacatcatnaaatccgttatccagaaatgaagtttgctggaggacaaccnattttttatagatgtgattttggctgccgggagaaatctcgaccacgactgagaccaatttattattttttatcnaatcgatga

SEQ ID NO: 8155 - DNA, 255 bp, Bacillus clausii
atgttacgtgtttggtatgcactaaaaaattttttcttgttgctttggttcccaagatgctggaaaaaggcacgggggaaaagggaattgatacgcggtctcgtcggtaaacaaattgaaatttcaacacccttcggatatctcgctggcgaattagtggtcgttggggaagactatattgaattgttggatgaaataggtgcagacgtgcttgtccgcattgccaaaatcgaaacggtcaggtcactaagctga

SEQ ID NO: 8156 - DNA, 435 bp, Bacillus clausii; identical to SEQ ID NO: 8129
  misc_feature (1)...(435): n = A,T,C or G

SEQ ID NO: 8157 - DNA, 621 bp, Bacillus clausii
atggtcaaacattttccatcagccaaagaagcaattgaacaggtggcattgtataaaaacaacgatattcctgtctcagtaggactaggagctggcgaccctgcaatgtggaaaatggttgctgatgtttccgccaagacggtgccaaaccatatcaatcaagtctttccagcacccggctatacacgtgggcggatgagcgagctaaaggcgtcgactacactcgtcaacgcactgattgaaccaactgggacagctggtgaagtctatatttccactgggccacgcagtgctgatttcaaagaaaaagtttcctgtgaactggctgcggccatgcttgctgaaattggcgtagactctgtcaagttttatccgatcgatggcgaaaaacgtctcgatgaagtcgcagcaatggtcaaagcggctgtcaatgccggtttaacaatctttgagccaacaggaggaattgatgtggacaatgtcgagcgcatcgtccaagtctgtctcgacaacggggcggaaacggtgattcctcatttgtatacatcactgattgaccaaaagaccggcaaaacagaagtggagaaaatcaagcagttaattagtatggaatggaagtaa

SEQ ID NO: 8158 - DNA, 270 bp, Bacillus clausii
atgacgcacgtagctaaacaagcagaagagcgcgtgagcgactgggtattctctctgtcttgccattttaaaacagctcgtttttatcatcgtctaaacgatcagttaagcaaacacgggttattcacaaaaacagcgtcaacgaggagaccgtttcttacttctgacgaggcggccattctagccaacgctttcaaacaagcttccccaccaacaaacataaacctaatggccggtggagaagggctggccatggattacttctgttaa

SEQ ID NO: 8159 - DNA, 204 bp, Bacillus clausii
  misc_feature (1)...(204): n = A,T,C or G
atgtcttgcctttcaatatgtaacagcatttatgtttctcatgtttggaagaaacaccccctatgctcgttttgtggaaaaattttacgaacatcnaccaaaaggattggtatgacaagttgtatgaactttctttacattatgaattacggagtcgcacaccgaggnatagggaaaagtgatggaaaagcacggagggattaa

SEQ ID NO: 8160 - DNA, 207 bp, Bacillus clausii
  misc_feature (1)...(207): n = A,T,C or G
atgtttgagttacttctcttctttataataggttgctgtatgacatcaangctattgattctgaaaatcaatggaaaaccaagtcctaccaagcataatttaaggaacaagtgccgatataccgacttgaaagaaggagagagacgaatgatccnatntataattattttatatttaatangcctatgtctgcctttcagtatataa

SEQ ID NO: 8161 - DNA, 204 bp, Bacillus clausii
  misc_feature (1)...(204): n = A,T,C or G
atgtttgatcgctcttccgtcattgatgttatttttctgaaatcgtatttgccactggggtttaagaaaccaatcattacaacgaatatttngcataacactgtaaaagtgaaaaactggaatggttttcttcatgnagaagagacatttggcatgactagaanctttgtgatagtgacggatgtccaagcacatgaagtgtat

SEQ ID NO: 8162 - DNA, 309 bp, Bacillus clausii
  misc_feature (1)...(309): n = A,T,C or G
atgatcaggaatatagtcaatttgatcatgtgccttcctttttatactttattcttcattaatcctgaagttagtttgtacgcactatacgaaagagagaatgctcctgttatccctataattgctnccacactgttagaactaaagaaaatacctacggcaaataggacaacccctatgaatccaatcagtacgagaatcattggcttacgttcgatcactcttcacctcacttacgttagttttttaccgctcacacgcttttatttcgtttgtttatgtaacttgcttttattcgcctgtggataa

SEQ ID NO: 8163 - DNA, 243 bp, Bacillus clausii
  misc_feature (1)...(243): n = A,T,C or G
atgaggcaatcgagctatttctgggtaaagcggttcggcaaattccttcattttgcgcctccctttttctacgtatttttagtataccattcattgtttgcctatataggaatggcggcttctagtaccgtggtgggccttgttattttaattctggcagtacgaactgtctgtggaacgggcaaagaattgagaancccgctgctttccattagactatgcctcttcttaaccgttcggtga

SEQ ID NO: 8164 - DNA, 819 bp, Bacillus clausii
atgaagccctttatgcggtgtacgacggaggaatggatgcttcttttgacgatgtgtggctatgaggtgttggccaagtcgttaggagaggaagtgtttggcgaaaaatcagaagagagctgggaaacgttgtttgaatgtgcagcgcatcaacttatgcttaaaggggtttgggatgatgagaaggcttcaaaggatgaggttccgcttgcggatgggctgcaatcttttattcgcagtgtagctgaagcaaagcaattgatccgtttatcaaacccattgaccaatgaagcattattatttaggcgtatcggcgacggccaatggattgaacattacataaagcaagaaattatccaagagtttcatcctgttgatgcaaagagtatagagaagaacatgcatcagttcattgaatataaagatttagaaccgagcaacgagattgaattcacgatgtcaaatggcgcttttactgcgctaagtgaccagcggcatgtaaaagaagtaaaaatgtactggcttgaagcaatgaggaaaaatgaagcgtggtttgatgaatttgcagaagcgcttttagcgaatgattggaagttttttaatacaagtgtgatccatgtttcacttgatggagaacagacagaaacagatttgaatgacctattgtttcatatgcctgcacgagatggagtttggtttgtaagatacaaagatgttcattcaaacgaagatgtcattattcaaaaaacatctttttctaaatggaaagaagtgtgtaacgaattccttgaacggacagtcttccacgctgccaaataa

SEQ ID NO: 8165 - DNA, 213 bp, Bacillus clausii
atgttgtttttcttatttggaatagcttctccaataggcagttatttgtctaattattatgtgaagaacgccaaaggttggtttgaccggtttacaaatatgttttatttatatgcacatcgttttgcccatcttacatttctaaagttaattgaaaagtatggtggagtaaaagggaggcttttttacctggggatagggtgtgtattttaa

SEQ ID NO: 8166 - DNA, 364 bp, Bacillus clausii
atggaggaagctgaacggcagcttattacaaacgtacttgccaattgtgcaaatcatttagaaggcaaaaagcaggcagcaaaacgattaaatatttccttggcaacgctatacaataaaatgaagaaacaccgtttgttattgttgggagactggaaaaaaaccggacggaaattgtccggttttttctgtataacttgcgcagaagccgtgccttttttaatgagcttccacacagaacgctctgctaccatcttttataaacgcttgatgcaagcgggcgtcatccgtcaattcaggatggaacgaacatgccaaggaaaggggcttggcttgaacgggaaacgaattctccgttgtattc

SEQ ID NO: 8167 - DNA, 345 bp, Bacillus clausii
atggtaagggatgattttcgaaggaataaaatcattacagccgccgtttttctatttattatgttcgccgttatgttagcggcgagtgctgtccataacatcgctcatttgattccctcgatggcagagctgcaaaagcatgcagtcccagcagatattacacagatgcattctggtgagtttgaccaggaagacattgatcgatttactgaagcacagcgtgagcatatcgcgatgcaggagacgatggtgctgctgacgttggatggaagccatattcattttggtgacaatcaaacgatggctggaacggtgcaagatatttcatttggttgttcaaaatga

SEQ ID NO: 8168 - DNA, 207 bp, Bacillus clausii
  misc_feature (1)...(207): n = A,T,C or G
atgtacgaaataagcattgtcacacctgtaagccaacaagacgagaaatacataaaacgttgctatgaatcagtaaaagggcaattacaagcaaacgttgaatggattgtcattttagaaggggattcccccttggcagaancaagttcaattggnagaacagnagaaaattccaatgtgggatgtaaaagttgtagtggacactga

SEQ ID NO: 8169 - DNA, 486 bp, Bacillus clausii
  misc_feature (1)...(486): n = A,T,C or G
atgagcacaccttnatatgtactattggagtcagcaaagtccaatagtgactcttacgatgtggtacttggagcaatgaaagaaacgaacgtgtccgttcatctaccttcttcttatagcaggatgttgaagcgccttttagaaaacagaatagcgaagccgaaaacactagcggtaaaaaaataccgtgcttctgctctcaacactctttttaagcgggatttcattcttgagcatggcatttattttgaggagaatgtccttggctttagtgatattttgtttacttcacaagcgtacaccaaaacgacgaaggccgtcgtgtacgacaaggatgccatttatttaaaattgatccgcaatgatccaattaatgacccgtctattgcgcaagcgtttaacggcattgaatggtatccgcaatccatggcacaagcaatcgcttcattnagaagacggtcaaccgttcaaaaacgttttgcttaa

SEQ ID NO: 8170 - DNA, 351 bp, Bacillus clausii
atggatgccatgattgtgcgcgctgcagctacttacgcggcacttgtgctgatgaagcaatacaaaaaagaaacaacgcaaacacagcaaggccctttcgaattggcactcgccttgtttgctggtgaagcggttgctgcattttggccgttatgggtgctttttccgctctttctgctgttaatagcagccatgttggaacgagggaaaggcgagtcgggcaaactacagcacacaagcaagtcccctacagcagcgcctcctctacagaaagaacgaccagcattggccatgcctttaccattaatcattgatgggatgatccagcatgaccatttgcgagaactgcgc

SEQ ID NO: 8171 - DNA, 213 bp, Bacillus clausii
atgtatttttttatttttgcgaagagaaccaagcaagtcgaggatgggaaagttcgaaggagggagcgtagttgcctacgtgaccgactgagaagcatgaaccagacgaagagatgcgacggttatctgaagcaaatgtatttcacaaagagaaccaagcaggtcgaggacatacgttttcgagcgaaggagcgtacgagggtacgtgactga

SEQ ID NO: 8172 - DNA, 663 bp, Bacillus clausii
  misc_feature (1)...(663): n = A,T,C or G
atggcatncagcacggatcattccagctatataagcaaccttgccacggatttcctaaaagctttgntcgcctttgacgaagaacaagcccaagaatggctgaaccgcgcttttagtatgtattcgatggaacgtgtggcgattgaactgtttagtattgcctatgacatgcttgaacaggaaagaaagcaaggaacgataacacttgctcatcaacaatatgctgtacgagccatggaggcgaaaatcacaaatttggcaatggtgctgcctacggacaggtccaagcaaaaaattttgttgttttgcggccctcatgaacaatcggctttgccgttaaggatctttgccttttatttaaagcggaaaggatttagcacaatctgttttgggacaggaatttctgttgaagatgcagaattggttgtgcagcagtgcgcgcccgtccttgtcgctgtttcttgcagagacgagcagaatatgcaggctgctgaggactggttgaaacaagtgataaaaaaacagcctaacacgaaaatagggttgcttggaaaagggttttcagagctccatgacaacaagaaagcaaactgtgagacgattttcatcggcaagtcaagagcagactgggaaatatggggtgaacgaatgctgcaacattaa

SEQ ID NO: 8173 - DNA, 525 bp, Bacillus clausii
atggtcaaaatgggaaaaaaaccgtttgtcgttttcttatttgcaatacttgctttatccgcttgcgtcgatggaacttctcctggcaaagcatctgatgaaatcaaagggctctccagtcaattggatgtcaatcatgcacaaaaagaacattcaaaagcagctgaaacctatgcccgtgcctttgaacagtatgttgatgaagctgcccctgtcctggtacaattgcaagaggcggtcatgacaggaaataacagcgaagcagccgcgctcacagaacttctagccgacaaagcaaaagaacacgagcaaacaaacacgtttccgccgccatttgccggagggtttgaggatatccaccattcctatacggtaagcttaggcgagcttgaacaggcactaaatacccgttcctatgaggccgagcaacaacattacagcaatgcttccttatcatttcgattaatgaggcgtgaatatgagtcacttattacggaatatggcattaaagctagcccctcatag

SEQ ID NO: 8174 - DNA, 228 bp, Bacillus clausii
  misc_feature (1)...(228): n = A,T,C or G
atggaaagaaagacgctaaacccaaagcggaaaatggggcaatgtaacggncctcttggaaacgatgcccgatccactgcctacgcttgctggatgaattgtgggctacaaacgactttaacattaattgttggaggaaacaacggaatgattgaacggtacacacgcccagaaatgggtgctatttggacagatgaaaaccgctataaggcatggcttgaagtataa

SEQ ID NO: 8175 - DNA, 207 bp, Bacillus clausii
  misc_feature (1)...(207): n = A,T,C or G
atgaancacaggattacactcattttcagctcgtctatatgcaaatggctctacccagccgcccattttacaattgtcggcgacgttcagccagacgctttatatccacgggccaaaccaaacaggcttaattcggtggcgaccaagctgatgtctaatacatggcgttcttataaaaagctaccggtctacttgaagccattattc

SEQ ID NO: 8176 - DNA, 375 bp, Bacillus clausii
atgcaaacgcttaaatttgaagaggcctggcaacggacgatttcggagaaggatgtacaagcaatcaaaaacgtgtttgcagcccagcaaggggaactgcagccgtttctcccgctatggcaagcgcttaaccaccgtggcgatcttttggtgaccgttctcgttcagcatacagggaacggggagtggccaaatgaagagcgggagtatgtctatttagaggacggcgaggaagtggcagccaatcatttttcgctaaaacgccttggcttgaaacctcacgtaagcatgccgtggacgtttatttttccaaaggaaacacaaaaaaaagcaccgcggctaaaaggggcggcgctttgtctgcgaacttggtag

SEQ ID NO: 8177 - DNA, 564 bp, Bacillus clausii
  misc_feature (1)...(564): n = A,T,C or G
atgagctatgacaagtttgcggaaacccatttcgtctccccgcaaacgatccatagtgatgtgatgcggatgtcggaatggctgaagcagtatgaccgaaaagccatgtttgaaacaaagcctttttgtggaattcgcttgcttgggaacgagcaagataaacggatgttgttgacaagtttgttcaacaatgaatttgctgcaaagcaagaagcaatttcacaaatgacaacggccttttcaggatggcatacgccgcaaagcattgccgatataggcaaaaagttaagcgatgttttagatgcaaatagcatctatgtgtcggccagtgtctgggcaaagttattggctgtagtgcttgtcgctgtgcaccgcggaaaaacgcatgaattaagcacaaacaagagcgcgcaagcaggagcaaactggaaactggctgaacaaatagcgaatgcgattggttggccatgttgccccgatggggaacttgcttatcttgcttctaattgcatcgccttcaagttgcttccgatccaaaaaaacggcaacgcancccgcttctga

SEQ ID NO: 8178 - DNA, 369 bp, Bacillus clausii
  misc_feature (1)...(369): n = A,T,C or G
atggtcgaancttcgcggcgattaatgaccgacctcttctcttttgcgcaagcaaatccaaattatatgcggttgttgtttaaaacagggcaagatgcagaagaaaagatttgccagcatatatcccatacgcttatcgcgatcgaagaagcgttcgaacgcaacataaaacgggcccaagaactggagatgttgccgaaagggggttcgagcaaaagacttgctgctatgctcgttagcttggtgcttggaacacttgagcgttggctattttctaaatcaccccatttagacaatattgcagctgaatcgttggcagttgaaatcgtttcttttgaattttttgggctactcggcaaaacaaagtga

SEQ ID NO: 8179 - DNA, 230 bp, Bacillus clausii
  misc_feature (1)...(230): n = A,T,C or G
atgaggcgccttcttgtanagggcgcctcagactgtagacaaacgctcgcatacttcgtcgtttgcctcggtcatatgctcatgaacccccgttctattcgcatcttccctcggctgcactcctcgtctgacaaacgttttctatcaagtctgaatgattttgtcgactttgtcgacaacctcaggcgccttnttgtaaanggcgccttaatttttagctattatctgct

SEQ ID NO: 8180 - DNA, 226 bp, Bacillus clausii
atgattggaaagggatgtttatccatgttaaaacaagttgtccacaaacattggcttccgttttctctcggagctgcctcattcgctttgctgatgggaacatttgtcattcttagcgaagacgaatcctatgattctccccaagtagcaaatccgcctaatgcaacggaagtattacttgaaacggttttcgctgatggaaatatacgaacagaacgtgtttacg

SEQ ID NO: 8181 - DNA, 654 bp, Bacillus clausii
  misc_feature (1)...(654): n = A,T,C or G
atgggagaaacccatgccgttaccccggcgtatttcccgttgtttgcgcgcctatcgcgcctgcctgcaaacgcgacggtctcgcccgcgatcctgacaaggcaactgaaacagctggtgccaatccaataccaatggtaccaagcccagctccgtacccaagcgattcaaacggccgtttcggaagtggctgccacagggcggtctgttttaaccgaggaagaagtcgcagccatgcaagcgtaccttgaaaacaaccctcccggcgacggtcccctcataaccgaggtcgacgaggaagtatacaaagacgggcgttatcccgggccgacgaaggatgcccgtgttggcgccgacgggatcgcgtataagaacaacatcaggacttttctagatccggtagccgactttttcttcggtgacttcctcacgctcgccgacccagaagcttcgttcggggagaaagccctggcaacgacgtttatcttagtgaagccagcgaaagtgggaggagtcatctacgacttgtcgaaagcgaggaaggtgaagactggggggaaggggaatggtgcnccttctattggcaagaaatcagtaccnagcggaccgtatagagaagttaatggattttcagttaaagtaaagccaggtgca

SEQ ID NO: 8182 - DNA, 463 bp, Bacillus clausii
atgccttcttcatcaatagacacatcgatagctttgctaattatttctatttgcgcattaattgatatattaagtcctggtgtacttgctgtaacagcttatttattattgacacagcctaatcaattatcttctcgcttgcttgtttttttgtttattacgcagtttggctacttcgtagtgggcttattcctatactttggtggagattcactattgaaaggaatcggaaaattatctgaatttgactttatcaattggttttatctcctttttggagcagttatggctctaattagcttctgtaaaccaaatgatactacaaaaaaacgtttaatttcatttataccccaaaaaacaacgatgaaagggatgatcatgttaggtatcattgtttttctaattgaatttgtaactgccttgccttacttttattcaattttgttaatgaatcacctaacaa

SEQ ID NO: 8183 - DNA, 444 bp, Bacillus clausii
atgattatattggattattttaataaaaggagggtcgttatgcattggaagattagcgctcttttagcagtggtattttttatgtctatgtccgggtgttcaaacggcgaggagttgttaatcggttcttaccaaagtgatgatcaaattgtttttaacgaggagaagacaatcaaagacccagacacaattaatgagtttaagaccattattcatgagtcggctattagcgaagagccggcctctacagagggatatcctaatagtgtgatccatataaataactgggataactcgacgatggtgatgatggtctatctttggtttgaaaataattctactatcacttttcgtcggggtattgaagaagatcagtattattcagtctctaaaaatgactcgaagcgcataaaggaattattgcgtctagacgagtctgagtaa

SEQ ID NO: 8184 - DNA, 375 bp, Bacillus clausii
atggaaggggcactggaacaaaagcgcgaggctcttggtcttctttaccactaccgtaatatggaacttcatgaacgggtgtttgaacaacgggaacgggtcgaaggcatgatgagcaataaagaagcgaattggcgagcgtttttgcaagaagcaggccatacgtattccaaggatgccatccgcaagccaacaggggtgactttccggaaggagtttgatcctgttcccgccagtgcgattgaacaaatcgacggaatcattgaaatgtatgagttggatatgcgcgagctggaacaattggtgcttgactacaaagaaaatttgcgtggattgtttgcggctgatgaagcattggcccaatcaattaagtga

SEQ ID NO: 8185 - DNA, 209 bp, Bacillus clausii
atgcaaaattggtttaaagtatggattcgtccccgtcaagttgtcgctgatgaattaaaaacagccagagaaaagaatcagacatggaattatttgctgattgcttatgtgtctgctgtagtgagcacttttacaaatttttcgagcgaagttgttccaacatttgcttacgttattgtgtttgctttacttactagcattgtggtagc

SEQ ID NO: 8186 - DNA, 236 bp, Bacillus clausii
atggtgaccgtagcgattgtgagcccttctttgtttaagcagcaatttctacaaacggcgctacgtcaagtcgggggaattgaggcaaatgttgctttttcaaactgggaggaggcgattgtgactgttgatgcatttttatatgcgccttgtgacgaatgggagcaaatcgacgtcatggggttgcctcgccatacagtgtttgtgctggaacggcatcagcgagtggttgacag

SEQ ID NO: 8187 - DNA, 349 bp, Bacillus clausii
atgggccaaaaatcacttgatgcggcacagacgattgacatgcttcaagcaatggcttcagaaacatccgatcaaaacggccagtttgccggattcagtagttggttgatcagtcaacatttacaatcaggaggcaggttaagttcaggaaagacggcaaccgcaatagcaaacttttggagtgaagcacacgggccgtttttaaatttacttcgagatgtgatggatgatttttcaaacaaacttgagcaaatacaaaacgccatatccgatgcttttacgagagaagctgtgttaaaagaatcgtttatgatggatcaactttatgatgaactagatcaattgaaaa

SEQ ID NO: 8188 - DNA, 210 bp, Bacillus clausii
atgtttgtcggtcccggtgtaaaggtagcgatgacacagtacgctagaaaagacagtaagctcatgatgatacctccatgcattttcatgcatgatacacccgcgggcagcttacggtatagtacgatattgcggaggcaaaacaaagcagtcgagggaagctccgcggcggctatcggcccgaacttacactgtatcaaccgaacttag

SEQ ID NO: 8189 - DNA, 215 bp, Bacillus clausii
atgatcggttgtgttctaagggtctattttgcaaggatatgcctactaaatcatctttcagacggtagctgggctattttcagactcttggcttttatggcttcaatcatctcggtccgttccaagtacctctccgtttgtggcatcaagtttaatatcatagttgttgcctgcattggtaactgttacttcataatacgtcacttggtcgtctt

SEQ ID NO: 8190 - DNA, 267 bp, Bacillus clausii
atggaaaaaagccgcctccctgatatcgggaggcgttttacgcgaacggatacgtccagaaacgttcgttgcaaagacgttccttcgcttcttcgacgccatcataataggctttttccaggcttggcaacgtccatgctaactgggaagcgtgggcgcgtaacgtatcaagcttgcgaatggcgtacgctgaaacgtcatggacgatatccgctgggccaatctctttttcgtggttattcgagaacgccactgcgtaaaaagtag

SEQ ID NO: 8191 - DNA, 220 bp, Bacillus clausii
atgcctttgtttctcggagcactcgccttgtttgcgctcatgcagtttgctgtcgttttcatctacacgcaaagtacattaacggaatacaacgctcatttggcatctgggcgaaccgctgctgagttcttaatggaaaacggccctatttcgattagtttgtttttgttcagccccctttatataggtccgctgctcttcctatttggcgcactattat

SEQ ID NO: 8192 - DNA, 411 bp, Bacillus clausii
ttgttcaggttcataagccaatacatactgtttttgcttaagccagtgtgggttgggttttttgtctcttgcccagggaggagccctgactgccccacacagctggtgggcagcagggctgcactcattgcagggctgactagctccagggtccatgcactgaacctcagccagtcccagccagtccccgcggaaaaggaatttattgatgtgagacctgaacaatcaggaggagataaccaggcagaccagaagggagagaagatgcccagacagagaaagagacaggtgaaacgggtggcattcagagagctacaggtggttcagagtggctggagattgagtgaagggtgcagggtgtgcacacaccaggttctgtggtttgcaatcttgatctttctgatgaagtga

SEQ ID NO: 8193 - DNA, 231 bp, Bacillus clausii
  misc_feature (1)...(231): n = A,T,C or G
atggccatcggcgttggcgctgcatggtattcattaaatgaccggaaaacanagcggagaatccggcnatntatagagccagtgatgcaagctaacctgatgaatgcccgtacttggaaaaaagcgagaaagagattcaaacgcatgtttgcttanacagaaaaaagcggccgcaataggccgntttttntgattacggaanccactgttttgcgcaagctaggaggatag

SEQ ID NO: 8194 - DNA, 336 bp, Bacillus clausii
atgtttgcaaaaagagctaaagctgctaaatacaatgaaatgttggttagtgagtacgtcccttttatgcgcaatgcaatgggagaagtatttgacataacgaatgttaaacccgaagaacaagcccatcaatacttagtaaggggcgatatacagcgggcattaacagtaataaaaaatttagaagataagggagaaatgacaccttttctaatttattataaaggtctagcccaaaaaagcgtgccgctgcttttagatgcaatggaaggtttcactaaaaacgatttttatatggttgaattggtaaagaagaagatcaatcaattagtttga

SEQ ID NO: 8195 - DNA, 320 bp, Bacillus clausii
atgaaacagtggattgagcaagattttgccgcttcgccgccaatgaaacgacgggagcgctttcatgcccgcgcaaaacgatggattgagatcgaagcaaagcgctttgaagacaaaaaagaacaacaggcttttaagtcggaggcgcttaaacgtttgcgctcctttctttcctactggcccaagcctgatcttgctaagttgtacaccgcttttttaaaagaacagcaactgccagtacctgttggtctgaaagagaggctgttaggctacgaagatatagctccacttgtggtacatgcaccaacagctttaccgga

SEQ ID NO: 8196 - DNA, 492 bp, Bacillus clausii
atgctacaggagaaaaaaggaacaaacattttaacgtttttaaaagctacgaaaacccattgcttccaaggaatcgcctttgctagctttttaggtggattcgtgttaattgttgtttcttcttggtggttgtgggccgttgaaggcacatggtttgcctttgcgattgcctgtttccaaacttattttgctggcatggttgctttaagccagctttatacggtgccgctcgtcataaaatacggactaaagttgccaaaagcgatgtttgtaagcatcaaagtgttgttagcgaaccctctttatacgattggtgcttttcttcagctcgttttgtttgctgcgctgttgtctatgaccattgttggcagtgcgctcttacttcccggtgtggcggcagtgtttgtaagcagaatgacgagcggtgcgattagtcgatctgagttaggagacaatggggtttttgttcagcagcaatctaattcacactga

SEQ ID NO: 8197 - DNA, 358 bp, Bacillus clausii
atgaccatgctcgtgctagagtttgatgaaaagcaactgcctgtcgagtacaggcacacgcttatagctgacgtgtttgcccgttcagaagtgctccgccttaatttgtttaaagggagtgaagtccgccaattgctaaggcgtatgctttacgaacaactccagtatagggacagcgaaaaaatcggcttgtcgcttttgcttggagagttgttgctgctattaaagcggacgaaaaaaggatttacctaccaaaacacaaatgagtggcgtgcggctgcccttaaagagtatatcgaaaataattactaccagttaagccgcgctgaagaattagctgccaaaatgggggtaagct

SEQ ID NO: 8198 - DNA, 270 bp, Bacillus clausii
atgaacttaaatagacggtttaaggtaaaggacgagaagcccttagccaaatctgaaataaacttacctgtttggttgagcgaggaacaaaaacaagaaattgcagctgctataaaagaaggcactcccatcttaataacggggaagcaggggccaacaggcaagacgtatttagcaaacctattaaaagaacaaggcgtccttgctttcgaggaatgggagtgcgtaaaggttactttaaacgatttgctcgaatacgagtctgattaa

SEQ ID NO: 8199 - DNA, 441 bp, Bacillus clausii
atggatcctaaaacaggttacctgttcgtatttacgaaagaaaataatttggaaatggtcataaaaaatagcgggaaaaaatcaattcactatttctacgcttttatagcgatgcatgacgatataactgcagaatctagttatagttgcagtcttatccctgaatttgatatagaatatgaagaaaagcgaattatagaagcacaaaaaattcttgatgaaaacttttctagagtaaagcgggttatttttgttactaagaaaaaagagatgcaaggtatttcaacagtaaaagctaagctatacgataaaaacttttttctagttgatactgaagactggagtcattacgcatctgatgttgcatatggagatctattggaaaatgatgaactagagtcaccaactttaccaatgttggctaaagtaaaacccaatata

SEQ ID NO: 8200 - DNA, 279 bp, Bacillus clausii
  misc_feature (1)...(279): n = A,T,C or G
atgaaacaggttgcccttgaaagcaaagtaaacgcgcttaaagaggggcatgtagataanagcgaantagaagaagcgcttgaagaatttttagctgaagtaaaagaaagcaacgaccagctacttgcggtgttaagcgacagctacgaacaagacgttgacacctatcaagtgaaagaaagggaacagccaacatttactggtcnagctaaaggcgatccaggtgttaagcctgttaaacaagggaaagacaataactatgaagaacgggccagtcga

SEQ ID NO: 8201 - DNA, 493 bp, Bacillus clausii
atgatcgttctatttaatttggcggctcatgtgtttatgggcgttctgtttcttattaatttcttgaccacacctggagattggtgggccctgtatccagccggactactgttattaagctcgctcagcattatgttagatagaaaacttagctataagctttatgcctccacgatggcggctgcattcatcgtttacttaagtcttgtcaattggatacaaacgcccgattatccttggatcttatatatttgtttcccattattatggtggcccctttccgccttttttggccaggcgagccgctcgctctttttcgctggcattgcgtcaagttcaatgatcttatattacattctccttaacatgttttgggaaaccggctttccttgggctatttttccggcattcgtcctcctatggtggcctttgtctataggtgttgcccgccgcccgctcgcttacggggtcctgggaacgatcctttcatctg

SEQ ID NO: 8202 - DNA, 273 bp, Bacillus clausii
atgagtgttaaaaagagacgatccgaaaaagaaacgtgcgcacttatcgacaatatcatattagcgcggcaaaatcagaacacatttcagtttaagtcatcatgcggcgggtatggtttgatgctacgtgacaaaagtaaactagcacttattaagcgaattagagttaaagaagaacgcggttgggaatgtgcagcaccgattgcctataaggatgaacattactttgtaaagatggtatttaaccggaagccgttaagggagcaggtgtga

SEQ ID NO: 8203 - DNA, 384 bp, Bacillus clausii
  misc_feature (1)...(384): n = A,T,C or G
atgccagacgataaaaatcgctatgatctgatttacccaatgtcgataaacattgctaaaaaactacacaagcggactgcgatcccatacaacaaaatggcaacggggatcacatcgattcgcatcatcgataaccatacaaataaccattcagatgaagccgattttgtccgttttttaaaggggtttcgcggtattaatacgtcatctgaagaaattaaagacaggttaactccatacattcctattgcgagaacgagggtgggcattgatgaaacgctatttaaacctctacagaagcggaacgaaagcgagcggtttaaggtgggatgggtcggtagaattgatcaagaggattaccgncagctaaaagggtatgattaa

SEQ ID NO: 8204 - DNA, 577 bp, Bacillus clausii
atgaaagtaagcaccaggatgttccaacacccttcaaaaaaaatatctgttaatggctggaaacaagtattggatccagatagaactacatcattaataaatgaagaagattttgtttatgttttcattgaggaaatagaaacaaaggttgtctggtcagatcaaaaggatatagttcaatatgattatgatttctttgtgttgttctttgataaggataatggaatagttcatataaatgaaactgatgctggaaaaggaaatcggcttgtggatagtatgtttccggaagcatcagcaattaagggagattcaatttatcgaagcttagacggaattaatcgattgatgattggaacgctgggattaaagcaaaaacctagtgggaggattagctttagaatgtttgctggtgctgatattaaggctggaattagtgaggcagttgcatcgggttcgactaagtctaatctattcggttacggctatcaagacggagaacgaattagtattggttgttcatataaaggaaaagtttggatgcgctgggtagagcggataaacttttggacagact

SEQ ID NO: 8205 - DNA, 216 bp, Bacillus clausii
atggttcgacatcatctttactttctaagtgcagcggtttgtctggcagttgccgttggctcattctttctgcttgaaaatccgctctcattcgctgtcatttttggcgggttgtgtatactcaacatcgttagaggccgttatcattaccgaagcgcgagaaaacaaaataacgcttcggcaacgaagacgctaaaaggaaaagagcgggcttaa

SEQ ID NO: 8206 - DNA, 278 bp, Bacillus clausii
atgaaatcgattgacggcaattctccattcctttattatgagtcttgtatgaatttcatacaccaaagcgccaggactggcacgatgccagttgacgaggagagggctaatcgaactttcggcgggttccctccggctgcgtgtgacagccgcaagcttttgtcaaaacaatggggtgacctgttgcacaaaaacaaaagcagcacgcaacaaattcaaagagtgggggcacgtctgcccctgcaggtcgatgcttccactgcgggaggatacgaaaa

SEQ ID NO: 8207 - DNA, 612 bp, Bacillus clausii
gtggacagtaagattagagaattaccaagaggggaaagccaaagccatataaacgagataaaggatcacttgctatctgaaaaagaagagatttgcgcccagtacaattgtagctcaaacgatgccgaaagaagagtgttaaactcctatcttactgcagaagaactatctacccaaatattatccctgtatcgacaagagcaaaaggaagcttttaacggtaaccactttggattcaatgtttctttaagtctggtgtttgccggattaggtttgtttagctttccaatttattttagcaatataaacgctaacttagccggaattttcactgtttacggaacattatttgttgtcgcatgctggttcacttttcggtattatcccaaaaaagttgataaacaaaaactgattagtttgcgttatacaggtattgcgatgttttttttactgtttatggcatttggggcgtatgccatgcacatcataaagtttgagaccgtcactgccttttcttcaatttaccttcttttttatcttatagcttggatatcagtttatttagcattccgaaatttgtataaaactgctcagaagtctgtcgactattaa

SEQ ID NO: 8208 - DNA, 432 bp, Bacillus clausii
  misc_feature (1)...(432): n = A,T,C or G
ttgagagaaaaattaaatgtaccagatatccctattattgtcggtgaattagggcattatcttgaagagatcggatttggaaaaaacgctatagagtttangcaaataaaccagattttgtataaaattgctcataatgaagaaaactgctactttgtaacatccaaaggcttaacagcaaatccagatggcattcatcttgatgcgagctcccaaaggaaatttggattacggtattatgaagctttttcaaaacaaaaacacgttttagatcctttggacatcgaggatgaatggattgctaaggaagcaaagcgtgaacttactaaaaatgaagccatgtttgttcaaagtacaaagtttgctttaggacaattgagttttaaagagttttcttctcatgtttccaaaatccaccaaagcgaggagtga

SEQ ID NO: 8209 - DNA, 605 bp, Bacillus clausii
atgactgattatctgtatgaatactcaccggaagtttctttcatacaaagcgatggaactattgtagtagtccaagaaaatttaaaaacagttatcaaacctaaaagtgacattgaattgccactagactctttttttgctatagattgggatggatttggagtcgatattaaatctgaatctcagggaagaggaagaaagactgattctattcaatacgctacgataaataatattgtagatcaaacatcagatattatttttgatgatgatggatcgggagaaatcgcagatgtcgtttctgtcaaaattgataaggaacattcaaaagtcatatttcatctgtatcactgtaaatactcacacggagaacttcccggtgctcgtgttaaagacttatatgaagtatgtggtcaagctgaaaaatcaataatgtggaatgataatgtcttagagattgttcgacgaatgattgcgcgagaaaataaaagacaaaaagactatggtgtaactcggtttgaaaagggagacctacaaactcttcatatgttaaagaagatggtgaaatctggttttaaaacagaatttgaaatatcaattgttca

SEQ ID NO: 8210 - DNA, 243 bp, Bacillus clausii
  misc_feature (1)...(243): n = A,T,C or G
atgtcaggtccattggtgtgtttcgntgccacttgctcagagcgtacttctgtttgtcctgcttcttgttttttctcgatnggggctagtccaaaagctgactcggttaaatcttcgccgtcttttccaagtgcaaccattacagtgggaacgattagcacaatgacgatcagcattgctgcaaataggattatccgtttcatggcagacctccattatttgttccaacactatagtctatga

SEQ ID NO: 8211 - DNA, 363 bp, Bacillus clausii
atgagtgtatatatcaacttgcttccttttatgaaaaaaattgacgaggccccagcttttttacaggattgggagggcggaattgaaatctcgacagatggcccccattggcatggcgataccgattggactcaggagaaagagcggtttgcttcctttgcaggagacattggcgtccacttgccaatttgggaattaaacttggcctctgtccagttccctcaatatgcggcctattcatttgaagcgtaccgtatgtatttagaatgggcttctacatttgcaagccatgctgtgctccacactcatctatacaacatgcctttgtttcatcgagaagaagcacaagctttatcgaagcac

SEQ ID NO: 8212 - DNA, 606 bp, Bacillus clausii
atggaggagcggagagcaggttacacattaatagagtggttgttgatattcgtaatagtttgttatttaattggcttaattgctcttgcattgagtctattattttcaccttatggagatttacttctcaacaatttagtacatcaaggtgatcctaaagcttcgttctacatattatcctttagtgtttttgttgcaggtttacttgggggagctttttatgctgctagaggactttatagaagactgacgtcagatggtacgcaacggactgtagaatttgaagatagatttgatgtgaaagtgtggttattttggtatgtcgttcgccccctccaaggaggggtattagctgtaataatcctttcattattaaatgctggctttgtaggtttctctaacgtaaatgaacctgatcctcaatcactttactttcaaataagcttaggatttcttgtcggatatggaactcatgacgtcctgaagaaaatagatgagattatcaaagtaaccttttctacttccaaaaaaaatgattctatgaacgtcattaaagaatcgaaagataagattcgcgaaaataaggatcaaggtttacacttataa

SEQ ID NO: 8213 - DNA, 376 bp, Bacillus clausii
  misc_feature (1)...(376): n = A,T,C or G
atgaaagttatgggaataagcgaatcggctataaaacatatttttggtgatgtagtagtgatccctgatttttcaaattttgaaccaatgtgtcatattccgaagggcataatggaaattataaatgaatctgtaaaagaaatttactattgtggacctttaatgacgatatacccatctcaattacctaagaaaaagatattaaaaaagaatttaacaagcaattctgatgccccgcttgtatatattacctttggaggatcgccctcaggaaaagaatatttaatatctgttctaaagggtttggcaaagatcagcgctaatattgtagtttccacaggtaataatataccaattaatgatatnaaagaagttg

SEQ ID NO: 8214 - DNA, 279 bp, Bacillus clausii
atggaaattattcacatacagaaaaatataataaaacgaattttgtacgaaaaaggcgggccgagcggtgctgggattggattttctaaggattttgaggtgggggtatttccatttgttttccatttcctcttcccaaatcgtttccgcttttttcttttccgctttctttttcgtgtcctagtggttgtttctttttttgccccgtctgtgtggctgttgttgccgttgtggctgtccacagctgagagcaatacaaattccctcactcccttctaa

SEQ ID NO: 8215 - DNA, 318 bp, Bacillus clausii
  misc_feature (1)...(318): n = A,T,C or G
atgggccttctattccttgcttttaatcagacttttttcatggggacgttttttcttatttccggatattttgttccttcatcttttgaacgtaatggagcaacccgatttatcaaagatagattcatccggttcctagtcccgtttatcttctacgttctcattcttagccaagttcaatcaattgaagtctatatgcttaaccaggagccatttacatggcaaacctatttttcacatttaacttacgggcccgatgtggtacgtcgagctacttttcgtattcgtttgnttatcacagtctgggcgaaattatga

SEQ ID NO: 8216 - DNA, 294 bp, Bacillus clausii
atgcgtcgatatcgttggctattcggagtcgcggcaagcattcttattattgcattagggtttattattcaagtcgagtacggaccctcggatagtgagcgcgtgatcgttgattacagtaaaaatgcctactcgtcacctgcttgctttgaccaagcagggtttacaaacaatataggcgagtcaacatacggagaagttgcaaatgactccacctatgtccctgaatcatcctgtacagctgtcgaatttgctacaaagcgtgggcctctctggttcgcttggtttatgtag

SEQ ID NO: 8217 - DNA, 557 bp, Bacillus clausii
atgtatcaacatgaagatcgtataaaagtgatgtcagagattgaaaacttcacaaggtcaataaacggtattcaaggattattactggttggctctggttcaactggctttagagatcagtattcggatcttgatttacttgtcgtagtggaaaatcccgaaaatgtagttgatattaatgagcaaattagaggatttttacaatcaaggttttgtgttctgaaagagaaagtataccagcatgaaaaggatattttcgttacttgtttcttttttgaaaactatcttgagttggatttaggtgtatggtcatttaataaacttagagcaacaaagccaaattggattgttgtttttgatcgagaagggatcctttccgataaactaaatgactctttaaataaactaaatcatagggatatggatgaagcaataaatgattcattaagttttatttggcaattttttagaagcgcagttgtagcgttaaaaagaggccatcttattaaagcgctaaaagatattgactttatacgaaatcaaattattgagctgat

SEQ ID NO: 8218 - DNA, 256 bp, Bacillus clausii
atggaaggagagggggagaaagatatgcttagttggattttgatcatggctttaacgtgtgtcaatttaaatgtatttacatgggccaatcgcttaaaagagagacagaaatcgtggttgtatgcacaaggagcccgttatttatttggacttgtacttagctttctatttatttatgtatggttaattgacgttagtgtcactggcctattaaatacgtttggctttgttgtcgcgatcaatttaattgtttccg

SEQ ID NO: 8219 - DNA, 253 bp, Bacillus clausii
atgtattcttttgtgcttctgctcgtattgatcgccgttttgtggtatgcctatcagaaaaacaaagaaacgttcaaacagctttcaattgggcaaactgccggtgttttcgttgcgtatggcgctgcggtcgctatcattgtggctgcgctctattatgtggtgcagccagtaacggagccgattgccaatgagctgctaaagctagctgctcgctttgggttgctcattattgtattgtttgtttgcatgt

SEQ ID NO: 8220 - DNA, 408 bp, Bacillus clausii
  misc_feature (1)...(408): n = A,T,C or G
atggggagggcaggttttggaattgcaattggagcatcgattcttctccttcccttagtcttgatatttggggtagacgaattacagttttctggcggctggaactgggcatctttggtttattctctgtgggaagctctattttgtgttggcgtcattctcggattaatcatattctttcgcaaaagagtttctcgtcaaggaaaaagttggagcttcttgtcagcccattccttcgtgatttatatcattcatataccgattatcgctattgttatggctggattgaaggtcatccactttccaccatccttcatgtttctagctatgattctgatcacgataccactttgcttcttgtnaagtnatataattaggcagattccctttgtgtcaaagattatttag

SEQ ID NO: 8221 - DNA, 599 bp, Bacillus clausii
atgacaaatgtcctttctacgctgcggtttaccacattacggctgatccgcaattggattgtgttattgttgctgctcggaattccgattgtgttgattacattttttgcgattattttaggtgattctaaaacagaagctggtatgccttacattcaagaatcaacaactttaatggttcttgcctttcaactgtttggaggctcaatcgtcatgtcctatatacatgaagactttttcacggaacgccgttttcgcattcagtctctgccttttagccagacgctgtatgcattctccatcagtgttctaggtacgttattttcgatttttcttgggggcattttggtgttttattctttttgggtcttcaatgttgaatgggggaacattggctgggccgtgtttgtgatcgcattaatggctctgttatcaagcatcgtctgcctcattttcacgttcgccgtcaaacagtttaaagtggcagaacgactgagtgaagtgtatggaatcggtgcgattgtgcttgctggtttatttttcccaatgccagaaaatgctttttttgagtttatgggttcatatggaaatccattgac

SEQ ID NO: 8222 - DNA, 259 bp, Bacillus clausii
atggaagcctgtcaacgtactcgttggcaggcttttgcagtatacggaagtgtagtgatcaaagacagtgttgcccgatcggaaaaaggctctaatttaaagagcgaggcaactagaattagttgcctcgctctctctgttttaatgaagcactgcagcgagtgcttcaaccgcaatccagccttcaacgccgttcgcttttacttttacaaaatcagtgtcttcctcaagaatctcgatcatatcatcttcgaaaagt

SEQ ID NO: 8223 - DNA, 627 bp, Bacillus clausii
ttgagcattaaaaacaatgaaggcattttgcaatcagagtatttcattaatgaatgggggcttccacaacatttaattctgatcagtggtgacggtcacggctgggtttgtttagattatcgatcagttaatgaaaaccctccggttattttcattgacgtcgaagtggaaaaggaacaccgtttagctgattcatttgcggaattcataaacaacctttatcaagatgagacctcaaaagcgtcatttattgacgacgtttttgaagatgaccaaacagagtttacgtataaagaaggggaaaaagcattttctggcaacaatgtaagaaagattagttttgctcttcttcactttaccaatacagatagtgatacaaattggtttttaaagcaattaaagaaactaacaaataaaaagaacgaatttattgttcacgatgcggcagaagcgctttaccatattgttaatgaccggtatggaaaagataaagatgtagatagcaatttaattcaagaagttatcgacaaacttaaatctcattctagtgctacagttaataattatgctaggaagatacagagactatttgacgagaataagaattttagctgtccttctctgtaa

SEQ ID NO: 8224 - DNA, 492 bp, Bacillus clausii
  misc_feature (1)...(492): n = A,T,C or G
atgaatccgaaccaagactattatatttatacgaaaaatcattgtgatctcagaagtaagcataaaaaggtattgattactacttttagccgaagcagtttgggacatatgatgagggctattgcaataggattagaattacaaaaaagaagccacgatgttttattagcgtgtgctgaggaaaccttgtacttgccaaagtcatacggtttaaattgtgttaaggtacatgaattagagccaatgcctttgtggtcaaaaatgaacagagaagtggatctttcggaaattaccaagaagaggttggccagcaaaaattatattgaaaagtgtatgatagatgatacaacacttataaatcaatncaacccagatgtgtattgcatgaatgcgataacatctgaagtatcggctaagcttgctaacattccatcaatttcattaaataatataaagttattcaatttccctctttcaacggaattcctttag

SEQ ID NO: 8225 - DNA, 376 bp, Bacillus clausii; identical to SEQ ID NO: 8213
  misc_feature (1)...(376): n = A,T,C or G

SEQ ID NO: 8226 - DNA, 300 bp, Bacillus clausii
atgctaggtaaaatcgattcgacaatctcatcccagtctttgcgccacatttcaaatttctgttccgtttcacctgacatgcggagcttttttactttggcaatttcatctggaatgtcacgattcaataagttgattttcctggcatcgagctcgtccactgctttatgtatatgccgtctgagaaaaatcccagctgccgtccctgccgtaaaaaggacgagcaatatgatgatgactgttacaaaaatatccacatggaactcccctctactgcgcttttcttttacctgtttttaa

SEQ ID NO: 8227 - DNA, 204 bp, Bacillus clausii
atggataatatgaagattgaaaataaaatggaagttatattagataaaagaaaaaaaataaatttaaatgatgactatgggatacaaaaaagttggaatgaaataatagcagttctcacagaaaatgaggaaaatactataaggtatttagaaaattgtagtaaagaagatttatactggataagtgaagtttttgaggattag

SEQ ID NO: 8228 - DNA, 1002 bp, Bacillus clausii
atgggagaaacccatgccgttaccccggcgtatttcccgttgtttgcgcgcctatcgcgcctgcctgcaaacgcgacggtctcgcccgcgatcctgacaaggcaactgaaacagctggtgccaatccaataccaatggtaccaagcccagctcggtacccaagcgattcaaacggacgtgtcggaagtggttgctacaggggggtatgatttaactgaggaagaagtcgcagcgatgcaagcgtacctggaaaacaaacctccgggcgacggtcccctcatagccgaggttgacgaggaagtatacaaaggtgggcgttatcctgggccgacgatggatgcccgtgtcggcgccgatgggatcgcgtataaaaacaacatcaggaccttccttgatccagtagtcgactttttcttcggtgacttcctcacgctcgccgacccagaagcatctctcggggagaaagccttggcaacgacgtttatcttagtgaagccagcgaaagtggccgaactaggatatgacttgtcgaaggtgaggaaggtggagacgggtaatagaactagccaggttaacaaagttaatataccggaaaatagtattaaacattcaaatgtaggtgactttacaacaaatcctagaacaggagctatttcaagaatgaagggtggaggacatggacaaagtaatattgaatttttagaaaaaaataatgtagattataatataactcaagtatatgagaacggtgttagagtggggaatgtacctggacataaggtgaaagcaaaaagaacaggttctaatcagtcatggtttccagaaaactggacggagtctgatattacagcagcaggtgctaaggttgctgaatcacctaaatttgccaatgctgaaaatggagtggctatttttggagagtataaaggagttagggttggtgttataaaaactaatggagagatagggactatttttccagatgctactaaacaaccatag

SEQ ID NO: 8229 - DNA, 325 bp, Bacillus clausii
atgtatggtatcaaccgactcattaaacacagccgcttgtataagcagaaactagaacacgcaaagcaacggttagattcggcaaaagcagcttccagagaaacatttcaacagcttgtttccgaaaccgatattccaccttactatttaaagccctatgctatccaaaaatttaaaatgtatttccttcaccagcgggcagacaaccttaaagaagcaatcaacctatttgaaatagaaaagacatttgaactccatcaatacgcgatgttccggtttcatggcgagaaaaaagcataccgtgcttttgaaaaagcgctccact

SEQ ID NO: 8230 - DNA, 255 bp, Bacillus clausii
  misc_feature (1)...(255): n = A,T,C or G
atgacgggttccattagctccatctnttggatgctttcccattctgtcgcttgtttgataacgggtgtgctgccccattcttcccagagaaagcgctggaagtactcgcttgcgctgaatttaatgaattcccaggccaggtctttgtttttgctcgtttttccgattgcgagcgggctgccggagaacatgccaccgacgccgttttcatttttaaagttttgcacaatcgggaagcggtcttgcaaactttga

SEQ ID NO: 8231 - DNA, 633 bp, Bacillus clausii
  misc_feature (1)...(633): n = A,T,C or G
ttgaggttggctaccaaatttgaaaattatgttgacagtatccttaatgaagtcgagcttaacaatcaaaattataacgacctaaaaagtgaaattttgacatatctcaatgagaagaaagagttttacgaaggcaaaggcctggattcagattcagcagcagacgcttctatcgaagactttggagaaagcaaagaagtaggaaaggatttacttaaaacttatcttccttatcgaaaaattgctctaataagtgccatcgtttccagttttgtacttagcacatctatttttttatattcttcttttttcgcaaactctgttcctttaatttggttttttttaatgctaagctcagctggagtaactagctatttttactttaaaccccttaaaacggctaaatatcgagctttctttatagggtttatggttgttttttcttttataagcttgataggtcaattttatcttgaagcaataaaacacgatataatatacatgatgttgttcgtattattaataattacgtttgtcgcaatattgacccncatagtaattggggcaattcatcagcctatcagctctcgatttcaaattctaaacactactcaaagaagaataaatgtcttg

SEQ ID NO: 8232 - DNA, 309 bp, Bacillus clausii
atgttgattcacgctgtcacctcattcacaaaaacagtatccctttattttacttcttttggcggagaaaaaaaagtggtgttgcaagtgagcggggggaagaggcacgaaaaaggcttgtccacgttcaatttcgcccccgtaaaaaagcaagcacgttggttggtgcttgcaaaaagcggctacttgtttaagagctgctcaatttgcgttcggcggtttacaagtttttttaaccgctgtttgtgggtggaaatacgaggggcatctttagcttctattgcttcaaacaattccattaacacatag

SEQ ID NO: 8233 - DNA, 276 bp, Bacillus clausii
  misc_feature (1)...(276): n = A,T,C or G
atgaaacggcaaccgctttttttagcggccataacagggttgttgtttacaggtgggtgcagcttcatgaccatcaatgcggaagatgtgctcgaacaagcccttgcaagagaagaaaagtttgttccttatacgatcattaaagaatttgatgatggctacagcgagtcggtctatgcaaaagacgagcagacgcagcgggtcgactttgccaaagncggccagctgttgtccacttctttatatgttgatggaaatatttatgaaaaagactat

SEQ ID NO: 8234 - DNA, 559 bp, Bacillus clausii
atggcaaaagatagtacgtacaatagctttcgtcaattgagggtttttgtccatacgattgagcgatatgtacaagagggcatccctgtagcggtcgtggatagtgcttttgctaatgggggtgatctagagctaattgcacttttagatgacagtaggctgctagaccacattatttcgtacaaagcgtggaacacaaactgcaatacgatcgggacttcaatagcagcagcaattttcggctttgagagcaccaatcggcatacggtcaacttaaagaaaaacattctctatcacctgttggatgatgggttttaccagggtgctataaggaaatcggtcactgatacattcctgccgggcattggagctaactatttcgatgtgaaaggaaaagaagaagtggtcggggaaaaaatagtaacgctcttgaaagaagcgtttgatacaaacattcgacatagttttaaaaatatagtagtatccaatctagagattacattcccttggaagcggatgtttgaaatcggcattcatctagacattcgggaaactcatt

SEQ ID NO: 8235 - DNA, 231 bp, Bacillus clausii; identical to SEQ ID NO: 7969

SEQ ID NO: 8236 - DNA, 219 bp, Bacillus clausii
atggtcgtttgtttgctcgttctttttggcacgctaatcggctctgcgattatcgctgtaaattgtcttgcgttatcaaggaatcatctaaaaatggcaaaaacaacgattaccatgtatagacgtttcgttagtggatatactaacgtaacacgtatcccccacctgccgtcggacattccgacggctttttttacggataaaaaaagccgccattaa

SEQ ID NO: 8237 - DNA, 216 bp, Bacillus clausii; identical to SEQ ID NO: 7957

SEQ ID NO: 8238 - DNA, 681 bp, Bacillus clausii
atgaaagtactttggttctatcttaaacgtgattttcttatgttgcttcctgtgaacacgatcattattctgctcttgttcactggcgtgattctcctaaaggcactgcaagtacgaattggcgaaccttttggaatacaagcgttgacggcagcaggcgcattgtttttccttttcatgtttgtattatgtttagctatcgcagtcgaggccatttggaaagagtggcggaagcgaacccaatatgattggtacgctatgcctggctcgatccatgtgaagttggcgagcaaattagtggctgtattaggatggcaatatattcaaatggtacttgctttttcgctggtcttggtgatgacactatggacatcaagtgtagaaaatgcggctcaaatcataaaaggattagacgtgttgccagtgtttggttgggaatatttgtgggcgctgcttattagcccaattagcggtattttaatcgtatttttattgttgtttttgttattgggcattccccggggatggaaaaaagttggtattattgtcgtttatattggccttgtctgggttttttatccgtatatttccattaaatttgaagcgaacaacactgtgccttacgacagcaatctaatcgtgctgcttgctcagacaagtctgttgcaaaatgctcattga

SEQ ID NO: 8239 - DNA, 345 bp, Bacillus clausii
atgaagaaggctaaaacaattgaaaccggtgccagcgtcgatgaatttattgagcgtgttgaaagcccgtcgaagcgggaggatgcatacaagcttcttgcgattttttcggaaacgacaggttatgaagcaaagatgtgggggccgagcattattggatttggttcataccattatgtgtacaagtctgggcatgaaggggatgcaccactcgttggtttttcgccgaggaaggcaaaaatcagtttgtatgttgcttgcgaggaaacgaaaaaacaacaattgcttaagaactttggaaaacatacgactggaaaagcgtgcgtgtatattaataaagtggcc

SEQ ID NO: 8240 - DNA, 301 bp, Bacillus clausii
atgatcatgctctcgtcagagcaaaaaaaagcgatccaaagccttcaggaaaaagtggaacaagctgacggcattaagcttaaattaaattgggacctcttagaaggtgagcgttccttaaacggcacggaagactattttcattataatgaaaaaggaaagctgcttggttatttagcagtttatttctttggcaataaaatggaatgctgcggaatggtcgatcccgctgcaagaaggcgcggtataggccgaatgctccttgatcaagccgcctctgactggcaaggaaagacgaaac

SEQ ID NO: 8241 - DNA, 202 bp, Bacillus clausii
atgaaaacaaggaaagcagaaatacaagacattgtccttatccaagagatcgccaagcgttcatgggaagacacgtataaagacttgattcccgctgatatccgccaagtttatatcgagcaagcttattcgcgccaaagcttgtcggttaagatcaactcttctgctgctttttttgtggtggaagaggctggtaaagtca

SEQ ID NO: 8242 - DNA, 576 bp, Bacillus clausii
atgaggatatacccttttcttcgccgatcattgcgaacattaagcggtttcggcctctttgctgctatattgctttctggctgccaagcccctgaagcgagccccgctcctaataaggacgatgcttcccaaggcaatgatgcctctgaggaacaacagccagaggagcaagcgttgacagttgtcaatggcgataaaaccgacatcctttccgctcgggcagcaacagctccgtttgataaaacctatttagtaccagatggctttgaagtcgttgaaacagccaatatgttaacatttgtgtcggaccaagatccttcttttcaagtttccgtcagcacggagccgctcccttctgataaagattggacgttgcgccatgattacacaacactcgctcttcgttccaacgaaagcgagccagtggaaattgatacacattggtttcctgagcttggttttgattattatttgaccgttgacgacagccatggcatcgttcatcgtcttgtccgctttgacgaaaaacgagatcatatgtatgtagctgcgctggtctttgcctgcccgatttaa

SEQ ID NO: 8243 - DNA, 327 bp, Bacillus clausii
  misc_feature (1)...(327): n = A,T,C or G
atgattcgtcgtctaaaaagcatgatgatggtcatgctaacctttctatcttttcatctaccaatatttgatcctttgtttgaccgtgagacaaaacagagagctgatgcaaaagcgctagttcagaaagctgacgccaaagagtaccatttgcttgatgtagtagtcggctattcggatcaatacgaagacattgaacttactcattattggcttacggaacgttttattatggatgaagcgtacaaacaaggcttgcaaaantttgacaagcgatttcgcctaaaattgagcctgcttataaggaaatcattatgcctagcttaa

SEQ ID NO: 8244 - DNA, 461 bp, Bacillus clausii
atggttttgtcgctgctggacgtgacaccgttgctgtcagtagacgacatgaaggccagcaacggagccgtcattattggcagcgatctaagccacgcgtatatgattgatcagacagtcaagttagtgccgtgggaggaggaaacaggcgagagaacgttagctgacggggttgattttcatgtgatgggcacagccaaaaaagattttcaacgtttaggcagttattcgttcttaatccctgcatctttagcagcgcaacttgatgtaaaaatagatacgtttacggaagaggagattgtgtatccactggaaaccgaagcagcaaaaatcagtgcccatttgcgagaaatgactgcctcttatccgttcgcgaacgtatatgatgaagagcctttttggacaatggctgccgacaatccttctgtttcgacgtactatttcttgataattgccctgtt

SEQ ID NO: 8245 - DNA, 231 bp, Bacillus clausii
atgccagaaagggatgaacaattaagggaagaggaagcaaggcgttcagaagaaacgcttcgatttgctgaagatctgatttactatgctgcgattcttggcggaattgcgacggcgatggatcttgtcggcttaacaattgccagagaggaagcgcgaaaagcagaaactgaagtggaggaggaattggagacgcccgtttccgcaacagccgccagttggttttactga

SEQ ID NO: 8246 - DNA, 765 bp, Bacillus clausii
atgggggcggaggtgcgatatttgaaccctgaattaaaagaaaagctagaggagttttgtaggtgttttgagaaggaagaaaaatttttaaatattgaacaaggtaactataaaaaactaatctatcatttatatgaaaaatttaaaagaacttccttgttatatattgatgcctttaacagcacaacattaaagtttcccgaaattgagttaatacctttattaagagttttaattgagactaacctacatttaacatatgtactaaaagggatagataacaaaaatgagattgaaaaaatgtatgaacaaaacgaaaagcatggtttttggcttactgctaagttattaaacgagaaaaaggaaaaaactccagaagaacaaaaatttattgataggttttataaaggtaaagaagatagagaacctaaaaggaatataatttttaaaagtataaaggtgttagctcagaaaactaataaggagattttttattataattattatttagccttcaataactttgtgcactataatagttcaacatacgtgaattatacttatcaagaggataacaatcattatttttatagttctggaaagagatcattagatcatagcgaagagttacaaaaggtttttgatatggttatattaaatacatttgcagagttaaatgtttttcttggatcagatgaaatagccgataaatataatgctatgtattatttaacatccttaaaagatgttgaaataaaacattaa

SEQ ID NO: 8247 - DNA, 210 bp, Bacillus clausii
atgactcaattagaatatgagctaacgatgtgcgaactcatttgctatccagatgtgcgacttgaatcgaagcaaggcatcgataatgcgattgataagatgacacgggatcagcgtttcgatttgtttcatctaaaatgcaatccagatgcaaccaaaccagaatccaaatcgcttttagcaattgtattttccgaaatccaaaagtaa

SEQ ID NO: 8248 - DNA, 222 bp, Bacillus clausii
atgataacgaaaatcattatcaatgtcaacgaaaattcgctaaaaatattgcttctttctgttatgtatcgttttgcccgcgcaatccctgttcacccgcttcaacgagcggtttggtcgccattatttataaagacaaccagcactatgcgagtgctggttgtctcagactgtagacaaacgctcgcatacttcgtcgtttgcctcactcatctgctttga

SEQ ID NO: 8249 - DNA, 300 bp, Bacillus clausii
  misc_feature (1)...(300): n = A,T,C or G
atggaagcctgtcaacgtactcgttggcaggcttttgcagtatacggaagtgtagtgatcaaagacagtgttgcccgatcggaaaaaggctctaatttaaagagcgaggcaactagaattagttgcctcgctctctctgttttaatgaagcactgcagcgagtgcttcaaccgcaatccagccttcaacgccgttcgcttttacttttacaaaatcagtgtcttcctcaagaatctcgatcatatcatcttcgaaaagtcaagtanttgttcggaattgctanagctttccctaaattag

SEQ ID NO: 8250 - DNA, 322 bp, Bacillus clausii
  misc_feature (1)...(322): n = A,T,C or G
atgatttccgcacaagctttccgagtaattgctgcttttcatagtggggtttggatgctgttttttattggcgctgctgtttggcttctgttcacgtggcgaggatggcagaacgcccgttttctttgtgcttcctttgtgcgaacaacggaagcggtccttctgttgtctgggtttttaatgtggtatgcgtacgagtttgctgctttttacgcagtcaaaggcgcgattgcgattctaatgctctatttctatgaaaaaacacgtttagcgataaagccncaacaatataggcagctatatcctcancgggtattgcttg

SEQ ID NO: 8251 - DNA, 213 bp, Bacillus clausii
atgttccgttttgtcaagatcaaacgcttcttgatcacattcaatgcctttcgtatagaggccaatcccatgaccgcgcagatcgtcaagaagacgaagcgcttgctggtaactggtggaaagagactcgccaatcgacgaagccacggtttgaatgggatacgggctctgtttcaggacctcttcccacacttcatgaagccagaaatctga

SEQ ID NO: 8252 - DNA, 798 bp, Bacillus clausii
atgatacaggacaagcaaatcgccctttcgacagaggaatttgttgctgcgttagtgttatgtgggtatgaggaagcggctgcagatattataaatgaattgcaattagcggaaacggaggagcagcttgttacgttttcaaaccaggcggaaacccttttaaacaaccgtggttactgggacgaaacacgctctagcaaccttgtcaaagggttggaaagttttatccacttgctaatcaaatcgcagaaaaaaacacgctgtgtccatgggaaccatgtgttgatttttcatcaaattgaaggggacgaaatgattgtccaaacgtttaaaggcatggagcatcgttttgagctgtgcaaacattcggattcgctatgggagcgtatggctgatttctttggcttagcagacgaggacgttgacttgcccgagaattttaggctgagatcccaagggtttgatctgttttcgcaagcgacaagcgaggaaattgatgcgattatccgtgatcaaatttatccggagaactttaatatttttttagatgattttcgcaaccatggcttttcactggacaacatctccatgatgatctctcattatacccgtgatgaaagtgagctcattcaagttaatttctttctaaaaagcagcaaagggttcatgtggtacgtcgactatagtctaattgaagaaacaaacgaaattcatataaaagcactggccccaaaagagtgttttgaggccgcggtctatgtgatgctcgatttttacaagcacgatgcagtggaatag

SEQ ID NO: 8253 - DNA, 537 bp, Bacillus clausii
atgctgctttatggagggctacttccctctcggctgcatcatttaagcgaagatgaagggttgaagcgtatcaattattttcgaacattacggaaagtggttgggaataaaccgatattcgcgtttagtttaattatgcgaacgcctcgttataacagcgctgatgaggagcccgattattatgaacagtacggagaacgtatatataaacaggcctatttaaccgataaatgggaacgaagcggcttgtctcaaaaagagcaagaggaacttcaaacgattcgacatgaggttccaaaagacatcattaaagactatgaagacagacgagcgtttaacttaaatatgaatgtcaagattacggaattagtcgagaacggcgtcattgactttttagcgataccacaagacgattctgccgaatacggctatacatcacaggaccaaaaacgagtctatgaccaaattgtaagccaagaggctgcaatcgaaagtggcccgtgtaccctggagctgatgaggccggttcctctttag

SEQ ID NO: 8254 - DNA, 258 bp, Bacillus clausii
atgataaacatcggaaagccgacggacggttccactttcatgcgcacaaactgtttacttgggttaaaaagaaaggcgaaaatattgggcttttttgaaaaagcgaactcttcaggctggtgtgcctccttgaattgttccatctctcgttctccttcgataactagaaattcggtacatatctatttttctattatactgctaaatactagaaaaaccaggtactttataaaaactttagaattttttgttggataa

SEQ ID NO: 8255 - DNA, 216 bp, Bacillus clausii
atggggtggtatggcggcaagcatcacctatgcgtacattgtctccaaacgtcgcaaaaagacaaactagcctatgtgatgaagacagcgcgtgtcttgcgctgtcttttttggtttttcgtggtcaataaagaaagattatttggacagactaggcccataagcagattgctggtaacattctctgtccgtctgtcaatagaaggaaacatctag

SEQ ID NO: 8256 - DNA, 224 bp, Bacillus clausii
atggaggacaacgcgttggctaacttagagatcgctatttccgatgaagtgctcaaaagctacccagacgtaaccatttctggattggcggtaaaagggattgatacaaaaacagacaaatcggaggaactcgaaaggtacatgaatcatgccgtttatcagcatgaagacacagatgactcgttagcaaagagtgagatacaaaactggagatctatttacag

SEQ ID NO: 8257 - DNA, 426 bp, Bacillus clausii
atgaataaacaaaaacgtttcctcaccgactggcgacttcacttactcgtattaggcattgttgtcgttgcagaaatgattggcgtgattgaaattcgcttaggagcaggaatgatcatgctcttgccgatgctgtttgcccttgtattcgggttagccttgtatttcacgccactcgtgaaagaaacacaatccaaacatgcagaaccaatcattacgctcagtgtagcgctgctgattgccaaaatcggtgtcactatagggccagacttgaaaaatgtgattgctgctggtcccgccttgcttttacaagaaatcggcaatttcggcaccattttcttagcactgcccgttgccgttttgctgctaggaatgaagcgagaaagcattggcatgacccactctatcggacgagagcccaattag

SEQ ID NO: 8258 - DNA, 339 bp, Bacillus clausii
atggaagcagattctttatttaaaacattagtagagtatgaaggtgtagaaatcatattagaatggaacagtggattaaaaattgtaggcaaaacagacacattttttgagacagacaatggattagatgatgatgatcccgattacacagagtattatgcagtcgcatttcaagtaaatcatattttatcccatcctactactaatgaaggcagtgtatatagttggttggaacaagaaaaaagtaccttggttgaaatttctctctatgatgatcccccaagtgcagtattttcacctgaaggaaagaaggtatgggaaagagaacgttccaaatga

SEQ ID NO: 8259 - DNA, 218 bp, Bacillus clausii
atgagcaccatcttttccatagtgtatcattcccctattagtatcaacgtattttccagtcaccgtgtcatagtatttacctatcggttcaccaaagtccactctctctttatttttggtcacagtggttcctttcccggcaaacttatcaagcaattcttgtgcttttttattatcgccatagaagatacttttgtgttttccatttgcaagttctt

SEQ ID NO: 8260 - DNA, 495 bp, Bacillus clausii
atgatctgcataagttatgcctttctttgtacgtggctcataactatgaaaaccgagatacttacacgcttgacaagcataaagatttatcttttagccttgctaacatgctcacattctttatctatgggagtgatgaaattgaagactcccaggatgattaatgctggccactttaacaagcgaatagaaattgaagtttataagggcgactttaatgaaaatggcatgtgggtaaaagattggtttccatatacaaaggcaatggcgtttattcaggtgaagcagctaaaggaaatcagtgagaacgacgttcaaacacgagaaggctatactgaaatgaccatcaggcaaaataaaaagacaatggcgattgaaaccggtatgcgagtcaaacaaaaggtgtttgggcaagagttgctttataaggttgatgacattgattatcgaccaaatgacaacaaatacatgactttaaagtgtataaaggagtga

SEQ ID NO: 8261 - DNA, 309 bp, Bacillus clausii
atgagcgttattaagatatttcttgagtatcaatgctatccaatgtggatatataatgaacgaggtgaattagttgacaatgatttagttggagaacttgacggtgaagacgaaattgataatatgcttttagagatacagaatatttatgataacctattcgaagacaatactatcaactttgagtacaaaggattttcaaatgaaaatgaaaagaccttatttcttaagaaggtagaaaacactgtagagttaattaaagaaaagctaggggacaagtatttagttgagaataaggtagaaatttaa

SEQ ID NO: 8262 - DNA, 225 bp, Bacillus clausii
atgacgtttaccatttctgtgtatcaacctttacatgctcgatggttaaaatcgattcttttaagcttcggcagtggcgttaaaattgtcaaacctgtggaattacaaacggttttagtagatgaggcaaaaaaaaataataaatgtttatcgagatgtgtgacaggctgttgtcatacatctttttttatactacagctatcaaccgttaaggagtcgatctaa

SEQ ID NO: 8263 - DNA, 210 bp, Bacillus clausii
atggagaccaacaaactccccacaacgtggctcgatacaaaggcgatccgcgcctaccgtcaacaagcgcaatcctatagtacgaaagaagatctttggtcttggtatgtattgcggcgtctctccatctatgtcacaattgtgtttttaaagtggaaatggacgccaaatgcagtaagctggatgaaccgctttctttgtggctttctc

SEQ ID NO: 8264 - DNA, 954 bp, Bacillus clausii
atgaatatgtattgctatcatgctacaaagctcgaaagtgtgcaaagtgcttttgagtttgcttcctcttacagaaattatgatttattattagccttactcgataaacatcaacacgacgatttgctcactgaatggtgccaagtgtatgaacttgtttcgactttaagatataacattaatattgattttaaagaagttcttgctaaaactgaaaagttattaccttacattaaatccgatcttttaataacaaaacttaaaatcttgcgctattctgcttattatcgattaaaacaatataaaatggcccatgcaattacactcgaaacagctgaatttttaaaaacactccggccaggttatttaaagtctgtattagctgcaagagtggctaacaatcttgcatatagttactttctatttgaacataacgttaaaaaggcagaacaactgatctcaagcaccattgtaaaccccgcaactcaagaatacattttagcttctgctcatcaaatacttggtcagatttatattttcaacaatttccaaaaatcaaaacagaacttgattttttcctacaatctttacaaaaagatgaatgtcctttcacaagcgaatgtaataaaaaacaatgacctgatttttcttcacaatgtgcaccaaaagtattttcctttggatgaagacatggatattgaagaacaagcccaccaatatattattcgcaaacagcctgataaagcaatagcattactggatatggctgagcagcaaaatggaaaaaataagtttaatttattttatcggtcaatggcaactgataactatcatttatgtaaagaagcgcttcattttgccatgatggatggcgattttgtttttacaaagtggatgtttgaaaaatttgaagaaaaatatgttcttacaaatgaaaggggcattttaaattga

SEQ ID NO: 8265 - DNA, 243 bp, Bacillus clausii
atgtgtatttatctaaatagacgttatcgggctatgttaaacttctttttctgccgttactcaaatggatacgtgatgccccattggcggcgaacggtatccattagctccattacatcgcgggagagcgctatatgtgtgtctccttggccggctattgctgcttccatcgcttggatttcgtattggagggcatgttctgtctggcctgctgtgatttcctcggttgagccatcaggataa

SEQ ID NO: 8266 - DNA, 336 bp, Bacillus clausii
atgttccctctcgtcttagcagcgattttaatcgctttgttttttgatacatacatcataaaagccatgaaaaagacggcaaacccgataatgtccattgccaaaaagagaagcgcggcccaaagaccggtccatattaaaatgccattttggatttcattatctttaatttttgtggcaataaccaagctgatgacccctccaactaacacgaataagccaaatagcaaaacaacattgatcacgtcgctaattagttgggatgttacaagcatcgtttctgcagtttcattctctaaccttttcgttcctgactgtttaaaccaagccgaatag

SEQ ID NO: 8267 - DNA, 388 bp, Bacillus clausii
atgccatttcctacttatgatgaattcatgagcatgaaaacagcagaccaacgccgcttgttggaagaagagcgtaagcagtacggaaacacgcgcatcattacagtcgaaggttggaatacagcaaacttagcaaatgtccttaacattcttggcttgccgaagttagacagaaaaccccctaccggcgaaaatcattcaagcaagattagacaactgccatttttgccaaaagaccagttggaagagtacaaaaataattacaagagaatgaaagacttcacagaatgggaaaaaattaatattgcagaccgcaaggaattaattactgcctggattgaaaagaaaatcaaacctgctgacttagcaaagcatttcggtaaaagcc

SEQ ID NO: 8268 - DNA, 335 bp, Bacillus clausii
atgattaatattataagaggggtgaaacaatcagagcctccttggcaaggatggagtgtcaacgagcatgactctttcatttcagtaccaagaagactcaagatgaaggacaatcatagggggatggactacatggcctataatcgtggggatagaacaatcacgacagagagattgcgtttgcgtttgtttacagaggcagatgcccagaatgtcgttgagctgtgcaataattataacctttataagagcactttacatttgccctatccatattcaatcgaatgcgccctttcatggatagcgaatcatgagcaaaactttgaattagacta

SEQ ID NO: 8269 - DNA, 226 bp, Bacillus clausii
atgggcaaggggaaagatatgcgctatctctgctatccttatatgcgtgaggcgcaaacaactgtcgattttgaaatacaatctgatgcgctggcagttcggattggacaagcggctagcttagttgtgccgttagaggaattacatagtgatttactcaagctggtggaaatggtgtaccatttaaacggatcggtacgcggaaagatggcgatatcttctgctg

SEQ ID NO: 8270 - DNA, 279 bp, Bacillus clausii
atggcaaacggagaattatctctcactctccagttgttaaatttgttattggaattgaggttggcgaagttaaatggtccaactcctcctaatgggacaggaagcattagggatttattgcttggcttagttggtcagacggtaacggtgacgacgccatttggtgtaataacagggacgttgctttccgtcctgactgactacatcgtgataattgaagacaccgggtcgcaagtgcttgtgcgtttagcagaaattgaatcagcaagcggacagtaa

SEQ ID NO: 8271 - DNA, 237 bp, Bacillus clausii
atggcagacatcgtttatccatgcttatttgtgtcatgctttaaaaagcgctccacgaacacttacccaaatcgctgtgttattgtcgtcttgtttgcggcagttccgccatcctttcaaaccttactgcgacccgaaaaaagtcactttccaactagcgcgcgaatatttagctttgcttcaagcatttggattgttgaaaaagatagctcctgcggcttttataaaaagcagtga

SEQ ID NO: 8272 - DNA, 339 bp, Bacillus clausii
atgattctttatgctactgttatatttttattatctatatgtctcgcctttcaatatgtaacggcatttatgtttctcttgtttggtagaaacaacccatatgcccgtttcgtggagaagttttatgaacatcagccaaaagattggtatgacaagtttatgaactttttctacattatgaattacggtgtggcacaccgaggatatgtaaaggtaatggaaaaacacggagggataaaagggaaactccgatatgcaggcttagtttttcttgcaacagtattattggttatcattggtaatattattaacgctattgaggttcgcctcacgagctag

SEQ ID NO: 8273 - DNA, 447 bp, Bacillus clausii
atgacatcaaggctattgattctgaagaatcaatggaaacccaagtccttcaagcataatttaaggaacaagtgccgatataccgacttgaaagaaggagagagacgaatgatcatatatataattattttatatttaataggcctatgtcttgcctttcagtatataccagcatttgtttttttagtcgtaggaagaaacaatttttatgcccgttttgtggaaaaattttatgaacatcagccaaaagattggtatgacaagtttatgaactttttctacattatgaattacggagtagcacaccgaggatatgtaaaagtgatggaaaagcacggagggataaaagggaaactccgatatgcaggcttagtttttatcgcaacagtaattctagctatcattggtaatattattaacgctattgaggttcgcctcacgagctag

SEQ ID NO: 8274 - DNA, 246 bp, Bacillus clausii
atgttaatgggaggtgctgttgcacctccctcaaactgtagccaaacgctcgcatccttcgttgttcgtctcgttcatatgctcatgaacccccgttctattcgcatcttcactcgacttcacgcctcggctgacaagcgttttctatcagttcgagtgattttgtcgacgttgtcgacaaccgctgggaggtgctggtgcacctcccgaaggccaattaaattaattgagttccatgtcttctaa

SEQ ID NO: 8275 - DNA, 366 bp, Bacillus clausii
atgaagcctacaaatgaagacattcaacaccaatacgggatagaccagaatgaccaaccgagccaaccacacgaggtgggcccagtctacagaaacagttatggggcggcaaatcagatggggaatatggctcagcaagtgagcgggtatcagcctgcccagcaatacgcaatgaaccaaaatgtgcaacacactcttgaatatgggagtaacacacagccatttgcacaggcatatgggagcaatacacagccatttgcacaggaatatgggagcaatacacagccatttgtacaggaatatggcagtaacacacaggcattcgcacaggcagaagccaatcagttttcacagcaggggcgatga

SEQ ID NO: 8276 - DNA, 266 bp, Bacillus clausii; identical to SEQ ID NO: 7636

SEQ ID NO: 8277 - DNA, 243 bp, Bacillus clausii; identical to SEQ ID NO: 8265

SEQ ID NO: 8278 - DNA, 954 bp, Bacillus clausii
atgaatatgtattgctatcatgctacaaagctcgaaagtgtgcaaagtgcttttgagttggcttcctcttacagaaattatgatttattattagccttactcgataaacatcaacacgacgatttgctcactgaatggtgccaagtgtatgaacttgtttcgactttaagatataacattaatattgattttaaagaagttcttgctaaaactgaaaagttattaccttacattaaatccgatcttttaataacaaaacttaaaatcttgcgctattctgcttattatcgattaaaacaatataaaatggcccatgcaattacactcgaaacagctgaatttttaaaaacactccggccaggttatttaaagtctgtattagctgcaagagtggctaacaatcttgcatatagttactttctatttgaacataacgttaaaaaggcagaacaactgatctcaagcaccattgtaaaccccgcaactcaagaatacattttagcttctgctcatcaaatacttggtcagatttatattttcaacaatttccaaaaatcaaaacagaacttgattttttcctacaatctttacaaaaagatgaatgtcctttcacaagcgaatgtaataaaaaacaatgacctgatttttcttcacaatgtgcaccaaaagtattttcctttggatgaagacatggatattgaagaacaagcccaccaatatattattcgcaaacagcctgataaagcaatagcattactggatatggctgagcagcaaaatggaaaaaataagtttaatttattttatcggtcaatggcaactgataactatcatttatgtaaagaagcgcttcattttgccatgatggatggcgattttgtttttacaaagtggatgtttgaaaaatttgaagaaaaatatgttcttacaaatgaaaggggcattttaaattga

SEQ ID NO: 8279 - DNA, 270 bp, Bacillus clausii
atgaaaatggcagaaatcaaagtaaatgaaagtaacgcattagaagtgtttcaacatgtcacaaaggctgcaactggcttagcttcaatagaagcaacaattgaaatggcaacatcatcacttgatgttcttgaacaacttaaccatttggagaaagcatatcaagcgcagcttaagtcctatatggaaacgttaaacaaaacgaaacaagagagccaacagctaattaaaatatacggggaaatagaccgggctttggctaatcaatga

SEQ ID NO: 8280 - DNA, 306 bp, Bacillus clausii; identical to SEQ ID NO: 7999

SEQ ID NO: 8281 - DNA, 366 bp, Bacillus clausii; identical to SEQ ID NO: 8018

SEQ ID NO: 8282 - DNA, 204 bp, Bacillus clausii
atggttagcgcttccctcaaagtccgctacatgtccctaccaactccggcattgctcgatagcaggtatttccacacctttgtcaaaaacatcaaagcattggttccattcgtatatttcgccaaaaatggcttatttcctttgggaaatatttgctttccttttacacttttttgtcgtttaggaatggcgcttttctcatag

SEQ ID NO: 8283 - DNA, 342 bp, Bacillus clausii; identical to SEQ ID NO: 8065

SEQ ID NO: 8284 - DNA, 339 bp, Bacillus clausii
atggaggatggacaaaaaaatcaagaaatgactatatcaaacaaaatccaggcctttattctaatgcctggatatatgatgatcctctcgtttgttttatattacttattaacgtttagttttattaaggcagaggggattattgcaatcatttcgtttcctttggttttttgttggatatacgttccgctttttagagaatatcaatttaaggagatgtattacaaagatggcgatatgcccataaaagttaaaattcaaaaacacaagcaagcaatcactgaatatagcattatagctgtatttacaactggtttcgcattgttatgtcacatatag

SEQ ID NO: 8285 - DNA, 243 bp, Bacillus clausii
atggaacaacatgaggaaagaaagatggacttacgtaacaaatttcaagcttttgtgttgatgcctggcattattatgttagtagcgtggatgctctatttcattttcactttagggaaaatgaattatcaaggggtgattccagtgattgcagcccctttgattctttgctgggtatgtaatcccttctttgaaataaacgaatataaggaaatgtttatgaggatgcagaaatgcctctaa

SEQ ID NO: 8286 - DNA, 360 bp, Bacillus clausii
atggattggggattcatgaaaaacataaatggaaaagaaatcaaattaagccgaaaaaacaagtttgttgcttttgttctattgccgctttatatgatcatcgcctttctaataggctatacagtgggccttgagatagctagcaaatggtatgattcaatggcaatcatcacgttcataatagcggtacttgtgctttgtattatattgaacccaattttcaatgcgttcgacttctatgacatatatgttgtgaatggggaattaagcctaaaggaaaaaatgaagaagtttaaagcagctttcataacattcactcttatttctgttgttgcaggcttatggggaggggtattttaa

SEQ ID NO: 8287 - DNA, 301 bp, Bacillus clausii
atgctaaaaccgtgtttttggatggcttttcaaccgttttgtacgaccgcatttgtaaaggagggggccaattcatccatgaaggagaaaatagctaaactaacaccaaagaatcgattcattgcatttgtgttacttcctttataccaagttgtgatgtttacgattggatatttgttttcttttaatataagcggaggaaacggtatatggagttttgtggggtttcttcttgtgacattttttgtttgttttatatgtaatccagttttcaacgcatttgagtttgataatattgaca

SEQ ID NO: 8288 - DNA, 228 bp, Bacillus clausii
atgtctagaagtttcgccgctgctgacatcgctgcaagagcgccgtccccatcggagacaaagcctgtccgttctggacgggctccaattccgccaagccttccaatgatacccatggttggcgctgaacctcctgctgagcgaccgttccttccacgaacatggactttaacaaagtctgttgagcccttttccccatcgacgcgtgaaatgtcgacatctgcatga

SEQ ID NO: 8289 - DNA, 465 bp, Bacillus clausii; identical to SEQ ID NO: 7270

SEQ ID NO: 8290 - DNA, 1182 bp, Bacillus clausii
atgtatgtagacgccgatgattggctttcgttagatggcattcaaattttgtatgacttgttagaagagacaaatggaaagtatgccgttggaaagtcgattcaagttgactcaaaaggacaaaaggttattggaagatacgaatcgagtaaagtcaggcacaatgtctcacctttttcgatcaagcatttgttttaccatttagggccaagagcgcggatgatgagtttagatttaatcaaacatcataaaatccgttatccagaaatgaagtttgctgaggacaaccaattttttatagatgtgattttggctgccggagaaatctcgaccacgactgagaccatttattatttttatcgaatcgatgacaacgattctctgacaaaacaaacggatattggcgagaaaatggactcgaacattaaagttttaaaatacgtattaaataagaagctggagccggaaaaagaaaaaaacatcgtcaaccgcttaattgaatttgactgcattacgaggctttttgaccggaaacactttgtaaaaagcaaagataaacaattgtattatcccaatttccatgaggcaatgggcattttcaaaaaggccaaacgcccttatgaaattagagagacgattattaagccaataaacgttatttattttgatttggcaatggcaaaggattatggcacgctagaagcattggcaaaatggtcgaaaaaaggtggagaaacaaaacagattatagagaacgggcttccttacaatgttgccgtattggaaaatgggaaagaaatgaagattcccgttcggttaaaagcagaattggatacagaaatgcaagaccaagaaaaaatccaactgaaaattaaactgactggccattccctgtctccgattgaaggagttgccttaatagacagggccaatgtggacaacgtctaccagctaccgaatgcagtaaaacagaaagaggactctgtggtagtttcactgaaaatggaagaattaaacgttcttccaaaaggctcatacgagtttgccctgatgtatgacgactatgaaaagaaactagttaaaaaacgaacggaaaccacattgaccgctaaacttgataacggcaaaaagtttaatctgtataaaacaatcaacaacaatataggcgttaaagtaaaataa

SEQ ID NO: 8291 - DNA, 516 bp, Bacillus clausii
atgataactttttgcaaagaggtcttgtcgatgaattcattttttaaacgtgtgcggcttgcagttcgacttccgcaaaaacaggcggcgttccaactgaacaaagaacggatcggcgtcccgtttttatatgttggtttgctgtcagcccttgtctgtatcccattgtcgattgagacatttttacagtcagaaggaattattgccgatttggcgttgcctatgtttcttgtctattttgtgtttgtgtattttccgttatttaccctttctgtttacagccttttagcggctgtgacagcattggccagggcgatcgcgctagcagctaaacggaaattaacatttttaatgctttataaaattgcttgctttgcggcaacgttgccgatccttggttacggtgcttgcttgctcgtaaatgaggcattggctgaaacctgggttggaatcagcatcgtgtttatactagtgcttttgatccggctcctgttcccattatccacaggcgaataa

SEQ ID NO: 8292 - DNA, 204 bp, Bacillus clausii
atgccaggcgagagacggtgcaaagagacctattttatgggccattgttttttgcgcatggaacgaaaagagtgtctgttgcaaacgacggcgcctgctgactcgccttgggaaaataagcgactgacaccgtatgtgtggatcataccggcaaagaagccgataaaagcaaaagcgcccattccaagagtgcgatcattataa

SEQ ID NO: 8293 - DNA, 1000 bp, Bacillus clausii
atggaaatcggaagtttgttcgttggtcgagtaaatggatcaggccaaacattggcctttcatgaagggcaagtcttgcgtggcgttgtgctgaaccgttttgccgattctgggcttgtgcaaattcaattgaaggatacacgtgtcgtggccgagttaaaagcggatttgatggttggcaagacctattggtttaccgtgcaaaaaggacaacctttgccaatcttgcaaaaagcggcagaaggccattcatatgaacagcttctcacgtcatggaatagaatgccttcacaccgcaatgtccgtgtgcttgcactgttggattcaaccggattgcctttgacaaaaaagggatttgcaggcgtggcccacgcgtatgcatcattgaaactgtctgaacagcagacaaaagaagcattgctttacatcaagcagcagaacgtaaacgtgacagccgccacgctccaagcagcccatgtggaagtaaacgcatctgagtcgttaagtgtcgcgctacggcagtttgctgcagcctggaaacatacagtgcctgcccaactccttttccaattggaggagcttgggcgccagctggaagcaggcgaatttcgacgaggtgagctgttaaaagcgtatataagcacgctaggacgggtgacggagctacttgatcccattcgaaatggagcaggagacaggaaagcaaaaaaagcagctgaagagctggctttgcgcttttctctttaccaagaaggcacactgatccctttgataaaacagcagtttattcctttgtttggccgcgattggttgctgcaatgggaaagcgccgagaacagcgaggagaacaagccgcttcgtttttatattagcgctgagcttgaacagcttggttatgtattagtagatggacgccagcatgaacagcggctattcgcgacgatttacagcgggcaaccggcaccgtctgcttttgtttcgtttaggtgggaaacaactc

SEQ ID NO: 8294 - DNA, 207 bp, Bacillus clausii
atgcaaagcaatccttcccctacttgtcagcgtaccgagtatagtcacaaaaatctactttcctgcttgaggcaaggaacgatcgcctttttgctattttgtggtaaaatggacgtacagacgttcaccgcagcaaacaccgcctatttaaaaaatgcgtttttgacaaggcagccattacgggcgtgcaccgagatggacaagtag

SEQ ID NO: 8295 - DNA, 285 bp, Bacillus clausii
atgtacgaaataagcattgtcacacctgtaagccaacaagacgagaaatacataaaacgttgctatgaatcagtaaaagggcaattacaagcaaacgttgaatggattgtcattttagaaggggattcccccttggcagaacaagttcaattggagaacagagaaaattccaatgtggatgtaaaagttgtagtggacactgaattaaaaaatgtcaacgaaaagcgtaataaaggcattgaggtagcaacagggggaatacctctattttttagatgtcgatga

SEQ ID NO: 8296 - DNA, 339 bp, Bacillus clausii; identical to SEQ ID NO: 8272

SEQ ID NO: 8297 - DNA, 447 bp, Bacillus clausii; identical to SEQ ID NO: 8273

SEQ ID NO: 8298 - DNA, 282 bp, Bacillus clausii
atggagacgtttgctttaattatctttactattgtaggtttatcaattaccctgcaatttttaacgggtatgttgtttttcttatttggaatagcttctccaataggcagttatttgtctaattattatgtgaagaacgccaaaggttggtttgaccggtttacaaatatgttttatttatatgcacatcgttttgcccatcttacatttctaaagttaattgaaaagtatggtggagtaaaagggaggcttttttacctggggatagggtgtgtattttaa

SEQ ID NO: 8299 - DNA, 819 bp, Bacillus clausii
atgaagccctttatgcggtgtacgacggaggaatggatgcttcttttgacgatgtgtggctatgaggtgttggccaagtcgttaggagaggaagtgtttggcgaaaaatcagaagagagctgggaaacgttgtttgaatgtgcagcgcatcaacttatgcttaaaggggtttgggatgatgagaaggcttcaaaggatgaggttccgcttgcggatgggctgcaatcttttattcgcagtgtagctgaagcaaagcaattgatccgtttatcaaacccactgaccaatgaagcattattatttaggcgtatcggcgacggccaatggattgaacattacataaagcaagaaattatccaagagtttcatcctgttgatgcaaagagtatagagaagaacatgcatcagttcattgaatataaagatttagaaccgagcaacgagattgaattcacgatgtcaaatggcgcttttactgcgctaagtgaccagcggcatgtaaaagaagtaaaaatgtactggcttgaagcaactacccaaaatgaagcgtggtttgatgaatttgcagaagcgcttttagcgaatgattggaagttttttaatacaagtgtgatccatgtttcacttgatggagaacagacagaaacagatttgaatgacctattgtttcatatgcctgcacgagatggagtttggtttgtaagatacaaagatgttcattcaaacgaagatgtcattattcaaaaaacatctttttctaaatggaaagaagtgtgtaacgaattccttgaacggacagtcttccacgctgccaaataa

SEQ ID NO: 8300 - DNA, 375 bp, Bacillus clausii
agttgtccgctccgctgattcctgtttttgaagggattacggtgatgccgttaatcggaacgattgacacagcgagagcgaaactgatcatggaaaatttgcttgaaggcgtgatcgaacaccggtcaaaagtcgttttaattgatattacaggtgtcccggttgtcgatacaatggttgcccaacatatcattgaagcttccgaagctgtccgtttaattggagcgaaggctgtattagtaggcattcgccctgaaattgcccagacaattgtcaacttgggcattgacttggctagatttccaacgcagagcacactacgcaaaggagttgtgttggccttagaaatgacaggaaagaaagtggtcgatttat

SEQ ID NO: 8301 - DNA, 355 bp, Bacillus clausii
atgaggattccgattctcaagctcaatcaatatttattaatcagcatccaaattgagttagatgaccaaacagccctccaattccaggaggatctgcttgaaaaaatccacgaagaaggttcaaaaggagtcgttatcgatttaacaagtgtcgatatgattgactcgttcattgccaaagtacttggcgatgttgtcgacatgtccaatttgatgggggctcgtgtcgtattgaccggcattcgtcctgctgtcgccattacattaattgatatgggaatcaaattagaaggtgtttcaaccgcgttagatcttgaacagggactcgcaagcttgcaacaggaattggagggtt

SEQ ID NO: 8302 - DNA, 312 bp, Bacillus clausii
atggatatccaatcctgtgtggaagtaaaaaatgaatggggaatcgtcgctgctaggcaggcagggcgcgacctttcacgccaaatcggttttggcagtgtagatcaagctcggatcacgacagccatttctgaacttgcacgaaacatttatttgtatgcgaagcggggagaaattcgccttgaattggtggaaaagccctccaaactcgggataatcaaaggcattcgtgtgattgcgaaagatgacggcccgggcattcaagatatacggcaagtgatggtagacggatttacgacttccagcggccta

SEQ ID NO: 8303 - DNA, 429 bp, Bacillus clausii
caataaaatgaatctagcgttttcggctttaagtgaaaatgaatcttttgcccgagtgacagtcagtgcctttattgcccaacttgatccgacgatggaggaattgacggaaatcaagacgattgtctcagaggcggtcaccaatgcgattatccatgggtacgagaatgatccgaatggacaagtttatcttacagctgaactgaaggaccgtgaactcgaactcattatccgcgatgaaggggtaggcatatcagatttggatgaagcaagacagccgctttacacctcgaaaccggaactagagcgctctggaatgggcttcacgattatggaaaatttttgccaagagatgaaagtaatttccgaaccaatgattgggacaaccgtttacgtcaaaaaacagctgaccacgacgaaagcaatgtg

SEQ ID NO: 8304 - DNA, 339 bp, Bacillus clausii
gaacttgaaaatcggattggagcaaaaggagcatgtattgttagttcggctagaaggggaactggaccatcattctgccaaagaattgcgcagccaaatagaagcacggctagaaaacatccagcatattgtgctgaatttggctgagctgtcttttatggacagttcggggcttggcgtcatactgggcaggtataagcaaattaaggcaaatggtggcgaaatggtcgtatgcgcgatttcgccaacgatcgagcggctgtttgagatgtctggcctttttaaaattatccgtttggaagaaagcgaacgattcgcattgcaaaaattgggggtggc

SEQ ID NO: 8305 - DNA, 462 bp, Bacillus clausii
taccagagaaacaacttgctcatttaaaacaccaattgctagaaatgaaagacgggcttgaaacaaagaagcgacgaaccactggcgaaatgtcggacagccgcggcgacattgcccggggcgccgataaccatattggtgaaaccgcttctgaatacgaagaccgcgttatccaacaatcacttaacgaagcggaccaaaaacgccttcaagacgtcaaagaagcgctagaacgaatcgaagaagggacgtacggaatttgtatcgatacagggcaaccgattccttatgaacgccttgaagcactcccttatgcaaagcgaacgcctgaagcgcaacgagaaagagaaacgcctttagcggaggacaatcaagaagttagtggagtggactatgtgcgaatggagggcgatacagagacaactcgtgcccttgaacaagaacaacaggcaagccaccaat

SEQ ID NO: 8306 - DNA, 873 bp, Bacillus clausii
ggaagtccgtacagcgtacgaacaagccagcgatttccaagtacagctggccgtgcttcaacaagaagagatccaattgcggattaggcgggatgatattgatcgccgcttgaaaaatcttcaggatacgattaatcgggctgaacagctttctgtacagatgtccgtggtgtttgactttttatcaagtgaccttaagcaagtcggcgaatacattaaagacgccaatgaaaagcaagcgttcggcttaaaaataatcgaggcacaggaagaagagcgtcgccgtctttcccgggaaatccatgacgggccagctcagatgatggcaaacgttatgcttcattcagaattgattgaacggatttaccaggaacggggcattgaggaagcgcttaaagaaattcgcgggttgcgccgtatggttcgttcttcattggcagaggtaagaagaatcatttatgatttgcgcccgatggcgttggatgatttagggctagtgcctacattgagaaagtatttggagaatattgaagagcgtcatggcttaaaagtcacttttaaacactttggcgttgaaaagaggcttgcccaacaatttgaaattgcgttatttcgccttgtgcaggaagcggtgcaaaatgcgactaagcacgcagaaccgactgaaattatcgtgaagattgaattgaaaccaaaaaatgtaacgctagtcattagagatgacggcaaaggatttgacctttctgaaagaaaggaatcttcgtttgggttaataggcatgaaagaaagggttaacatgctaaatggcaaaatgacgattcattccaaaccgcaagaaggaacaaatattttgattcaactccctgtctctac

SEQ ID NO: 8307 - DNA, 546 bp, Bacillus clausii
  misc_feature (1)...(546): n = A,T,C or G
tggttgatgaagaacagcggattatccaaattaacgccaaatcagaacaattgtatgcgttagcaagccatgccattgccggcaagcctttgcgccattactttgatgaggaagcgctcgtgctatggtccgttatgaaagataaacaaccagtcgtccatcaatacaaccagccgaagcctggcttacatgtgattgtgaatacggttccagtatttgaaggagaagcgtgcgtcggcggcatctcgatcgaacgggacattacagatgtggttcgcttaaatgaagaattatcgtctaaaaccgcgtctttgcatcatttgaatacgactagcgaagatgaaccttttcagaaaatcatcggccgcagtgaaccggttaggcgggcaatccatcttgccgctaaagtggcaaaaacaacggcgaatgttntaattacaggcgaaagcggngttggcaaagaactgttcgctgaggggcatccaccaggcaagtgacagaagcangaaaaaccgtnnattgccattaattgcggcgccattcctg

SEQ ID NO: 8308 - DNA, 1224 bp, Bacillus clausii
ttcatttttattttgttttttaattacacgcattaccaaacaaattatccatccaattgaccaagcgaccaaagcggctattcgcctagctgagggtgattatcagactaggacgtatgaagatcaccataaagaacttgggctgttaggccgttctattaatgcgcttgcgtataacttggagcaattatcaagacgccaccaggcacagcaagaccgaatggctgcgctcattgaccatatgggaagtgcgctcttgtttatgaatgttcgtggcgatgtggtgctgctgaaccaaacgacggagcaagtttttgaagtcgatagcagtgattggctttcaaaaccatactaccatgtatttccgagccaaccccttatccagtttgtgcaattggtttatatgacagagaagaaacagcgaagtctaatcgaatggacgaagcatttttcaactcgcgtctatgatgtatacggcgcaccggtgatggcagattcaggtaggctcagaggtgtaacgcttgtcatgcatgacattactgaacagaaaaagctagagcaagttcgcaaagactttgttgccaacgtttcccatgagttaaaaacgcccgttacatcgattaaaggttttgcagaaacgctccttgacggggctatagacgatcctgtgctttcgaaacagtttacggaaatcatatggaaagaaagcgacaggctgcaaatgctgatcgtcgatttgttggagctgtcgaaaattgagaatgcccagtttaagcttgatttggaagacatgtcactgaaagacattacggaagatgtgtttgaactagtgcggggcaaagctgaagaaaaagacatgcacttgcatatacaagaacaaggcagctccgtgattgaaggggattggcaacggctgaagcaagtcgttttgaacctagtttccaatgcgatcgcctatacgccatcaggcggccatgtaacggtcacactcaaagaacaaagggacgctgttgttctaaaagtgcaagatacaggaattggcatcgacccaaaagaaacattgcggatttttgaacgtttttaccgagttgaccgggcgagaagccgcaattcgggagggacgggtttgggccttgcaatcgttaagcatttggccgaagcgcaccatgcaaaaatagaagtgcagagcgaagagggcaaaggaaccgagttttccttgacgtt

SEQ ID NO: 8309 - DNA, 248 bp, Bacillus clausii
gaattgacttagtgaaaaaaatgaagctctatgacggggaagcggttgaaggatacaacaaccaggatgtaaaagaattgcaggccgagtttcctgacgagggcatgagcgggatcgacccccgttatgtgatcaaccgaatttcgtcagcgattatccgcaagcaattaacatcgatttccgcgttggatgtgctccgttctattaaggaagggcttgacgcccatgcttcgatttctaaggaagac

SEQ ID NO: 8310 - DNA, 696 bp, Bacillus clausii
ttgggccttgcttatttgacgttgacgactttctttctgccaatagtgtccttcctttttacgcaatggagtatattgaaggtgaaaattttgttgacttcctccggggcaaagggccagagtggctgcctgtattggcattgcaattgttgagtgcattaagcgcgctccatcaacaaggctgggtatttggcgatttaaagcccgaaaatgtgatcgttacgcgtcgttcggctgaagtcagactgttggatgtaggcggaacgacacgagtgggccgcgcgatcaaggaatatactgagtattatgaccgaggttactgggaacaaggtacacgaaaggcggagccgacctatgacttatttgcggcggcaatgatggtcgtcgactgtgcgtacccacggcaagtaaaaaaagagcggggcaatacggcaagccaattaaaaaagcttgtttatcaagcgccgctattaaaaccttaccgggaaattgtttataaagcgttaatgggagggtatggatctgcagaagcaatgaaaaacgactttcttgcctcggtaaagcaaaccgaagagcgtagccgagtgaaacggaaacagcaacgtaaagctagaaaacagaaaggtgcgccgatcgacttaatcctagtgatgtcttttgttctcatcctttttgtcctatacttattgatacaat

SEQ ID NO: 8311 - DNA, 111 bp, Bacillus clausii
ttgatgatccggcgaaggcagaaggtaccgaagaagaaagatggatggtctttcaacgagtccgagatgagataggaacacgtataaagaaattcgcagaaacaggagaat

SEQ ID NO: 8312 - DNA, 276 bp, Bacillus clausii
ttttactaaattgacgggttacgaagaagaggaagtattgggcaggaatccaagcctgcttaaatcagggcggcaatcatcggatttttattcaatcatgtggtcggagattatggagaagggcagctggcaaggtgaaatttggaaccgcagaaagaatggagaagagtatctcgagctgttaaccatcaatgctgtaaaagatgaaacgggggacgtcgttcattatgtcggcacgttcagcgatattacaggccgcccgccggggacaaatga

SEQ ID NO: 8313 - DNA, 426 bp, Bacillus clausii
attcttaatgacaacacttgattcggccacgcggctcatgcgttacgccgttacggaactaggcgaaagcatcaacgtacggttgcttcataacaagcatacggccaccattctcggcctaataggagcaacgatactggccctttccggtacatggcaaagcgtatggccgctatttggcgccgccaaccaaatgctcggggcattggcgctccttgccattaccttatggctagtgaaaacaaaatcgaaagcattgtttgtgataatccctatggtgtttatgtttattgtcacaacatcagcgcttctcgttaggatgcattccaattttctggccggtgattacttattcgttgttgcttccttcatcctatttgtcatgtgcgtattcttcggcatcgagggggcccgcagtgtggcaaa

SEQ ID NO: 8314 - DNA, 614 bp, Bacillus clausii
  misc_feature (1)...(614): n = A,T,C or G
agtgagctttctggctatgaagcaggtgcttttactgccagtaaagcaaaggnaagtgcaggaaagtttgaacaagcaaatggcggcaccatctttttagatgaaattggcgatatgccattagatttacaagtccatttgctgcgtattttagaggaacgggtcgtgacgcggattggtggcagcgtgccgatacctgttgatgtacgagtcatatctgctacaaataaagatttaaaggaagcggtgcaaaaaggtacatttcgtgaagatttatattatcgtttatgtgtcctgcaaatggagcttccgccattaagggagcggattgaagacatacctgtgttaattcaatctttcttgcctgttctttgccaggaatttggaaaacagtcgattagcttaactagggaaacgttaagcatcctcgaaaattatcattggccgggaaacataagagaattgaaaaatgtcctacagcaagcgatgtttatgatggacagcgatgtcatccatccccatcatttaccggacagcatctattcacaaacacaaggtccngaacatgagaaacaaaagctgttgcgngcgcttgaacagcaggaaggcaatgt

SEQ ID NO: 8315 - DNA, 492 bp, Bacillus clausii
ggccaatatttcacatgatttaaaaacaccattgacggtgatgattgcttacattgaaaagctggaactagaccgagaaatgcctgaacaagaacgaatgcgaatcattggccgccttcatgagaaaacagaacaggtgatttcgcaaatgaataagttctttgctttagcaaagctggaagcaggcgatgagctgttgccattaagccgaattgatttgaatgaagtttgccgccaaagcgtgcttgaccattatgagtggttggcttcaacaggaatggacgtacaaatcgacatacccgagaagccgatttacattcaaggcaatgaagaagggctcgaacgggtgttgagcaatttgatcgccaatgcgattctttatgggcatgaaggcaatgtctttggcctgtcggtaacggaagaagagggacaagcagtcgttgacgtttgggataaagggaaaggcattcccgaaacagaacaagagcggat

SEQ ID NO: 8316 - DNA, 849 bp, Bacillus clausii
tttatttctaattggtggcgcttttttaggcttgttgatcgctaggcctactattcaaatgcctgcctttaccggattttataatgacacgctcggctttttgtttccaattttgtttattacgattgcctgtggggccatttctggcttccattcacttgtttcctcaggaacgacgtccaaacagctgaataacgaaaaaaatggccgctttgttgcttatggttcgatgctgatcgaggcatttgtcgccatcatcgcgattggttccgttgcttatttaacacttgaccaatttaatgcgcttatggccgaactgaatgatccgattagtgtgttttccgtcggcatcggccactttatgaacacgtggggattgcctgtggcagctggtgttacgtttactgcactcgccgcatcggcattcttaatgacaacacttgattcggccacgcggctcatgcgttacgccgttacggaactaggcgaaagcatcaacgtacggttgcttcataacaagcatacggccaccattctcggcctaataggagcaacgatactggccctttccggtacatggcaaagcgtatggccgctatttggcgccgccaaccaaatgctcggggcattggcgctccttgccattaccttatggctagtgaaaacaaaatcgaaagcattgtttgtgataatccctatggtgtttatgtttattgtcacaacatcagcgcttctcgttaggatgcattccaattttctggccggtgattacttattcgttgttgcttccttcatcctatttgtcatgtgcgtattcttcggcatcgagggggcccgcagtgtggcaaa
